United States Patent 9,328,346 (POLYCOMB-ASSOCIATED NON-CODING RNAS) - sequence listing, part 117

SEQ ID NO: 167256 - RNA, 41 nt, Homo sapiens
uauaaaauuugauuucuuuccuugauaaauuauuuuuccuu

SEQ ID NO: 167257 - RNA, 41 nt, Homo sapiens
aaaaauacucauaaaaugugauuuugaaaauuaauauguag

SEQ ID NO: 167258 - RNA, 79 nt, Homo sapiens
cauggccuugggagggacauggagauaggaggagaaggugggcaaguaucaaaagacguuggccccugugguaggaggu

SEQ ID NO: 167259 - RNA, 48 nt, Homo sapiens
cagcaauaaacaaaaaaauuguguauggcuauaauuuuucucuugaaa

SEQ ID NO: 167260 - RNA, 46 nt, Homo sapiens
gagacugguuagugauccugcauuagaaaaggaaaucguagugaac

SEQ ID NO: 167261 - RNA, 96 nt, Homo sapiens
acaacauagaaagaaauguuaugaaugccacagacuauguagaacacgcuaaagaagaaacaaaaaaagcuaucaaauaucagagcaaggcaagaa

SEQ ID NO: 167262 - RNA, 76 nt, Homo sapiens
uagggagugaaagcagguguggaaaggcccuucugagugaaccgaagaguuaaugcaauucuuaauaaauagaaaa

SEQ ID NO: 167263 - RNA, 89 nt, Homo sapiens
agauuagaaacaguauugauaaaauaacucaauauguugaagaaguaaagaaaaaccacagcaucauucuuucugcaccaaacccggaa

SEQ ID NO: 167264 - RNA, 374 nt, Homo sapiens
gauugugccacaacauguaaugguuaauaauuacuucuuccuuuuuuuguuuuuaagagcagggucuugcucuguugcccaggcuguaguguaguggugcagucacagcucacuacagccucaacuuccugggcccaagugaucuuccugccucagccuccugaguggcugggacugcaggcaugcaccauugugcccggcuaauuuucuuuuuuuuuaaaguuuuuguagagaugggggucucucuauguugcccaggcuagucuugaacucuuggccacaagugauccuucugccuuggcucccaaagugcugggauuacaggcaugagccacugugccuggccuauaauuacuauuuuaaaaugaggaagg

SEQ ID NO: 167265 - RNA, 48 nt, Homo sapiens
cgggggcugcgccgcgcccgcacccgcgccgcgcgccgaggaccucag

SEQ ID NO: 167266 - RNA, 53 nt, Homo sapiens
gaaacagauacgcauugugucagacaacaagcauggcugaacggugaauccag

SEQ ID NO: 167267 - RNA, 46 nt, Homo sapiens
guggcuaagcagguucgguuaccugcccccggcugaccccacaaca

SEQ ID NO: 167268 - RNA, 39 nt, Homo sapiens
gagccuggggcuggucccccaaagaugacgugggaggag

SEQ ID NO: 167269 - RNA, 49 nt, Homo sapiens
cccacgcugcucccugccagaccucccuguccugacccaggcucgcagg

SEQ ID NO: 167270 - RNA, 57 nt, Homo sapiens
gccccugaacuuccacgagguggcgggcagcgccgccgacauccagaucgacuucuc

SEQ ID NO: 167271 - RNA, 42 nt, Homo sapiens
ccguggcccacgccuucuuccccggccaccaccacaccgccg

SEQ ID NO: 167272 - RNA, 41 nt, Homo sapiens
uccccacgccccugucacagaugggagaguugaggcccagc

SEQ ID NO: 167273 - RNA, 42 nt, Homo sapiens
guuuccuuuauuucauucaaaggaauuuugaauuuaucuuag

SEQ ID NO: 167274 - RNA, 43 nt, Homo sapiens
guguggaccugaacacagguaagagaaugcaacuguuguagag

SEQ ID NO: 167275 - RNA, 96 nt, Homo sapiens
cuggaaugucuucucugaaagguugaauugaagcuuccucuguaucugaaucuugaagacugcaaagugauccugaggauuacagcuguggaauuu

SEQ ID NO: 167276 - RNA, 58 nt, Homo sapiens
uuguccaagcuucaaauaauuuugaaagaaauuuucccauaugaaaaaaggagagaac

SEQ ID NO: 167277 - RNA, 49 nt, Homo sapiens
agcaggucuuuuauccagugaacaggauguuuugcuuuagcagcaguga

SEQ ID NO: 167278 - RNA, 70 nt, Homo sapiens
uuuuauguggacguauguuaaauuauccaacuacccuauuguuaagcauuugguuuuaaaauuuuuaugc

SEQ ID NO: 167279 - RNA, 49 nt, Homo sapiens
gacuuugaacgccuuugaaauggcuuugcuaaaaugcucccgccacaaa

SEQ ID NO: 167280 - RNA, 39 nt, Homo sapiens
uggugugaggacagguccugagccugugccaguccuggg

SEQ ID NO: 167281 - RNA, 48 nt, Homo sapiens
ccucuaacagaaacaccuggcccccagccaucgucaacacacauuggg

SEQ ID NO: 167282 - RNA, 48 nt, Homo sapiens
ccaaacaacgggaaaggcauaacguuauggccaggugguaggaaggca

SEQ ID NO: 167283 - RNA, 46 nt, Homo sapiens
agcaguaccaucugggucuggaucaaaaacgcagaaaauacguggu

SEQ ID NO: 167284 - RNA, 46 nt, Homo sapiens
ucuguuugaacagcuacuacucuugguaucacgacuacgggcaccu

SEQ ID NO: 167285 - RNA, 72 nt, Homo sapiens
ucacaccaaauccuuggaccccucccggccugugaccuuugugagcaacucuaacuaugcagcagacaaggg

SEQ ID NO: 167286 - RNA, 46 nt, Homo sapiens
guggucuguggccaacgagccugcgucccaccuagaaucugcuggc

SEQ ID NO: 167287 - RNA, 41 nt, Homo sapiens
aggcaguucuucaacaacguuucucugcaucaccacaugca

SEQ ID NO: 167288 - RNA, 47 nt, Homo sapiens
gaaaccuuucuauuuccacggugucaacaagcaugaggaugcggacg

SEQ ID NO: 167289 - RNA, 46 nt, Homo sapiens
auggugcccugggcggcacugcgcgcuccagcgucgacuggcagau

SEQ ID NO: 167290 - RNA, 45 nt, Homo sapiens
ccgccaggcccacgaggccuccgggaaagcuguguucauggccga

SEQ ID NO: 167291 - RNA, 77 nt, Homo sapiens
gcacgggaagcagccugaugccccagaagaaaaaccccgacaguuuggagcugauccggagcaaggcugggcgugug

SEQ ID NO: 167292 - RNA, 45 nt, Homo sapiens
cugcaccaaggaauucagcuucgugcagcucucagaugccuacag

SEQ ID NO: 167293 - RNA, 46 nt, Homo sapiens
ucaacuuuggggccaucacucucaacagcauggaugccacuaguga

SEQ ID NO: 167294 - RNA, 33 nt, Homo sapiens
ccagagggcaggggccuguggcuccuggugaaa

SEQ ID NO: 167295 - RNA, 45 nt, Homo sapiens
gcaggcaauccccuggguguggaccgagagcugcuccgagcaggu

SEQ ID NO: 167296 - RNA, 25 nt, Homo sapiens
agagguacuauuauuauccuuaucu

SEQ ID NO: 167297 - RNA, 47 nt, Homo sapiens
auugacagagggaaauaauuggcgauguaucgugcuaggugcuauua

SEQ ID NO: 167298 - RNA, 47 nt, Homo sapiens
gucgaagaaugugucauuaacucuguccuaggggcaggugagggaca

SEQ ID NO: 167299 - RNA, 374 nt, Homo sapiens
uuuaaaagcuaucagggggccaggcacaguggcucaugccuguaaucccagcacuuugggaggccgaggcagguggaucaugaggucaggagaucgagaccauccuggcuaacgcagugaaaccccaucucuacuaaaaaaauauauauauauauacaaaaaauuagccgggugugguggagggcgccuguagucccagcuacuccgggaggcugaggcaggagaauggcgugaacccgggaggcggagcuugcagugagccaacaucacgccacugcacuccagccugggagaugagugaaacuccaucucaaaaaaaaaagagcuaugaggguuagaauggguaggacuuggcagaugaugaggguggggca

SEQ ID NO: 167300 - RNA, 45 nt, Homo sapiens
agcccuggugauuucuuuccaguuuccugagguuguuccccuuaa

SEQ ID NO: 167301 - RNA, 51 nt, Homo sapiens
augucauugagaggauuacaugggauaacccaugaauaguggcuggcaugg

SEQ ID NO: 167302 - RNA, 84 nt, Homo sapiens
aagaucccugaaggggcugcugacugccccagaaucugccgaggugagaacagcauccugaggcacagcucccaggggacagag

SEQ ID NO: 167303 - RNA, 64 nt, Homo sapiens
cuuaucaggugauauaaucuuccuguucugggcugcuugcuggaggaauaggaagugacauuua

SEQ ID NO: 167304 - RNA, 44 nt, Homo sapiens
uucagguggagcugaucagaauaauguucagcaucaacccccug

SEQ ID NO: 167305 - RNA, 32 nt, Homo sapiens
cccgggcuggcugguccuugugcaguggggca

SEQ ID NO: 167306 - RNA, 56 nt, Homo sapiens
uaggaaauaccuagauggguauuguucgauuuaaauaugcuaccaguuucaguuag

SEQ ID NO: 167307 - RNA, 60 nt, Homo sapiens
augaaacccucaagcaucucacaaacgacaccacaacuccggaaaguacaaugaccagcg

SEQ ID NO: 167308 - RNA, 44 nt, Homo sapiens
ucccgcaacgucacccaucuguacucaaccaucuuagggcauca

SEQ ID NO: 167309 - RNA, 47 nt, Homo sapiens
gugagcaggugguauucacagccugcaugacccucacggccagcccu

SEQ ID NO: 167310 - RNA, 33 nt, Homo sapiens
gcacuguguuccugacacguacagcaacgccac

SEQ ID NO: 167311 - RNA, 42 nt, Homo sapiens
uaacaauguuuugcuaugcuguuaucaagggcagaccuagca

SEQ ID NO: 167312 - RNA, 49 nt, Homo sapiens
uuccuuuaugaagaaaaaauaaaauagucacauuuuaauacuacucuag

SEQ ID NO: 167313 - RNA, 50 nt, Homo sapiens
aggaaauggcaacuaguagaucaguaaaauuacgaaaacgaugccugcaa

SEQ ID NO: 167314 - RNA, 63 nt, Homo sapiens
cuuacuguuuuuuuaaaauaacuuuuugccuuaauagcucauugucacuaauaacuucugugu

SEQ ID NO: 167315 - RNA, 28 nt, Homo sapiens
cuaauaaaaaaggaaacuaaaggcaaag

SEQ ID NO: 167316 - RNA, 57 nt, Homo sapiens
agagagccaugaaggacauccacuauucggugaaaaccaacaagaguacaaaacagc

SEQ ID NO: 167317 - RNA, 46 nt, Homo sapiens
gagaaguucaaguaucagauaaagaaagacacacacaacuggagca

SEQ ID NO: 167318 - RNA, 48 nt, Homo sapiens
cccacucaguguuuguaaauguuucuaaaggucagguugccaaaaagg

SEQ ID NO: 167319 - RNA, 46 nt, Homo sapiens
uggcaaccugaccuuuagaaacauuuacaaacacugagugggucug

SEQ ID NO: 167320 - RNA, 29 nt, Homo sapiens
caaaugguaaggcaaauacgguucugagu

SEQ ID NO: 167321 - RNA, 55 nt, Homo sapiens
gccggcgaaccagggcugacccgcgccguccagccugaaggccaccagcgccucg

SEQ ID NO: 167322 - RNA, 49 nt, Homo sapiens
uggcaggcuuacuuacugcgcaggcgucagguggagcagaagccgggag

SEQ ID NO: 167323 - RNA, 60 nt, Homo sapiens
aggcuuuuucaguaacuuuccauagaguucuaggggccuguagagaugguuucagggcca

SEQ ID NO: 167324 - RNA, 44 nt, Homo sapiens
accaugaguucugucuagcaguguggguguugagaccacaugaa

SEQ ID NO: 167325 - RNA, 4020 nt, Homo sapiens
gaacucggcaaauacaaacaccgugguaaggacgugguucgguggccggcgggggcuucguucaggcugcagcaacggccggaccgggcgggggcggggacggcggcgacucccggccucgacucuucagccgcccgcgcggccgccgccgccgccgcuucccgccucgggcggaucgggccggagcgccgggcggcgggcgcgggggggcgccgagggcucgcggcgcggggagggcgggggcgccgguggggccuggggccgccgcgggccgggccgggccgcggaggcgguugggcccggucgggcgcgcagccccggccccagaacccggccgccgggagggagggcgggaggggagccgccgcuuccccccgaggggcccguccgcgcuggcuugacgagggcuccccgaguggcuacagaacaaaaacuguguguggggaaucgggcgaacccccgagacccaucgugauccacuuuaaugcaguggaagauuaaugguuacuuuggggguuucuuagguuguuuuuggcggcugugcuuugggaaccuucucugaggccauuuuauguuuaaaaaaaggacgaagguugguugaaaagcacuuaucucaguuccuuccgaauggguaaaauggcgaaggggaagacccccaucguaucuucgccuagcagaagcaccaaaacaaacaaaaaaagccugcagugguccaaguguccccgcuuucgccuugaaauuuaccuacuucuucccguuggucccuuuuuguuacuugcgaucacguagguuugcaaaaagcagucacauaaauaaccuuuucagucaccaacgcagugugaucacuaguccacccaacucuuauuuuuaugaugacaauaaaacacguuuuuugcccggucccaaaugccgcagaccagcccgcggccgcccgacaccguaccguuggcgacucgggucuaaccaucauggcugcggccgcuuacccugcuuuucagucccugagccuugugguccuccucccuuuggcugcccuguuuauauagagccauugccgcucucuaauauagacucugccaggaugggaaggugcuuuucaggccuacgucaccgccucuccauuuaaacaccagauccggcuuuaaauagugagagcugcugagagcggggcugggaggugcgugcucccgaggcaagagccaggcgugugcagagcucaguuuauuucuagguccuuuuuucacccugugauuucgcacccgucgcgggcugcuuucagagccccaaguuuugguuuuguucccagcagcagcuaggauuugccuucuuuguuugcuagggggaauauauccgaaucgcugucccuuuuuguuuacaauuuucaaaauuaauuauuuaaaacaaagaguuuuagaucagauggucuagccauuuuucuuaugugcauuauuuucgggaauuuaaaaaacugcuuucuacauggaaaauguuagcugcagaggacuugguuuugguaguguuuuguucaaguauucaggaaauaauguuagaaauauagcuccuaauauuucauuauguuuuccuauaguaaauauaaaagacacgaggcuuuucagagaaauagauaaguaccuaaagcuucaguauaggaccauuuauguguaggagaaucgugaguagagggaagagacagacugcaaacuagauuaaaaaaaaaucuaaguagaacuuuauugccuuggauauuaacauggguauccgguauaaaaauuauuccaauuuauuuuccagcauugcaucagggaauuaacauuuuugaaggaaaccuaacaaaugacuuaauaaugccacuaguggcccucugauuuaccaguucuuaaguuugaaauaaccuguuuuuuaaaaauuaggacaaacuuaaauuguauuucgugaaagaaacuuugccucaaguauuaguguagaauuuuaagcaauaauuuagaaauugcuuauuucaaauacuccuaugugcccacauacuuuucaaaaauuaguaucuugaaggcuuuucaaauugugaacaauucugcuaaauuacucguuaggcauauauuuugugaagaauacacauuucccuuccuucaccuauagggcuuaugaagcuguuaaguggucaaguugugaguucauuaaggcacaaaaauaaaaucuuaaugauuuauuaaguugagaguacuagaagaaagcagauuuauaccuacacaugucuggaucuccaagcaaaagguuuuuagagguaacugacuucagaaacgccaaaacaccaucuaguuuacugaaaagcauacauauugucaauuugagauuuauacucccaauuuaaaauacauugcccuccuaacgccucgaggaguaauuauugguuaaaaaaaaaaaagcacuuuauagagauacuuuuguaauucaguuaagucacuuuaggcaagaugauguccauagucagauauacuuuccuuauauauagaauuagaauguuaaaguagggacuauagaaaugugcauuuuacagaugaauaaacuucaagaggcggauuuggcaaaauaaagcagguuagugagugaacaguaaagcaagaacccagauauuugaauugguuuucuuguaaugagaaggauuaaauaguauuuaaugguugagguaaauuguauugacaaacucauuuguauuuguuuguuuucugagacagggucugggccugucacccaggcuggagggcaguggugcaaucuuggcucacugcacccucucccuccugggcucaagccauccucccaccucagccucccaagcagcugggacuacaggcacgugccaccacuccuggcuaauuuuuuguggagauuggguuucacuauguuacccaggcuggucuugaacucuugagcucaagcgauccucccaaaauugguuuuauuugauagcgauuaaccuuaagcaagguaugaaacagaaguaaugagaaaacaucuaaaaagcuuguuaaccauaacccucugauaauggggaggauuuauaaccaggcaacucuaguuuugucaaggcagcucuaguuuugucaucugacaugacuuccuuuugucuaacagguuaaaaauaggaugugggggaaaaaauaggauguggauugggcuaauuguucuaucucccacuuuguaguuuuuaaaaaauauuuuauacuuuuugaaaguucuuucacaucuauucucauuuuacucauuuuaccauucaaccuucuagaagccagcuucuuuacuucccgcuccuccaaguaguaucaacggugcuaauuguaauaauaauaguaaacauuuagaggguucauguucauuauaauguuucauagcauuaccugggcaguaguagaggagaaauccugggaaggaaaucaguauaccuuguuccuugggaccuuaagaccugccauugugaguguaugaguaguuuaaugguacagcuugaaaguacagacugggucacacaacagaaguuaggugauuuuuaaaccugaauguucauuagguugcagauuauuaccaggcagaugacucccggacauaagauucuccaaagucuaagauacaguggugagguaguaagacauacaacagaguucaaaccaagcauggaauaguagaagccagacauaagcaacccguaaagcuauuauugaacauuacauuagguauuuugacuacaacauaggaaauuauaauuggaaauuguauggaccuuguagucuuaggggccuucuguuuaugaacugcauuaaucuuaaaauuuuuauuaaagugugcagucaucaaauccaguuuauggcaaaugaugguggucguaucuuuaaagucauauauagauaguuggcaaaaugacuauucguuuugaauuugugaaaaccuguuauacauuauaagcugugaaaaacugucuuuuucaagucuuuuauuuuuccuuuaaagccuaaauuauacagaucugug

SEQ ID NO: 167326 - RNA, 4015 nt, Homo sapiens
augacaucuucaaucacagaucuguauaauuuaggcuuuaaaggaaaaauaaaagacuugaaaaagacaguuuuucacagcuuauaauguauaacagguuuucacaaauucaaaacgaauagucauuuugccaacuaucuauauaugacuuuaaagauacgaccaccaucauuugccauaaacuggauuugaugacugcacacuuuaauaaaaauuuuaagauuaaugcaguucauaaacagaaggccccuaagacuacaagguccauacaauuuccaauuauaauuuccuauguuguagucaaaauaccuaauguaauguucaauaauagcuuuacggguugcuuaugucuggcuucuacuauuccaugcuugguuugaacucuguuguaugucuuacuaccucaccacuguaucuuagacuuuggagaaucuuauguccgggagucaucugccugguaauaaucugcaaccuaaugaacauucagguuuaaaaaucaccuaacuucuguugugugacccagucuguacuuucaagcuguaccauuaaacuacucauacacucacaauggcaggucuuaaggucccaaggaacaagguauacugauuuccuucccaggauuucuccucuacuacugcccagguaaugcuaugaaacauuauaaugaacaugaacccucuaaauguuuacuauuauuauuacaauuagcaccguugauacuacuuggaggagcgggaaguaaagaagcuggcuucuagaagguugaaugguaaaaugaguaaaaugagaauagaugugaaagaacuuucaaaaaguauaaaauauuuuuuaaaaacuacaaagugggagauagaacaauuagcccaauccacauccuauuuuuucccccacauccuauuuuuaaccuguuagacaaaaggaagucaugucagaugacaaaacuagagcugccuugacaaaacuagaguugccugguuauaaauccuccccauuaucagaggguuaugguuaacaagcuuuuuagauguuuucucauuacuucuguuucauaccuugcuuaagguuaaucgcuaucaaauaaaaccaauuuugggaggaucgcuugagcucaagaguucaagaccagccuggguaacauagugaaacccaaucuccacaaaaaauuagccaggagugguggcacgugccuguagucccagcugcuugggaggcugaggugggaggauggcuugagcccaggagggagagggugcagugagccaagauugcaccacugcccuccagccugggugacaggcccagacccugucucagaaaacaaacaaauacaaaugaguuugucaauacaauuuaccucaaccauuaaauacuauuuaauccuucucauuacaagaaaaccaauucaaauaucuggguucuugcuuuacuguucacucacuaaccugcuuuauuuugccaaauccgccucuugaaguuuauucaucuguaaaaugcacauuucuauagucccuacuuuaacauucuaauucuauauauaaggaaaguauaucugacuauggacaucaucuugccuaaagugacuuaacugaauuacaaaaguaucucuauaaagugcuuuuuuuuuuuuaaccaauaauuacuccucgaggcguuaggagggcaauguauuuuaaauugggaguauaaaucucaaauugacaauauguaugcuuuucaguaaacuagaugguguuuuggcguuucugaagucaguuaccucuaaaaaccuuuugcuuggagauccagacauguguagguauaaaucugcuuucuucuaguacucucaacuuaauaaaucauuaagauuuuauuuuugugccuuaaugaacucacaacuugaccacuuaacagcuucauaagcccuauaggugaaggaagggaaauguguauucuucacaaaauauaugccuaacgaguaauuuagcagaauuguucacaauuugaaaagccuucaagauacuaauuuuugaaaaguaugugggcacauaggaguauuugaaauaagcaauuucuaaauuauugcuuaaaauucuacacuaauacuugaggcaaaguuucuuucacgaaauacaauuuaaguuuguccuaauuuuuaaaaaacagguuauuucaaacuuaagaacugguaaaucagagggccacuaguggcauuauuaagucauuuguuagguuuccuucaaaaauguuaauucccugaugcaaugcuggaaaauaaauuggaauaauuuuuauaccggauacccauguuaauauccaaggcaauaaaguucuacuuagauuuuuuuuuaaucuaguuugcagucugucucuucccucuacucacgauucuccuacacauaaaugguccuauacugaagcuuuagguacuuaucuauuucucugaaaagccucgugucuuuuauauuuacuauaggaaaacauaaugaaauauuaggagcuauauuucuaacauuauuuccugaauacuugaacaaaacacuaccaaaaccaaguccucugcagcuaacauuuuccauguagaaagcaguuuuuuaaauucccgaaaauaaugcacauaagaaaaauggcuagaccaucugaucuaaaacucuuuguuuuaaauaauuaauuuugaaaauuguaaacaaaaagggacagcgauucggauauauucccccuagcaaacaaagaaggcaaauccuagcugcugcugggaacaaaaccaaaacuuggggcucugaaagcagcccgcgacgggugcgaaaucacagggugaaaaaaggaccuagaaauaaacugagcucugcacacgccuggcucuugccucgggagcacgcaccucccagccccgcucucagcagcucucacuauuuaaagccggaucugguguuuaaauggagaggcggugacguaggccugaaaagcaccuucccauccuggcagagucuauauuagagagcggcaauggcucuauauaaacagggcagccaaagggaggaggaccacaaggcucagggacugaaaagcaggguaagcggccgcagccaugaugguuagacccgagucgccaacgguacggugucgggcggccgcgggcuggucugcggcauuugggaccgggcaaaaaacguguuuuauugucaucauaaaaauaagaguuggguggacuagugaucacacugcguuggugacugaaaagguuauuuaugugacugcuuuuugcaaaccuacgugaucgcaaguaacaaaaagggaccaacgggaagaaguagguaaauuucaaggcgaaagcggggacacuuggaccacugcaggcuuuuuuuguuuguuuuggugcuucugcuaggcgaagauacgaugggggucuuccccuucgccauuuuacccauucggaaggaacugagauaagugcuuuucaaccaaccuucguccuuuuuuuaaacauaaaauggccucagagaagguucccaaagcacagccgccaaaaacaaccuaagaaacccccaaaguaaccauuaaucuuccacugcauuaaaguggaucacgaugggucucggggguucgcccgauuccccacacacaguuuuuguucuguagccacucggggagcccucgucaagccagcgcggacgggccccucggggggaagcggcggcuccccucccgcccucccucccggcggccggguucuggggccggggcugcgcgcccgaccgggcccaaccgccuccgcggcccggcccggcccgcggcggccccaggccccaccggcgcccccgcccuccccgcgccgcgagcccucggcgcccccccgcgcccgccgcccggcgcuccggcccgauccgcccgaggcgggaagcggcggcggcggcggccgcgcgggcggcugaagagucgaggccgggagucgccgccguccccgcccccgcccgguccggccguugcugcagccugaacgaagcccccgccggccaccgaaccacguccuuaccacggu

SEQ ID NO: 167327 - RNA, 1212 nt, Homo sapiens
ucagguaauuaggaaugauggaaccauuuuaaaauguaauucagaaaauuguacuaucuagcccuuagguuuugucuucuuugaaagacagaaaauacuaauauuucuuuuaccauuugguuuagguuauuaaaauaacuuuauuugagggcuguaacacauauaacuguaaucguuguugaggauacaguaaagaagaugaaaauuguacuugaaccuuugaucugugcaugauaacccuauuauugaaguaugauuauauaaaaaugcuuacuuaguuuuuuacugaacacauuuaacaugccaagugaguauuaaacuucuuugaacuugugauaucaaaguaauuccuagagcauauuaagagcaaauuuauuguaugcuauuauuauacauaguaucucuucauugacaaaagaccaaugucuagcucauguguuuuggcauauuggugcuugaaaaauuuauuuacauggauuuuaaguguucccuauaaucuugauuauauaguuauuauuuauuuucuauucuguguauguuauuuuuguuaauuuguaaauuugugaaauuaggggcuugucuugcuacauauuuuaauaagauguaauuugcuuuuuaaucaauucaagauucuggguugucuaaaggaacauauugggggaauuugauucugugugaauuguaugacaaugaugauaacugguucugugaacuuuuauugcuuuuaccaauuuugaagcaaaguucuuuggugcuuuguuugguucaagauauuaaaugagcuauuaagcuuuuguuccuuuaaagcuuuaaaaaugaacagcucccgaagugucugaucuuacugcucuuucuucacuccuaagguuagcaaagauaauguaagcuuuagucaagucucauaaucuguuguuaaaaccuuguuggaaauagcugaaugaggauguaaauaugaaaaauaaaacauuuuaaggaauguauuugaacauggcgagaagucagagaaggggaggauuaugcauacuguguaugaaugacaaccuuuaauaaaauuguuaguuuucuugauaauuucuugugccuuuggugguaugaaauuaaauaugaauucauuucuuuugagauggucacugcuaaaaugauaacucggaaugcaugcuuuuugcuuuaggccagcuucuucagguggucagagcagccaauggugcccaa

SEQ ID NO: 167328 - RNA, 46 nt, Homo sapiens
aguuccaucaacuuguaagaccaauggagcuuguguuugagcaggc

SEQ ID NO: 167329 - RNA, 46 nt, Homo sapiens
aaaacaaauggaaauuucaucucaaggauggcauuaugaaucuuaa

SEQ ID NO: 167330 - RNA, 95 nt, Homo sapiens
cgacacgagccgauccaucauccgcaauguaaaaggccccgugcgcgagggcgacgugcucacccuuuuggagucagagcgagaagcccggaggu

SEQ ID NO: 167331 - RNA, 42 nt, Homo sapiens
aauauaggccaguaaagcugaaugaaauugucgggaaugaag

SEQ ID NO: 167332 - RNA, 46 nt, Homo sapiens
caaaaagucacucuucccaaaggccgacauaagaucaucauucugg

SEQ ID NO: 167333 - RNA, 45 nt, Homo sapiens
cagcaugaccgacggagcccagcaagccuugaggagaaccaugga

SEQ ID NO: 167334 - RNA, 45 nt, Homo sapiens
gagcgcauuaccaaauauggcacccacaaagucauggcuaccagc

SEQ ID NO: 167335 - RNA, 46 nt, Homo sapiens
ucaggauuuggcuucauuaacagugagaacguguucaagguacaag

SEQ ID NO: 167336 - RNA, 32 nt, Homo sapiens
aaggccugccuccagacgcugcagccugggug

SEQ ID NO: 167337 - RNA, 45 nt, Homo sapiens
ggaugcgcaggauuuaggauaagcugucacccaguccccauaaca

SEQ ID NO: 167338 - RNA, 45 nt, Homo sapiens
aucaucguggcugcucugggcgugcugcuguccgugguggggggc

SEQ ID NO: 167339 - RNA, 76 nt, Homo sapiens
gguuucuguuuuguaauuuaagaagagcuauucaucacuguaauuauuauuauuuucuacaauaaaugggaccugu

SEQ ID NO: 167340 - RNA, 45 nt, Homo sapiens
gccuccccguccagaagccuguaggaaagcggaagcggccuggca

SEQ ID NO: 167341 - RNA, 46 nt, Homo sapiens
ccagagcugguggaacgucucauugcuguagauaucagcccagugg

SEQ ID NO: 167342 - RNA, 42 nt, Homo sapiens
uaggugcugggucagggcauccaaguucacccuccacacgaa

SEQ ID NO: 167343 - RNA, 42 nt, Homo sapiens
ccaggcuagcuuacugcacgaacugggaguuuccaccaagga

SEQ ID NO: 167344 - RNA, 41 nt, Homo sapiens
caaaaacgggugaaagugggaugaggaggagugaaagagac

SEQ ID NO: 167345 - RNA, 45 nt, Homo sapiens
cggugccgaacgcuggccacuggauccacgcugaccgcccacagg

SEQ ID NO: 167346 - RNA, 99 nt, Homo sapiens
cugcuccacauuugggcacagaaggacucagacaggcacugugugggcacgagguuuuacagggguggucagaccucaggcuuuaaugaauaaagacac

SEQ ID NO: 167347 - RNA, 46 nt, Homo sapiens
cugccaagagucccagucaccaggccacccuaagucccagcccuug

SEQ ID NO: 167348 - RNA, 45 nt, Homo sapiens
uucgugagguggccgagaacugcgcggacaagcugcagcgacugg

SEQ ID NO: 167349 - RNA, 42 nt, Homo sapiens
ggcaggcgaggaggggcuugugcaucccacaagggacagaug

SEQ ID NO: 167350 - RNA, 43 nt, Homo sapiens
cacguucuguaagggccagaaagaggaggcgccuuccacuggg

SEQ ID NO: 167351 - RNA, 61 nt, Homo sapiens
cgggcagcuccgggaccugcuucaggaugagcccaagcuggaccggaucgugcggcucagc

SEQ ID NO: 167352 - RNA, 42 nt, Homo sapiens
ccaacauggagcucucgcagaugucggagcucauggggcugu

SEQ ID NO: 167353 - RNA, 33 nt, Homo sapiens
uacaucuguauuaugaacaccuaaauauguaag

SEQ ID NO: 167354 - RNA, 51 nt, Homo sapiens
aaagcaaauggauuuccaccugacaaaucuucgggauccaagaagcagaaa

SEQ ID NO: 167355 - RNA, 51 nt, Homo sapiens
gcaucuggagcaccaaggacuuccugcagcgagagcaccgcagcaugagag

SEQ ID NO: 167356 - RNA, 51 nt, Homo sapiens
cauaguuugcgcgcugccuggggcucccuggagaucugggcugcuauacag

SEQ ID NO: 167357 - RNA, 48 nt, Homo sapiens
caagaugaccaagcgggaggaugggggcuacaccuucacagccacccc

SEQ ID NO: 167358 - RNA, 85 nt, Homo sapiens
gccugaagggucaagugcugucuaccaucaacaccaaccagaugaacaacacacacgcugcuguaucucccuguggcaggugggc

SEQ ID NO: 167359 - RNA, 90 nt, Homo sapiens
aaggagggguauuggcgucugggaccacgagaggcuggggcuggggagcaggcacagaacagagagccagcuucaucgcgugggaagagc

SEQ ID NO: 167360 - RNA, 76 nt, Homo sapiens
uggguuguauggcagauuuguagccucguguggcuucaccccagaugugaagguuugggaagucugcuuuggaaag

SEQ ID NO: 167361 - RNA, 43 nt, Homo sapiens
guggcaguaguauucaucucuacaauacccggcggggcgagaa

SEQ ID NO: 167362 - RNA, 40 nt, Homo sapiens
ggcccugcuucuucccauugaaacuacucuugucuacuua

SEQ ID NO: 167363 - RNA, 53 nt, Homo sapiens
gcccaguggguggaaucuguccccaccuggcacugaggagaaugguagagagg

SEQ ID NO: 167364 - RNA, 41 nt, Homo sapiens
cucuguugccucauuacuuuucuauauagcagaaugaucuu

SEQ ID NO: 167365 - RNA, 43 nt, Homo sapiens
acgaauuaagaugggaugaaaaugcuuuaacuuugaguguuuu

SEQ ID NO: 167366 - RNA, 41 nt, Homo sapiens
uccucuugccuacccuguccugcagaaugagguguccggcc

SEQ ID NO: 167367 - RNA, 42 nt, Homo sapiens
uguugccugcaaaaauaaaaugcagaacguacucuacgauag

SEQ ID NO: 167368 - RNA, 82 nt, Homo sapiens
aguggugguggggcugcuccuucccaccccucagaacagcucugauccucguuaauaccuggcugcgugugcagcugaggag

SEQ ID NO: 167369 - RNA, 48 nt, Homo sapiens
aaaugcuauuaacuaggaauuagcuguauaguuaaguuaugccugugc

SEQ ID NO: 167370 - RNA, 56 nt, Homo sapiens
uuuaaaaaggagggaauccugcaaggaaccggugagggacacagcagcaagaaaug

SEQ ID NO: 167371 - RNA, 42 nt, Homo sapiens
gggucuuggaucccgcaccaauggaaaaugaaggggccgccg

SEQ ID NO: 167372 - RNA, 44 nt, Homo sapiens
cuccaaagccagagcugguggcugcaccgaaggagaagacagca

SEQ ID NO: 167373 - RNA, 46 nt, Homo sapiens
augaugggagcggggacuuggcgcuugagccaaagggaauguugaa

SEQ ID NO: 167374 - RNA, 44 nt, Homo sapiens
aaggcaggagguuugccaaacuggaauauggagcccauggccgg

SEQ ID NO: 167375 - RNA, 57 nt, Homo sapiens
uggauggacuggcagaggugaugggagccacagcagagguggcgcuggccaggccag

SEQ ID NO: 167376 - RNA, 44 nt, Homo sapiens
gggcuugaacaugggagaugcugaagaugcagcaggggcggcag

SEQ ID NO: 167377 - RNA, 43 nt, Homo sapiens
gauucuagccguaagauauuuuaauucccaugccauaucagaa

SEQ ID NO: 167378 - RNA, 44 nt, Homo sapiens
aucgcagaacgugaaaaucuucugucaggaggggcgauccucac

SEQ ID NO: 167379 - RNA, 49 nt, Homo sapiens
cacagccuucuugugauaaccauuccagcacacugugggaaguaccccc

SEQ ID NO: 167380 - RNA, 45 nt, Homo sapiens
agcgucuucgagguguuauuacaaaccgaucugguaaagucccac

SEQ ID NO: 167381 - RNA, 64 nt, Homo sapiens
cguggggaaggccucccggagggucggagaagaggaguggggagagagggguaaaaguggugaa

SEQ ID NO: 167382 - RNA, 70 nt, Homo sapiens
cgcgaugggucggcggggagggcgguguggagcgcggcgccgggcgggcgggugggcggcggccaggccu

SEQ ID NO: 167383 - RNA, 43 nt, Homo sapiens
ggagguuuccguuggcugucgacuuggccggaggcgaagcgaa

SEQ ID NO: 167384 - RNA, 44 nt, Homo sapiens
caaagucggaggacaaggacucgccccgcgaucccggcccgccc

SEQ ID NO: 167385 - RNA, 67 nt, Homo sapiens
gcgggcauggugaugaggaccgagacagggggagacuggcggugaggccugaaggggcgagucccgg

SEQ ID NO: 167386 - RNA, 60 nt, Homo sapiens
uugcuagcgaauggauuuggggccuuaaccagucugguggcgacagggaagggaacaaau

SEQ ID NO: 167387 - RNA, 45 nt, Homo sapiens
auggcaaaggccacuggggugaaaccucuggcauccuccacuucc

SEQ ID NO: 167388 - RNA, 46 nt, Homo sapiens
uggggaaugagccacgaggcacccagcaggagccacggaaccagga

SEQ ID NO: 167389 - RNA, 56 nt, Homo sapiens
gcucaacaagcaugaggagaacccgaagaccaagaagcagcagcggaaggagcggc

SEQ ID NO: 167390 - RNA, 46 nt, Homo sapiens
uguguucucacuguuauuaacuagacucagaaagaaaaccucagga

SEQ ID NO: 167391 - RNA, 60 nt, Homo sapiens
caauggccaagaucaaggcucgagaucuucgcgggaagaaggaggagcugcugaaacagc

SEQ ID NO: 167392 - RNA, 49 nt, Homo sapiens
ggugcugaagcugcggcggagagcagcgcuggcaggccgggcgagggcg

SEQ ID NO: 167393 - RNA, 45 nt, Homo sapiens
gcuguucuucaggagaagugaaaguggcugcccgaugccuccaga

SEQ ID NO: 167394 - RNA, 42 nt, Homo sapiens
uguggcucagaucugcggccacuccgggugugugcgcgauau

SEQ ID NO: 167395 - RNA, 38 nt, Homo sapiens
agugaguggcuuccggcccaugaccccagacccacugc

SEQ ID NO: 167396 - RNA, 46 nt, Homo sapiens
aagugguugacauccagggacacgcgccagcgguccgcagugugcc

SEQ ID NO: 167397 - RNA, 45 nt, Homo sapiens
ggcgugcccgccggucugggcucucagaaacuuccggaaaguucu

SEQ ID NO: 167398 - RNA, 29 nt, Homo sapiens
gaaaaacagaagauaaauguaucaaaaga

SEQ ID NO: 167399 - RNA, 45 nt, Homo sapiens
ggcguggcgcagcugaaggacuucaucaccaagcucguggacauc

SEQ ID NO: 167400 - RNA, 46 nt, Homo sapiens
uuccccuucccaggagugaugcugaucgaggacuuugugacccggg

SEQ ID NO: 167401 - RNA, 45 nt, Homo sapiens
gcuguggggggagcggcuggucagccucaaccuccugucccccac

SEQ ID NO: 167402 - RNA, 73 nt, Homo sapiens
gacuggaagagcguuguuuuccaagguacaggaugccgcgccuccuaggagccgaagggacgggaggccgcgu

SEQ ID NO: 167403 - RNA, 78 nt, Homo sapiens
cccaccaugcccggucaacagauccucaaccacuagacaccagaggugucuacaccgcaggcucggcgaggcucgggg

SEQ ID NO: 167404 - RNA, 44 nt, Homo sapiens
ugucgugaagacaucugcgugugcggggugcgugggugccugga

SEQ ID NO: 167405 - RNA, 39 nt, Homo sapiens
gucuuacccagcacuuagaagagcgacuggccuggcaca

SEQ ID NO: 167406 - RNA, 44 nt, Homo sapiens
aagaaaaggaagacaugaagauauucauuccugcauuaucugug

SEQ ID NO: 167407 - RNA, 49 nt, Homo sapiens
cacugcccggccuucagaaagacagaauuucaucacccaaugcaggggg

SEQ ID NO: 167408 - RNA, 62 nt, Homo sapiens
cagcucggcaagagacugccucaguuugaugacgaugcggacacuggugaggcggauggagg

SEQ ID NO: 167409 - RNA, 84 nt, Homo sapiens
gacaguccagcccaccuccucuucugcccggagaagcuccaggggcugccuuugugaucacagcaucuucacaaggaccaaagg

SEQ ID NO: 167410 - RNA, 42 nt, Homo sapiens
gaggaggucaugguggggagcgggcccagacagcacccagga

SEQ ID NO: 167411 - RNA, 46 nt, Homo sapiens
ucggagcgggcguaguacucaucggggcucagggcgccccagaagu

SEQ ID NO: 167412 - RNA, 65 nt, Homo sapiens
gugucacugcccgagaacacaucccucuggggcagcuccauccgcaggguaucaccccggaucac

SEQ ID NO: 167413 - RNA, 103 nt, Homo sapiens
ugucgaagaucugccagaggucggggugcaggugcuccgugucguaucuggaaguggccaggagccggccaaauucaugcugauugcucagauggaggaagau

SEQ ID NO: 167414 - RNA, 44 nt, Homo sapiens
agggaaggcuuugugagagcagccggggacccgccagguagggg

SEQ ID NO: 167415 - RNA, 42 nt, Homo sapiens
gaaacaggcucucggucauggggcccacauacguccgcagca

SEQ ID NO: 167416 - RNA, 62 nt, Homo sapiens
gaaaggaaacauggagugagcagacguggggccuggggagcaggcagauacacggggcaggg

SEQ ID NO: 167417 - RNA, 44 nt, Homo sapiens
caggcccccuaaaaaggcacaauggcagggcagguuuggcagag

SEQ ID NO: 167418 - RNA, 107 nt, Homo sapiens
ugcaaagggccucagugggaaccaggucugcagacccgagugggcagagagacggguggaagcaggugccccagauggucccgcaggcgucaccgucugguuuggag

SEQ ID NO: 167419 - RNA, 42 nt, Homo sapiens
ccaaggucuuggagacagaucugguuuaccaucuuuuaacaa

SEQ ID NO: 167420 - RNA, 34 nt, Homo sapiens
ucuuucccgaugcaucuccaguuuugucccagau

SEQ ID NO: 167421 - RNA, 45 nt, Homo sapiens
augaucuccucgggggccaugcgggcugagacuaugacagcugca

SEQ ID NO: 167422 - RNA, 42 nt, Homo sapiens
uuuccaguggcugaugagcugggcacucagaauguuggugag

SEQ ID NO: 167423 - RNA, 46 nt, Homo sapiens
uuguuggucugagccaucaugggcacagagacagugcugccgucug

SEQ ID NO: 167424 - RNA, 46 nt, Homo sapiens
gaaucuggcucucuccaccucugaaaaguccacuugcuugaccgug

SEQ ID NO: 167425 - RNA, 60 nt, Homo sapiens
ucagaucccgcuggacgaagaucgcgucuguggugcugaucucauccuuguuccauggcc

SEQ ID NO: 167426 - RNA, 46 nt, Homo sapiens
uccuguugucagcuggagcauggccaacaccgaggccaccccauag

SEQ ID NO: 167427 - RNA, 45 nt, Homo sapiens
gucaccccuagggcagggucgacccaaggcugcagguccgaggaa

SEQ ID NO: 167428 - RNA, 46 nt, Homo sapiens
aacugcagacuccugugauuggagcaguauacaaaguacagcaaca

SEQ ID NO: 167429 - RNA, 46 nt, Homo sapiens
ucuaaaucugcagaaauaaaauucuaaggggcgaaaguccaaggca

SEQ ID NO: 167430 - RNA, 67 nt, Homo sapiens
gucugcagagccagcacugugauaccucauaguaggugcucagugaaugucugugaagugaauuacu

SEQ ID NO: 167431 - RNA, 53 nt, Homo sapiens
ucagaccaacuggaaaccaaguggaguuucuacaggaccaacuagaauaggga

SEQ ID NO: 167432 - RNA, 86 nt, Homo sapiens
gugguuuauuaggggaaugagccuuucuuuguguaugacaacuaugaaaacuauugagaagaaauaguuacgugauacagucauaa

SEQ ID NO: 167433 - RNA, 50 nt, Homo sapiens
caguggggcauucgugggaaccagagggauuuuggacaaguccagaugga

SEQ ID NO: 167434 - RNA, 46 nt, Homo sapiens
cugcguucccgggacuccggagauccccggcugcaggggcgggggc

SEQ ID NO: 167435 - RNA, 47 nt, Homo sapiens
ggagguggggcagguuggcaaagaugaggggagagagggagggaggg

SEQ ID NO: 167436 - RNA, 60 nt, Homo sapiens
gacgagagggaggaugagggcagaggcggggccggagaaggacagcaggaaggagagagg

SEQ ID NO: 167437 - RNA, 41 nt, Homo sapiens
gcaccgcgggggagggagcucagccugagacaugcagagga

SEQ ID NO: 167438 - RNA, 88 nt, Homo sapiens
gaucaaaggcuaggugugggguugggagugaggggaggcuugcccagcucagagaacggagaagggggaacaaaaaccaugaacgagg

SEQ ID NO: 167439 - RNA, 45 nt, Homo sapiens
ccccccagaaucuccuccccucugccuucccauaaccaaauccag

SEQ ID NO: 167440 - RNA, 42 nt, Homo sapiens
agcaaugggagagaagcagaauauucggacaaacacggacag

SEQ ID NO: 167441 - RNA, 51 nt, Homo sapiens
gcugugagggaauuugcaaaagagaucgaugucuccuacgucaagauugaa

SEQ ID NO: 167442 - RNA, 42 nt, Homo sapiens
guuuggcgaggugugccgggggcggcucaaggccccagggaa

SEQ ID NO: 167443 - RNA, 42 nt, Homo sapiens
cagcggcgugaguuucugagcgaggccuccaucaugggccag

SEQ ID NO: 167444 - RNA, 46 nt, Homo sapiens
cuacucagcuuuuggcucugugggcgaguggcuucgggccaucaaa

SEQ ID NO: 167445 - RNA, 35 nt, Homo sapiens
cugugccccgcuggauugcacuuugagcccguggg

SEQ ID NO: 167446 - RNA, 41 nt, Homo sapiens
ccuccccaggugccccccucaccuugaugggugcguucccg

SEQ ID NO: 167447 - RNA, 26 nt, Homo sapiens
aucccacauccccggaccccgccugg

SEQ ID NO: 167448 - RNA, 41 nt, Homo sapiens
ggcgguaguuggugguggaacccagaaacggacgccggugc

SEQ ID NO: 167449 - RNA, 56 nt, Homo sapiens
gauuuucuuagauuguaggucuuggucccccagcggucugucgugccauugggaag

SEQ ID NO: 167450 - RNA, 31 nt, Homo sapiens
cccuaacuuuuacaucugcuauuggaauuug

SEQ ID NO: 167451 - RNA, 46 nt, Homo sapiens
uggcucuguucugugccaaggcacagugcucuguguuggagcuaau

SEQ ID NO: 167452 - RNA, 41 nt, Homo sapiens
cucccggggcccccacuguggagauaagaaggggauggaau

SEQ ID NO: 167453 - RNA, 55 nt, Homo sapiens
acgggcuccugggacuccuuccucaagaucuggaacuaauggccccacccccacu

SEQ ID NO: 167454 - RNA, 63 nt, Homo sapiens
cucgcuggccacgacaaccgcgugagcugccucggggucaccgacgauggcauggcuguggcc

SEQ ID NO: 167455 - RNA, 45 nt, Homo sapiens
gcgaccgugcaggugacagcuggggcccaggcugggugggcaggg

SEQ ID NO: 167456 - RNA, 42 nt, Homo sapiens
ucugacgacgccacgugccgccucuucgaccugcgggccgau

SEQ ID NO: 167457 - RNA, 50 nt, Homo sapiens
aggcguagccguuggggaagaacugcaggacacgggacccagauggggug

SEQ ID NO: 167458 - RNA, 45 nt, Homo sapiens
ccucuaucaagcugugggacgugcgggauuccaugugccgacaga

SEQ ID NO: 167459 - RNA, 47 nt, Homo sapiens
agacagcgccgcccgcgcaccgccagcgaccuccgccgcagaguccc

SEQ ID NO: 167460 - RNA, 81 nt, Homo sapiens
aagaggaagugccccucucaaccugugcgggcugcugcgucccaggacugagacgcaggccagccccggccccuagcccuc

SEQ ID NO: 167461 - RNA, 47 nt, Homo sapiens
caguuaucugcugaugggccagguagaagagaacagaggccccgucc

SEQ ID NO: 167462 - RNA, 47 nt, Homo sapiens
ucccugaaguuuuacgugccuugcaagcagugcccccccaugaagaa

SEQ ID NO: 167463 - RNA, 46 nt, Homo sapiens
ccuugccgugacugucagucuuauuggugcuuauaaaacuggagga

SEQ ID NO: 167464 - RNA, 36 nt, Homo sapiens
gcacccaccugcccaaagcagugccgccggacaggc

SEQ ID NO: 167465 - RNA, 53 nt, Homo sapiens
aaacggggaacugagccuaaagucaagcugccccccaagucccaaccuccgga

SEQ ID NO: 167466 - RNA, 51 nt, Homo sapiens
cucagugucaccgcugauggcuucucagccuccuacaagacccugccgcgg

SEQ ID NO: 167467 - RNA, 28 nt, Homo sapiens
ccagggcuccaaaccggcgaggggagca

SEQ ID NO: 167468 - RNA, 87 nt, Homo sapiens
caccuacugccgcuaugacucggucagcguguucaacggagccgugagcgacgacucccggaggcuggggaaguucugcggcgacgc

SEQ ID NO: 167469 - RNA, 41 nt, Homo sapiens
cagcuguuccuggcacaucaucgcgcccccggaccagguac

SEQ ID NO: 167470 - RNA, 53 nt, Homo sapiens
ggggcggcuggagaaggcccagggaacccugaccacgcccaacuggcccgagu

SEQ ID NO: 167471 - RNA, 90 nt, Homo sapiens
ugugggaccuuccggccugcgccccuagucgcccccggcaaccaggugacccugaggaugacgacggaugagggcacaggaggacgaggc

SEQ ID NO: 167472 - RNA, 46 nt, Homo sapiens
uuacguggcaagugagggguuccccaaccucuaccccccuaauaag

SEQ ID NO: 167473 - RNA, 45 nt, Homo sapiens
cugccugcgcccugcugccuuuugcccagggccagacccccaacu

SEQ ID NO: 167474 - RNA, 1964 nt, Homo sapiens
ggaagcaccaacugggauuggugaagggacacacaucaguacccuggagacucagaauuacuuggggaaggggauuucuuaauacaugccuuccaauaggaugggggcauggagcuauucauugucccccaggugcagagaacugauucauugucaucauuauccauuuguggccccuuaauauuuuauuuaucugguuugggcauugagugcuacaauaagugcaucuaagcccugaucuaauaccaaaaugguuucacacauaaaaguugaguuuggguuuguacccagggguuuaacuuuucuuuaaucuuggugucauauaauuuagucaauaaugaacaugcuauaguuuuaaaagaggucucuguuuuaauaaauaaacagaucauacuuccccgaagcaaauaagagaaaauaaaaauuccuuagcaggguguauuaggacauuuauauucugguuucugcucauuucugcagagucagcuucugugccuucuauuguacccugugaucuggucacacccagcuuucucucccauccacaauaccccagacccuuggcuuucugcaugcuauucccuugcauggcuagugcuggguuucucuuaagauucuucuccaucauuuauuucagaaguaaauggucucaaccagugaauggaaaaaggaaaguaacuucaaauuuuggaaagggauucagaacaaaaucaucagguugaagaucccggaagaugacugaagcucagccaggucaggggcacaucaguguguggguccccaugguucucagauguucuuaccauagccuuuaaggccaugccucuccuaguauugcccagaugcugccaggacagugggcccucuguagcugccccuaccuggagguggacuugccccuuucacuguccauguagcucaagaaaucaucucucccuucagggggaagccuuuugauggugaagugucagagagcaaaggaggaacugucaacaauggugauuccacuaaugaaaauauccaaugugagcuggugguccuuugcuuguuguucugagguaagugaacaugugauuuggccacaguguuuuacuuccaaccuaaaaugacuuuacugccucucucuuucccuggcugauuucuucccaacucugccacuguucuuuuuccuacuccuuuauuuauccagucucuuuucuuucucuacguacuucaugauccauucuuucucagacccucucuuucuguggcuauguuugcgauucacucccuuucucuguagcuaccuuuuuucccuucucuggcuuuacaaucugccuuccagcuguccuuguccggacuagugguuaaaaucuugggcccugguauugggagacccaaguaggacucuugcucugcuucuuaaccaacaaguaauuuugggaagauuaccucugggcuuuaauuucucugucagucaaaugggguuaaaaaugacuucaaaggguuguuuuaaagaugaugugagauaaucaaauaaaguguuugcgauaaggcaccaaaaaaagauacuuauuauuauccguccacauucauuuuuucuuccucccuggcucuccuuguccuuccaccagaccugaucuuuguaacuuugcauuucugucaccuuaugcauucccuauagauuuuccaguaugccaaauuguaugauuuuuuuccaaauucauagaacacauaagaaauguuuauguccucuagaaguucaucuuagagaguugggaucagcuuuagcaaggggcugcuccugcagcuguaccaaugagagaauaugguccauuccaccccagagagaaggcgggggauuaacgugcauauuccacagggcuagaaguaaacccagacuuuuaccauagcaacuuuuuaaaugcaaaaagcacuugagaaaucucauuaccacguuugaagcuucuguaaaucgucaccag

SEQ ID NO: 167475 - RNA, 42 nt, Homo sapiens
ggaguugucuaggaggccuucaaagaagggaaauggcuugug

SEQ ID NO: 167476 - RNA, 41 nt, Homo sapiens
cuucuuccccguccgccgacuucagcucugacuccccacaa

SEQ ID NO: 167477 - RNA, 45 nt, Homo sapiens
ccuccuccugcaggccuacagguuccaagaugccugccaccucag

SEQ ID NO: 167478 - RNA, 50 nt, Homo sapiens
ggaaccuguaggccugcaggaggaggcagaacugccagccaagauccugg

SEQ ID NO: 167479 - RNA, 210 nt, Homo sapiens
ggcuucugaagacacgagccgugaguaggcaggggauuguaguagcagcugaccugaguggggaaggaaggaggauuucaguuaggucucccauuuggcugaugggaaggaggcccaguguugcagggaggcaggcuagcaggccacccucacucauguacucauuccugguggcucaucucaggacagaaggcaauugcagcuaaggaa

SEQ ID NO: 167480 - RNA, 41 nt, Homo sapiens
cuuggccuggagcugcucaaaggcuucccggaguugugucc

SEQ ID NO: 167481 - RNA, 46 nt, Homo sapiens
cucagccucagggaacaacagcuuacccugcaggguauacagaagc

SEQ ID NO: 167482 - RNA, 52 nt, Homo sapiens
cugcagcuacgaacgggaccggaggaagcagcgggauggagguggaugcagc

SEQ ID NO: 167483 - RNA, 76 nt, Homo sapiens
ucgcucuccauccccuugucauucucaacaucucagaccacuggauccgcaugcgcucccaggaggggcggccugu

SEQ ID NO: 167484 - RNA, 46 nt, Homo sapiens
gcaucuaauguaaguuugagcucccaaaccuggagcugaggacaga

SEQ ID NO: 167485 - RNA, 46 nt, Homo sapiens
auuggcuugacggaagaguuuuguguggggaagucagagcugagag

SEQ ID NO: 167486 - RNA, 46 nt, Homo sapiens
gccggggaagcucgaaggagagacuggcagggcccagccccagagg

SEQ ID NO: 167487 - RNA, 42 nt, Homo sapiens
caacuugacgaugggcugcacgcuggggacggugguggugac

SEQ ID NO: 167488 - RNA, 46 nt, Homo sapiens
gggccugcgagagggucagcgugggccggggcugcggggagaagag

SEQ ID NO: 167489 - RNA, 46 nt, Homo sapiens
gcauccacgaguugucuguggagcagcagcucuacuacaaggagau

SEQ ID NO: 167490 - RNA, 42 nt, Homo sapiens
gggcaaaggucaaggggccaccacagccgacggcaaagguca

SEQ ID NO: 167491 - RNA, 40 nt, Homo sapiens
ccccaugcuauggaagcguguuuccacuccugcuccccuu

SEQ ID NO: 167492 - RNA, 48 nt, Homo sapiens
gaagaaaagcucagugugagaucccuggugaguugcaaggggagcagg

SEQ ID NO: 167493 - RNA, 44 nt, Homo sapiens
ugaaguucaugcacauggggaagcggcagaagcucaccaccagu

SEQ ID NO: 167494 - RNA, 76 nt, Homo sapiens
aauccaugggcaucgcccagauucaggaggagaccugccagcugcuaacggaugaggucagcuaccgcaucaaaga

SEQ ID NO: 167495 - RNA, 57 nt, Homo sapiens
agaagcugaagcuuagcaacacugugcugcccucggaguccaugaaggugguggcug

SEQ ID NO: 167496 - RNA, 44 nt, Homo sapiens
cuucuccucccuggaaggaugaagcccccgguggagagacggag

SEQ ID NO: 167497 - RNA, 46 nt, Homo sapiens
ccuucccugggacgccuuccugccgccuccacugaucugaggagau

SEQ ID NO: 167498 - RNA, 43 nt, Homo sapiens
gcugccgcuagaguuuuccugcuccccgcgcucggguggcggg

SEQ ID NO: 167499 - RNA, 38 nt, Homo sapiens
ugcucaucauucuccagguccccagaugacugcaugca

SEQ ID NO: 167500 - RNA, 45 nt, Homo sapiens
uggaaaaaaagaagcugucagaaggcaugaccugaaguaccugca

SEQ ID NO: 167501 - RNA, 83 nt, Homo sapiens
cuuagaagguauagucucuagcccucuaaggcuggggcuggugaucagccccaacagagaaaaugaggaguuuagaguugcag

SEQ ID NO: 167502 - RNA, 73 nt, Homo sapiens
auauucuaggcuuugugugcugccaguuggguucaggcuucaccuccuggaaaccauguagacuuauugcagc

SEQ ID NO: 167503 - RNA, 47 nt, Homo sapiens
uaauuuucugcugaugccauacccucacuuuucucagcaaagaauaa

SEQ ID NO: 167504 - RNA, 42 nt, Homo sapiens
gaaaaccaguaagucugcugccacuacagcaaggaaaggaau

SEQ ID NO: 167505 - RNA, 48 nt, Homo sapiens
cuuuucucaaagaguuuacauguacaagaaagucaccacaccaaaaaa

SEQ ID NO: 167506 - RNA, 46 nt, Homo sapiens
gcaacgugggcuaccuugcccaugccauucaccaggucaccaagua

SEQ ID NO: 167507 - RNA, 46 nt, Homo sapiens
uggccgaccacaucauuagcaugcggacucagcuugucuccaaccu

SEQ ID NO: 167508 - RNA, 45 nt, Homo sapiens
cacuggcaugcagcuacaagguuaucggcuuuaugaccccaagac

SEQ ID NO: 167509 - RNA, 50 nt, Homo sapiens
augggaccuccagauaucauccuggcagucauugaagacuuuaagaggga

SEQ ID NO: 167510 - RNA, 33 nt, Homo sapiens
gcccucugcucaguccugcagcugcccacugcc

SEQ ID NO: 167511 - RNA, 39 nt, Homo sapiens
gacaagguagggaggagaaggaggagaauuagaaaaaca

SEQ ID NO: 167512 - RNA, 24 nt, Homo sapiens
cuacagugcaagaugccuacugag

SEQ ID NO: 167513 - RNA, 41 nt, Homo sapiens
auuaagccuggggagacacagucuggagagaaaccucaugu

SEQ ID NO: 167514 - RNA, 42 nt, Homo sapiens
guccagaucauugaugaccuuauugaaaggagccaugaaagu

SEQ ID NO: 167515 - RNA, 47 nt, Homo sapiens
aaaauacauaaugauauugauugcaaaaacagcagcaguucuucauu

SEQ ID NO: 167516 - RNA, 45 nt, Homo sapiens
cucuggcugcacgccugauuggacaguucucacgcuagcgccgcu

SEQ ID NO: 167517 - RNA, 43 nt, Homo sapiens
cagucaccuguacgcgggccgcgugagccucuugucuucgucg

SEQ ID NO: 167518 - RNA, 41 nt, Homo sapiens
ggggauggugaggcugugggugccgacagcggcaccagcag

SEQ ID NO: 167519 - RNA, 46 nt, Homo sapiens
acaacggcuucuccugcagcaacugcagcaugcuguccgagcgcaa

SEQ ID NO: 167520 - RNA, 38 nt, Homo sapiens
gugauuaucuuugguguccauucuaaaagugccugaaa

SEQ ID NO: 167521 - RNA, 46 nt, Homo sapiens
agcagguggccucucugucuggacagugccaccaccauggugagaa

SEQ ID NO: 167522 - RNA, 45 nt, Homo sapiens
cgugccaucgugaacagcgccuugaagcuguauucccaagauaag

SEQ ID NO: 167523 - RNA, 50 nt, Homo sapiens
cucuccaugaugauccacccagccgccuucacucuggagcacaucccuaa

SEQ ID NO: 167524 - RNA, 46 nt, Homo sapiens
guaucaggaagaagggcagcuucugggacaguucacguaugaucag

SEQ ID NO: 167525 - RNA, 105 nt, Homo sapiens
acacuacucauuauuuuuguacauuuuuguauauacugggacagcgugaaacacuggaauccuucauggacgagggcauauacaaugaugggacagugccacacu

SEQ ID NO: 167526 - RNA, 54 nt, Homo sapiens
cacugccucugcaggugcagaggggucagcagcaggagaagcguguugaacacg

SEQ ID NO: 167527 - RNA, 55 nt, Homo sapiens
uaacgggaagcucuuugcauuugcauuuccucaacaaaggagcaaagcagaggaa

SEQ ID NO: 167528 - RNA, 72 nt, Homo sapiens
aguccucaaauacacugauguaugaaacuauucauacaucaagcagcauuuuuuucacucuccuuagaauug

SEQ ID NO: 167529 - RNA, 50 nt, Homo sapiens
uaaaucaaaauuuccuauauaaaacugauuugggauuugggguggaaaua

SEQ ID NO: 167530 - RNA, 52 nt, Homo sapiens
aaauaucugucuuugguagugcuucugcugcugccaccaaauugauaagaug

SEQ ID NO: 167531 - RNA, 46 nt, Homo sapiens
gaacaggccgaucacguacugcuggugcuccgagagcucaccuguc

SEQ ID NO: 167532 - RNA, 42 nt, Homo sapiens
cccacucuguaauacccccaucccaguaaaaaagggccagau

SEQ ID NO: 167533 - RNA, 59 nt, Homo sapiens
ccucccagccugagccaggcagucccuuucagaggccuaagcccacugcacagugagau

SEQ ID NO: 167534 - RNA, 29 nt, Homo sapiens
cuggaggaggaaaagaggaugcuggaggc

SEQ ID NO: 167535 - RNA, 46 nt, Homo sapiens
agguggagaguuaccggugucgaagcgccuucaagcuccuggaggu

SEQ ID NO: 167536 - RNA, 53 nt, Homo sapiens
uuccaggagucguggugaccagggaggggagccgggccagcgggcggcaggag

SEQ ID NO: 167537 - RNA, 43 nt, Homo sapiens
auggcucagcuccccuagucuccugccgcccgcuggcccggcu

SEQ ID NO: 167538 - RNA, 72 nt, Homo sapiens
agggucgggggcucgagggagacgaggagagcggggccggggguuugggagagagacaaggagagcggggcg

SEQ ID NO: 167539 - RNA, 46 nt, Homo sapiens
gucccuggguucugaaaggaaggugagagggcagagucagccauga

SEQ ID NO: 167540 - RNA, 49 nt, Homo sapiens
cacgcacgucauggcugacucugcccucucaccuuccuuucagaaccca

SEQ ID NO: 167541 - RNA, 45 nt, Homo sapiens
guggaauggcuuugggggcaaagugcaagaaggagagaccaucga

SEQ ID NO: 167542 - RNA, 42 nt, Homo sapiens
uuggguugcaccucagugccuccucuucccccauugguacag

SEQ ID NO: 167543 - RNA, 42 nt, Homo sapiens
uuccagggucaggacaccauccuggacuacacacuccgcgag

SEQ ID NO: 167544 - RNA, 85 nt, Homo sapiens
ugagggaguuuaaacuuuuaucccuuugguggugguuugggugcgacgcgauuagauguguuucagaaaaguggucguggugaga

SEQ ID NO: 167545 - RNA, 49 nt, Homo sapiens
agcugaguugaguagccuuguggggcgugggucuggggcagugagagag

SEQ ID NO: 167546 - RNA, 58 nt, Homo sapiens
aggagaugugaccugguggagaagagacagccuguacaaggagggaauccccaggaac

SEQ ID NO: 167547 - RNA, 48 nt, Homo sapiens
cugcaggaagcugaagugagaggcccggagagggcccagcccgcccgg

SEQ ID NO: 167548 - RNA, 53 nt, Homo sapiens
acuugcacacguccuucucuaggccgcacacggggccgccgcugcccacgccc

SEQ ID NO: 167549 - RNA, 80 nt, Homo sapiens
cgaguuucuggacaaguuucucagugcuggcgugaagcagagcgaccuucccagaaaggagacggagcagccgccugcgc

SEQ ID NO: 167550 - RNA, 56 nt, Homo sapiens
cggggagcauggaggagagcgugagaggcuacgacugguccccgcgcgacgcccgg

SEQ ID NO: 167551 - RNA, 46 nt, Homo sapiens
ugcacaacgccagcgcgcaccugaccuucaacaaguucuggcgccg

SEQ ID NO: 167552 - RNA, 62 nt, Homo sapiens
acgaaauguggaagggaaugcuggaguaaaauauccccucuccccuccgcccgcccacccgc

SEQ ID NO: 167553 - RNA, 51 nt, Homo sapiens
ucacagugugucgucuccuuggagcagaguggggggugcagaggcaccagg

SEQ ID NO: 167554 - RNA, 46 nt, Homo sapiens
ugccugugugaucccagggaauucacugcaccuugcugaaucugag

SEQ ID NO: 167555 - RNA, 45 nt, Homo sapiens
gaagugcgugccgggaggguucugggaagaggcagcuguggggcc

SEQ ID NO: 167556 - RNA, 38 nt, Homo sapiens
caggccagggcgaccugcgcgcuucccgaugggagcaa

SEQ ID NO: 167557 - RNA, 31 nt, Homo sapiens
guuugggguucgcaggugaggagagagaaca

SEQ ID NO: 167558 - RNA, 52 nt, Homo sapiens
uagcucgaugcagcugcugggagguuuugcaaagcgcauucagaauagcgag

SEQ ID NO: 167559 - RNA, 44 nt, Homo sapiens
uuccugaaugacccacgaagacgaauguggccacaaggcuucuu

SEQ ID NO: 167560 - RNA, 27 nt, Homo sapiens
cuguguuuuugugugugugugagagag

SEQ ID NO: 167561 - RNA, 42 nt, Homo sapiens
ucuccaauuacaauguguuacagaauuuggaagggggugucu

SEQ ID NO: 167562 - RNA, 137 nt, Homo sapiens
cacucauugacaaggccggacuacucaggaagguguuucaaacaacuccccugcuacgcgaaucacagcgcugcugucgccaacagcgccgcgaagaggcucuccccguuggcggaggacccgcuugcacuuccucu

SEQ ID NO: 167563 - RNA, 49 nt, Homo sapiens
cuccggucacauccgugaggucugugaagagccacagaagcaguacaaa

SEQ ID NO: 167564 - RNA, 50 nt, Homo sapiens
ucagaaaaagaggaacguuucuguaaaagcaaagcaagcugugugauuag

SEQ ID NO: 167565 - RNA, 49 nt, Homo sapiens
ccccaggauucaguagcuaacgugacaguuuccauguccuuuugccuag

SEQ ID NO: 167566 - RNA, 53 nt, Homo sapiens
augaacuugaaagguugccuggacucgcuggagcaaaggaaagcgauuuuguu

SEQ ID NO: 167567 - RNA, 34 nt, Homo sapiens
aaacugugugauuuuuuuuuuuuuuuaaguaaag

SEQ ID NO: 167568 - RNA, 28 nt, Homo sapiens
ugguacagcuggaggccaagcagaaggc

SEQ ID NO: 167569 - RNA, 23 nt, Homo sapiens
cgaggccagcggugguggcuaca

SEQ ID NO: 167570 - RNA, 47 nt, Homo sapiens
caucuggguucuuggcagcguagccugcuguuaucagccgaaugauu

SEQ ID NO: 167571 - RNA, 45 nt, Homo sapiens
aagguuacuagcuccaaacacaaaauaccuuccguguuuccuagc

SEQ ID NO: 167572 - RNA, 46 nt, Homo sapiens
ccaggaagauggaggugggguucaaggccagaggccagcccaaguc

SEQ ID NO: 167573 - RNA, 39 nt, Homo sapiens
uugaagucgcccuucaaguuuucggacagugcugggggg

SEQ ID NO: 167574 - RNA, 63 nt, Homo sapiens
aagaagaagaagauggccagcgaccaggagcaguuggcaagcaagcucgacaaggcccucucc

SEQ ID NO: 167575 - RNA, 31 nt, Homo sapiens
aaaucacagaggcaggugaaggauuggagcc

SEQ ID NO: 167576 - RNA, 54 nt, Homo sapiens
ugcccucaucggaauggggaaagccagggggaggaaccagacuugggaugaaca

SEQ ID NO: 167577 - RNA, 70 nt, Homo sapiens
ugacaucagaugauuaugagcugggagcagggauaagaaagagacacaaggggucugaggaggaacauga

SEQ ID NO: 167578 - RNA, 45 nt, Homo sapiens
aacggacccacgccccgagcgcccugucgcccccccgcaagagag

SEQ ID NO: 167579 - RNA, 45 nt, Homo sapiens
cccgcgggagcugaagcccaacaagaaguacagcuggaugcgcaa

SEQ ID NO: 167580 - RNA, 41 nt, Homo sapiens
accgcuggcugagcgggaggugaaggcagagguggaggaca

SEQ ID NO: 167581 - RNA, 73 nt, Homo sapiens
auccaccuuguagaccacugggaggggugggagaaggcguucccuagguccucacagugguccucguacgugu

SEQ ID NO: 167582 - RNA, 55 nt, Homo sapiens
ggaaccccaguugggguuugggggagcuugaugcgucauaaggaaagauguuggg

SEQ ID NO: 167583 - RNA, 52 nt, Homo sapiens
cuuccuggaggaaguggcacuugaagcugagcucugaugguggagguccagg

SEQ ID NO: 167584 - RNA, 46 nt, Homo sapiens
gguagcccgagccaccgggggcgauuccaauccccggggccccggc

SEQ ID NO: 167585 - RNA, 33 nt, Homo sapiens
cacggcgucuuggcggggaggagacaggccgcg

SEQ ID NO: 167586 - RNA, 21 nt, Homo sapiens
aucugguaaccagagccugau

SEQ ID NO: 167587 - RNA, 35 nt, Homo sapiens
ggagggagauaccaccgacggcugcaggggagggg

SEQ ID NO: 167588 - RNA, 96 nt, Homo sapiens
gagcagauaacaggggaagaggaggugggaggcugccacagcgcugccugcugggggaucaagguccccgcauccaggccuccagcacccuccauc

SEQ ID NO: 167589 - RNA, 82 nt, Homo sapiens
acugugggguuggagggagggaggaggggaaaggguauguaucccuuuguucuuuaaaagggagagccccaaccucucuggc

SEQ ID NO: 167590 - RNA, 47 nt, Homo sapiens
ucagcacuuguccccgugccugcgugcgugugccugcgugcacgugu

SEQ ID NO: 167591 - RNA, 45 nt, Homo sapiens
ugcuauuuuggcaccagcguuaguugcaauuuauauucugcagca

SEQ ID NO: 167592 - RNA, 42 nt, Homo sapiens
uugcucuggagcagagcugcgcccaggucgugcugcaggcgg

SEQ ID NO: 167593 - RNA, 81 nt, Homo sapiens
gaguccuuucugagcaggacauuugagcuggccugaaggaugaauagaagguggcagguauggggggggugcuguguggac

SEQ ID NO: 167594 - RNA, 43 nt, Homo sapiens
uuauggcaggaagguacagagaaagcccaguguggcugggagg

SEQ ID NO: 167595 - RNA, 43 nt, Homo sapiens
ggcuaugguccuugccuugggguugcagccacagccucccgug

SEQ ID NO: 167596 - RNA, 54 nt, Homo sapiens
uccugagaagcuugcugggggcgucuggugugugauucaggcugauaggguggg

SEQ ID NO: 167597 - RNA, 781 nt, Homo sapiens
uggggacuggagggugugaggcaaccagggggugccccucugagccaccacagacagaaugguucagaaggccaggcacacuggcucucgccuguaauccaagcacuuugggaggccaaggagggaagauggcuucggccaaggagggaagauggcuucagcccaggaguucaaggccagccuggaaaacauggcaaaaccucugucuacaaaaaauacaaaaaauuagccaggcauggugaugcacgccugucgucccagcuacucaggaggcuuagaugggaggaucacuugagccggggaguuugaggcugcagugagccgagaucgugccacugcacuccagccugggcaacagaacgagacccugucuuaaaaaaauuuuuuuuggccuggugcgguggcucacgccuguaaugccagcacuuugggaguccaagguggguggaucaccuggaggucgggaguuugagaccagucugaccaacauggagaaaccccaucucuacuaaaaacacaaaaauuagccgggcgugguggcgcaugccuguaaucccagcuacucuggaggcugaggcaggagaaucccuugaacccgggaggcggaaguugcagugagccgagaucgcaccauugcacuccagccugggcaacaagagugaaacuccaucucaaaaaacaaaacaaaacaaaaaaaacaaccaaaacaaacaaacaaaaaacuguaauuaaaauaauuaaaagaaaaaaguuaaaaaaaaaaaaaagagaggauggcuca

SEQ ID NO: 167598 - RNA, 47 nt, Homo sapiens
cugccaaucaggacgaggagaccgaccaggagaccuuccagcuggag

SEQ ID NO: 167599 - RNA, 48 nt, Homo sapiens
ccggcgcaucacacugagggcguccaauggcaaguuugugaccuccaa

SEQ ID NO: 167600 - RNA, 36 nt, Homo sapiens
agagcucuuccucaugaagcucaucaaccgccccau

SEQ ID NO: 167601 - RNA, 41 nt, Homo sapiens
agcuaugacgucuuccagcuggaguucaacgauggcgccua

SEQ ID NO: 167602 - RNA, 61 nt, Homo sapiens
guacuagggccggcccguccuuccccgccccugcccacauggcggcuccugccaacccucc

SEQ ID NO: 167603 - RNA, 39 nt, Homo sapiens
guugggggcugggagcccugggcguguaguguaacugga

SEQ ID NO: 167604 - RNA, 44 nt, Homo sapiens
cuuggucuuuuauuuuuuguaagugucauuuguauaacucuaaa

SEQ ID NO: 167605 - RNA, 50 nt, Homo sapiens
uccugaacggugagaagcauuuaggcauuagagucauuuuaauccaaauu

SEQ ID NO: 167606 - RNA, 48 nt, Homo sapiens
aaaacucucugaauauaaugaauauggggaauccaauaggaagucaaa

SEQ ID NO: 167607 - RNA, 42 nt, Homo sapiens
ucuuuucucgggugucauaccucacuauacauuauagaaguc

SEQ ID NO: 167608 - RNA, 45 nt, Homo sapiens
ggaaauccuucagccaaaagggaacccucacuguacaucggagau

SEQ ID NO: 167609 - RNA, 46 nt, Homo sapiens
guggaaagaauuuagaaucuauuucgcaauuaauuaguagugaugg

SEQ ID NO: 167610 - RNA, 41 nt, Homo sapiens
gaccugucccaccuggcggccaucgucauccugcugcugaa

SEQ ID NO: 167611 - RNA, 46 nt, Homo sapiens
uaacugagauccgggaaguaagcaaaaccaaaaagaccuuugaaca

SEQ ID NO: 167612 - RNA, 91 nt, Homo sapiens
uuguuuuuuacuauucacuguuuucauuugagagauucaggagcauauaaggaaaauaugaaauacuucagcuaaaaugcuaacgaaggaa

SEQ ID NO: 167613 - RNA, 43 nt, Homo sapiens
aagccagcuucuguuugcacuggucuucacaacucguuaccug

SEQ ID NO: 167614 - RNA, 28 nt, Homo sapiens
gcaaccuacgauggaaaucaugauaccu

SEQ ID NO: 167615 - RNA, 45 nt, Homo sapiens
uaugaucagcaagacuggggaggccgagaccaucaccacccacua

SEQ ID NO: 167616 - RNA, 104 nt, Homo sapiens
cugggccucuaucgugcuuuguaucuugucaacuggaucuggcgcuucuacuuugagggcuucuuugaccucauugcugugguggccggcguaguccagaccau

SEQ ID NO: 167617 - RNA, 49 nt, Homo sapiens
aaagaagcucaguuugccagcauaagugccaaagaccaucaccagcauc

SEQ ID NO: 167618 - RNA, 103 nt, Homo sapiens
uuucuguuuaaugcaucuugccuuaucuuuuuuuauuacuguguacaaagauuuuuuuacacaaagaaacuuaaugcuguauuaauaaauucaguguguagcu

SEQ ID NO: 167619 - RNA, 46 nt, Homo sapiens
aagucuuugugucugcaaugaaauuguacuccuugacaguugauag

SEQ ID NO: 167620 - RNA, 71 nt, Homo sapiens
ccuaucacuuucacuuauaauuccaaaagaugacuacaaccauguccaugcucagauucaaacaguuuucc

SEQ ID NO: 167621 - RNA, 41 nt, Homo sapiens
acagcauguaaaauuucuauaguauauaaauggcagcaaau

SEQ ID NO: 167622 - RNA, 48 nt, Homo sapiens
cuaucaaacugugauacacuuauaauucacugguccugcaucaggaga

SEQ ID NO: 167623 - RNA, 51 nt, Homo sapiens
gcgcauccccuccucccaggggcuuuugacgaaucuucagggcugcccuga

SEQ ID NO: 167624 - RNA, 45 nt, Homo sapiens
ccuugacagaaaggguuugucaccccugccuggacgcccauuguu

SEQ ID NO: 167625 - RNA, 41 nt, Homo sapiens
aucggcagccucagaaagguggaccgaggccacuaccgcag

SEQ ID NO: 167626 - RNA, 46 nt, Homo sapiens
aagaaaacggccuagcgccugauggugccagcugccaaggccagcc

SEQ ID NO: 167627 - RNA, 41 nt, Homo sapiens
gacagauaaugcaucccaagccgcuuggugcugucugagac

SEQ ID NO: 167628 - RNA, 54 nt, Homo sapiens
aaccuacacaccaccucuugccaauuacaugcuaucacaugaacacuccaaaac

SEQ ID NO: 167629 - RNA, 46 nt, Homo sapiens
cgagaagucccugcugcacaaugagaccucggcucaccggcagaag

SEQ ID NO: 167630 - RNA, 35 nt, Homo sapiens
ggcaaguggcaccacaucugugucaccuggacgac

SEQ ID NO: 167631 - RNA, 42 nt, Homo sapiens
auugucaacaucgccaacugcuccacaaacaugccgggcaac

SEQ ID NO: 167632 - RNA, 76 nt, Homo sapiens
ccugccccaaguggguggauaucugccuuccugcugcaaguggaggcagguccagcagccccucuucagagccccu

SEQ ID NO: 167633 - RNA, 58 nt, Homo sapiens
cauggcugugcagccgucccgcuggaguggccaugucccuugugcauugagugcaucc

SEQ ID NO: 167634 - RNA, 33 nt, Homo sapiens
cugcccagacaaagccccgccuuccccaaagca

SEQ ID NO: 167635 - RNA, 44 nt, Homo sapiens
guuuuaaauucauguugauucuuguaagcacuggacugucuuca

SEQ ID NO: 167636 - RNA, 57 nt, Homo sapiens
gugacuccaagcuacucacuguauuggacgggaguaguaauuuauuuuaaagauaaa

SEQ ID NO: 167637 - RNA, 36 nt, Homo sapiens
cucuucugaugauggaauuucgauuaaagugcacug

SEQ ID NO: 167638 - RNA, 38 nt, Homo sapiens
acuucuuuguuguaucucccguaguguaaacccucaag

SEQ ID NO: 167639 - RNA, 45 nt, Homo sapiens
cagcccaguacccucccaccuuugaccgggugugugccccaagcu

SEQ ID NO: 167640 - RNA, 46 nt, Homo sapiens
aagucccaggugacccccaacacucacaucuacagugcccucauca

SEQ ID NO: 167641 - RNA, 48 nt, Homo sapiens
gcaccagguagaggccgaccugacauucuuuaacacgcuggugagaaa

SEQ ID NO: 167642 - RNA, 46 nt, Homo sapiens
cucacugguccuuuugggacuuugccuuggccuaaaagggaagugg

SEQ ID NO: 167643 - RNA, 21 nt, Homo sapiens
caaauuccaaauuagagacuc

SEQ ID NO: 167644 - RNA, 43 nt, Homo sapiens
cugguauuuccuccaucacugcucuggaggacaaugaccauca

SEQ ID NO: 167645 - RNA, 48 nt, Homo sapiens
ugguuugagagaggccaagaacuggaauaagaacauggucccuagagg

SEQ ID NO: 167646 - RNA, 45 nt, Homo sapiens
auggcaggugacaaagcaaagaaaaacuaagugaagggaacaggg

SEQ ID NO: 167647 - RNA, 45 nt, Homo sapiens
ccauuuaauuccuugguugaacacaaugccuguaugaauguauau

SEQ ID NO: 167648 - RNA, 38 nt, Homo sapiens
ucuugggggccuuacacacugguugagacagcacccau

SEQ ID NO: 167649 - RNA, 57 nt, Homo sapiens
uauuugaauuucuuuacuuucuuguuucuuccuaaguauaaggucucugagaagguc

SEQ ID NO: 167650 - RNA, 37 nt, Homo sapiens
gcacccccaaacaaacguuaauuaccccucccggaga

SEQ ID NO: 167651 - RNA, 45 nt, Homo sapiens
augacucagggccgggcaggaauucacacuaugaauccggguggu

SEQ ID NO: 167652 - RNA, 56 nt, Homo sapiens
cuguuuaauuucaaauguuaggguccaaggaagcccucuguugcaaccagauaugu

SEQ ID NO: 167653 - RNA, 57 nt, Homo sapiens
gcaacagagggcuuccuuggacccuaacauuugaaauuaaacagagguaauuugagg

SEQ ID NO: 167654 - RNA, 33 nt, Homo sapiens
cguauggugccuaacucuccugugaacccuggg

SEQ ID NO: 167655 - RNA, 43 nt, Homo sapiens
ggggcuggaaaauaugaagaacugacagcugccccaaagauuc

SEQ ID NO: 167656 - RNA, 45 nt, Homo sapiens
gaucuggaaacuaagacuagagaagucuuaagagaugacugcuca

SEQ ID NO: 167657 - RNA, 115 nt, Homo sapiens
auuugcauuuucuauuuauauauuguaucagauggagagaccagagaagagaacaagcuguugauuccuaagcagaaaauuucggaagaagugcauucauacaaagugagaguag

SEQ ID NO: 167658 - RNA, 46 nt, Homo sapiens
aaccagaauucagccucugguaaacaugaacacuuaaaucuaacag

SEQ ID NO: 167659 - RNA, 46 nt, Homo sapiens
caugauggacccucugauguucaaguagguaugaaguauggcagaa

SEQ ID NO: 167660 - RNA, 45 nt, Homo sapiens
gauugaauucacaucuuauucagcaucaaagaauucacacaggag

SEQ ID NO: 167661 - RNA, 46 nt, Homo sapiens
acuccagucagagagcacaucuaguucaacaucagagcauucauac

SEQ ID NO: 167662 - RNA, 44 nt, Homo sapiens
gaugggaagauauuuaucaaauucaggcuucauucagcaucuga

SEQ ID NO: 167663 - RNA, 44 nt, Homo sapiens
gcagauaaauguuugaauucugcuccucucucaucaauccagga

SEQ ID NO: 167664 - RNA, 55 nt, Homo sapiens
gggaaagugugguaccagagugaaaagggauucugucuggagucuucugguuccu

SEQ ID NO: 167665 - RNA, 53 nt, Homo sapiens
gguuuucucuugcggcaggaagugggcaggacuaacgugcacgaaagcguugg

SEQ ID NO: 167666 - RNA, 39 nt, Homo sapiens
gaaguaaggaaagccugaguugagguuguuggucaaagg

SEQ ID NO: 167667 - RNA, 42 nt, Homo sapiens
caggcaccagcgaacccacgaagagaagucuuauggcugugu

SEQ ID NO: 167668 - RNA, 72 nt, Homo sapiens
uugcggggugcaaggugauggcugcaggaaagcacuggucccaucgccuucccacccauucgccaacgcggg

SEQ ID NO: 167669 - RNA, 39 nt, Homo sapiens
cucuaugaagcagacaacuggacaugcauauucauagca

SEQ ID NO: 167670 - RNA, 59 nt, Homo sapiens
agcauuuaccagacaugcacucagaacugaguaacuuagguacagauaacaacaggagc

SEQ ID NO: 167671 - RNA, 47 nt, Homo sapiens
ccccauucucuaauucaaggcuugugucaagaauaacaguagaagaa

SEQ ID NO: 167672 - RNA, 46 nt, Homo sapiens
uaggaggagagguagaacucgagucuuuuuagagcaagauagagaa

SEQ ID NO: 167673 - RNA, 58 nt, Homo sapiens
caacgguuuggagcagcacauguuugggaaaauggggcuagaaguaauguuacaguga

SEQ ID NO: 167674 - RNA, 74 nt, Homo sapiens
cuaacgcuucacgcacuaauuucaguagucacacaaaccaaucaggugguagugaacucaggcaaagggagggg

SEQ ID NO: 167675 - RNA, 46 nt, Homo sapiens
aggaaucucaggaugaaucagucuagaucgagaucagaugguggca

SEQ ID NO: 167676 - RNA, 42 nt, Homo sapiens
agcuuccgucgcaacggccgggaaagaaaccaguagcgggac

SEQ ID NO: 167677 - RNA, 79 nt, Homo sapiens
auuuccucuucuucuccuggugucguuccucuauuugaaguucagcuucuaguuuucgcugaugaaccauuaaggacug

SEQ ID NO: 167678 - RNA, 45 nt, Homo sapiens
agcugccauuuucuccauauccacuucuacuuucagagggcacaa

SEQ ID NO: 167679 - RNA, 43 nt, Homo sapiens
cuccugccacucuccuuguccucaggaguagacgugccuucuu

SEQ ID NO: 167680 - RNA, 36 nt, Homo sapiens
uuuuuuuucuccauuuuccccggcuccuugcacagc

SEQ ID NO: 167681 - RNA, 55 nt, Homo sapiens
ggugaacuaucucagacagaugccucuccuuuuuaauacgcauuugugcagcuaa

SEQ ID NO: 167682 - RNA, 41 nt, Homo sapiens
acccuaucuguuucaaaccaggaccaacccugagaaaggaa

SEQ ID NO: 167683 - RNA, 43 nt, Homo sapiens
uugucagguggcaaccuaggauuuuaugaugggcauguuggga

SEQ ID NO: 167684 - RNA, 46 nt, Homo sapiens
guucaaaggaacaccagcacagaaccugcagaguaucagcucauga

SEQ ID NO: 167685 - RNA, 40 nt, Homo sapiens
cgaggcgcggaggcgaagcaggaagcaaggaccgaccgac

SEQ ID NO: 167686 - RNA, 43 nt, Homo sapiens
gcucaaaaauauggauaucucuuuaaagaauuuggcugagugu

SEQ ID NO: 167687 - RNA, 54 nt, Homo sapiens
aaaaaauacaagguaggagugcuggggggcggggggugcugcaauuuuaaugag

SEQ ID NO: 167688 - RNA, 46 nt, Homo sapiens
caugauccuaguccucaagaagcucagucuagugagaggggcaagg

SEQ ID NO: 167689 - RNA, 54 nt, Homo sapiens
gaucucggagcuggacaaggagcgcucacuguagcucugcuguggauuguguug

SEQ ID NO: 167690 - RNA, 35 nt, Homo sapiens
uggcggcggcggcgggggugccggugguggcggga

SEQ ID NO: 167691 - RNA, 44 nt, Homo sapiens
cacccguguugaaagcagcauuauucacaguagucaaaaggcag

SEQ ID NO: 167692 - RNA, 62 nt, Homo sapiens
cacauguguuuugcguguccuuguggaguggcgucugcagaguguugagguucccuaguggg

SEQ ID NO: 167693 - RNA, 46 nt, Homo sapiens
ucuaacaucaccugcuucauccuuguuuaaugacuuuggugcccuc

SEQ ID NO: 167694 - RNA, 31 nt, Homo sapiens
uaucucaauguauucuguucuuaagauaaca

SEQ ID NO: 167695 - RNA, 44 nt, Homo sapiens
auuauguuaaaaccucauguaccuaauguuauuuccauuuugag

SEQ ID NO: 167696 - RNA, 75 nt, Homo sapiens
acaagggaacauuuacucagcagcauauuaauuagugccaauuuaaauauuugaugauugcuagguagcaaagaa

SEQ ID NO: 167697 - RNA, 24 nt, Homo sapiens
aaaauaggaguuaauauacaagag

SEQ ID NO: 167698 - RNA, 48 nt, Homo sapiens
gagaaauuauuugggaacaaaauaucuuuacaacagaguuagauauug

SEQ ID NO: 167699 - RNA, 49 nt, Homo sapiens
uuuaaguaaaaccauggugcauuuaucucuugaaccuacaaacuaguag

SEQ ID NO: 167700 - RNA, 65 nt, Homo sapiens
cauaauaaccagcaagaugggacuggucaggcuaucaagaauagaggaucaauaagggaauuuac

SEQ ID NO: 167701 - RNA, 37 nt, Homo sapiens
ccuccacacugccacagaccuuccuuucuaaaauaca

SEQ ID NO: 167702 - RNA, 45 nt, Homo sapiens
uaguucucaguaggaaauaaaguaacaagauggugagcugaaaaa

SEQ ID NO: 167703 - RNA, 58 nt, Homo sapiens
uuccgucuuuacucacuggguuuugguauuacuucaggugauuuguaaucucuaggcc

SEQ ID NO: 167704 - RNA, 43 nt, Homo sapiens
cuguggaauaugccuaguagauucaaugucuuuuuucggcuua

SEQ ID NO: 167705 - RNA, 59 nt, Homo sapiens
aaauugguggguaaaauuggcuaauacccuuuuuuuaaauaaacauuuuuagcuugaga

SEQ ID NO: 167706 - RNA, 48 nt, Homo sapiens
aaaaacaaaauuccgugauugauuaucucuauggcauuucauaucaua

SEQ ID NO: 167707 - RNA, 46 nt, Homo sapiens
aauguuuaguucuaaauuuuucagucacgaaucucuuacauauuga

SEQ ID NO: 167708 - RNA, 50 nt, Homo sapiens
uguaaguuaaacugcccaaacaaauagauccaaaauguaaugacauggcu

SEQ ID NO: 167709 - RNA, 92 nt, Homo sapiens
ggcagguguucagguuggcuaggaugcucuucacauagcuuauaagggacacaggggaagagcuucucagcaucucucaagugagcuagaaa

SEQ ID NO: 167710 - RNA, 57 nt, Homo sapiens
aguugauccugguuaucucaugaauauacauuugagauauuuucucauuugcaucuu

SEQ ID NO: 167711 - RNA, 47 nt, Homo sapiens
uuguuucuucaaacauagagaccgaaguaaguaaccuacuauuauag

SEQ ID NO: 167712 - RNA, 53 nt, Homo sapiens
accauuaauacaggcaagacugaaguuaugucaaagggaagauuacuaugugu

SEQ ID NO: 167713 - RNA, 57 nt, Homo sapiens
guuauucagugagaauaacaaggcuauguaguauuuuauugaauauaauagcuugaa

SEQ ID NO: 167714 - RNA, 41 nt, Homo sapiens
uuaccuugaggucugcaugaaaauauccuaacccaacacaa

SEQ ID NO: 167715 - RNA, 52 nt, Homo sapiens
uuacuuguuugauuuuuuuaaaucauugugugguuuuuauauucuuauucau

SEQ ID NO: 167716 - RNA, 51 nt, Homo sapiens
caaaauuuagaauucuuaagagaacucuugauacccuauaguaaauucuac

SEQ ID NO: 167717 - RNA, 119 nt, Homo sapiens
uaguaaaacauguaauugauuuccuguuuucguauguguguaagacuuaggaauuggucaacuauauagcauguuggcugagagcacugacuuuggaauuaaaucaaccugaguuugag

SEQ ID NO: 167718 - RNA, 41 nt, Homo sapiens
uccagcaaguuacauggugccuucuagugccucuacaucug

SEQ ID NO: 167719 - RNA, 50 nt, Homo sapiens
gacacauaaugauaaggggccugcaguauggcucuuaugcucaggagaua

SEQ ID NO: 167720 - RNA, 47 nt, Homo sapiens
uuuuaaauuaauuauuaccaguuuacuaguagaccuugaauuuucag

SEQ ID NO: 167721 - RNA, 417 nt, Homo sapiens
uuaaagacucuauuacauuuuguacuaguuguuuucauguuccugauaaagacauacccgagacugggcaauuuacaaaagagagagguuuaaugaacuuacaguuccauguggcuugggaggucucacaaucauggcagaaggugaaaggcaugucucacauggcggcagacaagagaagugaaugagagccaaguaaaagggguuucccccuguaaaacugucagaucucaugagaccuauucacuaccacgagaacaguaugggggaaauuacccccaugauucaguuaucucccaccagcucccucccacaacacugugggaauuaugggaguuacaauucaaaaugagauuuggguggggacgcagccaaaccauaucacauuuuaaaaagaaauaugucaaagaaauggag

SEQ ID NO: 167722 - RNA, 39 nt, Homo sapiens
uuacuuuaaguaauuuuuauucaauaauuaagugguuac

SEQ ID NO: 167723 - RNA, 45 nt, Homo sapiens
ucgaguuauggauccaacaaagauucugauaacuggcaaaacaag

SEQ ID NO: 167724 - RNA, 43 nt, Homo sapiens
aaaauuauuuagcugagaaauaaggaaaggagaguuacugggu

SEQ ID NO: 167725 - RNA, 66 nt, Homo sapiens
caguaaaugaacgugugucuaauaauuuagaugaguucucagauuuuaaagaucugcaaaugucug

SEQ ID NO: 167726 - RNA, 93 nt, Homo sapiens
auguuaacucugaaguacuccauucuugaaggcaugugguuguuaauagcuuccuaccaaucagggccacuugggaugaccauacuguuuccu

SEQ ID NO: 167727 - RNA, 55 nt, Homo sapiens
ugacagcacuagaagccagugguugucuggauccuauucauaaucaaauucaaau

SEQ ID NO: 167728 - RNA, 49 nt, Homo sapiens
gaacuugacuugcaugaauuaaaauguuuucaaaauuuugugugcuaag

SEQ ID NO: 167729 - RNA, 42 nt, Homo sapiens
aggcuccuagcaaaauugggaacaaucaaugagaggccggag

SEQ ID NO: 167730 - RNA, 46 nt, Homo sapiens
uggaagauacugggagaaaaauuauggagcaucaacuggguaaacu

SEQ ID NO: 167731 - RNA, 45 nt, Homo sapiens
ucagcuagaugcuggugugccagaaaaaauaagccugauuuccag

SEQ ID NO: 167732 - RNA, 42 nt, Homo sapiens
ugagcaaagcugcuugcacuucagucagguacacuguuacuu

SEQ ID NO: 167733 - RNA, 63 nt, Homo sapiens
uuauguaaaaagaagaacuuggagacauuaacaugaaaaagucuuuuaucauuagcucaugua

SEQ ID NO: 167734 - RNA, 46 nt, Homo sapiens; identical to SEQ ID NO: 87922

SEQ ID NO: 167735 - RNA, 44 nt, Homo sapiens
uguaauuccauuuaagagguugucuaaaagucuuuuuaauuaau

SEQ ID NO: 167736 - RNA, 36 nt, Homo sapiens
cuucauucuguuuuaauauggugauauuuuuaaauc

SEQ ID NO: 167737 - RNA, 34 nt, Homo sapiens
uuuuuuuuaaacucaugcugcuuuuacuggucac

SEQ ID NO: 167738 - RNA, 42 nt, Homo sapiens
augcugcagaaaagcaaauggaauauggauuugccagggaga

SEQ ID NO: 167739 - RNA, 46 nt, Homo sapiens
ccccauauucagcagagaguuagggaaugagaaguagaggggagau

SEQ ID NO: 167740 - RNA, 46 nt, Homo sapiens
cuggaaaaaaugagugagccuuuaauccgaaggagcaguuucucug

SEQ ID NO: 167741 - RNA, 43 nt, Homo sapiens
cugggugacuugaaacaggagauucugggucacuucuggcugg

SEQ ID NO: 167742 - RNA, 23 nt, Homo sapiens
ggguccgcaguguccacugccug

SEQ ID NO: 167743 - RNA, 46 nt, Homo sapiens
ggacaucucuucaaucccaagauggauaaaaacaaaucucucagug

SEQ ID NO: 167744 - RNA, 58 nt, Homo sapiens
uggauccaaagagaggccaacauuuuuugaaauuuuuaagacacgcugcaacaaagca

SEQ ID NO: 167745 - RNA, 122 nt, Homo sapiens
aagucuuaauugguuugaagaacuuucuucagaagcuccacccuauaauucugaaccugcagaagaaucugaacauaaaaacaacaauuacgaaccaaaccuauuuaaaacuccacaaagga

SEQ ID NO: 167746 - RNA, 49 nt, Homo sapiens
caacuccaauaauauucaaagagcaagggcugacucugccgcuguacca

SEQ ID NO: 167747 - RNA, 45 nt, Homo sapiens
cuuaguucuacugugcucauagguaauaauagcaaauguguauuu

SEQ ID NO: 167748 - RNA, 46 nt, Homo sapiens
uuucuuacuucagagaauucuuugccacguauuucuagccuaccaa

SEQ ID NO: 167749 - RNA, 45 nt, Homo sapiens
auaagagagaugaagagcagcaucuugaaucucauacagacugca

SEQ ID NO: 167750 - RNA, 48 nt, Homo sapiens
uuccaagcaggauuuuaauucaaaccauaauuuaacaccuagccaaaa

SEQ ID NO: 167751 - RNA, 42 nt, Homo sapiens
aacuuagaauuugauggcagugauucaaguaaaaaugauacu

SEQ ID NO: 167752 - RNA, 46 nt, Homo sapiens
uaagaaagaacaaaauggacauucuaaguuaugaggaaacagacau

SEQ ID NO: 167753 - RNA, 49 nt, Homo sapiens
ugaaaaaccuuuuugaugaaaaagagcaagguacuagugaaaucaccag

SEQ ID NO: 167754 - RNA, 40 nt, Homo sapiens
guaucaaaaauacuuccucguguugauaagagaaacccag

SEQ ID NO: 167755 - RNA, 45 nt, Homo sapiens
uaaauuaucaaauaacuuaaauguugaaggugguucuucagaaaa

SEQ ID NO: 167756 - RNA, 103 nt, Homo sapiens
uauuaggcggaguagagaguucaggugaagaugugaaggugagagaagaggauggguagacauuucccuggugaaggagguaaggaguacuaugauggaauua

SEQ ID NO: 167757 - RNA, 45 nt, Homo sapiens
guuccaccuuuuaaaacuaaaucacauuuucacagaguugaacag

SEQ ID NO: 167758 - RNA, 78 nt, Homo sapiens
gaccuuuuccucugcccuuaucaucgcuuuucagugauggaggaaauguugguuguguugauguaauuauucaaagag

SEQ ID NO: 167759 - RNA, 45 nt, Homo sapiens
gauggagaagacaucaucuggauuauacauauuucgcaaugaaag

SEQ ID NO: 167760 - RNA, 48 nt, Homo sapiens
gagacuagaagccuuauucacuaaaauucaggaggaauuugaagaaca

SEQ ID NO: 167761 - RNA, 30 nt, Homo sapiens
augaagcagugaagaaugcagcagacccag

SEQ ID NO: 167762 - RNA, 42 nt, Homo sapiens
gaaggaaagagauacagaauuuaucaucuugcaacuucaaaa

SEQ ID NO: 167763 - RNA, 44 nt, Homo sapiens
augaacuuuauguucauguguauuuuacuauuauuagaggucua

SEQ ID NO: 167764 - RNA, 47 nt, Homo sapiens
ucuuguaaaggggagaaagagauugaugaccaaaagaacugcaaaaa

SEQ ID NO: 167765 - RNA, 46 nt, Homo sapiens
uuuauaucugucagugaauccacuaggacugcucccaccaguucag

SEQ ID NO: 167766 - RNA, 69 nt, Homo sapiens
ccgaggucuggagggacuaaaagcccaccucucagaaucgcgguaacaaaccucaccuccguacgcaag

SEQ ID NO: 167767 - RNA, 46 nt, Homo sapiens
aaguggaaaucuaaauaccucuccaucaucuaaccaaacaagaaau

SEQ ID NO: 167768 - RNA, 45 nt, Homo sapiens
uuuucuccugucaaugaauugcucuuuguaaccauaggcuuggau

SEQ ID NO: 167769 - RNA, 46 nt, Homo sapiens
ugucucaaguugcaaauguaaaccuguuccacuuuuagagcuugcu

SEQ ID NO: 167770 - RNA, 76 nt, Homo sapiens
aacccugcggaugcagccugaagcugcugguggcugucuuugcuaacaaguggaaaaacaauuacagaguagccaa

SEQ ID NO: 167771 - RNA, 45 nt, Homo sapiens
agccgccgcggcggccuaagagcucgaacccuuucacacgcgcgc

SEQ ID NO: 167772 - RNA, 45 nt, Homo sapiens
uagauaugccaguguuuuucuacauugauccugaauuugcugaag

SEQ ID NO: 167773 - RNA, 41 nt, Homo sapiens
augcuuuuuaaggaaggaagaaugaaauuaaaaggagacuu

SEQ ID NO: 167774 - RNA, 34 nt, Homo sapiens
aagcauaugugcuacucaucuuugcucacuaugc

SEQ ID NO: 167775 - RNA, 46 nt, Homo sapiens
gcucgugguuucccuggaacuccuggacuuccuggcuucaaaggca

SEQ ID NO: 167776 - RNA, 48 nt, Homo sapiens
uuacuuuuauuuuggcugcagagauacacuggaauuauagagggagga

SEQ ID NO: 167777 - RNA, 28 nt, Homo sapiens
uagggagcccgugggcuuccuggugaga

SEQ ID NO: 167778 - RNA, 49 nt, Homo sapiens
uuucaaauguagagugagaaaacuggucauucuauguccauuuugaagg

SEQ ID NO: 167779 - RNA, 76 nt, Homo sapiens
guccucuggcaccaguagcaccggcagcaccaacagggccaggaauaccgcgggguccagggaggccgggagcccc

SEQ ID NO: 167780 - RNA, 66 nt, Homo sapiens
ucugcugggccccaagguccuccuggucccaguggugaagaaggaaagagaggcccuaauggggaa

SEQ ID NO: 167781 - RNA, 94 nt, Homo sapiens
cccuggcaucgacggcaggccuggcccaauuggcccagcuggagcaagaggagagccuggcaacauuggauucccuggacccaaaggccccacu

SEQ ID NO: 167782 - RNA, 41 nt, Homo sapiens
uccuauuggaagccgagguccuucuggacccccagggccug

SEQ ID NO: 167783 - RNA, 47 nt, Homo sapiens
uacccucaucucuucagucaccaugucauuaacagcaucucucucug

SEQ ID NO: 167784 - RNA, 42 nt, Homo sapiens
cugguccaucugguccuaguggacucccaggagagaggggug

SEQ ID NO: 167785 - RNA, 45 nt, Homo sapiens
agggugaaccuggucucagaggugaaauugguaacccuggcagag

SEQ ID NO: 167786 - RNA, 42 nt, Homo sapiens
aaaugcuagggauuagaguauagaucagauagcuggcaaauc

SEQ ID NO: 167787 - RNA, 47 nt, Homo sapiens
aaagaugaaucuguuaaugugccugacauagaugcucaaagaacugg

SEQ ID NO: 167788 - RNA, 66 nt, Homo sapiens
ucaaccuggugcuaaaggagaaagaggagccaaagggccuaagggugaaaacgguguuguuggucc

SEQ ID NO: 167789 - RNA, 27 nt, Homo sapiens
gugugcaaauguuaauccuuccguuau

SEQ ID NO: 167790 - RNA, 57 nt, Homo sapiens
uuugcauuuaggguccaaaugguccccccgguccugcuggaagucguggugauggag

SEQ ID NO: 167791 - RNA, 47 nt, Homo sapiens
ccuccaucaccacgacuuccagcaggaccggggggaccauuuggacc

SEQ ID NO: 167792 - RNA, 46 nt, Homo sapiens
aagcccuucuuucccagcaggaccagggggaccaggagggccagaa

SEQ ID NO: 167793 - RNA, 77 nt, Homo sapiens
cgugguccucguggugaccaagguccaguuggccgaacuggagaaguaggugcaguuggucccccuggcuucgcugg

SEQ ID NO: 167794 - RNA, 45 nt, Homo sapiens
gggggaccaacugcaccuacuucuccaguucggccaacuggaccu

SEQ ID NO: 167795 - RNA, 41 nt, Homo sapiens
gugcuccugguauucugggucucccuggcucgagaggugaa

SEQ ID NO: 167796 - RNA, 46 nt, Homo sapiens
gcaacaccugguagaccacguucaccucucgagccagggagaccca

SEQ ID NO: 167797 - RNA, 86 nt, Homo sapiens
gguccucuuggcauugccggcccuccuggggcccgugguccuccuggugcuguggguaguccuggagucaacggugcuccugguga

SEQ ID NO: 167798 - RNA, 77 nt, Homo sapiens
gcuucaccaggagcaccguugacuccaggacuacccacagcaccaggaggaccacgggccccaggagggccggcaau

SEQ ID NO: 167799 - RNA, 46 nt, Homo sapiens
cccugggaacgauggucccccaggucgcgauggucaacccggacac

SEQ ID NO: 167800 - RNA, 46 nt, Homo sapiens
cugcaggugcaccugguccucauggccccguggguccugcuggcaa

SEQ ID NO: 167801 - RNA, 45 nt, Homo sapiens
uacaguuucaccacgguuuccauguuugccagcaggacccacggg

SEQ ID NO: 167802 - RNA, 94 nt, Homo sapiens
auagggcccacaaggcauucguggcgauaagggagagcccggugaaaaggggcccagaggucuuccuggcuuaaagggacacaauggauugcaa

SEQ ID NO: 167803 - RNA, 45 nt, Homo sapiens
uugcaauccauugugucccuuuaagccaggaagaccucugggccc

SEQ ID NO: 167804 - RNA, 47 nt, Homo sapiens
uagggcccugcugguccuucuggcccugcuggaaaagauggucgcac

SEQ ID NO: 167805 - RNA, 47 nt, Homo sapiens
agggccucgaaugccagcagguccaacuguaccaggauguccagugc

SEQ ID NO: 167806 - RNA, 66 nt, Homo sapiens
ucguaaccaaagucauaaccaccaccgcuuacaccuggagguccaggagggccagggggaccaggg

SEQ ID NO: 167807 - RNA, 87 nt, Homo sapiens
uucuacagggcugaccagccucgcucagcaccuucucucagacccaaggacuaugaaguugaugcuacucugaagucucucaacaac

SEQ ID NO: 167808 - RNA, 68 nt, Homo sapiens
caacuucauaguccuugggucugagagaaggugcugagcgaggcuggucagcccuguagaagucucca

SEQ ID NO: 167809 - RNA, 64 nt, Homo sapiens
cuuacuccugaaggcucuagaaagaacccagcucgcacaugccgugacuugagacucagccacc

SEQ ID NO: 167810 - RNA, 49 nt, Homo sapiens
acugcuccacucuggguggcugagucucaagucacggcaugugcgagcu

SEQ ID NO: 167811 - RNA, 75 nt, Homo sapiens
ggauguuuucagguugggcccggauacagguuucgccaguagagaaaucacaguauacuuugauagcauccauag

SEQ ID NO: 167812 - RNA, 87 nt, Homo sapiens
acccuaaccaaggaugcacuauggaugcuaucaaaguauacugugauuucucuacuggcgaaaccuguauccgggcccaaccugaaa

SEQ ID NO: 167813 - RNA, 63 nt, Homo sapiens
acaucccagccaagaacugguauaggagcuccaaggacaagaaacacgucuggcuaggagaaa

SEQ ID NO: 167814 - RNA, 81 nt, Homo sapiens
ccugcuggccaacuaugccucucagaacaucaccuaccacugcaagaacagcauugcauacauggaugaggagacuggcaa

SEQ ID NO: 167815 - RNA, 49 nt, Homo sapiens
guugcugagggcaacagcagguucacuuacacuguucuuguagauggcu

SEQ ID NO: 167816 - RNA, 44 nt, Homo sapiens
aaagacaaucauugaauacaaaacaaauaagccaucacgccugc

SEQ ID NO: 167817 - RNA, 45 nt, Homo sapiens
caccaccgauguccaaaggugcaauaucaaggaagggcaggcgug

SEQ ID NO: 167818 - RNA, 47 nt, Homo sapiens
caaauaaaugaacucaaucuaaauuaaaaaagaaagaaauuugaaaa

SEQ ID NO: 167819 - RNA, 54 nt, Homo sapiens
uugugcaauacaguuucauuaacuccuucccccgcucccccaaaaauuugaauu

SEQ ID NO: 167820 - RNA, 73 nt, Homo sapiens
uuuuuuucaacacucuuacaccuguuauggaaaaugucaaccuuuguaagaaaaccaaaauaaaaauugaaaa

SEQ ID NO: 167821 - RNA, 45 nt, Homo sapiens
cuaauuaauaguauuucagauacuugaagaauguugauggugcua

SEQ ID NO: 167822 - RNA, 44 nt, Homo sapiens
caacucaauacaggaguauuucuucucaaauucuucuagcacca

SEQ ID NO: 167823 - RNA, 53 nt, Homo sapiens
ucuucuucagauucagcauuuguucuuugccagucucauuuucaucuucuucc

SEQ ID NO: 167824 - RNA, 36 nt, Homo sapiens
agaaaaauuaaauuguaccuauuuuguauaugugag

SEQ ID NO: 167825 - RNA, 44 nt, Homo sapiens
agguuacugccauaguccuuuguagcucuaauauucugugucug

SEQ ID NO: 167826 - RNA, 40 nt, Homo sapiens
ucaacuucgguuggugugugucgaagaaaccugacugcgc

SEQ ID NO: 167827 - RNA, 74 nt, Homo sapiens
gaccgcgccuggcucaggugugggaccccauccuuccugucuucgcagaggaguccucgcguggugaguaugcg

SEQ ID NO: 167828 - RNA, 38 nt, Homo sapiens
ugcuuaucgggagcugcgggagauggaguagcacccca

SEQ ID NO: 167829 - RNA, 66 nt, Homo sapiens
cccgcuauagcaguggaguggaggggcacugauuggaguggaaaugggaaucuuuuggugauggca

SEQ ID NO: 167830 - RNA, 487 nt, Homo sapiens
cccagcuccuuagcgccugccugcccaggccccaccucucucuggccaccucauucugaggugagcugcucaggccccgccucuuccaggcccgccuuuucuguggugagcugcccaggcccugccucucccgggcccaccuacucugaggugaacuguccaggccccgccucucccggggccgcccccucugaggugaacugcccaggccccaccucuccugggcccgccuccucugaggugaacugcccaggccccgccucuccugggcccgccuccucugaggugaacugcccagaccccaccucuccugggcccgccuccucugaggugaacugcccaggccccgccucuccugggcccgccuccucugaggugaacugcccaggccccgccucuccugggcccgccuccucugaugugagcucacccagaucccaccuccccaggcccgccuccucuuagguagccugcucaggccccgccu

SEQ ID NO: 167831 - RNA, 46 nt, Homo sapiens
cccuccaaugcagccccuacuaagggggaguuuaaggagccauaca

SEQ ID NO: 167832 - RNA, 47 nt, Homo sapiens
uccuccucccccuccccccaacaacaacaacaacaacaacuccaagc

SEQ ID NO: 167833 - RNA, 33 nt, Homo sapiens
agaggagaacaccacccuucgagagcaagugga

SEQ ID NO: 167834 - RNA, 46 nt, Homo sapiens
gcagcagcugcugccccacccccuccaauagaggaagagugcccag

SEQ ID NO: 167835 - RNA, 47 nt, Homo sapiens
gaagcaugucuuugaagacccucagaggcgagagguugccaaacgca

SEQ ID NO: 167836 - RNA, 58 nt, Homo sapiens
cacgcucgccaccccgggcgcugguguugccucacauugcaagccaccaccagguaga

SEQ ID NO: 167837 - RNA, 46 nt, Homo sapiens
aaacuccccggccccgcuguagagggaccuucagcgaccgggccag

SEQ ID NO: 167838 - RNA, 62 nt, Homo sapiens
uagggguucgcuggcugagcacacaugaucccaauaucacauggagcacucgaucuaucguc

SEQ ID NO: 167839 - RNA, 77 nt, Homo sapiens
uuugauucugaauacugccgcuaccacugccggauguauucuccaauaccaccaucgcucccaccaccagcaccaca

SEQ ID NO: 167840 - RNA, 128 nt, Homo sapiens
aagaccaagcacaccuggcaacguacacugaauucguaccucaaauaccuggauaccaaacauaccccacauaugccgcguacccgaccuacccaguaggauucgccugguacccagugggacgagac

SEQ ID NO: 167841 - RNA, 119 nt, Homo sapiens
ggacaaggaagaucacuauauguaccugugaugaucacuuggaauccacacugguaccgccagccuccgguaccacaguacccgccgccacagccgccgccuccaccaccaccaccgcc

SEQ ID NO: 167842 - RNA, 117 nt, Homo sapiens
auccuaaagcaccaaaagaccuucaacauuuucugagagcaacagaguauuugccaauaaaugaucucucauuuuuccaccuugacugccaaucuaacuaaaauaauuaauaaguuu

SEQ ID NO: 167843 - RNA, 40 nt, Homo sapiens
caaacgcaggaaaugcugauuucuuuauggagggggagac

SEQ ID NO: 167844 - RNA, 67 nt, Homo sapiens
aaggagcagcaacucgacugguucucccaggagcaggaaaaacccuugugacaugaaacaucucagg

SEQ ID NO: 167845 - RNA, 52 nt, Homo sapiens
caaaucacauguacccaaugacuccggcuuugacacaacaccuuaccaucau

SEQ ID NO: 167846 - RNA, 51 nt, Homo sapiens
augaaaugugaccaccucucaaucaccuuugagggcuaaagaguagcacau

SEQ ID NO: 167847 - RNA, 78 nt, Homo sapiens
agaaaugauuuagcacccagauucacacuccuaugccuggaagggggacaucuuugaagaagaggaauuagggcugug

SEQ ID NO: 167848 - RNA, 54 nt, Homo sapiens
agacuccauuuugcugccacacacagagauguaagaggcaggcuuuaauugcca

SEQ ID NO: 167849 - RNA, 69 nt, Homo sapiens
cgacaagaacgauuagggaaaauaugcugcuguggguuaacaacucagaaagucccugauccacauuug

SEQ ID NO: 167850 - RNA, 47 nt, Homo sapiens
gcccaaauuuacauuguuaauuaaaucaagaaggaagaagaucuaag

SEQ ID NO: 167851 - RNA, 49 nt, Homo sapiens
gaugagacugaaaguucuuuguuguuuuagauuguagaaugguauugaa

SEQ ID NO: 167852 - RNA, 40 nt, Homo sapiens
guaauuuuaagugggugggguuauuuagaauguuagaaua

SEQ ID NO: 167853 - RNA, 46 nt, Homo sapiens
gaauggcuuucccaacgggagacgucaauaacuucgugguuggcag

SEQ ID NO: 167854 - RNA, 61 nt, Homo sapiens
uggugugugguuguucuaaauuauggagaugcagaguugaggguuuuuuguuuuguuuugu

SEQ ID NO: 167855 - RNA, 36 nt, Homo sapiens
uaugauauuagggauuugcuucaaaauaagcaguug

SEQ ID NO: 167856 - RNA, 53 nt, Homo sapiens
gagcucaaggauguugcugcuguggaagagccugugaaggagaguagaaaauc

SEQ ID NO: 167857 - RNA, 46 nt, Homo sapiens
agagagcaaaggauuggaugccccuauaagaucaaagaacaaggau

SEQ ID NO: 167858 - RNA, 28 nt, Homo sapiens
gaggaagacaguuacagccacauuaugg

SEQ ID NO: 167859 - RNA, 24 nt, Homo sapiens
gccacuccagaauaguaccagauc

SEQ ID NO: 167860 - RNA, 46 nt, Homo sapiens
uucuuucagauucaggaugauuaccuugaccucuuuggggacccca

SEQ ID NO: 167861 - RNA, 46 nt, Homo sapiens
uuggcagauucacugaaaagagguacaaaucuaucgucaaguacaa

SEQ ID NO: 167862 - RNA, 383 nt, Homo sapiens
cuccaggcugggugcgguggcucacaccuguaauccuagcacuuuggaaggcugagguggguggaucaccugagguugggaguucaagaccagccugaccaacauggagaaaccccgccucuacuaaaaauacaaaauuagccgagugugguggcauaugccuguaaucccagcuacucgggaggcugaggcaggagaaucacuugaaccugggaggcagagguuguggugagccaagauuccaccauugcacuacagccugggcaacaagagugaaacucugucucaaaaaaaaaaaaaaaaaaaagaaagaaagaaaaaaaagaaaaaauagggcugcucugggcaauagagcuucagcaggugguagauacauacuucca

SEQ ID NO: 167863 - RNA, 28 nt, Homo sapiens
ucugauaccaccagaucuguccccggcg

SEQ ID NO: 167864 - RNA, 45 nt, Homo sapiens
ugcugauagucuccagcaggcccugaccgugggcuggugugugga

SEQ ID NO: 167865 - RNA, 42 nt, Homo sapiens; identical to SEQ ID NO: 88092

SEQ ID NO: 167866 - RNA, 42 nt, Homo sapiens
gcggggccgccugggggagggggccggcggaggcccgggcgu

SEQ ID NO: 167867 - RNA, 42 nt, Homo sapiens
ccacgaacaaaggagcagccaacacuguagcgaaaagcuaga

SEQ ID NO: 167868 - RNA, 70 nt, Homo sapiens
cguagacaccucaacccggggcucucuuuuaaaguucagcaagagucacacacugagaaggaaccggugg

SEQ ID NO: 167869 - RNA, 69 nt, Homo sapiens
acugacggagaaccucuccagggugugugugugugugugugugugugugugugugugugucaaguucca

SEQ ID NO: 167870 - RNA, 68 nt, Homo sapiens
cuaauccugacugaguuuuugaggcagccuucuauucccacucgcaccaacccagcacgcuuaccaaa

SEQ ID NO: 167871 - RNA, 44 nt, Homo sapiens
ugauccacuugggcauccaguaauggcucagccagucagcccgg

SEQ ID NO: 167872 - RNA, 45 nt, Homo sapiens
cuucaauacuccuaaaaccaaagaaggauauuacuaccgucaagu

SEQ ID NO: 167873 - RNA, 46 nt, Homo sapiens
uaggaguauugaagggaaauuucugggcugcauuugccaucauugc

SEQ ID NO: 167874 - RNA, 50 nt, Homo sapiens
uuaagccauuuugcucuuauaugcuuauucuuacagguugaugaugcaau

SEQ ID NO: 167875 - RNA, 96 nt, Homo sapiens
caucuccugagagagacguuugaggauuccaaucugauacccaaagagauucucuggcgaccaaaagaagccuucagugauggaauaacuucaguu

SEQ ID NO: 167876 - RNA, 45 nt, Homo sapiens
cuagaucaucgauuuucuuccuauuacuugucucugccaccagaa

SEQ ID NO: 167877 - RNA, 46 nt, Homo sapiens
uucugagggaacucuauuuguuugauguucuccgcgcagaucgaac

SEQ ID NO: 167878 - RNA, 82 nt, Homo sapiens
ggaagaacacagauagcguggugaucuucucuggagaaggaucagaugaacuuacgcaggguuacauauauuuucacaaggu

SEQ ID NO: 167879 - RNA, 45 nt, Homo sapiens
gcccuccaaaacaucacaguaaauaagcagauagacaggauagcu

SEQ ID NO: 167880 - RNA, 40 nt, Homo sapiens
gaaugcaaauuaaaucccuauguuacugauuauuuaagac

SEQ ID NO: 167881 - RNA, 48 nt, Homo sapiens
auuaugaaguccuuuuuaacucugaggaaggcauucaggcucuggaug

SEQ ID NO: 167882 - RNA, 45 nt, Homo sapiens
aaaaaggacuucauaauguucacuuccaauaugaucugccaccuu

SEQ ID NO: 167883 - RNA, 116 nt, Homo sapiens
agaauaacauccuggauauaaaauuaggcauuuaagaaggaccaaaaaagaccaagcuuagcgugggaccauguuggacuagagagagaugagguggguuagguaaaauagguaga

SEQ ID NO: 167884 - RNA, 69 nt, Homo sapiens
cugcuagaaagguaaggugcugucucugucccuuguguaguguaguuagaguagacuuguuauuagaau

SEQ ID NO: 167885 - RNA, 51 nt, Homo sapiens
uacacuacacaagggacagagacagcaccuuaccuuucuagcagccaguaa

SEQ ID NO: 167886 - RNA, 100 nt, Homo sapiens
uugguugcugccacucuguugaagcagcugaaagaagcccaaguacaguauccucuccagacauuugcaauuggcauggaagacagccccgauuuacugg

SEQ ID NO: 167887 - RNA, 48 nt, Homo sapiens
aguuuauaaaacuuggcggauuuuaaauaguaaaacuaugaucuuggu

SEQ ID NO: 167888 - RNA, 124 nt, Homo sapiens
ucauguguguuuaauugaaaugauuuguagccaucccuuugguuuuuacuauaaaauauuuacuguaugauuuacucuuuccuucauuauaggauggaaaugauuuuuuauaagcuguauuuaa

SEQ ID NO: 167889 - RNA, 47 nt, Homo sapiens
aggauccuuuuuaauaaugcuguaaagaaacguuugaugacagacag

SEQ ID NO: 167890 - RNA, 34 nt, Homo sapiens
uauuucauuucaauaacuaauccagcccaagauu

SEQ ID NO: 167891 - RNA, 70 nt, Homo sapiens
aauaucaucacugucgggauguaccccugcacgcccucuaugacaauguggagaaacucuuuccagguag

SEQ ID NO: 167892 - RNA, 65 nt, Homo sapiens
uccuggacacuaugaaguuuuggauuuaaagccaaauggcaaaguugcauccguggaaaugguua

SEQ ID NO: 167893 - RNA, 47 nt, Homo sapiens
caacuuugccauuuggcuuuaaauccaaaacuucauaguguccagga

SEQ ID NO: 167894 - RNA, 61 nt, Homo sapiens
aauaauaaauuuuucuauagauuuucauuauugucuugguuguacguuuucuuuuaaauua

SEQ ID NO: 167895 - RNA, 49 nt, Homo sapiens
uagagauacauauggagucagaccuuuguuuaaagcaaugacagaagau

SEQ ID NO: 167896 - RNA, 44 nt, Homo sapiens
acagcauuuugaauuugaauaccagaccaaaguggauggugaga

SEQ ID NO: 167897 - RNA, 25 nt, Homo sapiens
cuaauaucaccgaaugcuuuauggu

SEQ ID NO: 167898 - RNA, 44 nt, Homo sapiens
ggugcagcauuggaguuugguuuuaggagaguaggaaguaauac

SEQ ID NO: 167899 - RNA, 51 nt, Homo sapiens
accuaauauccaguuaauacuuaaaugaaauuucccuaagugucccaagaa

SEQ ID NO: 167900 - RNA, 42 nt, Homo sapiens
uggcgguaguugacccgcuguuuggaaugcagccaauucgag

SEQ ID NO: 167901 - RNA, 48 nt, Homo sapiens
uaugaagauugcacacagagguccagaugcauuccguuuugagaaugu

SEQ ID NO: 167902 - RNA, 71 nt, Homo sapiens
uuuauuagggauguuguugguguauaugucucaccuacuuugcuuccuuacugaacaaugcaacuuugaga

SEQ ID NO: 167903 - RNA, 34 nt, Homo sapiens
ccgggugccaggcugaagaccgcauccuccaccc

SEQ ID NO: 167904 - RNA, 128 nt, Homo sapiens
ggcgcgaggacuucccgcucccggagccuuagcgaucugccacagcguucggcugcguacccggccucaauuuuguggacauguacccuccucuucgucguggguccuucccuugugcccgcucgcgc

SEQ ID NO: 167905 - RNA, 73 nt, Homo sapiens
gugugucaaggguuaauaaacaucaggccugggcugagaagcugacucaggauucugauucccuggagacuac

SEQ ID NO: 167906 - RNA, 50 nt, Homo sapiens
uauauccguuuaaacgauagcucuccauucucaccuuuccacaggcccug

SEQ ID NO: 167907 - RNA, 51 nt, Homo sapiens
aguuucuuuugaaugccucaguccuugauguuuggcuccuaaaaaaaaagg

SEQ ID NO: 167908 - RNA, 43 nt, Homo sapiens
ggagagcaccagccuuuaaguuccuuggcaguuaccucagcua

SEQ ID NO: 167909 - RNA, 80 nt, Homo sapiens
acuauuuaaggcagcauuuagcaugccuaugaagcaccaggagaacuuauuaaaaugcugauucugagucaguaggucug

SEQ ID NO: 167910 - RNA, 47 nt, Homo sapiens
aaagcuacuugggcccagcguuguaacaaaguguuguuuaugaguuc

SEQ ID NO: 167911 - RNA, 46 nt, Homo sapiens
cuuugggagaagauuuaagccuuauguaaagcagggcuacaugagu

SEQ ID NO: 167912 - RNA, 46 nt, Homo sapiens
agcacuggggagaugcauggaaauuaugaauguagaagcaggagau

SEQ ID NO: 167913 - RNA, 66 nt, Homo sapiens
aucccuuugugccagaacaccauuuaauuaaagguuaucuaccuagaacguuuugguacuggaauu

SEQ ID NO: 167914 - RNA, 56 nt, Homo sapiens
aacaacaaggacucuuccuuagucuuuuuaaauagaguggcaguauaacaaaauag

SEQ ID NO: 167915 - RNA, 63 nt, Homo sapiens
gcucugaucuugcaguuucuuuucacuauguugauucuacaaccauguaugaguuagaauacc

SEQ ID NO: 167916 - RNA, 51 nt, Homo sapiens
aaccuaccuuaccugaacguauacuaaaggaaauuagucaagcaaacaaaa

SEQ ID NO: 167917 - RNA, 52 nt, Homo sapiens
uuaaagcagaguuuuaaaauuaguuuauaggaucugagguggcuauuaguua

SEQ ID NO: 167918 - RNA, 41 nt, Homo sapiens
caguaaauuugcuaacugguuauuuucacaauuuucuugaa

SEQ ID NO: 167919 - RNA, 45 nt, Homo sapiens
auuaagucagaaaaauguauuuuuaaauguuucuugaagugccuu

SEQ ID NO: 167920 - RNA, 41 nt, Homo sapiens
aucuaagcauggcuguucuagcuauauacacaaacccagaa

SEQ ID NO: 167921 - RNA, 46 nt, Homo sapiens
uuaguuugugaggaugaugaaauugugagguauaaaaaaaguucag

SEQ ID NO: 167922 - RNA, 43 nt, Homo sapiens
gucuuucagaauaauggcaaauggaaaucaaccaguaacaucu

SEQ ID NO: 167923 - RNA, 48 nt, Homo sapiens
aauagugcuccaucacucgcauucuucuagucaagagucaguaccaaa

SEQ ID NO: 167924 - RNA, 42 nt, Homo sapiens
gacccuguccucggcccuguccgcgccgaagcagcccgggac

SEQ ID NO: 167925 - RNA, 108 nt, Homo sapiens
ucucuuucucauuugccuuugcauucaagcaaagaagaugcuuaugauggagucacaucugaaaacaugaggaauggacugguuaauagugaaguccauaaugaagau

SEQ ID NO: 167926 - RNA, 54 nt, Homo sapiens
aagcuggcugugcccuaaugaguuaaagaaacucugugaagagggaugguacgu

SEQ ID NO: 167927 - RNA, 39 nt, Homo sapiens
gaauccugagacacuguagcauaucaaggucagugaaag

SEQ ID NO: 167928 - RNA, 46 nt, Homo sapiens
aacugguggcauugauuccauauagugaucagagauuaaggccaag

SEQ ID NO: 167929 - RNA, 87 nt, Homo sapiens
guugaaaacaucacugcccaaguucaauuuucaaaaacaguuauuggaaaggcacgcuuaaacaacauaaccauuauugguccacuu

SEQ ID NO: 167930 - RNA, 46 nt, Homo sapiens
ucccauuguuauaugguaguauuucagcuacacaauauuuuagcuu

SEQ ID NO: 167931 - RNA, 48 nt, Homo sapiens
gguuagugauugccuaacacuuauaagccaaaauaaucuuugcaaaau

SEQ ID NO: 167932 - RNA, 86 nt, Homo sapiens
uuauuauaucuacuuuuaguggaguuugagucagaaaaaaacaagaauuugaaacaaguaaaaagauagaagagaaauaaagaugg

SEQ ID NO: 167933 - RNA, 42 nt, Homo sapiens
uuuagcuuuucuuaggucaauguccagugugcuuuuuuccau

SEQ ID NO: 167934 - RNA, 70 nt, Homo sapiens
uuuuagaguucuuuccuauguuuuucuuacgugauuucccacaguuccaugaguccaacaaaggagagug

SEQ ID NO: 167935 - RNA, 52 nt, Homo sapiens
auccauugucuaaggaaauuauuuauaaauaauagagauuaauuuauuugag

SEQ ID NO: 167936 - RNA, 45 nt, Homo sapiens
aguagccuccaucaugacacacuuacuacauuuaugaauugagca

SEQ ID NO: 167937 - RNA, 36 nt, Homo sapiens
uuuuaaauuuuuugucuuuugacuuggaguacaaau

SEQ ID NO: 167938 - RNA, 58 nt, Homo sapiens
ccaauaauuauuacauucuaaauuuucaucuaugagaaauaacaaacaagaagggaau

SEQ ID NO: 167939 - RNA, 41 nt, Homo sapiens
uugugguuguaauuuuuaaaacuuaguguuuugucugauua

SEQ ID NO: 167940 - RNA, 79 nt, Homo sapiens
aauuuguuuacuguuuuaagaaaacuaccaguuuacuuacagaagauucuuuuuuccaaacaguagguuucauccaaga

SEQ ID NO: 167941 - RNA, 45 nt, Homo sapiens
cacaggacaaggcuucaaacuugucaaaucuuaauuuggacccca

SEQ ID NO: 167942 - RNA, 46 nt, Homo sapiens
uugggugaaagaagugaggaaaauuaaugaccaguauauugcagug

SEQ ID NO: 167943 - RNA, 46 nt, Homo sapiens
aaacuaaaagcuuuccucgaacuucggacaguggauggacccagac

SEQ ID NO: 167944 - RNA, 46 nt, Homo sapiens
aaaguauauuuuacucacaggacagauuacaauagccuugauagaa

SEQ ID NO: 167945 - RNA, 46 nt, Homo sapiens
cuugacauuuauuuuaguggacuuucaguaacugaaagauggaaac

SEQ ID NO: 167946 - RNA, 46 nt, Homo sapiens
agaaucaauuuauugguugcuauaugcuuaggucuauacguaagau

SEQ ID NO: 167947 - RNA, 54 nt, Homo sapiens
gcgguuaauuuuuguaacgugagggaaaagcccacauugcugguuacaugugua

SEQ ID NO: 167948 - RNA, 41 nt, Homo sapiens
acaggacuuggugaggauuaaauguagaugaugguggagag

SEQ ID NO: 167949 - RNA, 66 nt, Homo sapiens
cagggaaauguucaacaugaugguggccaaaauugggauggugacccuggggacgagaaguagaaa

SEQ ID NO: 167950 - RNA, 56 nt, Homo sapiens
agggugaugggacgccauuggagcauuuuacauaguggagugcuaaauuuugguuu

SEQ ID NO: 167951 - RNA, 51 nt, Homo sapiens
auuugugcaguuuguaauugaaaggucaguaagguuggaaaauaaagugug

SEQ ID NO: 167952 - RNA, 58 nt, Homo sapiens
acuuccuccaggacaggacucguuaaaaaauagcagcuucacugcuagaggcggcuaa

SEQ ID NO: 167953 - RNA, 45 nt, Homo sapiens
auguuuaaugcacuccccaaucaagacgcacucuacuggaagagg

SEQ ID NO: 167954 - RNA, 45 nt, Homo sapiens
uugaaaaagugguuguugagggcaaugacagccccagcauugaag

SEQ ID NO: 167955 - RNA, 46 nt, Homo sapiens
auugcagacauguauggcuguuugguaguauucagaaacaucacag

SEQ ID NO: 167956 - RNA, 45 nt, Homo sapiens
auuuuugggucucagagacccacgagcccacgccgcacaggccgg

SEQ ID NO: 167957 - RNA, 84 nt, Homo sapiens
acuuuacaaguguuaccguuuuaaagucuuaggacaaaaacacuacguuaagcucagguacaaacugggugacaaaaauuaaau

SEQ ID NO: 167958 - RNA, 41 nt, Homo sapiens
agaccauuaauuugauuuuggaugaaagccaugaacgagua

SEQ ID NO: 167959 - RNA, 48 nt, Homo sapiens
guccauacauaguuaauagaaucuugcauucauuucuuucguaaauau

SEQ ID NO: 167960 - RNA, 43 nt, Homo sapiens
guggugggaguguuugcacaauggauauuaguaaaugcagcaa

SEQ ID NO: 167961 - RNA, 49 nt, Homo sapiens
uuuuauuuuuuggaagaaugguacucagugcuuugauuugauuaguaag

SEQ ID NO: 167962 - RNA, 135 nt, Homo sapiens
aagaaacagauucugcgcuugauuuggggaauauucgagcagaaccuuuaaauucuguagcacacugaggaaaaacuacauacuuggacaucuguaaaucuuuguacagaaacugauuauucugaggaugauaua

SEQ ID NO: 167963 - RNA, 47 nt, Homo sapiens
aaguaguacuuuuugauacuuuaguauuuauggaaacuaguggaaaa

SEQ ID NO: 167964 - RNA, 49 nt, Homo sapiens
ucauuaguuaacaguaugccaucuccuacuuacuggcaucaucugggga

SEQ ID NO: 167965 - RNA, 36 nt, Homo sapiens
gggagagguuugcuagauccuaagagaaacucauag

SEQ ID NO: 167966 - RNA, 46 nt, Homo sapiens
ucagugaauucuuuaugaaugcaaagaaaaauaaaccugaguggag

SEQ ID NO: 167967 - RNA, 45 nt, Homo sapiens
aaaauguuuucauucaggacuacuauaaagcuuuggaagaugcag

SEQ ID NO: 167968 - RNA, 44 nt, Homo sapiens
aaauauccuagugcuuuauagcuuaaguuaauucuuguggucaa

SEQ ID NO: 167969 - RNA, 51 nt, Homo sapiens
aauaauauauuuaauaaaaugaaacaauccuuaaaugcagaggugaaguga

SEQ ID NO: 167970 - RNA, 48 nt, Homo sapiens
gagcuuuucaacugagccaaacaauaagcuauuuuguaauaggcccuu

SEQ ID NO: 167971 - RNA, 48 nt, Homo sapiens
ugcuuaaccuaauguuuggcauauaauuaagucugaaugguugguaag

SEQ ID NO: 167972 - RNA, 43 nt, Homo sapiens
caauuaccauggcagcugcucaagcaguucaggcuacagcuca

SEQ ID NO: 167973 - RNA, 46 nt, Homo sapiens
uuuacauauauugaugcuaucaaugaaugucuauuuaagaugaagg

SEQ ID NO: 167974 - RNA, 54 nt, Homo sapiens
caucaucuucggcacuuaugacaacauuaacacagaaugccaguucaucagcag

SEQ ID NO: 167975 - RNA, 46 nt, Homo sapiens
uccuagauggagacugcugccuucucaccggguccucacaugauag

SEQ ID NO: 167976 - RNA, 40 nt, Homo sapiens
uguuucugcauccagauagagugcaguucaugagggaggg

SEQ ID NO: 167977 - RNA, 39 nt, Homo sapiens
uuuagugaucaaacugccauucacaguguaaggcagcac

SEQ ID NO: 167978 - RNA, 93 nt, Homo sapiens
ggaggcaugcuuuaauaucacaauaauuuugauuuguaaaccaagaaauuaauccuguguuuaucuaacuucauaauagcaauuauugcccga

SEQ ID NO: 167979 - RNA, 44 nt, Homo sapiens
ugcuaugaaaauaucauggaauaauagggauuuuaggguggaua

SEQ ID NO: 167980 - RNA, 48 nt, Homo sapiens
acaauaaggauacaaacaaauaugaaggauggccugaaguuguagaaa

SEQ ID NO: 167981 - RNA, 42 nt, Homo sapiens
uggagucaaacaggacaugcuuaauucuuccagcaaccaguu

SEQ ID NO: 167982 - RNA, 69 nt, Homo sapiens
uuuacuuaguuacacagaagauaucuaaaaauaauaauaaaauaaucaaccaaauucuacauaggcaga

SEQ ID NO: 167983 - RNA, 48 nt, Homo sapiens
uacuggcuauguuacaugauuuuaaacuuuugaaauauaaagauuuuu

SEQ ID NO: 167984 - RNA, 70 nt, Homo sapiens
acaggauaauuuucuguucauuuugaagaaaauuauucacuaaaauaauauauuugacauaaauuuuuaa

SEQ ID NO: 167985 - RNA, 43 nt, Homo sapiens
agauugccucugggcagcauuagauugucuucuagcaaaaccu

SEQ ID NO: 167986 - RNA, 45 nt, Homo sapiens
uuauagaaaagcgcaaagagaccaaguuccaguccaucucacuac

SEQ ID NO: 167987 - RNA, 45 nt, Homo sapiens
ucagauguggcaccauuuauugaguuucugaaggccauacaagau

SEQ ID NO: 167988 - RNA, 37 nt, Homo sapiens
aaucuuuggcaucuuugcuguggaaagaaacugagua

SEQ ID NO: 167989 - RNA, 45 nt, Homo sapiens
acaggagaaguauuagacacuaaauauuuugacauguggggagga

SEQ ID NO: 167990 - RNA, 46 nt, Homo sapiens
uuuuucauuaucagccacauucuucugauagcuuaauuaguaugaa

SEQ ID NO: 167991 - RNA, 46 nt, Homo sapiens
ucaauuucucccccuucaguuuaaugagugguguuaagaauaaugu

SEQ ID NO: 167992 - RNA, 30 nt, Homo sapiens
gagauuaucuuuuguuugauaccuuaagaa

SEQ ID NO: 167993 - RNA, 41 nt, Homo sapiens
ccuauagcuucuuuagugcuuucucucuuuacacaaaaagu

SEQ ID NO: 167994 - RNA, 61 nt, Homo sapiens
gugucucaaugggggcaguuuugcuuuccagggaacauuguaauuuuggguugucauagcu

SEQ ID NO: 167995 - RNA, 44 nt, Homo sapiens
aaaaaguuaucugguugcuguguaaaauaauuaaggaaguggaa

SEQ ID NO: 167996 - RNA, 46 nt, Homo sapiens
cuuggucuucgagcaggaggaagaagccugcucgaaggcccuaaga

SEQ ID NO: 167997 - RNA, 45 nt, Homo sapiens
auccauccuuauuucaggaaccauucugccauuaccaugagagau

SEQ ID NO: 167998 - RNA, 288 nt, Homo sapiens
cagacuguuuacuagcagguuuuuuauucacagauuaaaaccguaaacaacaaaacacacucagaaaaaaagcucaacuguuuacccacauccugacccuuauucacuucucuccagaucuuccugaucuuggggccuuagaguauacucuucugucuaggauggucuuuccucacucuucacuuggcugucuuccuucuugaccuuugguucucagaguacacaucacugucuuagaagcuguucucuaucccucagccuaauguugaacagcuaaagaucuaaggu

SEQ ID NO: 167999 - RNA, 64 nt, Homo sapiens
uaaaucacaggaacaaaguucuuuuagaauaccuaacccauggaugauuuuggacaucuauucu

SEQ ID NO: 168000 - RNA, 24 nt, Homo sapiens
agaccuaggcagcuuuuccuagcu

SEQ ID NO: 168001 - RNA, 46 nt, Homo sapiens
uucauggucaccaaauggaacagcagagagagcauuuucaucgugg

SEQ ID NO: 168002 - RNA, 48 nt, Homo sapiens
uuaaaaauaaacucauaguuagauaaaauauauuugcccuaaugcaga

SEQ ID NO: 168003 - RNA, 44 nt, Homo sapiens
uauuauaugguauuauuuuagaaaaauaaaacacauuucuagaa

SEQ ID NO: 168004 - RNA, 46 nt, Homo sapiens
cauuuuauguuauuucucaaguauuugaaauaaaaauggaugcaag

SEQ ID NO: 168005 - RNA, 105 nt, Homo sapiens
ucuuuaucuugaugaauuguuuguauaauuuuuauguaucucauguaaaauuaagaucuaauagauacaaaguagaaauguauugaucuuaaaaaauuuauaaac

SEQ ID NO: 168006 - RNA, 46 nt, Homo sapiens
gcaacuuguaaguugcucuugaaaauaggaagcagauuuuggaggg

SEQ ID NO: 168007 - RNA, 65 nt, Homo sapiens
uaauuauugaugguuuucagccugaaguuuccauuaaguuuuugcuucccucacccauacaagau

SEQ ID NO: 168008 - RNA, 38 nt, Homo sapiens
acuuuuuggagcaaauguauaaauguacuaaguugagu

SEQ ID NO: 168009 - RNA, 85 nt, Homo sapiens
guaaagaaguuuaguacguccaucugaggcccuaguucaggcgcucuuuccagcugcaguguuucauuguccagcgacauugugg

SEQ ID NO: 168010 - RNA, 83 nt, Homo sapiens
uagaacaaugacuccuuauucacauaguagcuugauuucuaccugaguaauaaaacuucacuaaauuagaucagaguagauag

SEQ ID NO: 168011 - RNA, 76 nt, Homo sapiens
acaauuuugucaauauagagugauguuucugugguuuaugugauuuaguccacuucccaaggaaauaauggaagua

SEQ ID NO: 168012 - RNA, 163 nt, Homo sapiens
gaucucauauaugcugcuguuuuaaugcccccagcaacuagaggcuggugggaagauuacauaaaauaagggugugugugaauugcacugacauaaguauguauucauacuugguuuauguuaacuggcaagaaaucccccuccugguaaauaauuuuuuaug

SEQ ID NO: 168013 - RNA, 42 nt, Homo sapiens
ucuugucaugugaauuuuacuuuugaacuuuuuugguuuaga

SEQ ID NO: 168014 - RNA, 57 nt, Homo sapiens
cugggaggcggacggagccggggcucagguucggggagggauggaggaggccgggga

SEQ ID NO: 168015 - RNA, 469 nt, Homo sapiens
aagauggacccgcuacggaacgaggugcaagggcggcaggguuacugcuguggucggccagcggugcgaauuggggcgggcuaaaggacgggcgguggcuggccgggcgcccagugcgccugcgcagagacagagugcccagugcgccugcgugguugcgaucggguugccaaacuccgguuaggacgccugcgcguugugucgccgacguuguguagucuccccugggaaaggagggucaggcgaguccacgugagggaagcccccgcugugcgcggagcccucugcugggcggagggggagugccagcccccaggagcuaauccccggcugauggcgcagggcgcggggcuuggccgucuagugugaugaaggaggcgacccccaaggugggaaggcgcacggguugggguuugaggguggaugauuggugacggaggguguaucuucaggaggagguucgagugaa

SEQ ID NO: 168016 - RNA, 45 nt, Homo sapiens
ccucggccuccccuucagcagcuuugaccacucuaaagcccacua

SEQ ID NO: 168017 - RNA, 861 nt, Homo sapiens
uccuugcuuuguagaugaucuuucauuuugcuugaaucagcaguccagaagaaaaugauauauuucuguauuuuaaguguuuggguuuuuguuuuuuuuuuuuuuuuaaugacuuccuugcuuuucaagagaaacgugagucucagaggacuuuggaauguuuggaauguuaaguuuauaccaggucauuguuuaugcugcaugugaguagcuuggguaucacaagauugaaaaaaaguuaaacuauuuuuuuuuuuuuugagacggagucuugcugugucucuaggcuggagugcaguggcguuaucucggcucacugcaaccuccgccucccagguucaagcaauucuccugccucagccuccagaguagcugggacuagagacgcgcaccauaaugcccaggcuaauuuuucuauuuuuaauagagacaggguuucaccuguuggccaggauggucucgaucucuugaccucgugaucugcccaccucagccucccgaagugcugggauuacaggcgugagccacugcacccagccaaguuaaacucuuuucaagaguuuaagacuaugucagacauuuaauuguagaauguagaaucaaauauuuucaguguuuauauugaagcauauauucauuguuuucaucugugaaacauuagugaugcacacauuacuuuccgaugucauuaacugggaauucgcuuuauuauuacuacauuauuaucuucugagugauaugguuaauuugguucaauaauaacuuuuuuuaaagguauggaucagcuuugcucaguuugaguugucuucaggaaaagaaggaaguuugacuaaaugcagacaaauuuaugaagaagcuaac

SEQ ID NO: 168018 - RNA, 1204 nt, Homo sapiens
caugccagaggugagcaucucaagucaaauauaauuuuguuugagauacguguuuagucuuacuuuagaugaccaucuaaauguggguguauuuuagaguauaacgaugaucuaacuaacuuagucucuucuacucagauuaggcuuguacguggaaagguggcugugggggacaggggaaguagcccucucauuagauaccagagcaguagacauccaggaugaugcccaggaugaacugggauaucaugggggugggugacgccccuucugcagcaggaaagccuaaaggggcuggggaagaggccaggcaaggaagaagccagcaggcuggcccacccggagaacgagggggauggagguaggaacugcacaucccuguauucucuaaaccaggauguccuugcaacuucuguugucacuguccugaaaguccucgccugccuucaguaguuaagcuugacccacaagguagcaccaaaccacagcuaggaaagauuugaaucucacaugagucguagaacucacccagccguuuuguuaaucucaugcacuaacaugacccugcauuuaaugguuuggcccccugauugcauuaauuaaggcagggcuuuggguaucacugaguucaucaguuguccucggcuccuccaccagacugccagcuuucagguguccaugccacgguuuauucauccuuauucccugccaggcugcaccgagccagugcgcaccuguucagugaaugcuuguugcacugaacucucauaauaacaaggaauguacaguagagguaagaacaugcauacuggcuaaccugggccuguuuucucucuggacgcucaauugcguguggcuagaauauggaguaccugggagaugcuuggcaaguuucucagcucuugauaagucaagcauuugaaaaacuuccaaagagaaucucuaagacugaauccaaggcccuuuuucuguaaucuggaauucuagccaaguuuuggccagcuuauagauaccaauguuauuuaucuuauccacauguguucuuuaguuguucaguaaaaauccuauguuccuagauguagguuagagugauacuucagcugugcuuuggaugggggcaugcugcuuuguaaaugucaagacugacccauuuacuuuucuuccuuaggugcuuuggaaaucauauauugauuuugaaauugag

SEQ ID NO: 168019 - RNA, 46 nt, Homo sapiens
uaugcacaguuugaaauacgacagaagaaucugucauuagccagaa

SEQ ID NO: 168020 - RNA, 45 nt, Homo sapiens
auuauaccaucuuugagaagaaguuuggugauaggcgggguauug

SEQ ID NO: 168021 - RNA, 46 nt, Homo sapiens
gaaaaaacaggacugugauuaguaacuggauaaaauacgcacaaug

SEQ ID NO: 168022 - RNA, 50 nt, Homo sapiens
cgaucaguggaaauggccaauauaauuauuaagugacuuugguguguuca

SEQ ID NO: 168023 - RNA, 45 nt, Homo sapiens
aacaggcugaacaugaacuaaaucuggcaagaaaaaugagggaau

SEQ ID NO: 168024 - RNA, 60 nt, Homo sapiens
aaccagauguuaaaaaauuagaagaccaacuucaaggcggucaauuagaagaggugauuc

SEQ ID NO: 168025 - RNA, 64 nt, Homo sapiens
agauucuugauguucuugaggaaaucccuaaaaaugcagcauauagaaaguauacagaacagau

SEQ ID NO: 168026 - RNA, 42 nt, Homo sapiens
ucggcggugcuuuucggggacucguucugcaugccuuaccgg

SEQ ID NO: 168027 - RNA, 45 nt, Homo sapiens
ugugcgucaccgagucguuggcgcugucauggcgggugugcugaa

SEQ ID NO: 168028 - RNA, 61 nt, Homo sapiens
cagcagagaguacccauucuucgaguucaaagcacaauuuuaaacauguaaaauggauaua

SEQ ID NO: 168029 - RNA, 46 nt, Homo sapiens
agacugacaaaaaccuuaauguaauuuacuuauaaugccagaagga

SEQ ID NO: 168030 - RNA, 47 nt, Homo sapiens
uauuuaugcauauguuuuaauugucuugauuuucuuguagaugaaga

SEQ ID NO: 168031 - RNA, 36 nt, Homo sapiens
uuuuauacauuaacagguugaaauuugucacauaga

SEQ ID NO: 168032 - RNA, 49 nt, Homo sapiens
caggauggugaugccauuuauugagauggagcagcagaccaggauggag

SEQ ID NO: 168033 - RNA, 46 nt, Homo sapiens
caggaugugauggugguguggagaguagcagugaaagaggugaaaa

SEQ ID NO: 168034 - RNA, 57 nt, Homo sapiens
ggccucucugaggaaguaguuuaugaaugguuucuaaaugaugaaaagauucaguuu

SEQ ID NO: 168035 - RNA, 49 nt, Homo sapiens
uaaaguacaauaauuuuagauauuagcaagugauaugaggaaaguaaaa

SEQ ID NO: 168036 - RNA, 41 nt, Homo sapiens
ugugggugcauuaauggaagugaugcagaaaaggagcaaag

SEQ ID NO: 168037 - RNA, 42 nt, Homo sapiens
ggccugccuucugauggggaccaucagguuccaacuacugca

SEQ ID NO: 168038 - RNA, 46 nt, Homo sapiens
aaggggagggccaccuccuccuccucccccuccacacaacucaggu

SEQ ID NO: 168039 - RNA, 55 nt, Homo sapiens
ccuagagauuauguuuugguaguucuuauuuuaauuuuuaacuuuuuucuaggau

SEQ ID NO: 168040 - RNA, 65 nt, Homo sapiens
gaguaagaccaguggaauaacagaguaacacaagguacacaaacaagcacuucagaaaugugaaa

SEQ ID NO: 168041 - RNA, 70 nt, Homo sapiens
guuggcuggucccagaagcaggagaugaccgagaagauguucccgaagguugaaaauggagagaagauug

SEQ ID NO: 168042 - RNA, 48 nt, Homo sapiens
ugagaagauaccuuugucuaguauagaggaaaaagaugagcacaaaaa

SEQ ID NO: 168043 - RNA, 39 nt, Homo sapiens
gaaauaugaugagggccugaauuaagagaguacuuuggg

SEQ ID NO: 168044 - RNA, 43 nt, Homo sapiens
cacaagaucauauuugacuuagaaaauuuucaggggaaaggug

SEQ ID NO: 168045 - RNA, 53 nt, Homo sapiens
aaauauauggaaacuauuuuuauaaagguuuaggggauuaaaggagagaaugg

SEQ ID NO: 168046 - RNA, 39 nt, Homo sapiens
aguaagauuuacaggucagaccaaauguguuaggcagaa

SEQ ID NO: 168047 - RNA, 42 nt, Homo sapiens
ugugcuuaccuguaguuuuacugguuucgaaaaauggcagau

SEQ ID NO: 168048 - RNA, 45 nt, Homo sapiens
ugauuagaaggaugaaacaagaggaguggcucaaaacgagaauuu

SEQ ID NO: 168049 - RNA, 75 nt, Homo sapiens
uuuguaucuugugccauccgguuggagauugaaucguuccauucaauuucagauguguuucauauuucggaauuu

SEQ ID NO: 168050 - RNA, 45 nt, Homo sapiens
cauuuuauaacuccuuuaaguaauauuagguaugccaaaccagau

SEQ ID NO: 168051 - RNA, 88 nt, Homo sapiens
uggugcugugcggccaauuccaaccccagauggccgguugggagcgagcaguucugcugugggaaggggaauguguguuguugacgga

SEQ ID NO: 168052 - RNA, 45 nt, Homo sapiens
guuucuacucuccuucccacugauuuuuuuuuuccccccauuggu

SEQ ID NO: 168053 - RNA, 58 nt, Homo sapiens
aggucggggaaggaaggugguuuuuaaucucccauuaggauuccaggagggaaugaag

SEQ ID NO: 168054 - RNA, 47 nt, Homo sapiens
uuucucuccaggauaguagagauuucucuauuucaccucaaccuaau

SEQ ID NO: 168055 - RNA, 45 nt, Homo sapiens
acaauagacauuuuagucuacgauaaccauguucauguggcaaga

SEQ ID NO: 168056 - RNA, 66 nt, Homo sapiens
aacaagaaaggaacaauaggaaaaaaaaugguuuuaaaaaagcaaagaagcaaaaaagcaagaagu

SEQ ID NO: 168057 - RNA, 44 nt, Homo sapiens
ccauugaaaagauauuugugaaguagaacgcguaaaauaggaag

SEQ ID NO: 168058 - RNA, 48 nt, Homo sapiens
agcaugcuaucuuauuucugguagaaauccuauucugguagaaaugcu

SEQ ID NO: 168059 - RNA, 47 nt, Homo sapiens
gugaaaauucaucuuauaaauguucaauucagugugauagaagcaau

SEQ ID NO: 168060 - RNA, 68 nt, Homo sapiens
gccuuuuaaaauauuaccuaaagcaguacuuuuucacaaauacagggcuacaaucuaaauaacaucca

SEQ ID NO: 168061 - RNA, 35 nt, Homo sapiens
agagaaauagcacugauauuuguguucaggaaaag

SEQ ID NO: 168062 - RNA, 43 nt, Homo sapiens
gcaauuaaaguuaaauugucagguuaaaguagauugcuauaaa

SEQ ID NO: 168063 - RNA, 55 nt, Homo sapiens
guauaaaaagaugcaaauuaugacgucaguaacaugaaguguggugggggguaga

SEQ ID NO: 168064 - RNA, 44 nt, Homo sapiens
aaacuucuguuucuaauuccuagccaacaaggagaagaaaauag

SEQ ID NO: 168065 - RNA, 66 nt, Homo sapiens
aacaaaguccuggaaccccucuccuguguuauauuauuauaauuuuauuaucacuuuuaugcaugu

SEQ ID NO: 168066 - RNA, 46 nt, Homo sapiens
aaaauaacuucacacucuaugagaaagaauuuaagcagagcuuaaa

SEQ ID NO: 168067 - RNA, 47 nt, Homo sapiens
ugagcagcaacuucaagaucaucucuuccaacagauucacaugacag

SEQ ID NO: 168068 - RNA, 44 nt, Homo sapiens
agaaccagagaaggccaagaguagagcaauagaaagcuuagacc

SEQ ID NO: 168069 - RNA, 89 nt, Homo sapiens
auaacaacacacacucucucucucucacacacacauacacacacacacacagacacaacuuuuuauccauguaauaacaaauaucuuga

SEQ ID NO: 168070 - RNA, 48 nt, Homo sapiens
aucguuagguucuuccuccagaaaggagguggaaaagggaaaaaccaa

SEQ ID NO: 168071 - RNA, 26 nt, Homo sapiens
aaguaauuuaguauccauagccagag

SEQ ID NO: 168072 - RNA, 56 nt, Homo sapiens
gaaaaaguuuccauguagguacagagacaugaaaucacauguagauuaagggaagg

SEQ ID NO: 168073 - RNA, 28 nt, Homo sapiens
auaauaagcaaauuaaacaauuuuuuug

SEQ ID NO: 168074 - RNA, 23 nt, Homo sapiens
cuccacaccaaauuugggaggcu

SEQ ID NO: 168075 - RNA, 42 nt, Homo sapiens
aaagauccacaaggucuuaauaaaaugauucuauagcuagaa

SEQ ID NO: 168076 - RNA, 50 nt, Homo sapiens
cccuguauuaaggcauuuaauguauuuaaugaguauuaaauuaguuucag

SEQ ID NO: 168077 - RNA, 26 nt, Homo sapiens
cguaagaaaaguaaaauucauauuug

SEQ ID NO: 168078 - RNA, 46 nt, Homo sapiens
gacgagguguucgccgucacauucgaaaaguacacaagaaaaagau

SEQ ID NO: 168079 - RNA, 46 nt, Homo sapiens
gacaaacgagaauauauuauuaagcuagaacccauagaaacuaauc

SEQ ID NO: 168080 - RNA, 41 nt, Homo sapiens
uaaacuaguaauuauaucaauacuuaauuguaauuggggug

SEQ ID NO: 168081 - RNA, 47 nt, Homo sapiens
uauggaaaagaaauuaauuacaaaacaguggauaagcuaguauagau

SEQ ID NO: 168082 - RNA, 50 nt, Homo sapiens
aauaagaauuagcuuuauaauaaauauaauuguguaauuguaauccagug

SEQ ID NO: 168083 - RNA, 49 nt, Homo sapiens
gagaguuuaauuugcccuaauuguaucuaguaaauggcagaaaaagaau

SEQ ID NO: 168084 - RNA, 44 nt, Homo sapiens
acccuauaauuuaaguacugugaaaaucuccauuuuagaccuga

SEQ ID NO: 168085 - RNA, 51 nt, Homo sapiens
uauuuauuucuguuuuuucauucuccaauucuagaauucuuguaacugaua

SEQ ID NO: 168086 - RNA, 81 nt, Homo sapiens
uguccaggcacagcuaagcuaauccugggcuuauuuugaauguuaucucaggauguguauguguucuggugguagcagugu

SEQ ID NO: 168087 - RNA, 65 nt, Homo sapiens
aaucuguccacauuuggauuaugaauacugggugagucuccagaggagaucaguauauuccugau

SEQ ID NO: 168088 - RNA, 54 nt, Homo sapiens
cccuuaaaaaaaaguacugcaagugucaccuuaaaucauuuccacaagaucagu

SEQ ID NO: 168089 - RNA, 46 nt, Homo sapiens
gugcagucuuuuguccaccuccccaccugcaaauggcccaucccca

SEQ ID NO: 168090 - RNA, 46 nt, Homo sapiens
gucucuauagucuccagcaaguccuucuugcucgggccgcccccga

SEQ ID NO: 168091 - RNA, 43 nt, Homo sapiens
gagucgugauuguccaccuaaccagagaucagggaaacuagca

SEQ ID NO: 168092 - RNA, 45 nt, Homo sapiens
gcccagggccucaucuuugugguggacaguaaugaccgggagcgg

SEQ ID NO: 168093 - RNA, 49 nt, Homo sapiens
cuuuuccucccccauagccacaggccucugcuccugcuccugccugcau

SEQ ID NO: 168094 - RNA, 45 nt, Homo sapiens
uuucuguuuuggguguacucuaggggccagguugggagggggaag

SEQ ID NO: 168095 - RNA, 31 nt, Homo sapiens
ugcugacuuuaggaccgacuucaggauucug

SEQ ID NO: 168096 - RNA, 44 nt, Homo sapiens
uauuuuccuguagaguaauaguuuccauugguacuaggaacugc

SEQ ID NO: 168097 - RNA, 49 nt, Homo sapiens
augaauaggaaaacaggagacacuacuuuucugccuuuugggagagagg

SEQ ID NO: 168098 - RNA, 46 nt, Homo sapiens
gauuuaucuggacucaggcugagcugaaggucugaaaucgucuagg

SEQ ID NO: 168099 - RNA, 68 nt, Homo sapiens
uucccaguggucuuaaaaugcccauuucccggcagguaagccugguagcuuuuaaucaagauuguaag

SEQ ID NO: 168100 - RNA, 46 nt, Homo sapiens
uuucugucaaaaggaagcauccaucuggcucuaguuauguuagcag

SEQ ID NO: 168101 - RNA, 138 nt, Homo sapiens
cugggcauuggagaaacagaauuuaaaaaguagaucaaauuucuauccuuauggcuuauggaggagucagacaauaaagaaguuaacaagaaauaagcaugaucauacaagauagugauaccagguaagggacuggga

SEQ ID NO: 168102 - RNA, 49 nt, Homo sapiens
aguuuggguuuaaccugaguuauuauguaauauauguguuuaaggguga

SEQ ID NO: 168103 - RNA, 52 nt, Homo sapiens
uuuuugcuuuuacagcagaaauuuauguggaaucacagguugugaacauucg

SEQ ID NO: 168104 - RNA, 43 nt, Homo sapiens
aaugaacagugguuucaguuggcauuuuuuaaaaauuaggaag

SEQ ID NO: 168105 - RNA, 90 nt, Homo sapiens
ugucauuuucagaugccauuuuugaaauguguaaucuaugauauaaacugguuuggcacauuuucuucacuuaugugcuuaucaugugug

SEQ ID NO: 168106 - RNA, 49 nt, Homo sapiens
aagaaacccuguguuacauuucauuuaggcaugcugaaacaaaguugag

SEQ ID NO: 168107 - RNA, 47 nt, Homo sapiens
cuuuaguuugagaaagaagauuaguggaaauaugguuuuccagugug

SEQ ID NO: 168108 - RNA, 47 nt, Homo sapiens
ugagagaaaggagcccagugauuuccuaaacaggucaucgcaucagg

SEQ ID NO: 168109 - RNA, 44 nt, Homo sapiens
auaggacagacauggucuuugcccuuacagaacauccagcauag

SEQ ID NO: 168110 - RNA, 45 nt, Homo sapiens
uaacuauugucuuaaaaccggggauauccaucuauaggaacacaa

SEQ ID NO: 168111 - RNA, 51 nt, Homo sapiens
aucgauauuuuggcucaugauucucauaucauagauuuaguauuugggguu

SEQ ID NO: 168112 - RNA, 74 nt, Homo sapiens
ucuuuaugugaagucucucuguagaugauuguuaugguccuccugagauuuaaacuccguauauguaaacugcg

SEQ ID NO: 168113 - RNA, 42 nt, Homo sapiens
uuucagccuuuguaaccacgugacuugugcccugaagccagg

SEQ ID NO: 168114 - RNA, 42 nt, Homo sapiens
aaagugacuuaggccagggucugugugcuuaagguguugggg

SEQ ID NO: 168115 - RNA, 38 nt, Homo sapiens
cacaguugcaaguggguucuaugccuggcaucuuugau

SEQ ID NO: 168116 - RNA, 51 nt, Homo sapiens
cgugcuggaaaucuugcucgccgggcagccgccacacaaccugaugcaaag

SEQ ID NO: 168117 - RNA, 42 nt, Homo sapiens
ugaggccaucgugagccuguggaccuagguaauagcccacug

SEQ ID NO: 168118 - RNA, 64 nt, Homo sapiens
auaucauaacuguaucccauguuaacaggacggugaaaucuuaccagaacuauccuaggugaaa

SEQ ID NO: 168119 - RNA, 41 nt, Homo sapiens
ccuuugcaagaccuccagugugguuuucucuuauugaccgg

SEQ ID NO: 168120 - RNA, 39 nt, Homo sapiens
agcaugaguucugugguuugaagagauuauaauagacaa

SEQ ID NO: 168121 - RNA, 56 nt, Homo sapiens
cagcccugggcauuuccagcucgagaguuccuucgaaagaagcugauugggaagga

SEQ ID NO: 168122 - RNA, 52 nt, Homo sapiens
agucuguuucacgauagaaaacaagacuccccaggggcgagaguauggcaug

SEQ ID NO: 168123 - RNA, 28 nt, Homo sapiens
uguucugggcuuuuuggauuagguagua

SEQ ID NO: 168124 - RNA, 52 nt, Homo sapiens
auucugcuaagacucuguuuuuaaugauagaggucucagaaaaaugaguuga

SEQ ID NO: 168125 - RNA, 41 nt, Homo sapiens
gucuugguguccucuuggagcagagaauaggacaucccuga

SEQ ID NO: 168126 - RNA, 47 nt, Homo sapiens
uuucuaggcacugagaauauagugugaauagacuuagcuucugcuga

SEQ ID NO: 168127 - RNA, 46 nt, Homo sapiens
cugagcagaaccggcuuucagaaugugaagaacaagcaaaggcagc

SEQ ID NO: 168128 - RNA, 46 nt, Homo sapiens
cgacgggaagcagauggcagugaaacuccagagccuuuugcugcag

SEQ ID NO: 168129 - RNA, 46 nt, Homo sapiens
uucgcacgcuguguggacuggucgauugcaguuuacacccggggcg

SEQ ID NO: 168130 - RNA, 116 nt, Homo sapiens
cgacauuucaacugucagcgucaagauguagaugcagauguagauguagauguagauguagauguagauguagauguagauguagauguaggugaacuuucuccauuugaugggau

SEQ ID NO: 168131 - RNA, 40 nt, Homo sapiens
gcacaucugacauguguauugucugauggaaaagaacagu

SEQ ID NO: 168132 - RNA, 49 nt, Homo sapiens
ugguuugacugguagucuuucuucuggauacaucuauaggguagaguag

SEQ ID NO: 168133 - RNA, 46 nt, Homo sapiens
cuaggggacuggggagaagagacauagcauacaaccuuagggagug

SEQ ID NO: 168134 - RNA, 45 nt, Homo sapiens
aaaaugugguccguaauggugcugaugagcuggcuucagacagua

SEQ ID NO: 168135 - RNA, 47 nt, Homo sapiens
aagaauuuguuuugguuugagagaagguguagaucuguccaguauua

SEQ ID NO: 168136 - RNA, 45 nt, Homo sapiens
ggugaugcagguucugaaugcugaugccauuguugugaagcugaa

SEQ ID NO: 168137 - RNA, 46 nt, Homo sapiens
cuucuccccagggggcuugagugcagugaggguugggauaugugag

SEQ ID NO: 168138 - RNA, 57 nt, Homo sapiens
aacaagagcugguauuacaugugcagauagacugauuuuuuuuuguagucaugacag

SEQ ID NO: 168139 - RNA, 47 nt, Homo sapiens
uaagcaguuuuuagggggauggggguguuauagcuuagguaggauga

SEQ ID NO: 168140 - RNA, 107 nt, Homo sapiens
gggaaggcuacuuugaggaagugacauuuaaggccugaagagauauuaggaauuagcuagauaaaaagugggagaagacaguuucugaccuggagagcagcaaugac

SEQ ID NO: 168141 - RNA, 72 nt, Homo sapiens
ucuuaggauacucaggaagggagagagaaaauggggcauaugaugaacugcaagugauuuuguaugacugga

SEQ ID NO: 168142 - RNA, 78 nt, Homo sapiens
ugggaguuagacagggaccacuuguugaaggcuuauaugccaugcauuuuagguuuugucuugaagaauuuugaauug

SEQ ID NO: 168143 - RNA, 72 nt, Homo sapiens
acagcauggguaaaaauaugggccugcccuaguuagaacaggcugguagaaucuccaaggaaaacaucaagg

SEQ ID NO: 168144 - RNA, 61 nt, Homo sapiens
cccucagcugguagucacccccugcuaccagccucuauucauuuccaucacccugucuuuu

SEQ ID NO: 168145 - RNA, 45 nt, Homo sapiens
accaaggaguauugcuguuucacaguagggucucuauucaguuua

SEQ ID NO: 168146 - RNA, 46 nt, Homo sapiens
uggagcugccuuuagcagcaucugcuucuccagcuggagaggcuug

SEQ ID NO: 168147 - RNA, 47 nt, Homo sapiens
gcccgauucugguuggacccccuuuccucuacuucauaccgcagcug

SEQ ID NO: 168148 - RNA, 55 nt, Homo sapiens
cucugugcagagacugaauucucccuuuuuaauagagucucaauacuagucauuu

SEQ ID NO: 168149 - RNA, 38 nt, Homo sapiens
ccaauagauagauggcuugcguuucugcuuucaucuuc

SEQ ID NO: 168150 - RNA, 45 nt, Homo sapiens
aaauuuaaagaagaaaauacaaauuacuuaaauuuaacugcccag

SEQ ID NO: 168151 - RNA, 42 nt, Homo sapiens
caccuaauuccuuaucuauuuguguuauuuagaagcaggcug

SEQ ID NO: 168152 - RNA, 54 nt, Homo sapiens
guugcaucuguuugcugcuuuuucccugaggucuuuuucuuaacucucuuccuc

SEQ ID NO: 168153 - RNA, 44 nt, Homo sapiens
gaugcacaggaagugugaguggagauauuuuaauuugugcacag

SEQ ID NO: 168154 - RNA, 57 nt, Homo sapiens
ugucugcaguuucaguaagagaaagaauggguucagggcuggugaucauucagugau

SEQ ID NO: 168155 - RNA, 77 nt, Homo sapiens
uggucauuagguacauguuugaauguuuucaauuugaagagauuccucuacagucugugggaaccucggugugcaag

SEQ ID NO: 168156 - RNA, 46 nt, Homo sapiens
uuuugcugaaugucagcaaacauuuacugucacugcucugauguca

SEQ ID NO: 168157 - RNA, 47 nt, Homo sapiens
gucccuugucagaugauaaccuuuaaucuugguccuuuugcccuaaa

SEQ ID NO: 168158 - RNA, 45 nt, Homo sapiens
cuuugcauucagcaugcaugagauguuuugcuuguguauagggag

SEQ ID NO: 168159 - RNA, 36 nt, Homo sapiens
ggagaaaguguuucaggaugggguggaacagggugg

SEQ ID NO: 168160 - RNA, 41 nt, Homo sapiens
uuuuuuuggacuaguagccuccaaaccuugaguauagacuc

SEQ ID NO: 168161 - RNA, 46 nt, Homo sapiens
uguagcuuuggcuuccuucugugggcugucauugaaggcucuugag

SEQ ID NO: 168162 - RNA, 45 nt, Homo sapiens
aauagagauuuaaaguuuuaauccaggaggacaggaauuaaguua

SEQ ID NO: 168163 - RNA, 47 nt, Homo sapiens
acucacucccaguuuuuuagggacaaauagugucccccaucagagcu

SEQ ID NO: 168164 - RNA, 48 nt, Homo sapiens
ucuuggauaaugaauuccuguuaagugucuuguuugacucagaguuug

SEQ ID NO: 168165 - RNA, 49 nt, Homo sapiens
cuuuauuguguucauuagagcacugucuauuauuuccugccuucuuugg

SEQ ID NO: 168166 - RNA, 30 nt, Homo sapiens
uaauuuuucuuucuuaaagugggccaucau

SEQ ID NO: 168167 - RNA, 45 nt, Homo sapiens
uuuuguuacuuuuuacuacagcaucaguauccuugccagaaccaa

SEQ ID NO: 168168 - RNA, 36 nt, Homo sapiens
agagcugacucugugauuucacuggccacucccaaa

SEQ ID NO: 168169 - RNA, 45 nt, Homo sapiens
uagggccuguggggagauggauucuauuuucaguuugcggccuuu

SEQ ID NO: 168170 - RNA, 46 nt, Homo sapiens
gcuauguuuaugaaaggaauuuaucaucuaagauaaacuggggcag

SEQ ID NO: 168171 - RNA, 56 nt, Homo sapiens
aagcagaagcuguguuguagaauguagcgccuuuaggccuuccacuguccuuaacu

SEQ ID NO: 168172 - RNA, 24 nt, Homo sapiens
ugcuaggauauguggcgacuuaga

SEQ ID NO: 168173 - RNA, 38 nt, Homo sapiens
auaguggcaucucaguugguuuuaauuuacauuucuua

SEQ ID NO: 168174 - RNA, 47 nt, Homo sapiens
cagaaaccaggcaguggaagcuaaaauuucaggggaaaucgggcgga

SEQ ID NO: 168175 - RNA, 44 nt, Homo sapiens
auuguauauagugaaaauuauucuugaaaauccauuuagugucg

SEQ ID NO: 168176 - RNA, 47 nt, Homo sapiens
aucgguagcauagucuucacaaauguaaucaaugcagaggggcauua

SEQ ID NO: 168177 - RNA, 44 nt, Homo sapiens
ggcuuguguucugauaaaaauaaguuaagacauagagauacaca

SEQ ID NO: 168178 - RNA, 36 nt, Homo sapiens
uugcagcacauggagaaaucuuuuuucuucugacgu

SEQ ID NO: 168179 - RNA, 46 nt, Homo sapiens
agauguguuguuaguucgcugaaaguagaauuuaauuggcuauucu

SEQ ID NO: 168180 - RNA, 25 nt, Homo sapiens
uauauugacauuuucauuguguuga

SEQ ID NO: 168181 - RNA, 60 nt, Homo sapiens
aauggaaacccuugaguucuuagauauucauggauuaauguuaccacaucuaauggauau

SEQ ID NO: 168182 - RNA, 45 nt, Homo sapiens
aagugaacaggaaauuacuaacuuuuguugaguuucuacauaugg

SEQ ID NO: 168183 - RNA, 46 nt, Homo sapiens
uuuugugagaacugggaaaaacuucacuauaagcucucccuuguuc

SEQ ID NO: 168184 - RNA, 44 nt, Homo sapiens
agaaugugagugaagcaggaaaaauauaaaaagguuuuauuuau

SEQ ID NO: 168185 - RNA, 43 nt, Homo sapiens
ggguaguaugagagcagaaaggcaugaagaaaccccaugauca

SEQ ID NO: 168186 - RNA, 51 nt, Homo sapiens
uuuuaauaacugcuugaguuuugugggaugauuccugaguaugcagagaca

SEQ ID NO: 168187 - RNA, 43 nt, Homo sapiens
cacuccuuguuaacuauguauucugcugguaugcagaacuuaa

SEQ ID NO: 168188 - RNA, 45 nt, Homo sapiens
gaauugacccauuuuauguaacauuuacaggccgaugggcauuua

SEQ ID NO: 168189 - RNA, 55 nt, Homo sapiens
ucaaagaguuagugguguuuguuuuguuuuuuaaugaauuguagaaauuuagagu

SEQ ID NO: 168190 - RNA, 34 nt, Homo sapiens
ugagucuuuccagagcaaaggaagagcucuauga

SEQ ID NO: 168191 - RNA, 47 nt, Homo sapiens
acuguucuuuuauuucaccuuuuuuccccccuugcaguaguauuugu

SEQ ID NO: 168192 - RNA, 29 nt, Homo sapiens
uuguuuuccauuucgucuuugcuuccugg

SEQ ID NO: 168193 - RNA, 57 nt, Homo sapiens
aaucuccuaauuuguuuccucugcuccauccuuuucuugucacagugucuguuuuca

SEQ ID NO: 168194 - RNA, 32 nt, Homo sapiens
guggugccuuuguugcuaaugugcauuggcug

SEQ ID NO: 168195 - RNA, 47 nt, Homo sapiens
accccuguucccuuuccugcucuccauguucuuuuuuccauuucacu

SEQ ID NO: 168196 - RNA, 47 nt, Homo sapiens
caguacagaacuuuuaaaauuuuaguggagccacacauuucaaccuu

SEQ ID NO: 168197 - RNA, 36 nt, Homo sapiens
gauuuucaugccauugaaauuucuucugugaaguag

SEQ ID NO: 168198 - RNA, 46 nt, Homo sapiens
cguccuuggggcuggaacuuuccaugcuuacucucugcaaaccaag

SEQ ID NO: 168199 - RNA, 51 nt, Homo sapiens
acucagucccugaagcuuuggucauguguaaacacuugcuauguuaagaag

SEQ ID NO: 168200 - RNA, 79 nt, Homo sapiens
uagaggugcaguaaggaugaauaaaauaucaucucuguugcaaguugcuugcagucuaacuggagugagaugacaucug

SEQ ID NO: 168201 - RNA, 100 nt, Homo sapiens
uuguauaagaaguugaauaagaacagauuugaauaacugguaagacaacagaaauguaucacuugaugguauuugauaaauauuaaugcgaaguguacug

SEQ ID NO: 168202 - RNA, 61 nt, Homo sapiens
gaccugaccacgucaccaacucugcugauacccauuugccugcagaaaaaaaaucugauuc

SEQ ID NO: 168203 - RNA, 76 nt, Homo sapiens
cuuaaaugauuauauaauaaaaagcaaaggaaaggcagcuguauauaaaauauuguaacuucaagugagcaucuug

SEQ ID NO: 168204 - RNA, 50 nt, Homo sapiens
ugguguucuuuguccuccgauaauauuuuugugacccuuucuguuguagu

SEQ ID NO: 168205 - RNA, 41 nt, Homo sapiens
aucuuuacagaaggggugggauuuguccucugcuuugucau

SEQ ID NO: 168206 - RNA, 55 nt, Homo sapiens
uaaaaaagacaccaaaagaaaagcaaggaaaggagaaguaaagaauggaagaaag

SEQ ID NO: 168207 - RNA, 43 nt, Homo sapiens
agggauugcuuuuuacauugggaugauuucuguggucaggcaa

SEQ ID NO: 168208 - RNA, 62 nt, Homo sapiens
aaauuaaagauucucaauccccugaauuuaccugucuaaccauaaguuuguuugaucaucag

SEQ ID NO: 168209 - RNA, 50 nt, Homo sapiens
uguauagccuagaaugaaaauucugaucuuuauccauuuucauuguccca

SEQ ID NO: 168210 - RNA, 87 nt, Homo sapiens
uaauggagaaaaaagacccacccucaacuuucauccuuuagaggaaggcaaugggaguuggcagcucuggugaggaauaagaaggga

SEQ ID NO: 168211 - RNA, 23 nt, Homo sapiens
aucugguccuuaggaagcuguga

SEQ ID NO: 168212 - RNA, 46 nt, Homo sapiens
gucaaugugacgguggacuacauuagaccagccagcccagccacag

SEQ ID NO: 168213 - RNA, 52 nt, Homo sapiens
ucuaauagauuaaaauuuuuuucuugauuaacuucacuguggaguuggcaag

SEQ ID NO: 168214 - RNA, 51 nt, Homo sapiens
uagcacccuauucuuaguuuaugaauacaauuugucucuaauaucucugag

SEQ ID NO: 168215 - RNA, 30 nt, Homo sapiens
guuuugugguaaauauaugauaccaguuau

SEQ ID NO: 168216 - RNA, 31 nt, Homo sapiens
cuuuugccagguaucaaaaccuuuugcuccu

SEQ ID NO: 168217 - RNA, 49 nt, Homo sapiens
uuugugcuacuauuucuccacuagucugaccccaucugcuuucugccuu

SEQ ID NO: 168218 - RNA, 370 nt, Homo sapiens
cauucuuguuuucuagcaucauuagggcuuuguucguuuuuuguucuguuuuguuuuguuuugagacacagucucacucuguugcccaggcuggagugcaggggugugaucucagcucacugcaaccucugccucccagguucaagcgauucucuugcugaguucagccucccaaguagcugggauuacagaugcccaccaccacgccuggcugauuuuugcauuuuuaguagagaugggguuuugccauguuggccaggcuggucuugaacuccugaccuuaagugaucugccuaccuugccucccaaagugcugggauuacaggugugagccaccacuccggccagggcuuuauucuuuuccauaucu

SEQ ID NO: 168219 - RNA, 48 nt, Homo sapiens
cuguucucuuuuucuucaucacacucccuguggccaacucauccacua

SEQ ID NO: 168220 - RNA, 41 nt, Homo sapiens
gguuguguuacaucauucuuggcccuugauuucuugaggag

SEQ ID NO: 168221 - RNA, 52 nt, Homo sapiens
cuacaugcucuagauuccaguucuuuuguucuccuugggauuuugugcuauu

SEQ ID NO: 168222 - RNA, 50 nt, Homo sapiens
ugugcuuccuaggcuucugucauugucccucuucuuaccacuauucaguc

SEQ ID NO: 168223 - RNA, 48 nt, Homo sapiens
ggguuggagcagagggagcaaagguggagguggugggagaugggguua

SEQ ID NO: 168224 - RNA, 48 nt, Homo sapiens
gaucuguagggaauaugaucuaguugggaagacaagauauguacccag

SEQ ID NO: 168225 - RNA, 25 nt, Homo sapiens
ugagaggcaguaggagccucaacug

SEQ ID NO: 168226 - RNA, 46 nt, Homo sapiens
ugugaaugcauggcauauuuagcagugaguggaccaguuuaguugg

SEQ ID NO: 168227 - RNA, 52 nt, Homo sapiens
uuucauucuaaccaugcauccuuuugaguucuuaaaauaggacuaaguccau

SEQ ID NO: 168228 - RNA, 42 nt, Homo sapiens
aauuaucaauugucaauauauuguuacuuccaauauuguuag

SEQ ID NO: 168229 - RNA, 48 nt, Homo sapiens
ccaucuguagccaggggaaaauuuccugaccuuucauuagcagccaaa

SEQ ID NO: 168230 - RNA, 51 nt, Homo sapiens
aucacaacuguuccuccaggagaaaucuauaauuaggggauaagaagcuaa

SEQ ID NO: 168231 - RNA, 47 nt, Homo sapiens
gaacuccauauggcaggucuuaacugguuuguagacauuugcugaua

SEQ ID NO: 168232 - RNA, 88 nt, Homo sapiens
caggccacauagaguggcaucucucauucccaagugugagcaauuuucuuauucuggcaaaaaaaaaaaaaaaaaaagauuuguugca

SEQ ID NO: 168233 - RNA, 46 nt, Homo sapiens
cuaacuguuauuauuucuguugacugagccccauaugcacuucuag

SEQ ID NO: 168234 - RNA, 46 nt, Homo sapiens
ccggcaggaugaugaccagagaucaucacacuacgaugaacugcuu

SEQ ID NO: 168235 - RNA, 41 nt, Homo sapiens
agcaauacaguggaauguauaguuauauuuuccaugcaggc

SEQ ID NO: 168236 - RNA, 40 nt, Homo sapiens
uaauacuuaaugagcauucauagauagugaaauuuuuuaa

SEQ ID NO: 168237 - RNA, 45 nt, Homo sapiens
cauaaggaaauacaggccccauaaagaauggggagaaauacucag

SEQ ID NO: 168238 - RNA, 47 nt, Homo sapiens
uuucucuuaaauguccuaauggcuuccguucuuuuuuaacuuuggaa

SEQ ID NO: 168239 - RNA, 72 nt, Homo sapiens
ggaagccagccugcggucugccuaccuucccaugucucaaagacagagcuccacaaaucuaucccagagaaa

SEQ ID NO: 168240 - RNA, 24 nt, Homo sapiens
gcuucucucuucauuuuugcaccc

SEQ ID NO: 168241 - RNA, 83 nt, Homo sapiens
ggcacucucuguugccaagacacauaccauccauuucaacaccacagucacuaaugguuaaagagaggaucaggucugugcca

SEQ ID NO: 168242 - RNA, 58 nt, Homo sapiens
uuguuauuacagauggguuuugaugucaaggucaacugaguuuugaguuguccauaag

SEQ ID NO: 168243 - RNA, 45 nt, Homo sapiens
gugauugaaugaauuaauaaauguagcuguuuuaaacaguugacg

SEQ ID NO: 168244 - RNA, 58 nt, Homo sapiens
auacauguacauaaugauggcgucuauguaguuuugaaugagugaggaaucuugaggg

SEQ ID NO: 168245 - RNA, 35 nt, Homo sapiens
acucuuagaugauuuaguuccuugcaagucugauu

SEQ ID NO: 168246 - RNA, 61 nt, Homo sapiens
uucuucuaguugggcaagcauaccauuccugcccccuuuggaaacuuugcuuagccaggau

SEQ ID NO: 168247 - RNA, 67 nt, Homo sapiens
uagcuacaucgccugaggaaacgugccagucuuccuaaccaguguuuucauuugagccacugaaaca

SEQ ID NO: 168248 - RNA, 41 nt, Homo sapiens
gaugacaaggaaagacauacacuuuuguguggcugugacug

SEQ ID NO: 168249 - RNA, 57 nt, Homo sapiens
cccaccccgcccagccacccuugcacacacaaauauucauucacuugcaaaagacau

SEQ ID NO: 168250 - RNA, 42 nt, Homo sapiens
gagucaugcuugcugccuccugccagaucgccuuggccuccu

SEQ ID NO: 168251 - RNA, 51 nt, Homo sapiens
aauucccaggcaccagcagugucagaguuuacauaaaacaucaaguauaua

SEQ ID NO: 168252 - RNA, 61 nt, Homo sapiens
accugaagauugggaguaggaauuaaaagacagacuuccaugacauaaucuaguguuucag

SEQ ID NO: 168253 - RNA, 29 nt, Homo sapiens
cauuccagaguaauaaauaaagucaucac

SEQ ID NO: 168254 - RNA, 51 nt, Homo sapiens
uauggagucagacuguggaggaugguguggccuccugauugggguguucag

SEQ ID NO: 168255 - RNA, 45 nt, Homo sapiens
auugugcuuuuuacucuuaugcuuucauguuuuaauacugaugag

SEQ ID NO: 168256 - RNA, 45 nt, Homo sapiens
ugucguaugugcagggaaugcagaaauaacucuucuaaggcccug

SEQ ID NO: 168257 - RNA, 46 nt, Homo sapiens
auuuuucccuuucacguggugcuccuuguaagcagccugccuugau

SEQ ID NO: 168258 - RNA, 62 nt, Homo sapiens
uacagggaagucauacuggagguaaaugugcauuguuguuaggcaagcacaaauucugcagu

SEQ ID NO: 168259 - RNA, 50 nt, Homo sapiens
ccuaaagguuuucucugauauaaucuucauucuucuaauagcuguuggaa

SEQ ID NO: 168260 - RNA, 49 nt, Homo sapiens
ugguacugccuuucuuuugggaugaucaaaagcaaagcauaagaauggg

SEQ ID NO: 168261 - RNA, 45 nt, Homo sapiens
uaucuaagaugagagcauggcuaagacaugugaucauagagcaag

SEQ ID NO: 168262 - RNA, 65 nt, Homo sapiens
uugaaauguuaacagugucugcuaaaaaagggcuuuccucugaggaaguggcuguugagauuucc

SEQ ID NO: 168263 - RNA, 47 nt, Homo sapiens
uuaaauuguuaacauauugccccacuagcuauuuauguauuuuuaga

SEQ ID NO: 168264 - RNA, 87 nt, Homo sapiens
gccaggggucuuuuuggaucaaaacuuagcauucuagcagcuuuggguuggggcuucugucaggcugagauguuaucaggggugaaa

SEQ ID NO: 168265 - RNA, 46 nt, Homo sapiens
cuggaaugcugggacagaacuucuugauuugcccuuuagaguagaa

SEQ ID NO: 168266 - RNA, 46 nt, Homo sapiens
gagcuuucuuguauuuuuucagaccccauggccuagcagccccugg

SEQ ID NO: 168267 - RNA, 48 nt, Homo sapiens
ucuuacagauuaauugccaaaguaauuauauuguaaaauaauaugcau

SEQ ID NO: 168268 - RNA, 49 nt, Homo sapiens
caagaagauagguccaagaacaguuuuucuucaaagguaucuuguuaug

SEQ ID NO: 168269 - RNA, 69 nt, Homo sapiens
aguaaaccacuggacaacuuuugggaggcauuagguaugaguacccaaguagaagcacugacuucucug

SEQ ID NO: 168270 - RNA, 46 nt, Homo sapiens
cuaaggcaguguuaaauuagccaauuaauaaaaaugaacacaccau

SEQ ID NO: 168271 - RNA, 45 nt, Homo sapiens
caccauccuagagugguagugaugguaauagcagcagcccacgag

SEQ ID NO: 168272 - RNA, 41 nt, Homo sapiens
gacguccgcuggcagucuugggacucugcagugugcuagcc

SEQ ID NO: 168273 - RNA, 51 nt, Homo sapiens
ggacugagggagaagaccaauuugauuuguccucuuuagaugucagaacaa

SEQ ID NO: 168274 - RNA, 76 nt, Homo sapiens
cugucaaucaaauaucucuguccccuuucaaugacucuacauuggguuuugaaauuugucucaguaacacagagau

SEQ ID NO: 168275 - RNA, 48 nt, Homo sapiens
uauguaauguugggaaaagccauuuccacaauaguaggaaguuaaaag

SEQ ID NO: 168276 - RNA, 45 nt, Homo sapiens
cuaagaacagaccauugugauguucggaggcuucugaacugucag

SEQ ID NO: 168277 - RNA, 43 nt, Homo sapiens
cacaagugacaagagccugacaaacagagguaugcugaagauu

SEQ ID NO: 168278 - RNA, 45 nt, Homo sapiens
auaauggaaucaagaggauguagcaaucacuggguuauguggaua

SEQ ID NO: 168279 - RNA, 33 nt, Homo sapiens
guuugaggucuuggcaggacauccaaggggaga

SEQ ID NO: 168280 - RNA, 44 nt, Homo sapiens
ccccaucguuugaucaacaaaaauuguguugaaauuucagggag

SEQ ID NO: 168281 - RNA, 72 nt, Homo sapiens
gcugcccagugcaguacccuagcuacaucccaguucuaguccccaguucauagcagccccacccaacagcac

SEQ ID NO: 168282 - RNA, 43 nt, Homo sapiens
guugguaaaagcaggugagucuguucaaauucauaacuuaaag

SEQ ID NO: 168283 - RNA, 42 nt, Homo sapiens
uagaauugcucuuugcugcugccugaaaaaugauguccucau

SEQ ID NO: 168284 - RNA, 45 nt, Homo sapiens
aagguacagaaaaacauuauaagcaacuguugccauuggggaaaa

SEQ ID NO: 168285 - RNA, 42 nt, Homo sapiens
ucauuucuuucaucguagcuccaagugugcuguaucgugucu

SEQ ID NO: 168286 - RNA, 45 nt, Homo sapiens
gggaaugugucccuacuauaguaaacucuuccuuaagagaguuuu

SEQ ID NO: 168287 - RNA, 42 nt, Homo sapiens
cucagaccugacaguuucauuuuuccccccaaguagaagcaa

SEQ ID NO: 168288 - RNA, 43 nt, Homo sapiens
uccuggcacucacuuuuccucuccaucuuuaggucuaacccag

SEQ ID NO: 168289 - RNA, 46 nt, Homo sapiens
uuguguuucuguaauuuguacaguaucguugaaagguguugaagag

SEQ ID NO: 168290 - RNA, 46 nt, Homo sapiens
cagaaagcauuucugguuuuuuagaaacuccuuuuuuaggcaaaga

SEQ ID NO: 168291 - RNA, 40 nt, Homo sapiens
aguggcauauaaaagggaguaggugaugugauggaggcag

SEQ ID NO: 168292 - RNA, 45 nt, Homo sapiens
gguuuaucugcuaccuaguaaauauggggaggugucaggacugua

SEQ ID NO: 168293 - RNA, 62 nt, Homo sapiens
caucaauuaaaacagcauaaaauagaaacugaauaaaauaugcaaaggucagaguggcugug

SEQ ID NO: 168294 - RNA, 41 nt, Homo sapiens
cacaguaauuuaauuaaauuugccucccuccguggcccaca

SEQ ID NO: 168295 - RNA, 63 nt, Homo sapiens
aaugagaaggcacccucggcugacauaacaccacuagucggaguggauguggacuuacacaug

SEQ ID NO: 168296 - RNA, 42 nt, Homo sapiens
aaggaguugcccuggagaggaaauaucaugagaaauguuagg

SEQ ID NO: 168297 - RNA, 44 nt, Homo sapiens
gcaagagucuuuacauccaacguguugcuauaacuacccccuaa

SEQ ID NO: 168298 - RNA, 38 nt, Homo sapiens
ggaugucaacugguuguggugauggggugggggcagaa

SEQ ID NO: 168299 - RNA, 47 nt, Homo sapiens
uacaaauucauggugcuuuuuuuuuguauuuuuuuuuaauaagauaa

SEQ ID NO: 168300 - RNA, 49 nt, Homo sapiens
uuuuugucuuuaaauuuuaauauaaucuguuuuuuuuaaccagcccaua

SEQ ID NO: 168301 - RNA, 47 nt, Homo sapiens
gaaaaaaauccugccaaacucgagcggccccuggucucccaacccac

SEQ ID NO: 168302 - RNA, 45 nt, Homo sapiens
cacacugcaaccguccccacccaguucgccgucaccuaccucgga

SEQ ID NO: 168303 - RNA, 45 nt, Homo sapiens
gacuucuuaguuuuaauuaacaaaagggggaaguggugggggcgg

SEQ ID NO: 168304 - RNA, 41 nt, Homo sapiens
cgucuccuccucgcgccgggcucgcgguguugcaggcggca

SEQ ID NO: 168305 - RNA, 23 nt, Homo sapiens
uugaagauauuuccaaaugccug

SEQ ID NO: 168306 - RNA, 39 nt, Homo sapiens
uuggcaaguucauuugucucaucuaaggaguuccaggga

SEQ ID NO: 168307 - RNA, 40 nt, Homo sapiens
gagaccaggccugucagcaccaccaccaacccugucuugu

SEQ ID NO: 168308 - RNA, 44 nt, Homo sapiens
acagcucuucugcucuacaucaaggagccugagagacuggaaua

SEQ ID NO: 168309 - RNA, 37 nt, Homo sapiens
agguuuaagauagacuccuuguuuuacagacuaguga

SEQ ID NO: 168310 - RNA, 30 nt, Homo sapiens
ucuucuuccuuguucuuaucuggacuucag

SEQ ID NO: 168311 - RNA, 51 nt, Homo sapiens
gcugacauuugcugacuacgcuuugcagacuuucuccuuaagcucuguuag

SEQ ID NO: 168312 - RNA, 46 nt, Homo sapiens
aacgacaaauguuacugucuuugaguuaagugguucaauuagcacu

SEQ ID NO: 168313 - RNA, 51 nt, Homo sapiens
agugaugcaggguauauguguaucaucccugcugcuguaagagauccucag

SEQ ID NO: 168314 - RNA, 56 nt, Homo sapiens
gcaacguaugcaggagaggauagaaugaugagguccaggguacaguggaucucugg

SEQ ID NO: 168315 - RNA, 45 nt, Homo sapiens
uucaaaugcagcaguuaggaauagcauuucgucgcugguaauaua

SEQ ID NO: 168316 - RNA, 46 nt, Homo sapiens
agcugaccauacugaugcaugcaauaaaaggaacagaaaaaggaga

SEQ ID NO: 168317 - RNA, 80 nt, Homo sapiens
uguacucagcauaugcuaugcaucgcuuggugaggaaagcaggcuucugucaggcuuucugcuuggcacauggaggcagg

SEQ ID NO: 168318 - RNA, 131 nt, Homo sapiens
ugucauggugauaugaguaaagugcugugagaacaagcccuacccagauaaguaauggagugguucaaauaaaaucacaucugugcagaauccaagggguaaguuggguaggaguuuacaggugaagucau

SEQ ID NO: 168319 - RNA, 57 nt, Homo sapiens
uggggaagaauucacaauugcuacuaagaaagcagggagaaaaagccaagauuggga

SEQ ID NO: 168320 - RNA, 37 nt, Homo sapiens
agcacaggccuuuucuuuucaggagccucuuggcccc

SEQ ID NO: 168321 - RNA, 43 nt, Homo sapiens
gcacccaccgcuuuggcccugugauggggaaagaccuccacug

SEQ ID NO: 168322 - RNA, 77 nt, Homo sapiens
agggacagucacacacuugagcucauccuaucaaccccacuugccuuaccuucacucgguauuucaugggaggacuc

SEQ ID NO: 168323 - RNA, 46 nt, Homo sapiens
accauuaaggaaacagucuaagagaggucaagugaauuacccaaaa

SEQ ID NO: 168324 - RNA, 37 nt, Homo sapiens
cauacaaccugcuuaaaccucugcuuucaaucuccgu

SEQ ID NO: 168325 - RNA, 45 nt, Homo sapiens
acaaguuuuuacauuuggcagcaaagacauuuauaggccccuuua

SEQ ID NO: 168326 - RNA, 46 nt, Homo sapiens
cagcuccuacuacaagucccugcugucugccgaggaggccgcaaag

SEQ ID NO: 168327 - RNA, 73 nt, Homo sapiens
accugaugcugucacccaaggcacuuuuacuugaggagucuuuagcaguuucugcuuucauccuguguguucc

SEQ ID NO: 168328 - RNA, 44 nt, Homo sapiens
aggacgugcugagggauucaggacugcaggggugccugcuggua

SEQ ID NO: 168329 - RNA, 42 nt, Homo sapiens
ugaaaaaggaaaaacgcaagggggagggguagagauggagcc

SEQ ID NO: 168330 - RNA, 42 nt, Homo sapiens
guagugguggucucagugggaacaagagccguuccugggcag

SEQ ID NO: 168331 - RNA, 58 nt, Homo sapiens
cggugguguggggcccauccuucaucccuacuuuugcccccugaaagacaguagacag

SEQ ID NO: 168332 - RNA, 33 nt, Homo sapiens; identical to SEQ ID NO: 88765

SEQ ID NO: 168333 - RNA, 46 nt, Homo sapiens
uuucucggagacacagggcaggugggugggagcacaggguaggaaa

SEQ ID NO: 168334 - RNA, 46 nt, Homo sapiens
uuucgagcugaugaugcagacgaauuuggcuacagccgcuaaggag

SEQ ID NO: 168335 - RNA, 46 nt, Homo sapiens
uccuaacacccaggcuggccgccagcuggcaccugccucuauccca

SEQ ID NO: 168336 - RNA, 83 nt, Homo sapiens
cacagaaaucuggaugguggucaccuccagguggggcagcggaccccaggggugagauaaggaaggaugcuggggagacauaa

SEQ ID NO: 168337 - RNA, 45 nt, Homo sapiens
ugacaaaccagaagaggugggugccugauuccaaguuacacaggg

SEQ ID NO: 168338 - RNA, 41 nt, Homo sapiens
guacaguacccggggccagcaagagagagcagugguuacca

SEQ ID NO: 168339 - RNA, 31 nt, Homo sapiens
ugcucaguagauucccccggagugacuggag

SEQ ID NO: 168340 - RNA, 41 nt, Homo sapiens
aagauacuccaugucucauuguccugugggaaaugaccucg

SEQ ID NO: 168341 - RNA, 41 nt, Homo sapiens
cgaaaaugcccagagcaugcacgcacuugcugcagcagagg

SEQ ID NO: 168342 - RNA, 57 nt, Homo sapiens
aucucuaucugaaauuguuugucucuccaguuagaauguaugcuuugugagagggac

SEQ ID NO: 168343 - RNA, 36 nt, Homo sapiens
uuuuaguaacaacgucauuucuaauaugugugacuc

SEQ ID NO: 168344 - RNA, 39 nt, Homo sapiens
aacccgcuucaaccagcuggucgaacaauauaagcagaa

SEQ ID NO: 168345 - RNA, 45 nt, Homo sapiens
agccaaagccacagauaaaccaguggaagcaggagaagcagcaau

SEQ ID NO: 168346 - RNA, 46 nt, Homo sapiens
caaggcugaaguggagcagguggagcugccugauggaaagaagaga

SEQ ID NO: 168347 - RNA, 64 nt, Homo sapiens
ccugcaacuggugagccucagaaggggcaaccagagccugcaaaagaccagcaacagaaggcag

SEQ ID NO: 168348 - RNA, 46 nt, Homo sapiens
uggcggugacccgugaugaggcugcaaagcuucagacgacgaaggu

SEQ ID NO: 168349 - RNA, 47 nt, Homo sapiens
aauuugaauugcauagaauguuccaaguuagugguaugauauugcuu

SEQ ID NO: 168350 - RNA, 46 nt, Homo sapiens
acaguuuggagaacucaaauauguccgcauugucuugcauccagac

SEQ ID NO: 168351 - RNA, 45 nt, Homo sapiens
ucucaaacaaaaagaagaggaaauuacccucugaugugaaugaag

SEQ ID NO: 168352 - RNA, 48 nt, Homo sapiens
agaagaguguaauacacaaaguagaaguuucucaccaauccuaacaau

SEQ ID NO: 168353 - RNA, 23 nt, Homo sapiens
uauaaccaucucaacaucaagcu

SEQ ID NO: 168354 - RNA, 72 nt, Homo sapiens
uuucauaaaugucuuuagacuuuaaaaaaguuacugaaguuacggaaaugagcaucaguucugcuuagaucu

SEQ ID NO: 168355 - RNA, 87 nt, Homo sapiens
aggaaagcgauaguauugaugauggagaggaacuggcucagagugauaccagcacugaggagcaagaggauaaagguuuguuuggau

SEQ ID NO: 168356 - RNA, 71 nt, Homo sapiens
aaugaaauugaauaggcccucugucagcccaccuccuuaguucugaucugugccauugcagagcagucaag

SEQ ID NO: 168357 - RNA, 75 nt, Homo sapiens
aucaguuaaaaagaagggcagagaggaagaggauauggaagaggaagaaaacgaugaugaugacgaugaugauga

SEQ ID NO: 168358 - RNA, 46 nt, Homo sapiens
aaccuccuagaagcagguaaagcucucaaaggcaugaacaugaaag

SEQ ID NO: 168359 - RNA, 37 nt, Homo sapiens
gggaagggccugaccugcuggcagaauuugggccauc

SEQ ID NO: 168360 - RNA, 46 nt, Homo sapiens
ucaauuuggagcuguccuggaaguaaauaucccuaggaaaccaggu

SEQ ID NO: 168361 - RNA, 46 nt, Homo sapiens
gagccgaaggcuaaaaaagccaaaguggcagauaagaaagccagau

SEQ ID NO: 168362 - RNA, 44 nt, Homo sapiens
cuuuaccuauuuugagguguucuaaagauaaaaugagacaagaa

SEQ ID NO: 168363 - RNA, 51 nt, Homo sapiens
gucaaacucuuuuacauuucagcugcuuuacuuuugguuguacugaucaug

SEQ ID NO: 168364 - RNA, 33 nt, Homo sapiens; identical to SEQ ID NO: 88829

SEQ ID NO: 168365 - RNA, 32 nt, Homo sapiens
cugcuuccuuucucucgcucuucuccacccuu

SEQ ID NO: 168366 - RNA, 42 nt, Homo sapiens
acggaggccccuggcgaguacuucuucucagacggggugcgg

SEQ ID NO: 168367 - RNA, 42 nt, Homo sapiens
ugaguaugcccggcgcuuuggugugcccaucauagccgaugg

SEQ ID NO: 168368 - RNA, 46 nt, Homo sapiens
guccuuucucacaggacucgucccaagggaauucgguguaucagau

SEQ ID NO: 168369 - RNA, 42 nt, Homo sapiens
aaugauugcgaugagcugguggccaucaucgcccgcaccgac

SEQ ID NO: 168370 - RNA, 37 nt, Homo sapiens
ccgggcuugcggggucgcagcgccgcugcaggcagcu

SEQ ID NO: 168371 - RNA, 42 nt, Homo sapiens
gcugguguucagcagcuuggggaggugaccuggcagcugggu

SEQ ID NO: 168372 - RNA, 63 nt, Homo sapiens
ccccgauguacccucgcugaaucugggaugggagagacgaaccgagucuaggcaucugcguag

SEQ ID NO: 168373 - RNA, 44 nt, Homo sapiens
ucaccgagucucuggcaccagagggucauuuuuugccuccggaa

SEQ ID NO: 168374 - RNA, 65 nt, Homo sapiens
ugaauugggaauaagguggcuucuaguuguuuuuuguucuaguagcuuauucagcuuggaggcag

SEQ ID NO: 168375 - RNA, 40 nt, Homo sapiens
ggcuccuaucccuacauuucaaauagcauuucucucacaa

SEQ ID NO: 168376 - RNA, 50 nt, Homo sapiens
acuagagagacguuaaauaaauuauguguugguaucaugacuuuuaucaa

SEQ ID NO: 168377 - RNA, 42 nt, Homo sapiens
uuucaucaauaguaaggaagccagguuucaggguagcauugg

SEQ ID NO: 168378 - RNA, 59 nt, Homo sapiens
agacguucuuaucuaugacuagaccaucugaaugauuuggccuuugaaggugacucaag

SEQ ID NO: 168379 - RNA, 61 nt, Homo sapiens
caugagccucagcucagugacaagguucacaaugaugcucagaguuuugauuaugaccaug

SEQ ID NO: 168380 - RNA, 53 nt, Homo sapiens
augccuucuugggugcugaagaagcaaagaccuuugaucagcugacaccagaa

SEQ ID NO: 168381 - RNA, 49 nt, Homo sapiens
ggguagaugguacuauaaugaggauguucuggcuccuugcagguaggga

SEQ ID NO: 168382 - RNA, 350 nt, Homo sapiens
aacuacuuuuuuuucugagacgaagucuugcucugucaccugggcuggagugcaguggcgcgaucucaacucauugcaaccgccgccucccagguucaagagauucuccugccucagccuccugaauagcugagauuacaggcaugcgccaccaugcccggcuaauuuuuguguuuuuaguagagacuggguuucaccauguuggccaggcuggucucgaauuccucaccucccgccaggugaucugcccgccucggccucccaaagugcugagauuauaggcgugagccaccguaccaggccagagauaacuucuuacugguuuaccuuuccuguuaacauuuuagagc

SEQ ID NO: 168383 - RNA, 72 nt, Homo sapiens
aaggacggguuugucacuguggaugagcucaaagacuggauuaaauuugcacaaaagcgcuggauuuacgag

SEQ ID NO: 168384 - RNA, 45 nt, Homo sapiens
gaaggggcaugaccucaaugaggacggccucguuuccugggagga

SEQ ID NO: 168385 - RNA, 49 nt, Homo sapiens; identical to SEQ ID NO: 88857

SEQ ID NO: 168386 - RNA, 49 nt, Homo sapiens
cuccugggaugaguacagaaacgugacuuauggcacuuaccuggguaag

SEQ ID NO: 168387 - RNA, 54 nt, Homo sapiens
cauuuuuucuuuaugucaucccucauagagacaauuuuuggaguagauuucauu

SEQ ID NO: 168388 - RNA, 49 nt, Homo sapiens
auauccuucacccaauuaagaacacauguauuaaacagucagcacagau

SEQ ID NO: 168389 - RNA, 37 nt, Homo sapiens
cacugucucugccacaaggaaaauaugaaauacugag

SEQ ID NO: 168390 - RNA, 46 nt, Homo sapiens
cagauguaacuagaaaauucaagccuucuaguagccuuaauaccaa

SEQ ID NO: 168391 - RNA, 46 nt, Homo sapiens
ugucaucaauuauuucuuccuugcaugguuuuaucuuuauuggaaa

SEQ ID NO: 168392 - RNA, 81 nt, Homo sapiens
uccagauccugaugauggauuuaacuauaaacagaugaugguuagagaugagcggagguuuaaaauggcagacaaggaugg

SEQ ID NO: 168393 - RNA, 76 nt, Homo sapiens
agaccucauugccaccaaggaggaguucacagcuuuccugcacccugaggaguaugacuacaugaaagauauagua

SEQ ID NO: 168394 - RNA, 50 nt, Homo sapiens
gaaacaauggaagauauagauaagaaugcugaugguuucauugaucuaga

SEQ ID NO: 168395 - RNA, 51 nt, Homo sapiens
gaggaauuuuuauaacuguuaacuacaucacuuaucaagcauugaggccaa

SEQ ID NO: 168396 - RNA, 39 nt, Homo sapiens
caauugaacaaaauaacauuuauuacagacguuuuaugu

SEQ ID NO: 168397 - RNA, 69 nt, Homo sapiens
cauguacagccaugaugggaauacugaugagccagaauggguaaagacagagcgagagcaguuuguuga

SEQ ID NO: 168398 - RNA, 82 nt, Homo sapiens
guuucgggauaagaaccgugaugggaagauggacaaggaagagaccaaagacuggauccuucccucagacuaugaucaugca

SEQ ID NO: 168399 - RNA, 93 nt, Homo sapiens
aaggaggagaucguugacaaguaugacuuauuuguuggcagccaggccacagauuuuggggaggccuuaguacggcaugaugaguucugagcu

SEQ ID NO: 168400 - RNA, 53 nt, Homo sapiens
ugcgcuacugagacuguuacuacaaacuuuuuaagacaugaaaaggcguaaug

SEQ ID NO: 168401 - RNA, 97 nt, Homo sapiens
uuuauuuuuguauuuuucucugguugggaguaugauaugaaggaucaagauccucaacucacacauguagacaaacauuagcucuuuacucuuucuc

SEQ ID NO: 168402 - RNA, 76 nt, Homo sapiens
augauuuuaauaauucucacuuaacuaauuuuguaagccugagaucaauaagaaauguucaggagagaggaaagaa

SEQ ID NO: 168403 - RNA, 58 nt, Homo sapiens
aaaaaauauaugcuccacaauuuauauuuagagagagaacacuuagucuugccuguca

SEQ ID NO: 168404 - RNA, 43 nt, Homo sapiens
uaauuuugucaagcacagcuguggugggaagaguuagggccag

SEQ ID NO: 168405 - RNA, 86 nt, Homo sapiens
uuuucugggugugcaucuguugaaaugcucaagacuuaauuauuugccuuuugaaaucacuguaaaugcccccauccgguuccucu

SEQ ID NO: 168406 - RNA, 62 nt, Homo sapiens
gugccuuuaacgaaagaaauggucacugaaugggaauucucuuaagaaacccugagauuaaa

SEQ ID NO: 168407 - RNA, 48 nt, Homo sapiens
uccaaaaaccacaugcugcugaauuuaccagggauccucauaccucac

SEQ ID NO: 168408 - RNA, 61 nt, Homo sapiens
uccccgcugccaaaaaaaaaaaaaaaggaaacguuuaucaugaaucaacaggguuucaguc

SEQ ID NO: 168409 - RNA, 88 nt, Homo sapiens
uuuacccauauuuuaugcaacacaaacacuguccuuuugggucccuuucuuacagauggaccucuugagaagaauuaucguauuccac

SEQ ID NO: 168410 - RNA, 47 nt, Homo sapiens
auguauauauaaccuuuauuauugcuauaucuuuguggauaauacau

SEQ ID NO: 168411 - RNA, 24 nt, Homo sapiens
uacuaagcucuugauaguggauau

SEQ ID NO: 168412 - RNA, 51 nt, Homo sapiens
uuccugcccucuggguuccccauuuuuacuauuaagaagaccagugauaau

SEQ ID NO: 168413 - RNA, 38 nt, Homo sapiens
cggucaucuugaaugaucccuuugaaauuuuuuuuuug

SEQ ID NO: 168414 - RNA, 46 nt, Homo sapiens
cugcuacgugcccuacgcggccuucgccauguacauggucaacaac

SEQ ID NO: 168415 - RNA, 75 nt, Homo sapiens
ggcuggagccggugagagugcagggcaguggugcugaguuaacuaggagcucagguugauguggguggaaagaga

SEQ ID NO: 168416 - RNA, 33 nt, Homo sapiens
ggaucaccuauaagaggacucagaggggggugu

SEQ ID NO: 168417 - RNA, 39 nt, Homo sapiens
ucggccgcucucuggcucucucucccuccagggccggag

SEQ ID NO: 168418 - RNA, 47 nt, Homo sapiens
gcuaggguugcccgauggaaggaaagggaacggugagccgaggcggg

SEQ ID NO: 168419 - RNA, 57 nt, Homo sapiens
acaucugcugugucacggaggcagggcuauuuccaggacagggcaggcggguggggu

SEQ ID NO: 168420 - RNA, 50 nt, Homo sapiens
gucucugccuaccugacccucucccuccugcgaggccccacucagaugcc

SEQ ID NO: 168421 - RNA, 42 nt, Homo sapiens
caugggcauggagauggaguagugcaggaucagcguccagau

SEQ ID NO: 168422 - RNA, 40 nt, Homo sapiens
cgauccuugucauuguugggaaccaccuuagccuauuagg

SEQ ID NO: 168423 - RNA, 53 nt, Homo sapiens
gcaguccugagagggggcagaggggcacagccaggccaaggagggugagaggc

SEQ ID NO: 168424 - RNA, 48 nt, Homo sapiens
gagggaugagcgaggagggccaggggcugggaaaggguggucacagau

SEQ ID NO: 168425 - RNA, 39 nt, Homo sapiens
aaugaaauguauuucugacacuguggcugaaauaauaaa

SEQ ID NO: 168426 - RNA, 45 nt, Homo sapiens
caucuccauugucccgcaccuccacaggcucggccacaccugggc

SEQ ID NO: 168427 - RNA, 42 nt, Homo sapiens
guccggcagguaggacacaguguacgugccauccccauuguc

SEQ ID NO: 168428 - RNA, 41 nt, Homo sapiens
acgaggcacuugcuggcauccccagugggcagagcauggau

SEQ ID NO: 168429 - RNA, 44 nt, Homo sapiens
ugcucacccccgaagcggauggugaugacguacuugcccggcuc

SEQ ID NO: 168430 - RNA, 42 nt, Homo sapiens
auggcucaggccuggcccauaggcacugacauggcggcuguu

SEQ ID NO: 168431 - RNA, 45 nt, Homo sapiens
cacgcucaccacgugcuccccgaccuccuugggggugaaggagau

SEQ ID NO: 168432 - RNA, 46 nt, Homo sapiens
ggacuccuccacccgcaccucgcgcuuugucuccccgccccgcguc

SEQ ID NO: 168433 - RNA, 42 nt, Homo sapiens
cagugaacugaaaggggcugccgggcacgugcuggccacggu

SEQ ID NO: 168434 - RNA, 31 nt, Homo sapiens
uggucuaaggccacauggaauuggcugagca

SEQ ID NO: 168435 - RNA, 49 nt, Homo sapiens
gggacugcugggguggguagggguguugaguggaguucaggaaagaaac

SEQ ID NO: 168436 - RNA, 43 nt, Homo sapiens
guuuccucagguccugucccagaacuuaagaaggcaacaauga

SEQ ID NO: 168437 - RNA, 16 nt, Homo sapiens
aguuuccgguucuggg

SEQ ID NO: 168438 - RNA, 62 nt, Homo sapiens
gaccaagaaccuagaugaauggcccuagagagguaacaucuguuuggugccugcugucauug

SEQ ID NO: 168439 - RNA, 47 nt, Homo sapiens
acgaugcgggggcucccgcuaggucaugacacccagggcuuccagga

SEQ ID NO: 168440 - RNA, 50 nt, Homo sapiens
cacuggcgcuugugcguguaugugugugugcgugcaugugucauuugcua

SEQ ID NO: 168441 - RNA, 46 nt, Homo sapiens
uccgcagcccaacaugggccccggguuccaaaguuugcgaaguugg

SEQ ID NO: 168442 - RNA, 52 nt, Homo sapiens
uggagaggaaaaggggagggaugacggaggaagagguuuagacauuuggagg

SEQ ID NO: 168443 - RNA, 98 nt, Homo sapiens
auaagguuccuggcuuggugcagaugcuggaggaggaacuuggaggaugguauccaugguacccaugaggaagagcugcauccuuuuuggggaucagg

SEQ ID NO: 168444 - RNA, 51 nt, Homo sapiens
auauacacuucuuuuacgauguuugcauacauguguuacauguauacucau

SEQ ID NO: 168445 - RNA, 57 nt, Homo sapiens
aagauagagaaugcuagaggaagaagaaguuuaggcaggagguguggcuuugauuuu

SEQ ID NO: 168446 - RNA, 45 nt, Homo sapiens
uuuacagcuggaaaugccuccucccgggcauuccaagcugaccag

SEQ ID NO: 168447 - RNA, 53 nt, Homo sapiens
guguguggcccugucaccuugcccacuugcagguaaguaggagagagacaaag

SEQ ID NO: 168448 - RNA, 78 nt, Homo sapiens
gcugggaggaauuucuuguuugccucucacacauugaauugagggcugagaggaggaauguuuuuggugauggugggu

SEQ ID NO: 168449 - RNA, 46 nt, Homo sapiens
uauuugucuuucgccugugugucuauagaauuaugcaauuuuuacu

SEQ ID NO: 168450 - RNA, 48 nt, Homo sapiens
ggaaauucuacaagggcaggaacuacaagccccuggaccugcggccua

SEQ ID NO: 168451 - RNA, 27 nt, Homo sapiens
ggucaaggccugaggagcgcauugucc

SEQ ID NO: 168452 - RNA, 46 nt, Homo sapiens
gguggauggggacucugugagugggauuuguuuugugggcuacaag

SEQ ID NO: 168453 - RNA, 82 nt, Homo sapiens
cucuacuccugaguccuugaaggacuugaggcccuugggagccuccuucucuggaaagaauggcaucgcuggcccuucccaa

SEQ ID NO: 168454 - RNA, 66 nt, Homo sapiens
gaacaagccaaccuguggcugguugaggcagagaucuccccagagcugcagaagcgccugggccgg

SEQ ID NO: 168455 - RNA, 45 nt, Homo sapiens
uucuggaugucuggcucaaagcagcaggacugugggaaagagccu

SEQ ID NO: 168456 - RNA, 50 nt, Homo sapiens
aauacuaacccacggauuguauuccuaggcacuuuacauguguauuaaua

SEQ ID NO: 168457 - RNA, 36 nt, Homo sapiens
cggcgggcgguggagacccugaggcuccagcucccg

SEQ ID NO: 168458 - RNA, 81 nt, Homo sapiens
gggaaagacgaucuuugugggguuuucggucuuaggcgucagcuucuuucagacaguuuugaggaggucucagaauaccaa

SEQ ID NO: 168459 - RNA, 50 nt, Homo sapiens
aguaaaguaaaaaagagaggcagcagcagcaccagugcugggaguaccua

SEQ ID NO: 168460 - RNA, 46 nt, Homo sapiens
gagaaaauuguacaaauguagaacuugaaagaauuguaaauuuaga

SEQ ID NO: 168461 - RNA, 48 nt, Homo sapiens
uuguaaucuuuauucagacccuuugucaaguuuauaaagaauaugcag

SEQ ID NO: 168462 - RNA, 44 nt, Homo sapiens
ggagcugaaauuccauucacccaacaagagguuuaguaaacuug

SEQ ID NO: 168463 - RNA, 43 nt, Homo sapiens
cagugguagccuacagagaaacucaucuucugcauuauacuaa

SEQ ID NO: 168464 - RNA, 45 nt, Homo sapiens
cuaagugcuagaguuauaaguuagcaagauaccauucuugcccuc

SEQ ID NO: 168465 - RNA, 46 nt, Homo sapiens
gaacucauacugaguccucugugggugcgugggaccgaggaaugua

SEQ ID NO: 168466 - RNA, 40 nt, Homo sapiens
ggucauucaugguauagguuugcguagagagcuugaugga

SEQ ID NO: 168467 - RNA, 37 nt, Homo sapiens
ugaaacuacauagccagauuucuugugacucgggcag

SEQ ID NO: 168468 - RNA, 43 nt, Homo sapiens
cugcuaugcauaagaucauggcugaauaacaauaauguugaag

SEQ ID NO: 168469 - RNA, 45 nt, Homo sapiens
ugagacuuuugaaggucuuagaagagggugaguguauuuugcaug

SEQ ID NO: 168470 - RNA, 51 nt, Homo sapiens
auaaaucuauaaaauggaaaaauuuaacaugucuuuuugaguaauugaugg

SEQ ID NO: 168471 - RNA, 59 nt, Homo sapiens
agucuucucagagaggaaggacaagcgugaggaauaggaaaauuucaccuguagguggg

SEQ ID NO: 168472 - RNA, 94 nt, Homo sapiens
gaaucucuuggagaauucuagcuugugacuuucacuccugcuuucucuuucuccucuauguucaguaugcaauuguugauuaauugaaaaggag

SEQ ID NO: 168473 - RNA, 55 nt, Homo sapiens
uagaauuauagcccuaggaagguaagcaaauuucuguuuucugcuacaauauuuu

SEQ ID NO: 168474 - RNA, 48 nt, Homo sapiens
uccaauuacaaauuuuuuguagugcuauguccccugguuaaugauggu

SEQ ID NO: 168475 - RNA, 41 nt, Homo sapiens
gaccgggcugaguugugcauacugcugaaauuaaagguacu

SEQ ID NO: 168476 - RNA, 46 nt, Homo sapiens
agcagcacauuugcaguguuuguuugauauuugucauucuaccaag

SEQ ID NO: 168477 - RNA, 48 nt, Homo sapiens
auuugaaggguguuaacauuggaagaagagaagaauuauuuagccugg

SEQ ID NO: 168478 - RNA, 47 nt, Homo sapiens
gcucaugaccuuuaaaauuagaggaaauuugccuuggagucauccag

SEQ ID NO: 168479 - RNA, 54 nt, Homo sapiens
aauccuugcaucaguccuguuagguagguagcucuuauuauuuccaccauacaa

SEQ ID NO: 168480 - RNA, 47 nt, Homo sapiens
acaaauuaauagaaguaacauauacacagaacugugaaaauaggcac

SEQ ID NO: 168481 - RNA, 28 nt, Homo sapiens
gccaugauuuucugaaauaguaaacaac

SEQ ID NO: 168482 - RNA, 48 nt, Homo sapiens
ucacccaugggaacuuuuauugggacauuugaaaauuguaccagcugc

SEQ ID NO: 168483 - RNA, 48 nt, Homo sapiens
uauuggucuaucuucagguucacugauucuguccuuggaugugcccgg

SEQ ID NO: 168484 - RNA, 38 nt, Homo sapiens
cucuaguccaaccauugcuugcugcugaaggcugcaga

SEQ ID NO: 168485 - RNA, 47 nt, Homo sapiens
uuuuaauagugacacaagggagugugacugacagaugcugaagcaga

SEQ ID NO: 168486 - RNA, 45 nt, Homo sapiens
auuuauaaaaaguaucccaacauguuuaagaaaaucaagggcaua

SEQ ID NO: 168487 - RNA, 45 nt, Homo sapiens
cugugcugcccugaaagccaugggcuccauuguguauguaacuga

SEQ ID NO: 168488 - RNA, 38 nt, Homo sapiens
agauacugugcuaugugcugagaaugaauaagaugaau

SEQ ID NO: 168489 - RNA, 41 nt, Homo sapiens
gaagaguaugguucucuauacugaaagaauagagaaaagaa

SEQ ID NO: 168490 - RNA, 36 nt, Homo sapiens
uuaguuaggguagucaaggaagucucuuugaggaga

SEQ ID NO: 168491 - RNA, 56 nt, Homo sapiens
uauuacuauagaaggaauucacagauagaaccagugccacuuugagugaugcauac

SEQ ID NO: 168492 - RNA, 44 nt, Homo sapiens
aaauuuucagcaccugcuuuucucagcuuggcccuuccccgggu

SEQ ID NO: 168493 - RNA, 47 nt, Homo sapiens
ucauuugauuggauaguuuccaaggaagccccuccagauuggcacua

SEQ ID NO: 168494 - RNA, 48 nt, Homo sapiens
ucccauccugauucucuucuucuaccucuacccucuccaacuucuccu

SEQ ID NO: 168495 - RNA, 64 nt, Homo sapiens
uaccaccgggaaggcagcgccgaaaaaaccagaggggaaccacuugccgaucccccaggcacag

SEQ ID NO: 168496 - RNA, 34 nt, Homo sapiens
gcaaguuaggagguggccggggcggcaguucgag

SEQ ID NO: 168497 - RNA, 26 nt, Homo sapiens
auauguauauauagaguauuuggaaa

SEQ ID NO: 168498 - RNA, 45 nt, Homo sapiens
gaaugcuaaugugguuaggcuggcagcuaaaccuacaaagaacaa

SEQ ID NO: 168499 - RNA, 45 nt, Homo sapiens
auguacuaggugcuagaguaacaaaucuugggccuugucguguag

SEQ ID NO: 168500 - RNA, 70 nt, Homo sapiens
agaaccaaaauagagcaaacaaagaguggugugggauuauaggaggagggagaaauuccuucuagggaga

SEQ ID NO: 168501 - RNA, 92 nt, Homo sapiens
uagucugauuugagaacuagcaaguggauuuugcucgacuuggagaauaguggaaagugaaacugauaagguuguggccauauugggaagag

SEQ ID NO: 168502 - RNA, 58 nt, Homo sapiens
uugaguaggugucucaggugaagaacuuuggaaagauacgaggaacuucuuagaaaug

SEQ ID NO: 168503 - RNA, 46 nt, Homo sapiens
guggcaauuuacguuauuuuuccauaauggaaauugaggcagccuc

SEQ ID NO: 168504 - RNA, 45 nt, Homo sapiens
gggggcuaggauauauucccuuggauauucugaaacucacauaaa

SEQ ID NO: 168505 - RNA, 46 nt, Homo sapiens
uauggcuaccauagaagcacaugcaguggcccagcaagugcagcag

SEQ ID NO: 168506 - RNA, 81 nt, Homo sapiens
gaauggguaugguauuagauauugaucuuagaagguauuuagaaaagcuagacaagaaauuaaugaugaggaguggccaaa

SEQ ID NO: 168507 - RNA, 46 nt, Homo sapiens
cuuaugugucccagcagagggcaucuugacauaaugaauccagguc

SEQ ID NO: 168508 - RNA, 105 nt, Homo sapiens
ucugaaggagcuuucauccaguggugggggagagcuaccaauaauaaaguaaaauaauuugagaaagcauuggaugcucugaauaaaauaaugcgggaagguaau

SEQ ID NO: 168509 - RNA, 82 nt, Homo sapiens
uuuauuugagccacuuagaauauauaugccaauauacagaugagcaauuuaauuuuuauuuaagccuuuuacaagauucaua

SEQ ID NO: 168510 - RNA, 109 nt, Homo sapiens
augucuuuuuaaaaagauugucuuugauauguugaggucccaggaaucagagacuucaauaguuccuuugagucuacccuccaucuacccuucaaaagacaaaacaaga

SEQ ID NO: 168511 - RNA, 50 nt, Homo sapiens
uuuucugccagaaugccuucaucaacuugaccuuguguugaacaucucca

SEQ ID NO: 168512 - RNA, 41 nt, Homo sapiens
ccugugggaauggccgcugcugcugcuguggcaacaggaaa

SEQ ID NO: 168513 - RNA, 48 nt, Homo sapiens
agugaacaaaacaaauugccuuaaagagcuuguauccugcuagagggg

SEQ ID NO: 168514 - RNA, 70 nt, Homo sapiens
uuuuuacuuccuacgucaagguauuuuaccuccccagaugcaauggguggccgggggaaggggggagggg

SEQ ID NO: 168515 - RNA, 46 nt, Homo sapiens
aaacaaaauaauagauaauuccaaggugucaacuuccugagggaaa

SEQ ID NO: 168516 - RNA, 58 nt, Homo sapiens
cauugcuggaacuucuagucaaaccucauuuucucuuccauuuguuucccuaaaauag

SEQ ID NO: 168517 - RNA, 49 nt, Homo sapiens
gcccacuugucacauuuccauaauuccauggcuucuuuguuauucccag

SEQ ID NO: 168518 - RNA, 47 nt, Homo sapiens
guguuuguuuuuaaggcuaugcaauggcucaggaaggccagccccac

SEQ ID NO: 168519 - RNA, 46 nt, Homo sapiens
uacuucugcccuuaauucccugcaggugcguaaguacaagagcaug

SEQ ID NO: 168520 - RNA, 46 nt, Homo sapiens
gugaggggugggaggugaggaggagacucaaagacaaguggcacag

SEQ ID NO: 168521 - RNA, 33 nt, Homo sapiens
cuugggguuggucugaacaaaagaacauuagga

SEQ ID NO: 168522 - RNA, 389 nt, Homo sapiens
aacuauuuuccuauuuuauauuaaacuugaauauuuuaaagugcaaaguuaggccgggcgcaguggcucacaccuguaaucccagcacuuugggaggccgaggcagguggaucaccugaggucaggaguucgagaccagccugaccaacauggauaaaccccgucucuacuaaaaaaaaaaaaaaaaaaaaaaaaaacaaccaaauuagccgggcuuagugguacaugccuguaaucccagcuacucaggaggcugaggcaggagaaucgcuugaacccaggaggcggagguugcagugagccgagaucaugccaucgcacuccagccuggggcaacaagagcgaaacuccgucucaaagaaaauaaaaauaaauaaauaaagugcaaa

SEQ ID NO: 168523 - RNA, 377 nt, Homo sapiens
uagaguuggcaaaaugauaaagauagaaaauagaaguggcugggcaugauggcucaugccuguaauaccaacacuuuagaaggccaaggcaagcggaucacuugaggucuggaguuugagaccagccucaucaacauggugaaaccccgucucuacuaaaaauuuuuuuguauuauuuacaaaaaaauuagccagguaugauggcaggugccugcaauccuagcuacuggggacgcugaggcaggagaauagcuugaacccaggagguaaagguuguagugagccgagaucgcgccacugcacuccagccugggugacagagagagacuccaucucaaaaaaaaagaaaaaaaaagaaagaaaauauaaguuaccag

SEQ ID NO: 168524 - RNA, 38 nt, Homo sapiens
uaaaaacacuggauguguucuuaaauagaacauggcau

SEQ ID NO: 168525 - RNA, 34 nt, Homo sapiens
cagaugagccaaaauaagaaaacuugauaauaag

SEQ ID NO: 168526 - RNA, 45 nt, Homo sapiens
auauggaguguauuauaucauauccuguaggcaggagacuguugg

SEQ ID NO: 168527 - RNA, 108 nt, Homo sapiens
augcuacuuauaucuggagugcuauagaccaccagguuaaaaggaagacaguaggucugggaaggaggaauagaucauaaauugauaaacugcuuuucuugccagaaa

SEQ ID NO: 168528 - RNA, 46 nt, Homo sapiens
cagcuucgggcauuuaucccagagaugcucaaguacucuacagguc

SEQ ID NO: 168529 - RNA, 77 nt, Homo sapiens
caggcacuacggaccauaguuaaaaacuguuauaaacagcaugggcgggaagaccuuuuguaugccuuugaagauca

SEQ ID NO: 168530 - RNA, 40 nt, Homo sapiens
aauuuguugauugggaaccucuaaaguucagauugaggug

SEQ ID NO: 168531 - RNA, 41 nt, Homo sapiens
caaaauugggccacguuacagggaggugagaugaccaucca

SEQ ID NO: 168532 - RNA, 47 nt, Homo sapiens
uuaaguuguauuuuaagaguugucuauucugaauugauuauagugag

SEQ ID NO: 168533 - RNA, 42 nt, Homo sapiens
aaaagcauaacuauaaaucaaauuaauauuuaguguuaauug

SEQ ID NO: 168534 - RNA, 46 nt, Homo sapiens
ucugagaaacucucaccauuagcuuuauagcuauguaagacuugag

SEQ ID NO: 168535 - RNA, 232 nt, Homo sapiens
gcgccaaugucucaccugugcuuggggucaggcagcaggcugugaugccggugccucucugguugguacugugguucugcuuccuguuauauguagccucacgaaggaccuuuggauuuagccaauuacaugccccuacccugagcuucuuccccagcucuuugacuuccuggacauuggugaauauccugaauaagcaaaagggauaaaauucauagaaauaugguggcaa

SEQ ID NO: 168536 - RNA, 44 nt, Homo sapiens
uggaaugaggauagauaaauaacauacuuucaucauguaggcag

SEQ ID NO: 168537 - RNA, 81 nt, Homo sapiens
uuggaaaagucuuugaagaaagacauagugcuguguccuccuuuggaauaggaggaaacaaaguaccucugucccgccaga

SEQ ID NO: 168538 - RNA, 49 nt, Homo sapiens
ggcauucaugugaagugugauugcucuuauucacuauggaacugcuaaa

SEQ ID NO: 168539 - RNA, 46 nt, Homo sapiens
cucugcugguccccagaacccccuguguuccaggacuccugaccuc

SEQ ID NO: 168540 - RNA, 63 nt, Homo sapiens
uggugcuuuucuuugccuccugcagagaugcugagcuguggacaccuucagaaagaccagcac

SEQ ID NO: 168541 - RNA, 49 nt, Homo sapiens
auccacgguguccucaaggccaaguuacaugcuucuuugucucauucuc

SEQ ID NO: 168542 - RNA, 42 nt, Homo sapiens
gucacgcagauuacucgugacacauuuuaaauccuugggcaa

SEQ ID NO: 168543 - RNA, 61 nt, Homo sapiens
ggcccaucuugcccggugcuuuuuuuuuuuuuuuuuuuuaacaguucuguguuauugucag

SEQ ID NO: 168544 - RNA, 50 nt, Homo sapiens
ucgcaaguggauccugacugacaaagccacagguggguucaucuuugggg

SEQ ID NO: 168545 - RNA, 46 nt, Homo sapiens
guccccauuaacaauuuggcuaugcuaaguacaguucagauaggaa

SEQ ID NO: 168546 - RNA, 43 nt, Homo sapiens
gugaaggacaagaaacuucuggaggucaaacugggggagcugc

SEQ ID NO: 168547 - RNA, 39 nt, Homo sapiens
ucccucuccuggugccuauuugacauuuuccaucauaaa

SEQ ID NO: 168548 - RNA, 45 nt, Homo sapiens
ucccauuugggccaguauuucuuugauguacaugguuagcguuca

SEQ ID NO: 168549 - RNA, 60 nt, Homo sapiens
caggcugcaggaaagauucacacagauuuugaaaagggauucauuauggcugaaguaaug

SEQ ID NO: 168550 - RNA, 46 nt, Homo sapiens
uaaucaggggcaggcugagcagaugcagggacagucccagccugau

SEQ ID NO: 168551 - RNA, 41 nt, Homo sapiens
cggaccagugcagguggccauggccccugugaccaccagga

SEQ ID NO: 168552 - RNA, 33 nt, Homo sapiens
ccauauuauggcaucguuuucuagucuacuuca

SEQ ID NO: 168553 - RNA, 41 nt, Homo sapiens
aaguuuuguuaaccuuuuuuuuuuuaaaaggaagaaagcgg

SEQ ID NO: 168554 - RNA, 47 nt, Homo sapiens
uucacugucccaaaaaagccaaauuguggcaggacuucuuucugcgg

SEQ ID NO: 168555 - RNA, 41 nt, Homo sapiens
cgcauggaauuaucuguaugaaaucaaggugcgcuguggaa

SEQ ID NO: 168556 - RNA, 49 nt, Homo sapiens
cugccucccaguggccacacagaacucucccugcuggacucaccugagg

SEQ ID NO: 168557 - RNA, 47 nt, Homo sapiens
gguaaccgaaguauuagggguuugaggagugcgugcguguaagugug

SEQ ID NO: 168558 - RNA, 54 nt, Homo sapiens
gcuagccucugugggucaaguuucuggacaccaagucucugggaacuaguguuu

SEQ ID NO: 168559 - RNA, 43 nt, Homo sapiens
auaguguucuaauuaccuuaaaaaaaaauaaugaccaguuaag

SEQ ID NO: 168560 - RNA, 45 nt, Homo sapiens
uuuaguuuagaagugcuguauuccacaagguuuaagucagugagg

SEQ ID NO: 168561 - RNA, 47 nt, Homo sapiens
cuuggaugugaagauaaaauagugcuuuuuugaaauggagaggaaaa

SEQ ID NO: 168562 - RNA, 48 nt, Homo sapiens
uccauguggccaagucagccugugugcuacugaacugucgaaggaaau

SEQ ID NO: 168563 - RNA, 45 nt, Homo sapiens
ggaggcgcugaaagaacaggaagaggguaccggggacagcucauc

SEQ ID NO: 168564 - RNA, 45 nt, Homo sapiens
ugagguacauuugcaagagguggcaguagaaguaauuuaccagag

SEQ ID NO: 168565 - RNA, 89 nt, Homo sapiens
acauugccuaaaaaaauguuguuuggcuuuucuuuucugguuuaagauguuuuguugguaaugggaagggauuuuugagggaccgacug

SEQ ID NO: 168566 - RNA, 53 nt, Homo sapiens
agaaguauuucucuugauaaguaaaaauuaguugccagauacaugcaacuaac

SEQ ID NO: 168567 - RNA, 42 nt, Homo sapiens
ccaauacugaaauuguuuccaguacugaaauacuuuuauugu

SEQ ID NO: 168568 - RNA, 74 nt, Homo sapiens
uguuuuguauaagaagcugcauuucucccaguuugcucauuuguuaauagaaugcugauguauuccaaauaauu

SEQ ID NO: 168569 - RNA, 102 nt, Homo sapiens
gagagauguuuagaaaagggagagcuuggugaugcuggaguugggaagagaauugcaggagcaccaccaucgagaaggaaggagggagcaggaucagaaccc

SEQ ID NO: 168570 - RNA, 47 nt, Homo sapiens
ugaaaggucugauuuuguuuuuuuaaugaucauucuacugcuguggg

SEQ ID NO: 168571 - RNA, 98 nt, Homo sapiens
uccaaaaucagggguaagagcuuuccaggcagaagaaauuuugaguacaaaggccccagccuggaaaacuggguaaaaugugaggugugugacacacg

SEQ ID NO: 168572 - RNA, 65 nt, Homo sapiens
uacucccucaagaacuagcaugaguaacuucauugagcaguauuuaagcagggaugggccaguau

SEQ ID NO: 168573 - RNA, 39 nt, Homo sapiens
aucucuagagacauaaacugguaauuauccaguguaggg

SEQ ID NO: 168574 - RNA, 188 nt, Homo sapiens
aaggucucuaaggaagugccauuuagacacaccauaaaggccuggugcaguggcucacacuguuaaucccagcacuuuggaaggccaaggcaagaggaucgcuuaaggccaggaguuugagaccagccucgccaacacagcgagauccccaucucuauuuaaaaaaaaaaaagacacaccuuaaagga

SEQ ID NO: 168575 - RNA, 53 nt, Homo sapiens
gaaugaaacauacaggccuuagaugcuuggaauggcaucuagacauggcgggu

SEQ ID NO: 168576 - RNA, 40 nt, Homo sapiens
gacaguauggcuuaguggaugggacaggcccuugugagaa

SEQ ID NO: 168577 - RNA, 45 nt, Homo sapiens
auauggcauuugguucucacagcugugaauuguacuugaucagau

SEQ ID NO: 168578 - RNA, 28 nt, Homo sapiens
uaguuguuuuguccaaagggugccagua

SEQ ID NO: 168579 - RNA, 49 nt, Homo sapiens
gcuggugcucaaggggguaucugcccaugaccaguagaacccaaauccu

SEQ ID NO: 168580 - RNA, 69 nt, Homo sapiens
uuuucuaauucauugggucuaggguggggucuaagaaguucgcagaugaugcuucugguccaggaccac

SEQ ID NO: 168581 - RNA, 74 nt, Homo sapiens
uaaaauacuuaaaagaacuuaguuggauuucaaaaguaaaaagauaauugagaaaaacauagguuacaagaagg

SEQ ID NO: 168582 - RNA, 73 nt, Homo sapiens
gaccuuacauuacguuauaauguuugcaacguaauagcuuuuuaccuguagaccuacagaguguaccuguuag

SEQ ID NO: 168583 - RNA, 115 nt, Homo sapiens
guugguuuucuaguguugcaauuuucuuagccccuugaccugcauuuuauagauauauuuaaacauugguauucuuuucagucuuaacagauuugaugguuccaagaaucauugg

SEQ ID NO: 168584 - RNA, 47 nt, Homo sapiens
ggaggggaggagcuaccaaacagcugauggaguaugugacaagagag

SEQ ID NO: 168585 - RNA, 45 nt, Homo sapiens
gugauuugcccuaaaggaauaucgguuuaaguucucccuggugga

SEQ ID NO: 168586 - RNA, 44 nt, Homo sapiens
aauagugcggccauuuguuugcaaagucagguagauuggugauc

SEQ ID NO: 168587 - RNA, 43 nt, Homo sapiens
agggaaccuauauaguaggaaaguagcaguguggggguaggga

SEQ ID NO: 168588 - RNA, 42 nt, Homo sapiens
uacaauugugugaaaaggcuggggguugagaaagauggugga

SEQ ID NO: 168589 - RNA, 46 nt, Homo sapiens
cagagguuaucuuuguuucguguuuauuuucugguauaauggaguu

SEQ ID NO: 168590 - RNA, 57 nt, Homo sapiens
uggccuucuguucuuuccccaccuuccuuccuuucugacaaaagaaagcagaggcgc

SEQ ID NO: 168591 - RNA, 44 nt, Homo sapiens
auguuuaauugggauggaguggggagacaauuccagcuguuugu

SEQ ID NO: 168592 - RNA, 39 nt, Homo sapiens
uaaguuugugguuuggaguuuagaauuuuugggggagug

SEQ ID NO: 168593 - RNA, 76 nt, Homo sapiens
aaucuuuucagaaauaagguguuuuucuccuugcucagggaaaacuugguuagaaauuaggagcaguagauagacu

SEQ ID NO: 168594 - RNA, 43 nt, Homo sapiens
ucgagaauuuuuuuuuuuugaaggguaguuuagaggguagggg

SEQ ID NO: 168595 - RNA, 46 nt, Homo sapiens
uuaucccuaauuccuuucuauauuaggaagagagucuccugcucag

SEQ ID NO: 168596 - RNA, 39 nt, Homo sapiens
acaccaugucaucucccaguccgggcaagaggcggaugg

SEQ ID NO: 168597 - RNA, 43 nt, Homo sapiens
cagagccggggccccgggcccgugacagacgggccgaggaagg

SEQ ID NO: 168598 - RNA, 45 nt, Homo sapiens
cugggguagggaggccgacugagcaggagucguccgcuuauagug

SEQ ID NO: 168599 - RNA, 45 nt, Homo sapiens
cugcccugggcagagauaaacaggcccugaauacauuucccagau

SEQ ID NO: 168600 - RNA, 41 nt, Homo sapiens
ccuccucagaaagcaggucaaggcaguuuggcuccguagau

SEQ ID NO: 168601 - RNA, 46 nt, Homo sapiens
cgccuagcugugggaaauuauuucaaaaagggugccaaguuaagga

SEQ ID NO: 168602 - RNA, 37 nt, Homo sapiens
cacggggcguguguguaagaggcauucugaaacggaa

SEQ ID NO: 168603 - RNA, 74 nt, Homo sapiens
ggaguguuggcuggggaguguaugggaaagagaaccuagaggauuagggaaaacuaguuggauuauuaauauuu

SEQ ID NO: 168604 - RNA, 53 nt, Homo sapiens
acaauuuuaaagagguauguuuguaauugaauauucaaucuaguagaaggaag

SEQ ID NO: 168605 - RNA, 46 nt, Homo sapiens
uugauuaaauugaagaugacaaagggaauuuagcacauuuaaugag

SEQ ID NO: 168606 - RNA, 38 nt, Homo sapiens
uuuuuuccccagucagugcauauuuagacuuaaagguu

SEQ ID NO: 168607 - RNA, 43 nt, Homo sapiens
gauugaauaaccuccgcagagucaacaggagucugugcauaca

SEQ ID NO: 168608 - RNA, 41 nt, Homo sapiens
uuaaauguuuguuuaauuugguugcuguuuuaaaauuuaau

SEQ ID NO: 168609 - RNA, 46 nt, Homo sapiens
caaauauugauuagaugcucuuuacccaaaagugugauuugcagag

SEQ ID NO: 168610 - RNA, 121 nt, Homo sapiens
aaaaguaaaacagacagguaacauuaauuuuauuuaauauuuuuauuuaacccaguauauuaaaaauaucauuucaacauacaaucaauaugaaaacuaauaauuucacauucauuuuugg

SEQ ID NO: 168611 - RNA, 35 nt, Homo sapiens
gaguauuuuacauguaaagcacaguucaguuugga

SEQ ID NO: 168612 - RNA, 64 nt, Homo sapiens
cuguuagauuucuucuuuaaauuugucuugcuaauucuuagaaagaagcauuugugccuugaga

SEQ ID NO: 168613 - RNA, 48 nt, Homo sapiens
aagugcaguaauaauaucccaauaugcaaaugaggaagcugagacuaa

SEQ ID NO: 168614 - RNA, 57 nt, Homo sapiens
uucuuccacaccacacuuucuguuucaagaguccuaaaaagaggaacugaguucuuc

SEQ ID NO: 168615 - RNA, 165 nt, Homo sapiens
auaguuaaggugugaucuuauuaauuguacauguauacacuaauauaugaguaguaugguacugaacuggaaggguucauuugaugaaaaggguggugugcacuagacuuagguauuuccacaaguagggauugauggguagguagguagacuaggccaaggugu

SEQ ID NO: 168616 - RNA, 31 nt, Homo sapiens
uugucagccauuuucuugaauuugucaugcu

SEQ ID NO: 168617 - RNA, 46 nt, Homo sapiens
uaccaaccuauauguguuuggagguuauaacccagauuaugaugaa

SEQ ID NO: 168618 - RNA, 44 nt, Homo sapiens
gauaggcuuuuuacuaggguaauaacaguauggugauuccaaau

SEQ ID NO: 168619 - RNA, 46 nt, Homo sapiens
ucccuuuaugucuuuggagguacaaccggcuauauuuacagcacag

SEQ ID NO: 168620 - RNA, 46 nt, Homo sapiens
cagagaguggacacaacugaaaccaaacaaccuauccugugaucua

SEQ ID NO: 168621 - RNA, 45 nt, Homo sapiens
uccaagauccaugcauacaaccuugaaacgaaugccugggaggaa

SEQ ID NO: 168622 - RNA, 60 nt, Homo sapiens
aaaaugaaauuaaaaaauuuuuacaucuagcaacagcaacaaccacaaauuuaggggaag

SEQ ID NO: 168623 - RNA, 79 nt, Homo sapiens
uacuuaaaccuagauguuuaacuuaguguuuucaagaugugucuaacugaguaguagcugggucugauggcagcagugc

SEQ ID NO: 168624 - RNA, 96 nt, Homo sapiens
ccagcagugguuagaguugguuugucaaaagacuuacgugugugucguggucgugcucuuuguuguugcucuuagaaauuauggcaccaagaaugu

SEQ ID NO: 168625 - RNA, 133 nt, Homo sapiens
uugugguggccaaaguucuucauucuggcaguuuugaaacucucuuaugcuuauuaaugguuuuaaauaucucuuugacuucuucauggggaauuguagacccuaaguaugugguguaaaugccauguaacau

SEQ ID NO: 168626 - RNA, 55 nt, Homo sapiens
uuuuccgucugcuuuaaugugcauggugcugugaauaauugucuaguaauuggau

SEQ ID NO: 168627 - RNA, 61 nt, Homo sapiens
aagaaccaaguaucauuuaaaaacuagcaugaggaaggaaugaaacugaguagcauucauu

SEQ ID NO: 168628 - RNA, 67 nt, Homo sapiens
guuggaacacaucuuuccuuuaagugccucuuuuuucaccuagcuuuuaaaguuauucuuuguccuu

SEQ ID NO: 168629 - RNA, 58 nt, Homo sapiens
augucuuacauuuuguugccggagaacaaggaaguccaucuguaaggaguuuccuaaa

SEQ ID NO: 168630 - RNA, 43 nt, Homo sapiens
cuucauuuaauauuuuccacauccuggaaaaacuauaaacuga

SEQ ID NO: 168631 - RNA, 48 nt, Homo sapiens
gacaugauguaaaaauuugcuuuaaaccauucaugcccuuaaauagcu

SEQ ID NO: 168632 - RNA, 64 nt, Homo sapiens
agggagagcacaggcaucucccuggaaaagcaccugccaaugacgaauuucauggaagaaccua

SEQ ID NO: 168633 - RNA, 48 nt, Homo sapiens
aggccagagaaguuuggacugugcgggcccuggagagagcuggguaaa

SEQ ID NO: 168634 - RNA, 51 nt, Homo sapiens
cucugccucauugagaagaccacauuaaaaaacugaaggaggccaggcaca

SEQ ID NO: 168635 - RNA, 52 nt, Homo sapiens
aggaagucucaaugcagaggaagacaguagauugggagggggcaucuccaga

SEQ ID NO: 168636 - RNA, 46 nt, Homo sapiens
aaugaacagaaaaagggauguaaguagagggagcugauuugagcag

SEQ ID NO: 168637 - RNA, 45 nt, Homo sapiens
agucuaaaugucagaauuaaauauaugacuugcuacucgccaaag

SEQ ID NO: 168638 - RNA, 34 nt, Homo sapiens
uccauaugaucaagaaguugucuauucauagcca

SEQ ID NO: 168639 - RNA, 52 nt, Homo sapiens
acaggcaagcugauacugaaacuucuuuaaaguuugugcauaaucccccaua

SEQ ID NO: 168640 - RNA, 45 nt, Homo sapiens
uguagucuucuuugucaguaggugaguuguagacgguaggugaag

SEQ ID NO: 168641 - RNA, 41 nt, Homo sapiens
cagcuguuuucaacccuaaaaguguuugcuguccaggacua

SEQ ID NO: 168642 - RNA, 76 nt, Homo sapiens
uccaaaaacucuggauagggauuuacaggauccaauggcccauagauaaaaugaacuagaaaagagaaaaggaaug

SEQ ID NO: 168643 - RNA, 88 nt, Homo sapiens
cuuuuccacaaugagcucuucucaaucucuccuugccaucugcucagccuaaaccaaugaauuggcuuuacaaucagacuaaaacaaa

SEQ ID NO: 168644 - RNA, 42 nt, Homo sapiens
augcaagcuguuuacuacuagcuuguauccaguaggccacag

SEQ ID NO: 168645 - RNA, 83 nt, Homo sapiens
uuuauacaaacuaguuuuuaaauguucauaauccaacaaacaacaacuugaaaauauaacacuuuugcaacaauugucaaagc

SEQ ID NO: 168646 - RNA, 49 nt, Homo sapiens
uguaagccagugggaagccccaguaaaugacccuguggacacaccacac

SEQ ID NO: 168647 - RNA, 53 nt, Homo sapiens
cuggcaaugcuggaaaauuuuuaucccagaggggugggggggaggggggaggg

SEQ ID NO: 168648 - RNA, 46 nt, Homo sapiens
uucugggcaugcagccaugugagagguccgauaaaguaccugagaa

SEQ ID NO: 168649 - RNA, 45 nt, Homo sapiens
cuuuuuccagaccauagacaagauccuaaaugccuuuucuucauc

SEQ ID NO: 168650 - RNA, 46 nt, Homo sapiens
cuacaaccagcccgggaccugcuacacacugguggcacugcccaaa

SEQ ID NO: 168651 - RNA, 45 nt, Homo sapiens
uggugguuguccaggccaucagugcccugugucagaaauauccuc

SEQ ID NO: 168652 - RNA, 50 nt, Homo sapiens
guguagauguaugcuagagaaaaucuuccucccuuacuuuucuguaagag

SEQ ID NO: 168653 - RNA, 74 nt, Homo sapiens
uagcagauuggacacaguggaaaaaagauuagagaacuuaaagacaagucaauagaaauuguccaaacugaagc

SEQ ID NO: 168654 - RNA, 48 nt, Homo sapiens
gaugugaccaaauauacuuuagcagucuuucgaaggcuagggaagggc

SEQ ID NO: 168655 - RNA, 28 nt, Homo sapiens
uaggacgcuuuauaccauuguccuuagu

SEQ ID NO: 168656 - RNA, 30 nt, Homo sapiens
uaauuuuagaaagccaugccaaagagagau

SEQ ID NO: 168657 - RNA, 39 nt, Homo sapiens
ugguggcuuaaaacaacacaaauucuuuuacaguucugg

SEQ ID NO: 168658 - RNA, 28 nt, Homo sapiens
caaaaccagguaaagugcuggccagugg

SEQ ID NO: 168659 - RNA, 45 nt, Homo sapiens
uacuaggauacgacagcaauguugugagcacuuaaaacccucgga

SEQ ID NO: 168660 - RNA, 73 nt, Homo sapiens
aucucucuggccugagcacaguuuacaaaaaaaaaaaaaaaaaaaaaaagguugguggugacugcaagcugga

SEQ ID NO: 168661 - RNA, 41 nt, Homo sapiens
ugaauuagggagagaaaacaauacuuaaugaaugaccaaua

SEQ ID NO: 168662 - RNA, 50 nt, Homo sapiens
ugaaagucuggaauugaguccugagagaauugaggaauugagaauugaga

SEQ ID NO: 168663 - RNA, 77 nt, Homo sapiens
ugcguacucuuaggacaggcaggcagagcugccucuagguuaugaugccagaggcagugcugaggauugggguggca

SEQ ID NO: 168664 - RNA, 44 nt, Homo sapiens
gaaggggcauugguggcgcuuggcagcaggugugacagaccucc

SEQ ID NO: 168665 - RNA, 23 nt, Homo sapiens
ccuccgagccugcggcuccaccc

SEQ ID NO: 168666 - RNA, 43 nt, Homo sapiens
agagauuuaauggaaaaaugagaauuguuguguacaugauuua

SEQ ID NO: 168667 - RNA, 72 nt, Homo sapiens
auucuauuuuaaauuucugcuacagucccagguuaacauuuagcccccuguggauuauacacacucacuaac

SEQ ID NO: 168668 - RNA, 54 nt, Homo sapiens
ggugaauuaacuaaaggaagaagacaugaaauuauuccaaaagauauaagggaa

SEQ ID NO: 168669 - RNA, 47 nt, Homo sapiens
ggggcuguacccuuggcaaagccaggcacgcugcaaagauagaaaau

SEQ ID NO: 168670 - RNA, 58 nt, Homo sapiens
uccaacuuuagaucuagcuuuggcuauaccauuccacaaaaacaucuugcagacacag

SEQ ID NO: 168671 - RNA, 79 nt, Homo sapiens
ugauuggcauguuggaauggugguagcagguuuguugacagaugccccuucuuuggcagauauaacaagagaagacgcu

SEQ ID NO: 168672 - RNA, 81 nt, Homo sapiens
gccacuggacucagauguaaagauggugguggcuuugggguagaaaagggagucuuccuaaacuuuaugaagaaggcucca

SEQ ID NO: 168673 - RNA, 324 nt, Homo sapiens
aaaauaaaacuucccagccaucucgguggcucaugccuguaaucccagcacuuugggaggccaaggcggguggaucaccugagguugggaguucaagaccagccugagcaacauggagaaaccccaucucuacuaaaaacacaaaauuagccgggcgugguggagaaucacuugaacccaggaguuggagguugcagugagccgagauuacaccacuacacuccagucugggcaacaagagugaaacuccgucuaaaaucaaucaaucaaucaaucuucccuuauugguacuaauuaguaauuaagguaaagucuugucugaau

SEQ ID NO: 168674 - RNA, 45 nt, Homo sapiens
auaaauucuggaacuuuuugguuagagcagauaaaucccccagau

SEQ ID NO: 168675 - RNA, 58 nt, Homo sapiens
aaaacacgauauacauuguaucuguugcaagucagguuccaagggaaauggaacucag

SEQ ID NO: 168676 - RNA, 26 nt, Homo sapiens
acaaauacagauuuggaugagcacuu

SEQ ID NO: 168677 - RNA, 57 nt, Homo sapiens
ggugugagagagggagacagaaaagaaagggagugauaauguauaugucuccagaga

SEQ ID NO: 168678 - RNA, 32 nt, Homo sapiens
gccaugguuugggauaugauuaggaaggggag

SEQ ID NO: 168679 - RNA, 24 nt, Homo sapiens
aaugacugaguauguagagaaaau

SEQ ID NO: 168680 - RNA, 51 nt, Homo sapiens
acauggaucuacucguagaaguacuguuaccccuauuuuauaguuggagga

SEQ ID NO: 168681 - RNA, 47 nt, Homo sapiens
uauuuuuaacccccucuuccccauaagugauuuuggugcagugagaa

SEQ ID NO: 168682 - RNA, 49 nt, Homo sapiens
cuaauguugcgcagauaaaauucaaacuugagguaaacagaagaagagg

SEQ ID NO: 168683 - RNA, 45 nt, Homo sapiens
cccggaaggggucugcgguuccuggccaggacguucggaaggcga

SEQ ID NO: 168684 - RNA, 41 nt, Homo sapiens
acaguuuagcuaguccuuuaucuuccuuauuuuucuugaga

SEQ ID NO: 168685 - RNA, 50 nt, Homo sapiens
uuauacuguggcaaaagcuggaucugaugcaaaggaaaacaugaaagaau

SEQ ID NO: 168686 - RNA, 45 nt, Homo sapiens
ugagguuugaagaauguguguacuaagcaguaaaucauugccaga

SEQ ID NO: 168687 - RNA, 47 nt, Homo sapiens
uccuucuauucuaucccuaaugccuuaguuuaauacuguggcuugag

SEQ ID NO: 168688 - RNA, 44 nt, Homo sapiens
gcuacaaaaguagacuugaguaguugcaagagaccacagagccc

SEQ ID NO: 168689 - RNA, 42 nt, Homo sapiens
uuuuuacuguuguuauuguuuccuacaguaucaucuaaccaa

SEQ ID NO: 168690 - RNA, 49 nt, Homo sapiens
uauuaaaaacauagcagagaaggacaagaaguuccugccugcuaaauag

SEQ ID NO: 168691 - RNA, 44 nt, Homo sapiens
uuccuuuuuauauaauucaguuccagugcauucuucaaagccaa

SEQ ID NO: 168692 - RNA, 42 nt, Homo sapiens
ggacuguaugaaauauauuuauuauagucauaauuauaggag

SEQ ID NO: 168693 - RNA, 75 nt, Homo sapiens
gcuucauaauuacccagaaaagaaagauuagggggagugcucuaaauugguuggucucuggugaauauauaaauc

SEQ ID NO: 168694 - RNA, 52 nt, Homo sapiens
ucuuaaacuaaucuuuguugagggccaugggaguagggcuucauaauuauuu

SEQ ID NO: 168695 - RNA, 42 nt, Homo sapiens
uaacaacuuaaguagauuaugaguuuaucaauacagcagaau

SEQ ID NO: 168696 - RNA, 47 nt, Homo sapiens
caugguugugucaauuaauauuuuacuauuuauauuugagguagcau

SEQ ID NO: 168697 - RNA, 40 nt, Homo sapiens
agacuuaagcccugggcucaugccucugucuuugaaaugu

SEQ ID NO: 168698 - RNA, 50 nt, Homo sapiens
uaaggggggagguuuugucacuucuucaucuguacucacugcuuugccag

SEQ ID NO: 168699 - RNA, 54 nt, Homo sapiens
aagccaauacagggaaacuuauuagccaaaguaauauauuucaacuaauaggag

SEQ ID NO: 168700 - RNA, 36 nt, Homo sapiens
uucuuuuuuuagucuguaggguuuuuuuuuucccau

SEQ ID NO: 168701 - RNA, 49 nt, Homo sapiens
guuuuuguggccuaaguaaugaaaaauagauugauuggugauugacuca

SEQ ID NO: 168702 - RNA, 68 nt, Homo sapiens
uuuuuuugcucuuuauuuguuuauuuauuuauuuucucucucucucuacagaaugguccuagugccag

SEQ ID NO: 168703 - RNA, 73 nt, Homo sapiens
ucuucacguggaaaauaagcaugccaagaaaaguuaggcugguucugaucuuuuaaaaacaucagcagauaau

SEQ ID NO: 168704 - RNA, 51 nt, Homo sapiens
uuuuacagguugaaaaaagaauagcuuaggaguagcacauagagaguucuu

SEQ ID NO: 168705 - RNA, 45 nt, Homo sapiens
uguuaaauaaugcaugguuuucaacugguuagaugguacagcaga

SEQ ID NO: 168706 - RNA, 45 nt, Homo sapiens
uugugguguucaugacaauuuaggauuuaacacaauguucaaauu

SEQ ID NO: 168707 - RNA, 90 nt, Homo sapiens
uuaaacacacacacacacacacacacacacacacacacacacacacacacacacacagucucucucucucagcaaaaccaagagcuagag

SEQ ID NO: 168708 - RNA, 37 nt, Homo sapiens
guaaagaagaauagguaaugaucauauagcauaggaa

SEQ ID NO: 168709 - RNA, 46 nt, Homo sapiens
gaggacauccagucucgaauaggacacugcauguuauuccacucag

SEQ ID NO: 168710 - RNA, 54 nt, Homo sapiens
uuuuuuucuucuuuuucagaaaaaucguugcuuauauguauuugguggccagcg

SEQ ID NO: 168711 - RNA, 46 nt, Homo sapiens
uccuccuucccuccccacuuaguucauugucuucuguaggcccaag

SEQ ID NO: 168712 - RNA, 46 nt, Homo sapiens
cugaaugaaauacacgucuuaucuggacucagcaaagauaaggaaa

SEQ ID NO: 168713 - RNA, 46 nt, Homo sapiens
acuguggaucauucagacccagaagagacaaaagagguaaagaaag

SEQ ID NO: 168714 - RNA, 37 nt, Homo sapiens
cauguuuucgugugauaagauucaagucaccaaaaac

SEQ ID NO: 168715 - RNA, 47 nt, Homo sapiens
uaacaguuguguaucgauuccccauaauaggucaggcauucuaggca

SEQ ID NO: 168716 - RNA, 27 nt, Homo sapiens
uucuucuugccacuauuuggugaauag

SEQ ID NO: 168717 - RNA, 94 nt, Homo sapiens
agccagcucaaaaaggcucucacuggucaaaucuaggacaauaugaguaucagaaugaaugaugacaguaaugaguauaacauugagcaagaga

SEQ ID NO: 168718 - RNA, 82 nt, Homo sapiens
ucccugaguacacagugaugcgaacaaauaaguaaaaugggaggaggggaagaaacagcucuucuuuacaauagaaugucaa

SEQ ID NO: 168719 - RNA, 45 nt, Homo sapiens
uugggauaaacugauaccacaugccuucugaggugaugcacugag

SEQ ID NO: 168720 - RNA, 62 nt, Homo sapiens
ucucacugaauauuccuuuagcuggaaugaacuugauaauugaauguuuauuagagguuaag

SEQ ID NO: 168721 - RNA, 31 nt, Homo sapiens
cacacuguaacugaagagucacuggacacag

SEQ ID NO: 168722 - RNA, 45 nt, Homo sapiens
acucuuggccauagaacuaaaaaugaaaccugagauugacccaag

SEQ ID NO: 168723 - RNA, 45 nt, Homo sapiens
agguaugcuauauaauucagcaaguaccaacuuguguagcugcag

SEQ ID NO: 168724 - RNA, 79 nt, Homo sapiens
auguacugaggagauaauugaaaagucagacucuguacuguggggcuuuaaucggagcacugcuggaaaugauugcaga

SEQ ID NO: 168725 - RNA, 42 nt, Homo sapiens
cacugguuuaucauagaaaaguuugauggguuuagagcucag

SEQ ID NO: 168726 - RNA, 37 nt, Homo sapiens
uuguugaaauaauacgaagcugacuagcuuacgugaa

SEQ ID NO: 168727 - RNA, 46 nt, Homo sapiens
ccaccaaauacugugaauuguuuuuccauuuauuuuucuuagcuaa

SEQ ID NO: 168728 - RNA, 44 nt, Homo sapiens
ucaugucauuugguugguuuuauuuucuagcccuuuaacauagg

SEQ ID NO: 168729 - RNA, 47 nt, Homo sapiens
accaacaccaaagagucaucuguguccuccaugcuguguuugcagca

SEQ ID NO: 168730 - RNA, 32 nt, Homo sapiens
uccaguaagacauuuacauuccuguccagaga

SEQ ID NO: 168731 - RNA, 63 nt, Homo sapiens
gcagaggccuauuugcugucuccgucaaaagcccuggcuggugaagugugacccaggaucagc

SEQ ID NO: 168732 - RNA, 45 nt, Homo sapiens
ugccagccguaugccgcacuuaucuugggccggguugaagguggc

SEQ ID NO: 168733 - RNA, 45 nt, Homo sapiens
ugccccaccccugcuggaguuacccaguuacucucaugagccaca

SEQ ID NO: 168734 - RNA, 69 nt, Homo sapiens
uuucauaagauggucaugucccgagcuuguugggguggccacaggaugcgucgaaguggguugucgggg

SEQ ID NO: 168735 - RNA, 59 nt, Homo sapiens
ccccagaguuuguuguaucuucugcuccauucuggcugcuugugguguuagguuuagcu

SEQ ID NO: 168736 - RNA, 58 nt, Homo sapiens
ggguugccugagccgccuccucuagccacgguaguguugacugggccugagacuugcu

SEQ ID NO: 168737 - RNA, 50 nt, Homo sapiens
aaaugcugcugauuucaguggggacggacaccagguuccuuaguguagag

SEQ ID NO: 168738 - RNA, 42 nt, Homo sapiens
uaaaguucagggggggaaacgggaaugacccaaugaaguaga

SEQ ID NO: 168739 - RNA, 59 nt, Homo sapiens
ugagguucagggagguccacuauuuuguccauggucaugcacaucucucugacccaaag

SEQ ID NO: 168740 - RNA, 76 nt, Homo sapiens
ucaccauucugggagggcgacggcgacggcgacggcgacgacggcagcagcggcggcguugacaacaguagcagca

SEQ ID NO: 168741 - RNA, 92 nt, Homo sapiens
guuuguuuccuccaaucaguuuacucgugcuuggaagggccauuugugcccuugacccugguguggccauagccuuggggaagggcaggaca

SEQ ID NO: 168742 - RNA, 47 nt, Homo sapiens
gagcacagaggucccgccccagcguagcagcuagacagccccuagga

SEQ ID NO: 168743 - RNA, 45 nt, Homo sapiens
guuuuuugccuagagggaguuuuugagggggggccucaagguggg

SEQ ID NO: 168744 - RNA, 80 nt, Homo sapiens
cagauugggggaagagacaagguggauggggcaggccagauccaggagaagggaugggacagauccagagagggaaagag

SEQ ID NO: 168745 - RNA, 39 nt, Homo sapiens
cuaaggccuuuuuucagucuaagggcuacauaggggaga

SEQ ID NO: 168746 - RNA, 40 nt, Homo sapiens
agcuuuauaguucuaaugucuacaguuuugugaccaaaca

SEQ ID NO: 168747 - RNA, 44 nt, Homo sapiens
auuuucuaacagggaucacuguguaaaaaaacuggugguagaaa

SEQ ID NO: 168748 - RNA, 25 nt, Homo sapiens
uggaugauaauccaggaggcuuaua

SEQ ID NO: 168749 - RNA, 44 nt, Homo sapiens
ggcaaugaggcauccugagaacuccauauuaugggcacauugga

SEQ ID NO: 168750 - RNA, 42 nt, Homo sapiens
agccuguggcucaguacaaaccuuaggaggccagcugcagag

SEQ ID NO: 168751 - RNA, 46 nt, Homo sapiens
aggagacugcucaggcacugaauguaauuucauuuggggaucaggc

SEQ ID NO: 168752 - RNA, 42 nt, Homo sapiens
ggguaccagggguccugcugcgcaggagguuugcccagagug

SEQ ID NO: 168753 - RNA, 48 nt, Homo sapiens
gugucccacuuaucaccacucucucccaaggcaguauuacuuggugca

SEQ ID NO: 168754 - RNA, 47 nt, Homo sapiens
agaccugaaacuggcauuguauaagcaccaucaggagccuggugaag

SEQ ID NO: 168755 - RNA, 56 nt, Homo sapiens
aggucugcgagugacccuugcaggacuauagcaaugauggguguggacaagcaaaa

SEQ ID NO: 168756 - RNA, 41 nt, Homo sapiens
uguuaauauuguuuacaacaaauguaugaaauuuaaaucaa

SEQ ID NO: 168757 - RNA, 56 nt, Homo sapiens
uuuuuucucugcugucauugaaauuacuaggucauaacucccgaguuaacuuccag

SEQ ID NO: 168758 - RNA, 40 nt, Homo sapiens
gcagggucuggggacugggggcagcggcucgaccuccgcu

SEQ ID NO: 168759 - RNA, 47 nt, Homo sapiens
agauagugguugggauucaguuugucggaggcuacugccaacugcag

SEQ ID NO: 168760 - RNA, 40 nt, Homo sapiens
ucuaggaucuguagccucuucuguuaagaagauucuuuug

SEQ ID NO: 168761 - RNA, 39 nt, Homo sapiens
accuugguccuuauaguggccaguuuuuuuuuuuuuaug

SEQ ID NO: 168762 - RNA, 79 nt, Homo sapiens
cuuaggagacccuuuucugacuuuuauuuauucuuuuaaaaguacagagucuuugucaaaauaaaauagaauauaauua

SEQ ID NO: 168763 - RNA, 65 nt, Homo sapiens
aauagauauaauaacuuaaucuaaugucuucugguuaaaagcaguuugggaaagaaaacaggauu

SEQ ID NO: 168764 - RNA, 43 nt, Homo sapiens
cacggauugggugguucaggugcuugaugaguagaaaaggcag

SEQ ID NO: 168765 - RNA, 53 nt, Homo sapiens
agaaucuguguugcuucugacuaaggagagugacugauaacauuuaucuugaa

SEQ ID NO: 168766 - RNA, 44 nt, Homo sapiens
aauuagucaugguuaagauguaauucaucaugcaaaauaucaga

SEQ ID NO: 168767 - RNA, 80 nt, Homo sapiens
gaaucuaguuuauucuuuuauguuccuccaugaacuugacaauaauuuauaagucauaaucauuuugagaauaggaaugg

SEQ ID NO: 168768 - RNA, 49 nt, Homo sapiens
uccuuugaucaugucuuuuauuuagcucaugcuuuuaaaucuugcccag

SEQ ID NO: 168769 - RNA, 35 nt, Homo sapiens
ggcauauuuuuuccacaaaugguaguggagcggaa

SEQ ID NO: 168770 - RNA, 54 nt, Homo sapiens
uugaaggcauuuucugauugugcuuuacuuuagauuaacagucuggaaguuuuc

SEQ ID NO: 168771 - RNA, 139 nt, Homo sapiens
guuccuuuccugagcaucccacgcuguccugaguggcuuuugcccuucccuucauugccuuuguuccugccaucccccuacccguauucaugauauagcugaucuuuuggcauuccuaacaccuaacaaaaagaauugu

SEQ ID NO: 168772 - RNA, 45 nt, Homo sapiens
cuuugcucuaaaugacaguucagagcagacuauuguacaguauuu

SEQ ID NO: 168773 - RNA, 42 nt, Homo sapiens
cugagggaauuuaaugaaacucuaaauuaccacagccaacag

SEQ ID NO: 168774 - RNA, 46 nt, Homo sapiens
cauguaucaaacgaaguuauugaaauauuuuuaauaaguauaucua

SEQ ID NO: 168775 - RNA, 27 nt, Homo sapiens
ccugauauugaaaaagagccuugucuu

SEQ ID NO: 168776 - RNA, 39 nt, Homo sapiens
uuucuuaccauccucauuuucaguaugccagaguuuuga

SEQ ID NO: 168777 - RNA, 48 nt, Homo sapiens
ucacgaaaguaaaugucauauuauucuggguuaugaauuagcuucaau

SEQ ID NO: 168778 - RNA, 42 nt, Homo sapiens
augauucaguaacgauugggcuacguuaucucagagccaagc

SEQ ID NO: 168779 - RNA, 43 nt, Homo sapiens
aauuagaacgaggaauaaccuuaauauaaaaaaauguccuagu

SEQ ID NO: 168780 - RNA, 51 nt, Homo sapiens
uuuaguuuuucuuuuuuagguauuucuauuucuaauaguaugcuugugcug

SEQ ID NO: 168781 - RNA, 39 nt, Homo sapiens
cuagauccuguccaauucaguugcucccaauuuggccaa

SEQ ID NO: 168782 - RNA, 35 nt, Homo sapiens
uugucuuauuuaauaucuaauauucagaaugcaag

SEQ ID NO: 168783 - RNA, 46 nt, Homo sapiens
agguaaaagagaaccugcuuucaugcaagaugcugcugcacugcaa

SEQ ID NO: 168784 - RNA, 49 nt, Homo sapiens
gaagauaguuaaugaaucccauuuuaaacaaugaaaucuacaugagaca

SEQ ID NO: 168785 - RNA, 50 nt, Homo sapiens
uaguuaauauuuucauaaacuuuuuuuaagggaaaauguguguagaaguc

SEQ ID NO: 168786 - RNA, 42 nt, Homo sapiens
acagauuuuugauuggucagucuguggccagaugggaacuag

SEQ ID NO: 168787 - RNA, 64 nt, Homo sapiens
aagaaauaaggcucucaauguggaauuaugcaucagaaccccuagaacuaugcauagcuuagga

SEQ ID NO: 168788 - RNA, 24 nt, Homo sapiens
cuucauucagauauagacaagaag

SEQ ID NO: 168789 - RNA, 48 nt, Homo sapiens
uaccucuuuucagcagauaggcacuagaaaaacuucugccaggcacac

SEQ ID NO: 168790 - RNA, 41 nt, Homo sapiens
aaaugauucagccagauuuaaaaaucacauagcacuguauu

SEQ ID NO: 168791 - RNA, 46 nt, Homo sapiens
aaacuggacuucuuaguucuuuucuuuuggguacaagcauagguua

SEQ ID NO: 168792 - RNA, 57 nt, Homo sapiens
aucauuucccucuuggcccacuuucacguacgggaggacccgugcacacucaccuug

SEQ ID NO: 168793 - RNA, 42 nt, Homo sapiens
uauuuaagauauguaguuggccaguuuccuacacagagauaa

SEQ ID NO: 168794 - RNA, 24 nt, Homo sapiens
ucuauuuagcuuuuuuauauguua

SEQ ID NO: 168795 - RNA, 52 nt, Homo sapiens
auuaagggcuuggcgaaacugaagaagaucccagaaacaguuaaggcaauca

SEQ ID NO: 168796 - RNA, 46 nt, Homo sapiens
uaugaccuaguuauuaguauccacauauugcaguuaggagaacugg

SEQ ID NO: 168797 - RNA, 39 nt, Homo sapiens
guaaacuugauucaaaaguacuauguuuggugaauggaa

SEQ ID NO: 168798 - RNA, 42 nt, Homo sapiens
gucuuuaagccuccacuuacuauuaaaugaaaauauucaacc

SEQ ID NO: 168799 - RNA, 54 nt, Homo sapiens
cuucaaaauaaaaugaguugcaaaugagugaagauauagauacaauaagccaug

SEQ ID NO: 168800 - RNA, 47 nt, Homo sapiens
uuuuucaugguagcacuugaagaugagauaccuagggaucacuuggg

SEQ ID NO: 168801 - RNA, 47 nt, Homo sapiens
aaccaagugaacuaaaagagaaaaguugauguccuccugguaguaag

SEQ ID NO: 168802 - RNA, 45 nt, Homo sapiens
uaccugcaggacacuguagugacuccacugacucagcaggaagau

SEQ ID NO: 168803 - RNA, 25 nt, Homo sapiens
acuugacuggaauuagucauauauu

SEQ ID NO: 168804 - RNA, 46 nt, Homo sapiens
auaugaaaaaaauuaaguauauguggggaauuggaaaauggaacug

SEQ ID NO: 168805 - RNA, 53 nt, Homo sapiens
ugcagcuuaacaauuaugugguuuacagguacagaaggagagaggacagagag

SEQ ID NO: 168806 - RNA, 50 nt, Homo sapiens
aacaaugcaagccagaaaucaauguaugucaaucuaagaaugcugaaaag

SEQ ID NO: 168807 - RNA, 365 nt, Homo sapiens
auuugucaccacuagacuuucacuuaaagaaauguuauagaaaguuuuucagccaugcgcgauggcucaugccuguaaugccagcacuuugggaacccgaggcggguggaucacgaggucaggaguucaagaccagccuggccaagauggugaaacccugucucuaugaaaaauacaaaagaauuaacuggguguggugucuggcgccuguaaucccagcuacuccggaagcugaggcagagaauugcuugaacuggggagguggagguuguagugagcugcgaucgcgccacugcacuccagccugggcggcagagugagacuccaucucaaaaaaaaaaaaaaaagaguuuuucaggcugaag

SEQ ID NO: 168808 - RNA, 44 nt, Homo sapiens
aauugaacagugaauaaauauuugauuaauccagaagaaaggaa

SEQ ID NO: 168809 - RNA, 47 nt, Homo sapiens
auuacauuagacauaaaucgaccagauacuccaguugaaagacagag

SEQ ID NO: 168810 - RNA, 41 nt, Homo sapiens
ugaaaaguugaaauguuccuuguauauuaaauucuuuguau

SEQ ID NO: 168811 - RNA, 41 nt, Homo sapiens
cugccauauaaauguuuagugauaaaauuaaccucuugcag

SEQ ID NO: 168812 - RNA, 90 nt, Homo sapiens
cuuuaagugugcucaucaagauuuggugcaccugggccaaggcaagaauguugcuaggauccaagaggccauaauaaguuguggugauua

SEQ ID NO: 168813 - RNA, 29 nt, Homo sapiens
acuuuauuauguaucuggcaccaucacgc

SEQ ID NO: 168814 - RNA, 46 nt, Homo sapiens
aaucuauaaguuccugcuccaucugucauuuuauuuuuaucccuug

SEQ ID NO: 168815 - RNA, 46 nt, Homo sapiens
gaguaaaguagugaaaguaauguuuuuaggaugguuugucuggcag

SEQ ID NO: 168816 - RNA, 42 nt, Homo sapiens
ugucugccugggaauagcugaagccauacaaauggaccagcu

SEQ ID NO: 168817 - RNA, 46 nt, Homo sapiens
uuugacuagccaccugaaaguugugaaggguuuugaaaauauaaag

SEQ ID NO: 168818 - RNA, 48 nt, Homo sapiens
aggaaugagcauggaaguaaagagauguuaaccuuuucagagauagga

SEQ ID NO: 168819 - RNA, 24 nt, Homo sapiens
acaaaugaguaguagauacucuau

SEQ ID NO: 168820 - RNA, 84 nt, Homo sapiens
uuaaagcacucacauuaaggaaaguuugcauuuuaaauauaaaguagucuuaaaauuuuucucuacccacauauaaacaccauu

SEQ ID NO: 168821 - RNA, 50 nt, Homo sapiens
agugaagaaugaugcccuuuucuuuaaaacaaaaaucuggaggcagccag

SEQ ID NO: 168822 - RNA, 35 nt, Homo sapiens
aggcuuugguaagagaaacaaagaagagggaguag

SEQ ID NO: 168823 - RNA, 43 nt, Homo sapiens
gaguaaggguucauguauguguuuagucaccauucaaauuuga

SEQ ID NO: 168824 - RNA, 48 nt, Homo sapiens
aggaguuaguggcacugagauauaugagcagccuggguagaaauggag

SEQ ID NO: 168825 - RNA, 45 nt, Homo sapiens
cugaaugaugaguacuuaguuggcagauauuuaucaguugccuac

SEQ ID NO: 168826 - RNA, 42 nt, Homo sapiens
ucuauagugaccaguuauuugggagucaccugauugaccaaa

SEQ ID NO: 168827 - RNA, 34 nt, Homo sapiens
ucuacauuccaucauuuuagaaacaaaagccaca

SEQ ID NO: 168828 - RNA, 78 nt, Homo sapiens
uguuacgugguagguuaauaaacgagguaaugaggggaugaauguagagauagguggaacauauagauugguagauua

SEQ ID NO: 168829 - RNA, 63 nt, Homo sapiens
guggauauuuuggaaaaugaauuguguaagagaagacagaauuugaaaacagaaggacagaga

SEQ ID NO: 168830 - RNA, 57 nt, Homo sapiens
guucaggagguaugcccgugaauucaaacuugccaagcagguuguuauccuuggaca

SEQ ID NO: 168831 - RNA, 51 nt, Homo sapiens
caguugaugaggauggucaugacuccacuagcaguuucaauaccaagggaa

SEQ ID NO: 168832 - RNA, 50 nt, Homo sapiens
cuuggagaagcuucugaaucuuggggauacuaauagaaccaccaaccagg

SEQ ID NO: 168833 - RNA, 46 nt, Homo sapiens
uuggcaucucgaagggcuuucucuacuggguccagggugccacaga

SEQ ID NO: 168834 - RNA, 44 nt, Homo sapiens
cccagagcugaaguucagaacuuccuuguugauugucaguguua

SEQ ID NO: 168835 - RNA, 49 nt, Homo sapiens
uaaguccaaauuccuugacauggcacacaaggccuuccuugagucuggc

SEQ ID NO: 168836 - RNA, 45 nt, Homo sapiens
gccuggcacauuagaaauauuuauugaauaagaggugaaaugaaa

SEQ ID NO: 168837 - RNA, 45 nt, Homo sapiens
gcaaauaucaauaaaacaaaauuuguaauuuuauauuaguaugua

SEQ ID NO: 168838 - RNA, 54 nt, Homo sapiens
cacaagugacaggagaaauccauguauaaaugucugugcuacaugcuauaagca

SEQ ID NO: 168839 - RNA, 47 nt, Homo sapiens
uauccaucuuuuguaucaaaaggaauuuagcaaauagauguauguag

SEQ ID NO: 168840 - RNA, 46 nt, Homo sapiens
uggcuaguauaccaggguuaaugcuggugcuuuaaggagaagggug

SEQ ID NO: 168841 - RNA, 44 nt, Homo sapiens
uuugcuggaagcgcagaagaaucuucgaaggguuuuaaauagga

SEQ ID NO: 168842 - RNA, 33 nt, Homo sapiens
aaaaaguaauuccuuucuacccuuucuucccac

SEQ ID NO: 168843 - RNA, 101 nt, Homo sapiens
uugguaauagaaagaacauagcagauuuauuaguuucacucaucucauaaagauaaugucaucaaacauguuaugaacauaguucaggacaagagacaacu

SEQ ID NO: 168844 - RNA, 72 nt, Homo sapiens
acuauaggcuacaaucuuggagaaucccagacucgacacuuuuuuuguugcuguggcacauuagugcccaga

SEQ ID NO: 168845 - RNA, 93 nt, Homo sapiens
aaacuguuacagaugguaggugccaaagaagguugauuuagagggagaagaaaguucuuugggcuugaccuggccaggugaauuguuuuaugg

SEQ ID NO: 168846 - RNA, 29 nt, Homo sapiens
uacgaguagcagagaauguuccuugcaga

SEQ ID NO: 168847 - RNA, 22 nt, Homo sapiens
ggacagagggaacucagaucug

SEQ ID NO: 168848 - RNA, 46 nt, Homo sapiens
ugaauagucauugagcauuuuuucaggauacuuuagaaauaccaaa

SEQ ID NO: 168849 - RNA, 26 nt, Homo sapiens
uugcaaguaggcugggcagucuggcc

SEQ ID NO: 168850 - RNA, 44 nt, Homo sapiens
uauuguauauucgaugugagguuuagcacuaugaauagagucag

SEQ ID NO: 168851 - RNA, 56 nt, Homo sapiens
agcuucaggggauagggagauguugguagggaguugcuuuuucaagggaggacaga

SEQ ID NO: 168852 - RNA, 87 nt, Homo sapiens
uugguaacaucaugccccaguuagggguuaugugucuguaauugccacaggagcagcccuguguguuaugccugcagcuggcucuga

SEQ ID NO: 168853 - RNA, 108 nt, Homo sapiens
uguaugcuaaggcucaggcauugacaucaccucuauacguuuucaucaacaacucugacauuuugacaugacaaccuugaaacuauuaucuuauggaaugccagacac

SEQ ID NO: 168854 - RNA, 56 nt, Homo sapiens
guagaauggaaauggauuuuucuuuuaauuuuugguagagcaggaauuuuaaccuc

SEQ ID NO: 168855 - RNA, 104 nt, Homo sapiens
guugagccacccaacucuguacucuguaaauuaauaucuugcuuuugcaugaacucucuuugccgguuuucuccaucaauugccgugguagagaugaggcuggu

SEQ ID NO: 168856 - RNA, 102 nt, Homo sapiens
ggccaaauauuuucuucuuguauuuccaguggguaagggggugguaccacacacacuuuggguauuccauuguucuuccuuucaguuugagguucccaugua

SEQ ID NO: 168857 - RNA, 106 nt, Homo sapiens
ucugauuaacagaagggaaaaaaucaauugguagauuuugaagagagaaucaauuuccuuauuacagaaaaagaugagagacauaacuaccuuguguuugcaaauu

SEQ ID NO: 168858 - RNA, 84 nt, Homo sapiens
auuugcuucagucugugaugcuuucaagaguuugagaaauaggguauuuaacuucucaacuuaugccugauaggaucacgguaa

SEQ ID NO: 168859 - RNA, 46 nt, Homo sapiens
uugacagugauuuguaugucuacggcuuauuaaaccucagcauaga

SEQ ID NO: 168860 - RNA, 54 nt, Homo sapiens
cauuugccaucaagcagagcacaugccuuagagugaucaggaagaagcaauguc

SEQ ID NO: 168861 - RNA, 45 nt, Homo sapiens
uaugggacauauaguaggcauuuaauagcugauagugaaaucuga

SEQ ID NO: 168862 - RNA, 45 nt, Homo sapiens
agugcauugcugcuggcuggguucuccuccagugaacaauccugg

SEQ ID NO: 168863 - RNA, 47 nt, Homo sapiens
uaccugccauugaugguuugaaauuauuguuuuagaaaggauauacu

SEQ ID NO: 168864 - RNA, 52 nt, Homo sapiens
aacuuaagucaaauuaaaaagacccuuuugaaagccuagcgugaagugaggg

SEQ ID NO: 168865 - RNA, 42 nt, Homo sapiens
gagauuuaaagcugaaaaaguuggacuccacuucagagagcc

SEQ ID NO: 168866 - RNA, 45 nt, Homo sapiens
auuugggacaauauuccaugacaacuacuaaauaaaaaguacauc

SEQ ID NO: 168867 - RNA, 26 nt, Homo sapiens
uacugaaaauuuuuuguuucuaguuu

SEQ ID NO: 168868 - RNA, 27 nt, Homo sapiens
uuacuuuccuuccacugaugcaacaca

SEQ ID NO: 168869 - RNA, 41 nt, Homo sapiens
ggaaccgaagacaaaaugagagaauaaaagcagagaggagg

SEQ ID NO: 168870 - RNA, 46 nt, Homo sapiens
gauaugugaaaaaaugugagcaaauguguaccuuagaaucugagaa

SEQ ID NO: 168871 - RNA, 46 nt, Homo sapiens
accagaguagaacagugccacagcacaggcaucaagaagggucaca

SEQ ID NO: 168872 - RNA, 45 nt, Homo sapiens
auguaaaggcagacauauauuucuacuucucacaguaaggcccag

SEQ ID NO: 168873 - RNA, 89 nt, Homo sapiens
uugaaggcagguguaccuucccaaguucucugagcucauuuuugggcugcagcuccugccaguauggaaucagguaucacagagcccag

SEQ ID NO: 168874 - RNA, 45 nt, Homo sapiens
gaaugaacagaaacuuuagugaaacguuaauauuuguguugggcc

SEQ ID NO: 168875 - RNA, 48 nt, Homo sapiens
uggaggaagcaccuuguguuucuccugagucacauaaauaugaagcag

SEQ ID NO: 168876 - RNA, 56 nt, Homo sapiens
gcaugugagcuguucagccauugcccuugccucaugggggcagaagugggggugaa

SEQ ID NO: 168877 - RNA, 46 nt, Homo sapiens
guccucuuugaaauuuuuaugaguauauauugcuuuuaaauaaaag

SEQ ID NO: 168878 - RNA, 57 nt, Homo sapiens
acaaauugcaaacauuuagccugugguuaaaaauuacacccauccuuuuucuuuuaa

SEQ ID NO: 168879 - RNA, 56 nt, Homo sapiens
uuaugcuuuuuuuaaaaaguucagcaauuuguuguauuuuuuugauuugcuggucu

SEQ ID NO: 168880 - RNA, 52 nt, Homo sapiens
aaauuaaaugaaaacuacaugaauugaacuaaguugguggcugucaaaaugg

SEQ ID NO: 168881 - RNA, 28 nt, Homo sapiens
uaaggauccuggcuaaaggcugaugggg

SEQ ID NO: 168882 - RNA, 99 nt, Homo sapiens
cagaucacaguuguaccaguugaaaugcagaauaagcaaaagauccaaauacgguuguaaaggagccuuagccaggaauaucgcucauaaaucaagguc

SEQ ID NO: 168883 - RNA, 48 nt, Homo sapiens
gaaagggaaaaugcaaccacugucauuauuuaaagggaaaaagaugcc

SEQ ID NO: 168884 - RNA, 42 nt, Homo sapiens
uagaaaauaaauuaaauauaaauaaauauauuagacugauaa

SEQ ID NO: 168885 - RNA, 41 nt, Homo sapiens
uggaaguuggguacaaagaaauauaaagcuuaaagaucuag

SEQ ID NO: 168886 - RNA, 49 nt, Homo sapiens
cccuuguccccacacaugcccaccuuccuccagugucgacauccgucag

SEQ ID NO: 168887 - RNA, 26 nt, Homo sapiens
auucuguuuguccuuucugucaucuu

SEQ ID NO: 168888 - RNA, 49 nt, Homo sapiens
auacugguugacuuagugacagaaugaaugaggacaguuaggaucuaaa

SEQ ID NO: 168889 - RNA, 46 nt, Homo sapiens
gcuuuauuaaauagaaauauugcccuugagcucucuggcccaggac

SEQ ID NO: 168890 - RNA, 77 nt, Homo sapiens
caaccacauuauguuccuaauaaucauuaaaaauacuuuaggugagcugacauauuacacacuuggugagagaauaa

SEQ ID NO: 168891 - RNA, 47 nt, Homo sapiens
ggauuucuucugugcugacuuuguagacucuccccagaugaucucag

SEQ ID NO: 168892 - RNA, 45 nt, Homo sapiens
agugcccgagcacagcugaccuccaugucugugucuccugcccuu

SEQ ID NO: 168893 - RNA, 45 nt, Homo sapiens
auuuuuaguuauagaacucuucuucuauuuaaucuuauuucacag

SEQ ID NO: 168894 - RNA, 36 nt, Homo sapiens
cucacuucaucuuuuucuuuuuccuuccucugugug

SEQ ID NO: 168895 - RNA, 24 nt, Homo sapiens
aagaaaauauuagauaauauauua

SEQ ID NO: 168896 - RNA, 50 nt, Homo sapiens
aaagaaaagaaagggaccauaaaugugucacuuauauggucaccugccuc

SEQ ID NO: 168897 - RNA, 140 nt, Homo sapiens
uucuaacuugccuugcagccaacauggacguguaauuuaauucuggcuaauaggaugugauugaaaguaauguguguaacuuugggucauucucuuauugggaagaaagaggcugucuuucucucccagcccagccugug

SEQ ID NO: 168898 - RNA, 44 nt, Homo sapiens
uggauaugaauggaaugugguaaguccuccuagaccaugcaggu

SEQ ID NO: 168899 - RNA, 57 nt, Homo sapiens
cauaccucaguaacuuccuggaccagagucaccgcaucaucccggacuucugcauga

SEQ ID NO: 168900 - RNA, 80 nt, Homo sapiens
aggcaucuauaaguauuuaaagcuuaaacucgguuauaacagaugaagagaaguuuuccagguaaagaaauugaggcaag

SEQ ID NO: 168901 - RNA, 52 nt, Homo sapiens
auuguucauccuaguaagagauuaagaauugauaagaaccaaugguguacug

SEQ ID NO: 168902 - RNA, 47 nt, Homo sapiens
ucauggaacuggaaauauuuuauugugguuaagcauaaaguguaugg

SEQ ID NO: 168903 - RNA, 70 nt, Homo sapiens
ucaaguugacauauaaagguaaccaucacagaaacaaaguuugaaaaaaaaagguuacagcugaucugaa

SEQ ID NO: 168904 - RNA, 50 nt, Homo sapiens
auggacuuucaucguuuccacuuuggggcuacuauagauaauucuccuau

SEQ ID NO: 168905 - RNA, 399 nt, Homo sapiens
uacagcauuuuuuguuguuguuguugguuuuuuuugagaugcggucuugcucugucccccaggcuggagugcagugcaccggugugaucauaacucacugcagccuugaucuccuggacaucaggugaucuuccugccuuagccucccaaguagcuaggaacacaggugugcaccaccgcaugcaccaucacaccuggccaauuuuagcuuuuuuauugagacaaggucucacuuuuuugcugaggcuggucucaagcuccuggccucaaacaguccuccugccucagcuucccaaagcacugggguuauaggcuugagccacugcacccagccaauauaguuuuucauaguucagugaucuuguauuccuucuagaagaaguccugaucauguucaua

SEQ ID NO: 168906 - RNA, 51 nt, Homo sapiens
uaaagguaucuccucucuuucaacuuuuuguaauuuuuuggccagugguuu

SEQ ID NO: 168907 - RNA, 69 nt, Homo sapiens
uuuccccuuugggugguauccaugauucugacagacugucacucucgggguuaguuuuuuauauggcaa

SEQ ID NO: 168908 - RNA, 40 nt, Homo sapiens
aaauacagagaaaauacauguaacuauuuuacaagucaac

SEQ ID NO: 168909 - RNA, 45 nt, Homo sapiens
ucagcaccucuuagagauaugugugauaauauaugucagucagaa

SEQ ID NO: 168910 - RNA, 72 nt, Homo sapiens
augagauuaucaaaccagggucagacacuugacagcaaagugggagugggggagugugaaauuauauguaaa

SEQ ID NO: 168911 - RNA, 48 nt, Homo sapiens
aaauuggcugcaguuuaaucuuggggaaaaaggaagaaaacugccagu

SEQ ID NO: 168912 - RNA, 104 nt, Homo sapiens
aaugcuauuguuacauguguguguguauacauagacacacguauguauauguguguauauauauauauguauacauacacacacguauacacacacacacacuc

SEQ ID NO: 168913 - RNA, 38 nt, Homo sapiens
guucuguaguuagauucuuuuaaauaauguaaaaaaaa

SEQ ID NO: 168914 - RNA, 48 nt, Homo sapiens
augauuuuguuguuguguucagcuuaauugccauuagcuacugcugaa

SEQ ID NO: 168915 - RNA, 49 nt, Homo sapiens
auuggucugggacucgacuauguaguucuuaugauuuggacuggcucga

SEQ ID NO: 168916 - RNA, 44 nt, Homo sapiens
aaauugugugagauauagaagaaauaacuuaaaagaauugaaaa

SEQ ID NO: 168917 - RNA, 71 nt, Homo sapiens
aaagaaaaauaugauagaaguugaguacaaccuaauuagccuccaaaugagaauucaaaauaguuuagaga

SEQ ID NO: 168918 - RNA, 49 nt, Homo sapiens
uagcugauaaaauuaauuacagauagcuaaguaguaaaauauaacaaau

SEQ ID NO: 168919 - RNA, 86 nt, Homo sapiens
ccuccccuggcauccugaagaguagugaauauguuuugcuuccugagaucuaaaguaucccuuucguuaccaccuaguguucucuu

SEQ ID NO: 168920 - RNA, 43 nt, Homo sapiens
uauggugugugcugugccuuguauuuaaaaaauaaaacccuag

SEQ ID NO: 168921 - RNA, 461 nt, Homo sapiens
guaaguuauuugaacaccuggacauuuuguuuuuccaucaaccaggaagaaauauugagauaauggauauacaaucaugcaucacuuaaugauggagacacacucccagaaguguguugcuaguugauuucauaguugugcaaacaucauagagugcacuuacacaaacccagauggcauagccuacuacacaccuaggcuacaugguuuggccuuuugcuccuagagcacacaccuguacagcauguuauuguacugaauaggguauuuguaacauagugauauuuguguauauaaacauagaaaaggcauaguaaaaauaccauaguauaaucccauggaaccaucacuguauguacagugugauguugauggaaauguuguuaugccgcacacaacuauacauuuauccauccucaaacgcuaaucuccuaaagagaaaugaaagcacauguagaguu

SEQ ID NO: 168922 - RNA, 51 nt, Homo sapiens
auccaagaaaguuaguuacaugauuucuaaaucacuccuguucgguauaag

SEQ ID NO: 168923 - RNA, 43 nt, Homo sapiens
aacauuuuaguaaaaccaagaaagacuugucuuuagucaugga

SEQ ID NO: 168924 - RNA, 51 nt, Homo sapiens
uacuuuuaauaaugugauagcuuuuuuauuuucaaaaaaucuuccuuuuga

SEQ ID NO: 168925 - RNA, 46 nt, Homo sapiens
uggucuuuuaucuccuuuguugccuccuuucagaaaugcuucuaaa

SEQ ID NO: 168926 - RNA, 51 nt, Homo sapiens
agauuuuuggauucuuagaaggccacuuaaccauuucuguuuaguauuuac

SEQ ID NO: 168927 - RNA, 46 nt, Homo sapiens
gauggggccugaugguuuaaugcaggccuuaaucaagggcuaggaa

SEQ ID NO: 168928 - RNA, 49 nt, Homo sapiens
gacaaacaucuccuuucugguucuuaaaauauuuuacucuuagaccuuu

SEQ ID NO: 168929 - RNA, 83 nt, Homo sapiens
uuauaaauguuaauaauauuaaguguguuuagacuagaaauaugcuaauugacugccugaagacgaccauagcuaucaaaaga

SEQ ID NO: 168930 - RNA, 45 nt, Homo sapiens
uguccuugaacucuugauuggcuuugcaaguuguuuucuggaugg

SEQ ID NO: 168931 - RNA, 48 nt, Homo sapiens
uuauuuguuuucuuaguaggaaacugauuuaccuuacuucuacaugug

SEQ ID NO: 168932 - RNA, 43 nt, Homo sapiens
aagcaauaaccuuuuuauguucuguuucuaaagcaagaggaca

SEQ ID NO: 168933 - RNA, 35 nt, Homo sapiens
aauuuuccuuucuguauuuauuacagauucuccag

SEQ ID NO: 168934 - RNA, 45 nt, Homo sapiens
uggaacaugacuuuaagccuagauuuccauuacauaaaagucuag

SEQ ID NO: 168935 - RNA, 48 nt, Homo sapiens
uuuguauuugaauugaagccaugcuuuuuguuacaaagcccuuguugc

SEQ ID NO: 168936 - RNA, 48 nt, Homo sapiens
aguccagcuacauggaaguaucugccacuguauucauagcaucuggca

SEQ ID NO: 168937 - RNA, 73 nt, Homo sapiens
aaguauuaccgaauuugauuuucuguuguucccaacaaagugagaggugauccuagguuuuauuuugcuguug

SEQ ID NO: 168938 - RNA, 45 nt, Homo sapiens
gaauuaaccacuuugggaagaauuauggggcuggacaugagggag

SEQ ID NO: 168939 - RNA, 43 nt, Homo sapiens
guguuguugaaaaugauggaugacuugcugaaggagugggaga

SEQ ID NO: 168940 - RNA, 47 nt, Homo sapiens
uuuuuaauggccauuucuaauggcauaugaaauugaaagagacugaa

SEQ ID NO: 168941 - RNA, 42 nt, Homo sapiens
ugucugauacauugucuucucuuuucauugaaauggauuggu

SEQ ID NO: 168942 - RNA, 54 nt, Homo sapiens
uggaagucuuuaaagauaaaggaagggcugagaauguuuuauucuuguugacau

SEQ ID NO: 168943 - RNA, 53 nt, Homo sapiens
uguagauacauuauugaauugaagagccguuggcauuccagggaagcuuuugg

SEQ ID NO: 168944 - RNA, 56 nt, Homo sapiens
ccucuuaacgguuaagaguguccuuuaucuucagcguugaugacaaaccuguuaca

SEQ ID NO: 168945 - RNA, 34 nt, Homo sapiens
cguuuauauuaucuguauuggugaugugcuccac

SEQ ID NO: 168946 - RNA, 61 nt, Homo sapiens
guguugaaaagagaugcauucaauucacagcuauggaaguuuuaaauugauuuuuuuuucc

SEQ ID NO: 168947 - RNA, 46 nt, Homo sapiens
ucaccugaaaccugaguuacuguacacuuaaugcuugucucuccug

SEQ ID NO: 168948 - RNA, 45 nt, Homo sapiens
aggccagucuguuuuugcauuccucaguucugauuucuuuuggca

SEQ ID NO: 168949 - RNA, 43 nt, Homo sapiens
uuguugaaauuguuguauuuuuguaaugugauugcaacauugc

SEQ ID NO: 168950 - RNA, 41 nt, Homo sapiens
aucauuucuuuugauaagaaaauauucucuucuuguauaga

SEQ ID NO: 168951 - RNA, 59 nt, Homo sapiens
aauuuuuauuuuuauuuuuuugagggaucucccuacuguuuuccauacgacuacagcau

SEQ ID NO: 168952 - RNA, 45 nt, Homo sapiens
uaaaguaaacuugaaaauccuucuuuauuuucccuuugacucuua

SEQ ID NO: 168953 - RNA, 45 nt, Homo sapiens
ggccugugaagacugggccuauguuuccugcugcuuuugauacag

SEQ ID NO: 168954 - RNA, 30 nt, Homo sapiens
uuuagguuucuuauguguaaacuagaccau

SEQ ID NO: 168955 - RNA, 75 nt, Homo sapiens
gugacaaggaauugguaagguaucaaaauagaacaggaaauaauggaagaggcaagaccuucacaucuaggaaga

SEQ ID NO: 168956 - RNA, 40 nt, Homo sapiens
cuaccugccucuaccaggcauuauuaauugcccuuuggag

SEQ ID NO: 168957 - RNA, 46 nt, Homo sapiens
agucaaacuaaacuagacgggccuuggacagguggggaguuagcag

SEQ ID NO: 168958 - RNA, 46 nt, Homo sapiens
aucagauggcuugaauauguaauuaacaguuaaauuuguccuccag

SEQ ID NO: 168959 - RNA, 46 nt, Homo sapiens
gacauuuuuacuauuguuagacauacuucuuuguauucuugcccua

SEQ ID NO: 168960 - RNA, 45 nt, Homo sapiens
uccucccuucuuucuccccaggguuucccauuucacccuuuaaaa

SEQ ID NO: 168961 - RNA, 58 nt, Homo sapiens
ugaaucacuaauguguaauuauaacgugugcgauuauaaaaugggaaucaauguguuu

SEQ ID NO: 168962 - RNA, 46 nt, Homo sapiens
cugacacacuggcuuuuaugaaauugguuuuuauuaaaaucugcag

SEQ ID NO: 168963 - RNA, 48 nt, Homo sapiens
ucucuuugcaugccaaugggaaauggaaaaugaacuccauucuuauau

SEQ ID NO: 168964 - RNA, 41 nt, Homo sapiens
gggggcacucaaaugcuaaaaggucagaaaaaugaggugga

SEQ ID NO: 168965 - RNA, 41 nt, Homo sapiens
ugguuaauugugugaagugaugcugcuagauccaauaagaa

SEQ ID NO: 168966 - RNA, 44 nt, Homo sapiens
cagucuguuccaucucaucaugcccuuuaccucauuccuguaag

SEQ ID NO: 168967 - RNA, 40 nt, Homo sapiens
uuaaauugcuuuuaugaaagauaggauucacauaagcaaa

SEQ ID NO: 168968 - RNA, 46 nt, Homo sapiens
ucauaauggguuauuuuauacauagucacuguuaaugaaauugugg

SEQ ID NO: 168969 - RNA, 46 nt, Homo sapiens; identical to SEQ ID NO: 89838

SEQ ID NO: 168970 - RNA, 61 nt, Homo sapiens
uuauuugauuuucuuuuuuucacacucgcuaccucugucccucuccugcccucuucccuuc

SEQ ID NO: 168971 - RNA, 49 nt, Homo sapiens
gaaaguaagaauccauggugccuccauuaaagaaaaaauauaaauccua

SEQ ID NO: 168972 - RNA, 44 nt, Homo sapiens
ucaauuacaauugauuucuacuuagguaauguugcuaauuguua

SEQ ID NO: 168973 - RNA, 43 nt, Homo sapiens
cauugucuguaauuaaaccuuuaaugaauguuuuuaaugauag

SEQ ID NO: 168974 - RNA, 45 nt, Homo sapiens
cagugacauuguucuacccaugucaguuugauguguacauugaua

SEQ ID NO: 168975 - RNA, 24 nt, Homo sapiens
gcuaaagccuauguagacauuuug

SEQ ID NO: 168976 - RNA, 66 nt, Homo sapiens
ugguuguauguuuagagagauucuacucuacacaaugagaauuuucaaaugaauaaggcagcagaa

SEQ ID NO: 168977 - RNA, 47 nt, Homo sapiens
augaugcaguuaacugguuguugaauuuccaggucuacauucuuuaa

SEQ ID NO: 168978 - RNA, 46 nt, Homo sapiens
agcauugacuuucuucuuuggaacacaaagagacucauggaggggu

SEQ ID NO: 168979 - RNA, 41 nt, Homo sapiens
auauguaggcuaguuuuuggagacaguaaauucagucaagg

SEQ ID NO: 168980 - RNA, 46 nt, Homo sapiens
uaaaugagcaaaugaauugaagguaaaagugaugggggcaguuuua

SEQ ID NO: 168981 - RNA, 50 nt, Homo sapiens
caaaggcugucaaaaauuucauguccuuauauuuuuucuucuuuccagaa

SEQ ID NO: 168982 - RNA, 49 nt, Homo sapiens
cuccaagaaguauuuuucauagcuuggaaaagaggaaggaggccucugc

SEQ ID NO: 168983 - RNA, 46 nt, Homo sapiens
ucaggaaaccccucuauaauuuaaauauauuagcauauccuaagaa

SEQ ID NO: 168984 - RNA, 58 nt, Homo sapiens
gaugcuauauuuucagauucucuauuacuuugaauugguuuguaauccaaaaccauaa

SEQ ID NO: 168985 - RNA, 47 nt, Homo sapiens
auagaauauacugcuuucuuuucagccugugaaaauaaauuaaugag

SEQ ID NO: 168986 - RNA, 47 nt, Homo sapiens
uuuuacuuccgagcauuuuuuuuagcauggauguuaaacaccaucaa

SEQ ID NO: 168987 - RNA, 50 nt, Homo sapiens
uagagaagaagagaguuauuaaaaacuacaaagaacucaaggagaauggg

SEQ ID NO: 168988 - RNA, 81 nt, Homo sapiens
acagcagaaguagcuauuuuucucuauuuugccuaggaaguauuuugcuaagaagcaguagauagaagauggcaguaggua

SEQ ID NO: 168989 - RNA, 37 nt, Homo sapiens
ugauauggcuguuaauuuucuuuguuuucccuuuugc

SEQ ID NO: 168990 - RNA, 128 nt, Homo sapiens
gcaacccccaguuuuccuuuucugugcagugucuccuagucugcauuuuuccugcugaucagaacaaagugucaccaccauugugaccagcuauucugacuuguugcuaaauccaucuauaguauuug

SEQ ID NO: 168991 - RNA, 46 nt, Homo sapiens
uuagucauuggccaccuuuucuucuuucauguacacucacuucccu

SEQ ID NO: 168992 - RNA, 34 nt, Homo sapiens
acuuuaucucuugcuccucucccuuuuaaccaua

SEQ ID NO: 168993 - RNA, 51 nt, Homo sapiens
cggcuuuucucaaacguuaccuuccuagugaagccuaccuaggccauccug

SEQ ID NO: 168994 - RNA, 35 nt, Homo sapiens
aguacaugcauuuuggcugaaaaagauacaggcac

SEQ ID NO: 168995 - RNA, 48 nt, Homo sapiens
ggggugaggcaugggaaggggaggaggugaugggggucugaggauagg

SEQ ID NO: 168996 - RNA, 56 nt, Homo sapiens
acagcagugaauaaagaacuauguucgcuaaaugccuguguuuaacaugugagaag

SEQ ID NO: 168997 - RNA, 44 nt, Homo sapiens
gagugugucgaagaugacaucagagagaugccagggcaagauua

SEQ ID NO: 168998 - RNA, 47 nt, Homo sapiens
gagagcagaaagccauuguaauaauuaaugguaagagaugguaacag

SEQ ID NO: 168999 - RNA, 32 nt, Homo sapiens
auggaaauguaauuucagaagaccauaggaag

SEQ ID NO: 169000 - RNA, 106 nt, Homo sapiens
ugggacaugcuaaauuugacaucucuauuagauagucaaguguauguguugagcagcuaguugaaguacaugacacuaaaauucguaaaugggaauuagacuagca

SEQ ID NO: 169001 - RNA, 70 nt, Homo sapiens
caguguagagguuaggaaaauggaaagcuaccagcaaaggguauuccaaaagcaacagauggugaggaag

SEQ ID NO: 169002 - RNA, 48 nt, Homo sapiens
ugauagcuuugauaucagauucugaaaugaaauaaauuuugucucaau

SEQ ID NO: 169003 - RNA, 45 nt, Homo sapiens
uucaaacaugccaaagguaguuauuugaauacauuuaagccccua

SEQ ID NO: 169004 - RNA, 39 nt, Homo sapiens
uuuuuuuuaaauaaauguucucucuguaucuauagugag

SEQ ID NO: 169005 - RNA, 70 nt, Homo sapiens
acgcuuuuaccaccacauagaguuugaggcucucagucaaaaugacucaaaugccgcaccugcucggucc

SEQ ID NO: 169006 - RNA, 46 nt, Homo sapiens
ucucuccuccuggucuuuuaccccucucuuucuuugugggaccuga

SEQ ID NO: 169007 - RNA, 34 nt, Homo sapiens
ugacuagauaucaaagguagucagauaucaaggg

SEQ ID NO: 169008 - RNA, 56 nt, Homo sapiens
aaaccauuugcucagaagaauuaucuguuccugggaaugggauagcuucuagagau

SEQ ID NO: 169009 - RNA, 42 nt, Homo sapiens
uuauuuuauuccauuuguaccuugguccuaugaaguaugucc

SEQ ID NO: 169010 - RNA, 31 nt, Homo sapiens
gauagaaaaauagccguguagauaaaccuag

SEQ ID NO: 169011 - RNA, 46 nt, Homo sapiens
accuuuggucuaacaguauguguaaagaaaagcaauugaagauaua

SEQ ID NO: 169012 - RNA, 47 nt, Homo sapiens
ugacauauuauuuaaguauugggguaaaaccaaaccaucaucaccuu

SEQ ID NO: 169013 - RNA, 27 nt, Homo sapiens
cauggcuuaugaguggagcaaggggaa

SEQ ID NO: 169014 - RNA, 56 nt, Homo sapiens
guacugacuucuuaguauaaggugaagcagaaguauaugacuccuuguuacaagga

SEQ ID NO: 169015 - RNA, 38 nt, Homo sapiens
gaccagucagcuacagugaagcauccugcaaacuggca

SEQ ID NO: 169016 - RNA, 45 nt, Homo sapiens
guagaguucaaggggugagagaugugauacaccacaccgucccca

SEQ ID NO: 169017 - RNA, 49 nt, Homo sapiens
cugggguguaguuguguauacucagugccauuaucauaguccuugaaua

SEQ ID NO: 169018 - RNA, 51 nt, Homo sapiens
agauuaugauauggucuccugucaugacauauagaaauggaaaugccccca

SEQ ID NO: 169019 - RNA, 154 nt, Homo sapiens
ggauuauugccauguggauguaguagcaggaaaaauaaauuugugucagucugaauucuacuugugcauuuauuaaacuacucuuaaccuuuucuuaggucagugaucaucauacagauuugcuuuuauaugccuuagagaaaaauuccucuau

SEQ ID NO: 169020 - RNA, 57 nt, Homo sapiens
uuauccauuuacauuaguaaucuuaaauuauuuaccugcuuuggaauucauauguua

SEQ ID NO: 169021 - RNA, 50 nt, Homo sapiens
agcugguuugggauucacagcaaaaauaaaaaguguuacaagggguagaa

SEQ ID NO: 169022 - RNA, 68 nt, Homo sapiens
aauugguuagagaggagaaauagaacacuauuuaaaacaagagaaaugguauaucccccucuggcaga

SEQ ID NO: 169023 - RNA, 516 nt, Homo sapiens
uugaugggagaacaucuuuuuuuuucuuucuuucuuuuuuguuuguuuguuugggacaaagucucacucuguugcccaggcuggagugcaauggcgugaucuuggcucacugcaaccucugccuucuggguucagcgauucuugugccucagccucccaaguagcugggauuacaggcauaugucaucaugcucagcuaauuuuuuguauuuuuaguagaaacgggguuucacuauguugguugggcuguacuuagacuccuggccucggguaagguacaugccucggccucccaaagugcugggacuacaggcgugagucaccaugcccaacuuauuuauuuuuuucuuuuuaaugagacagggccucacuauguugccuagucuggucuugaacuccugggcuccaacaguccucccaccugccuccugaguaguugagauuauagaugugccaccaugcccaacugagaauauuaucuugaucuacuaaauaaauagauuuuauuuccauaau

SEQ ID NO: 169024 - RNA, 48 nt, Homo sapiens
gaggaacugugaggggacugguaggauuagaacacaaugagugagaag

SEQ ID NO: 169025 - RNA, 45 nt, Homo sapiens
uagucuaaaaucugcagugcccucuaacccuuugugguuauugaa

SEQ ID NO: 169026 - RNA, 74 nt, Homo sapiens
auugaaaugauauuaucuggcaugacuggaagggagugcuuacuuacagaauaacuucuuuggucuuuucaaag

SEQ ID NO: 169027 - RNA, 41 nt, Homo sapiens
caaaccauuuaccaaccacuagacaauagcgccucuggcag

SEQ ID NO: 169028 - RNA, 40 nt, Homo sapiens
aucauauuuaaauuuuaucuuucuuuuugucacuaacagu

SEQ ID NO: 169029 - RNA, 48 nt, Homo sapiens
uauacacugcuucuuaauuugcuauucuuuuaguauuccucuagucau

SEQ ID NO: 169030 - RNA, 46 nt, Homo sapiens
cuuuacuauguaccacacacugcugucauauuuucaggcacagccc

SEQ ID NO: 169031 - RNA, 96 nt, Homo sapiens
uguucccuagccuuuaaacuuuuuuuuuuuuggacauuucuuuucuaguauaaauguucuuuuuucuuaugaagcuuauuaauuuuuuuucugacc

SEQ ID NO: 169032 - RNA, 53 nt, Homo sapiens
ggcuuguggcugauugugauguaugugacauccugcgaccuuuguguagcaga

SEQ ID NO: 169033 - RNA, 60 nt, Homo sapiens
agagagcgaaaccaaccugcacaauggagacugaaacauaacuugagacccaaaguguac

SEQ ID NO: 169034 - RNA, 34 nt, Homo sapiens
ggauccaggaaaguuggagcagcugccucaugaa

SEQ ID NO: 169035 - RNA, 40 nt, Homo sapiens
gccuggccaaguugcacauuagaaagccaccaaagcaaau

SEQ ID NO: 169036 - RNA, 26 nt, Homo sapiens
ugcacuggaagcaacaaguaagcaua

SEQ ID NO: 169037 - RNA, 62 nt, Homo sapiens
acuuguauacagagaguuuacauaugucauuuaaugugauccucuaggaaugauggccccau

SEQ ID NO: 169038 - RNA, 71 nt, Homo sapiens
uauguuucaagauauagcuuaaauguaaccuaaaaaauaugaaaccucccauuuucuuucuuuaguuaaca

SEQ ID NO: 169039 - RNA, 50 nt, Homo sapiens
cucaucaccgcugcccccuugaaccuccccuccuucccuccuaaguuugu

SEQ ID NO: 169040 - RNA, 50 nt, Homo sapiens
aaguggccauuccaacucacagccuuuauuuauuuuaacuuuuugauguu

SEQ ID NO: 169041 - RNA, 51 nt, Homo sapiens
aaacaggagaugagagaaagagagaaggaaauaacuugaggaaagucagag

SEQ ID NO: 169042 - RNA, 42 nt, Homo sapiens
uuaaaaucacacuagaaauagucauagaaauugauaugcugu

SEQ ID NO: 169043 - RNA, 46 nt, Homo sapiens
ugcagaucuaagagcugcugguguauuaugaccagagacacugcaa

SEQ ID NO: 169044 - RNA, 44 nt, Homo sapiens
uuucuaccuggccuaagauuucuaccaugauaguuaauacuuug

SEQ ID NO: 169045 - RNA, 56 nt, Homo sapiens
cucuacagugacccuucuucacuaacacacuguaucaguaaucuaggagaguauga

SEQ ID NO: 169046 - RNA, 33 nt, Homo sapiens
uugagaaucacugcccucugugauaggcuuuuc

SEQ ID NO: 169047 - RNA, 440 nt, Homo sapiens
auaaucagaaugaagaacucuaaaaaugugacuuaauuguuuugagucuuuuuuuuugagccagagucucacucugucucucauuguggagugcagcagcaugaucucggcucauugcaaccucuaccucccagguucaagugauucucauaucucagccuccggaguagcugagacuacaggggcgcaccaccacacucagauaauuuuuuguauuuuuaauagagaugggguuucgccauguuggccaggcuggucuucaacuccugaccucaggugauccacccacuuuggccuccuaaagugcugggauuacaggcaugagccaccaggccuggccuguuuugagcuuguucaaucuaugucauaaguaaaccuaaucuuguuaaacuucaaaggaauaauauugugucuaaaauuucaauucaagcacugagcau

SEQ ID NO: 169048 - RNA, 47 nt, Homo sapiens
auaagccacugagaccaaaaugggauugcuuuaaauuuagcagaagu

SEQ ID NO: 169049 - RNA, 55 nt, Homo sapiens
guaagucaaaaugauuugaucagauuugaacuuuuagcagguggaaaaaagggaa

SEQ ID NO: 169050 - RNA, 40 nt, Homo sapiens
uugucacaagaauugacaggucuuagccuguuggagguaa

SEQ ID NO: 169051 - RNA, 45 nt, Homo sapiens
aguuuagguucgaauuuguggcauuugaggucccaaacaaaaacu

SEQ ID NO: 169052 - RNA, 62 nt, Homo sapiens
aguuaggaaugccucucaagagcucaaagggcuaucaguaaaagguuuauggaagggaguug

SEQ ID NO: 169053 - RNA, 43 nt, Homo sapiens
ugacaugagacuucacugaagugacuugccaagaagaaaugag

SEQ ID NO: 169054 - RNA, 44 nt, Homo sapiens
ucgccuuccuuuguauuaugaucuuuccuauaaggaagcuagca

SEQ ID NO: 169055 - RNA, 47 nt, Homo sapiens
guaaacaaaaaccucugcaagacuaucaaggacuaagacagaagacu

SEQ ID NO: 169056 - RNA, 111 nt, Homo sapiens
acccugguaggaaacaacaaacauauugcuuaucacauuuauccucuuaaaugggaaagacggaacuaggaagcuggaaaugagguagaaggaaagagaaaggaccaguug

SEQ ID NO: 169057 - RNA, 46 nt, Homo sapiens
aguagauaauuaugaaauauugugguaagugcuauggaagaaaucu

SEQ ID NO: 169058 - RNA, 49 nt, Homo sapiens
caucaucaguuaucuagaaggaauugcaucuaucuucuuuuuacuuaua

SEQ ID NO: 169059 - RNA, 45 nt, Homo sapiens
ucaugagucguuaugaaguuugucuuggugcauacuuuacccagg

SEQ ID NO: 169060 - RNA, 46 nt, Homo sapiens
acuauucuuaaagguuuuaaguaaauuccacaugaucagucuguag

SEQ ID NO: 169061 - RNA, 45 nt, Homo sapiens
ugacugaaauauucuuaaguuccaugaaacaaaccuuuccagauu

SEQ ID NO: 169062 - RNA, 42 nt, Homo sapiens
ugcuugucaaauaaacagagaacauucauucucaggcaugug

SEQ ID NO: 169063 - RNA, 45 nt, Homo sapiens
guuguagacguaauuagguuuuagugaaagaagacauuuauguag

SEQ ID NO: 169064 - RNA, 47 nt, Homo sapiens
aauaugaaugcaugcaugauauggccacaaaacuaugaaucaauuua

SEQ ID NO: 169065 - RNA, 41 nt, Homo sapiens
cuuugaauccucugugaugcuucucguguucuuuaucccua

SEQ ID NO: 169066 - RNA, 78 nt, Homo sapiens
auugaaaguuuuugagaaaugaaauauacugugaaaguuugaugcagauuagucuaguggugaaauauagggugggua

SEQ ID NO: 169067 - RNA, 51 nt, Homo sapiens
gcagaauuuuuaacucugauuuagccuuacaggggauaugaaaacauaaau

SEQ ID NO: 169068 - RNA, 32 nt, Homo sapiens
gcuacuuuuuucuuagggcacugugcauucag

SEQ ID NO: 169069 - RNA, 45 nt, Homo sapiens
gccuuccauaaggguuguacuauuuuucacucaugucaguaauau

SEQ ID NO: 169070 - RNA, 47 nt, Homo sapiens
cuccuuuguccuccaacucccaucccauucccuuucuuaaccucuga

SEQ ID NO: 169071 - RNA, 48 nt, Homo sapiens
uauuuuuaucagcaauuuucauugacuuggcaagugucauaaauuuaa

SEQ ID NO: 169072 - RNA, 58 nt, Homo sapiens
ugccaacauguguucucagugauuucacuuucuaggcacagguuccauaggagggaag

SEQ ID NO: 169073 - RNA, 47 nt, Homo sapiens
gaccuuaggcaagaagugggcccugagucacuguaggauguguagaa

SEQ ID NO: 169074 - RNA, 79 nt, Homo sapiens
aguaggcuggccugccaguuaauuucuugccucgugaagaggaggaguacacuuuucuuccagccuuucaaaauguugc

SEQ ID NO: 169075 - RNA, 58 nt, Homo sapiens
uuggcagugcuccaaaaaagaccauaaaauagcagccacauugcuucuuugucagauu

SEQ ID NO: 169076 - RNA, 43 nt, Homo sapiens
ucuugauaccugcucagaacuugguauaaacaaaacucuauau

SEQ ID NO: 169077 - RNA, 49 nt, Homo sapiens
gccaugaacacaagucagaguaaucugauucuuugcugcaguggcauua

SEQ ID NO: 169078 - RNA, 49 nt, Homo sapiens
acacguaguagguacucaaguauuagaugacugaaugaaucaauccaau

SEQ ID NO: 169079 - RNA, 52 nt, Homo sapiens
gauuauuggauuauaauggcuucucuauuccuaaggcuauauauauaucuaa

SEQ ID NO: 169080 - RNA, 45 nt, Homo sapiens
accaauuaccauucaucuuaaagauggcaaaagucuuccuccaag

SEQ ID NO: 169081 - RNA, 44 nt, Homo sapiens
acauuuuacuuuucauuuaaaaaaaaucuuagugauaaaaggag

SEQ ID NO: 169082 - RNA, 41 nt, Homo sapiens
gugauuagugacaucagguugaauuaauuauuuauauuuuc

SEQ ID NO: 169083 - RNA, 46 nt, Homo sapiens
uuacuaacacaacagcuauuccaucaguaaaauuccagcaccuaga

SEQ ID NO: 169084 - RNA, 48 nt, Homo sapiens
cugaaagcucugcaauaaauacaaaccaaacccaaaccacccaaggag

SEQ ID NO: 169085 - RNA, 75 nt, Homo sapiens
agaccuccugaaccugaugcaugacuugagugcauauucagaucaauuccucaacauggugugcgugaagcucca

SEQ ID NO: 169086 - RNA, 44 nt, Homo sapiens
aauaauaguccuuuccucaaagcguuauuucaaaaauugucaau

SEQ ID NO: 169087 - RNA, 47 nt, Homo sapiens
agagacugggaguagaggaaggguaaauagaggcaaaacuuuugcac

SEQ ID NO: 169088 - RNA, 29 nt, Homo sapiens
auuuguauuugaagaaaaggacuugggaa

SEQ ID NO: 169089 - RNA, 37 nt, Homo sapiens
guggaggaggggugugcaacuggagugauugguuuag

SEQ ID NO: 169090 - RNA, 45 nt, Homo sapiens
ucagcaaugcagaauucuguggaacacagcauuuaaaguauggau

SEQ ID NO: 169091 - RNA, 36 nt, Homo sapiens
aaggagagggagcagcuuuguuagagaggaaugcag

SEQ ID NO: 169092 - RNA, 25 nt, Homo sapiens
uaaaaccuucauuuccagaaacagc

SEQ ID NO: 169093 - RNA, 71 nt, Homo sapiens
uagggcaguuaucucaggucugggcucagcaauaggaaguggugaugaaagauuuggggaauaggaccagg

SEQ ID NO: 169094 - RNA, 42 nt, Homo sapiens
uucaguagcuaacagaauucuuuaaagacuaaauggagacaa

SEQ ID NO: 169095 - RNA, 45 nt, Homo sapiens
aaacauaaauucaucuaggauugagccauuaagucucaagaacag

SEQ ID NO: 169096 - RNA, 35 nt, Homo sapiens
uuuacuugacauaaagcuaaucuuuuuauuaguca

SEQ ID NO: 169097 - RNA, 43 nt, Homo sapiens
uuauuagaaagaaaacacauuauuuggacuguacaugucagag

SEQ ID NO: 169098 - RNA, 46 nt, Homo sapiens
gcauggccucaugcugauucucugccuaucccaagggccaaugcag

SEQ ID NO: 169099 - RNA, 47 nt, Homo sapiens
caguggaauguuucuuaaacuuacuuuucagugaaauucuguugucc

SEQ ID NO: 169100 - RNA, 47 nt, Homo sapiens
acaaguuucaaauauuuguugacuguuaucagacaguuccuccucag

SEQ ID NO: 169101 - RNA, 62 nt, Homo sapiens
uuaagggcucuuaaaaguggaauagggagacagaaaaguagauuagaguaaugcaaugugag

SEQ ID NO: 169102 - RNA, 48 nt, Homo sapiens
uuuugaacccucaggaauuucucuuuagaccaaaggcagcccggaggc

SEQ ID NO: 169103 - RNA, 67 nt, Homo sapiens
gcuuaaauuauuagagaguuauccaugauauuaaagugucaaaaaggaaagaauugagaauucccau

SEQ ID NO: 169104 - RNA, 73 nt, Homo sapiens
aacccaagaaguagauaucauaaucuucauuuuuacaaauugggaaacugagucacagguagaguaaaauaac

SEQ ID NO: 169105 - RNA, 48 nt, Homo sapiens
gaacucucugaugaggucacguagaagaagauguauuuuaaaaaugaa

SEQ ID NO: 169106 - RNA, 50 nt, Homo sapiens
aaaauguccggggggccugcagguacaguguuggagacacuaaagccuag

SEQ ID NO: 169107 - RNA, 43 nt, Homo sapiens
aagagggagaaaaacuaucauaggugcccaaggacuacugaaa

SEQ ID NO: 169108 - RNA, 45 nt, Homo sapiens
ccagaaauuguaacacacugagugugcucaugggcauggacuuug

SEQ ID NO: 169109 - RNA, 58 nt, Homo sapiens
ggagcuguucauuagcccccacuccccuacccacccuguuucucuuucauauccggca

SEQ ID NO: 169110 - RNA, 80 nt, Homo sapiens
ugagacagcaugauauguuuaggaaauuugcuuuagacaggugguaaaucaaacggcccaggguuggagaggggauacgc

SEQ ID NO: 169111 - RNA, 41 nt, Homo sapiens
uaaaauugguacaaauuuuucuuugcuagagagagucaaaa

SEQ ID NO: 169112 - RNA, 44 nt, Homo sapiens
aggagccaucauuucauggauaauaguguaaacaaugaaaaggg

SEQ ID NO: 169113 - RNA, 58 nt, Homo sapiens
auggauggacuaaaggaaggggauucagugaaggaaacuauggaagaaaugccagaga

SEQ ID NO: 169114 - RNA, 40 nt, Homo sapiens
cagugaauucagagauagcagagagccugcaugagaugag

SEQ ID NO: 169115 - RNA, 58 nt, Homo sapiens
aauuuggaaaaauugcugagaaagggaaggagguagccaagcaccagggaaaggauug

SEQ ID NO: 169116 - RNA, 32 nt, Homo sapiens
uaauggaaaugagggugggagagaguugaaag

SEQ ID NO: 169117 - RNA, 38 nt, Homo sapiens
aguccagcaccucucugauucuuggucuuuuccucuua

SEQ ID NO: 169118 - RNA, 46 nt, Homo sapiens
agaggagaugcaaugucaugcaucuaggcuccagcagaucaaguua

SEQ ID NO: 169119 - RNA, 40 nt, Homo sapiens
aaugcacugcgguucauaaaucacuugcuuauuuccaggc

SEQ ID NO: 169120 - RNA, 76 nt, Homo sapiens
uuugaauaagaucuuuuaaauccuuaaccccuauucugcccuuuugauacaucuuggcaauacucuucuuaauacu

SEQ ID NO: 169121 - RNA, 115 nt, Homo sapiens
aaacuauacagugcuauagcacugguugccauaucuucuucaacauuagucuaaaaacagaaaaaugucauuuuuaagaaugaauaucaaaaaagacugaauuuuagagcccugg

SEQ ID NO: 169122 - RNA, 46 nt, Homo sapiens
auaucuucgaaggucagacccugcuucugucucugggaguuuggga

SEQ ID NO: 169123 - RNA, 30 nt, Homo sapiens
aaaagaguaggcauggggaggggaccagag

SEQ ID NO: 169124 - RNA, 49 nt, Homo sapiens
cguaccaggaaagaacgucuaagggugaagagccagagggaggcauaca

SEQ ID NO: 169125 - RNA, 378 nt, Homo sapiens
agaaagugguagggggcuaggcacgguggcucacaccuguaaucccagcacuuugggaggccgaggcagguggaucacgaggucaggagaucgagaccaucuuggccaacauggugaaaucccgucucuacuaaaauacaaaaaauuagccaggugugguggcacgugccuguaaucccagcuacuugggaggcugaggcaggggaaucacuugaaccugggaagcggagguuggagugagcugagaucacgccacugcacuccagccuagagacagagcaagacuccgucucaaaaaaaaaaaaaaaaaagugauguguagggcuucaacaauguaucagugcuuggugguggggggaguggggauggaggagacau

SEQ ID NO: 169126 - RNA, 73 nt, Homo sapiens
ccaaaagggcaugagaaggaagaggagccccugaagaagauagggaaggaauggucucauagcacaaggacag

SEQ ID NO: 169127 - RNA, 52 nt, Homo sapiens
uuaaacuguccagauacuuuccucaagugacagagugauaaagccagccuag

SEQ ID NO: 169128 - RNA, 44 nt, Homo sapiens
agucuguuucgcagagacacugauuaaacauuugggguauuggg

SEQ ID NO: 169129 - RNA, 48 nt, Homo sapiens
ggcuaccccuccucuaaaaucuauguuuaaggaauuccccacaaccug

SEQ ID NO: 169130 - RNA, 29 nt, Homo sapiens
gaucuacacauuuguuucccauaaaucau

SEQ ID NO: 169131 - RNA, 59 nt, Homo sapiens
gguuuagguaauguguaggguauaagauggcagacucauuacuguacuuucacagagaa

SEQ ID NO: 169132 - RNA, 48 nt, Homo sapiens
gaaccuaagaugugaaaaacucaaguaguacaagagaaaggaaaggca

SEQ ID NO: 169133 - RNA, 42 nt, Homo sapiens
uuggaagaagaguguuuccuucugggcuuuaucuucaucagc

SEQ ID NO: 169134 - RNA, 81 nt, Homo sapiens
gaacuugaucacacauucccccuaaacuaguaacuggcaacggaaauggagagcugcuuucuuacggccacucuucagcag

SEQ ID NO: 169135 - RNA, 49 nt, Homo sapiens
caacuguuaaucucaccuuucccuuaauugauaaguguucauaccagua

SEQ ID NO: 169136 - RNA, 68 nt, Homo sapiens
uuuucccuugagauauagaaagagagcauccuucucuccagcuuauguaucauaccaaaauccucaga

SEQ ID NO: 169137 - RNA, 62 nt, Homo sapiens
auacccaugugugucuacaugguaaaucccauaaccuguguucccacuucuggagauccuga

SEQ ID NO: 169138 - RNA, 65 nt, Homo sapiens
aauagaaaugggugaaagauugcuauaugaggccauaaugaucaauagauauagauaauagauaa

SEQ ID NO: 169139 - RNA, 37 nt, Homo sapiens
uauauguacucacguagguaugguauacaccuacgua

SEQ ID NO: 169140 - RNA, 39 nt, Homo sapiens
aaaucuguguuuauauagaugugaauuuuuucuggcaag

SEQ ID NO: 169141 - RNA, 31 nt, Homo sapiens
guguuuauaucgaaguauggcauacacacag

SEQ ID NO: 169142 - RNA, 47 nt, Homo sapiens
ccuccagcccuuuuguagaaaacuuaauuuaaaaaauuaucugaugu

SEQ ID NO: 169143 - RNA, 47 nt, Homo sapiens
ggaaaguccauuugagcugagauuacacuuguucagaguguuuucaa

SEQ ID NO: 169144 - RNA, 52 nt, Homo sapiens
gaucucaauuuucucauauguauaacguagauaauuguaguuccuauuuaaa

SEQ ID NO: 169145 - RNA, 42 nt, Homo sapiens
uuuaaauauuuaugauucuuuaugaucuaauauaucagcaug

SEQ ID NO: 169146 - RNA, 33 nt, Homo sapiens
acugcgguuggugacggggguccccucagucac

SEQ ID NO: 169147 - RNA, 47 nt, Homo sapiens
cugguuuuggcuuuucauauaaaugcuaaaggaaggcgacaguacag

SEQ ID NO: 169148 - RNA, 40 nt, Homo sapiens
guuuauugccauuuuguuuuauuucugcuguauaaaaacc

SEQ ID NO: 169149 - RNA, 327 nt, Homo sapiens
gauauauucuuguuuuuuaauuuuuaauuuuuguggguaccuaguagguguauauauuuauggguuacaugagauauuuugacauaggcaugcaaugcauaaucacaucagaguacauaggguagcugucaccaaaagcauuuauccuuuauguuucaaacaauccaauuguacucuuuuaguuauuugaaaauuuacaauuaaauuguuuuuuuuuuuacuauagucacccuguugugcuagcaaauacuaggucuuauugaucuuccuauuuuuguccccauuacaaggauauacucuuuuguguuccuauuuaaaccaaaccag

SEQ ID NO: 169150 - RNA, 66 nt, Homo sapiens
accaaaaucuuaguggguuuuuuuucuugauggaaguagucuguuuuagagaagucaugagagaag

SEQ ID NO: 169151 - RNA, 46 nt, Homo sapiens
cagcaucccucagcugcuugcauuugauagcuuauuuugcaucugg

SEQ ID NO: 169152 - RNA, 59 nt, Homo sapiens
uccuguuacccgaagcagcaguuuucagacuuuagcaagcaucagagucaccuggagag

SEQ ID NO: 169153 - RNA, 55 nt, Homo sapiens
cugaccuuguaugugaaauaaguagaaauagauuauuaguuaaaaaugaaguaau

SEQ ID NO: 169154 - RNA, 44 nt, Homo sapiens
gauucuacagcccaaccacagcucauuguacacauccccuccug

SEQ ID NO: 169155 - RNA, 43 nt, Homo sapiens
acaacucugaauaugcuaagagccauugaguuguacacuuugu

SEQ ID NO: 169156 - RNA, 65 nt, Homo sapiens
aaauaaucaauggaauugaaagguuaaaggauuugucauuggccuagaaaacagugggggguggc

SEQ ID NO: 169157 - RNA, 99 nt, Homo sapiens
cagcuuccaguccuucaucuaaagggcuuuuuauuuuauuuuauuuuuuauuuuuauuuuuuuaaguuggaaguaugaaacugaaugaccuuuucuuuu

SEQ ID NO: 169158 - RNA, 95 nt, Homo sapiens
guguagaaagaaguaaauuguaggaaaugacuucaguaggaaguaugugaacacagaaaaagacaugggcugccagagagggagguaucuaugag

SEQ ID NO: 169159 - RNA, 47 nt, Homo sapiens
guuuauuuuggguucccaauucuauuucauugaucuguguguaucuu

SEQ ID NO: 169160 - RNA, 49 nt, Homo sapiens
uuuauauauaccuuccuuuuuuagcagcuggaauguucagggaucauag

SEQ ID NO: 169161 - RNA, 38 nt, Homo sapiens
ucucucuuuuuccccgauuuuccagagcuaggcugugg

SEQ ID NO: 169162 - RNA, 39 nt, Homo sapiens
guaacuaguggggcuuaaugaaggucauaaguuucugag

SEQ ID NO: 169163 - RNA, 99 nt, Homo sapiens
uaagauuuucugggauaacaguaagggauauuagauaauauaccguauguauuuauuacuagucuuuuccucuaggaaaagggauacuuugauaauuaa

SEQ ID NO: 169164 - RNA, 46 nt, Homo sapiens
uaauugagcugcuuacuauaucuguugcucauugauaaacugagag

SEQ ID NO: 169165 - RNA, 44 nt, Homo sapiens
acacauuugguaagaacuaggaaucuuagcauguuggagcugga

SEQ ID NO: 169166 - RNA, 45 nt, Homo sapiens
auuauguugcugcaaaguaauuaaaauuaguaucuagagcuaguu

SEQ ID NO: 169167 - RNA, 52 nt, Homo sapiens
uucucaaaagaaucauacuugggauuacagguacauuugauguuauaugaug

SEQ ID NO: 169168 - RNA, 49 nt, Homo sapiens
aagaagcuggcagauagagagugacagacagacaggcagcagugugagg

SEQ ID NO: 169169 - RNA, 46 nt, Homo sapiens
gaagagcuuugauugccugguugucaguggcuucaaaggcggucag

SEQ ID NO: 169170 - RNA, 45 nt, Homo sapiens
acagaagcaauuucacacaggaaacaugacccucauagacagcag

SEQ ID NO: 169171 - RNA, 48 nt, Homo sapiens
augccagugugguccaguaagggaaaacagggguaaaacacagccaaa

SEQ ID NO: 169172 - RNA, 47 nt, Homo sapiens
cgaauaaaaauucuuugaucuccagaagaucaggagaucaggagcca

SEQ ID NO: 169173 - RNA, 53 nt, Homo sapiens
ccuugguuucuagaaggaagggaaauaauauuucuugagcauuuacuagggug

SEQ ID NO: 169174 - RNA, 40 nt, Homo sapiens
aaaauccgacagcugaacuagguugcucuuuuuuggcagg

SEQ ID NO: 169175 - RNA, 43 nt, Homo sapiens
caaaacggaaucuauguagacaaugggacguuaggcagagagc

SEQ ID NO: 169176 - RNA, 45 nt, Homo sapiens
aauaguauuuauuagcuugccgaggcuuccugcuagcaaccacac

SEQ ID NO: 169177 - RNA, 35 nt, Homo sapiens
aaaccugccccaucuugucgcuuuuaggaccuccc

SEQ ID NO: 169178 - RNA, 49 nt, Homo sapiens
ccccccgcuuuggagacgagauggcucuuguucagucaagaccccagac

SEQ ID NO: 169179 - RNA, 327 nt, Homo sapiens
cauuauacauacauauuuaacauuuacuagcacuuacuauuuuaagcacuuuacagaugugaggcagguugacuaucccuuaucugaaaugccugggaccagaaguguuauagauuucagauuuuggaauauuugcauuauacuuaacaguuaagcaucccuaauccaaaaaugcaaaaugcuucagugagcauuuccuuugagcgucaugucaaugcucggaaauuucuagauuuuggagcauuuuagauuuuagauuuucggaugagggcuacugaaacaguaucauacaaauccuuuuaaguaucccaugugguaaggcaucau

SEQ ID NO: 169180 - RNA, 38 nt, Homo sapiens
gauagagguuccucccugcucagggugucagggcugga

SEQ ID NO: 169181 - RNA, 66 nt, Homo sapiens
auuccuuguguggauuuuuuuuuuaaagcuauucaugcucuaaggacuaggcaagggguaggggau

SEQ ID NO: 169182 - RNA, 39 nt, Homo sapiens
guuaguaugcaucuccuugccgucagaauggguuuuauu

SEQ ID NO: 169183 - RNA, 66 nt, Homo sapiens
auacaccuuagauaucauuguauugaacugcuaaucaccuuauuuuacagaaggagaaacugaggc

SEQ ID NO: 169184 - RNA, 40 nt, Homo sapiens
uggaaguagaacaacuuugauaagugaagaggauccuggg

SEQ ID NO: 169185 - RNA, 49 nt, Homo sapiens
caaauugccccugucaaaaucagaggagaaggcccugaagaaaauucgg

SEQ ID NO: 169186 - RNA, 55 nt, Homo sapiens
gaaaugacuucucugcuuuuucuuuucauguuuuagcgaguagggugcuucccgg

SEQ ID NO: 169187 - RNA, 44 nt, Homo sapiens
gcacucuuagcuaaaaguggaggagagaauugacuccuguugug

SEQ ID NO: 169188 - RNA, 57 nt, Homo sapiens
gcacuccucucucuuauguaaaucauccccuuucuuucaggaggcccaauucaaauc

SEQ ID NO: 169189 - RNA, 44 nt, Homo sapiens
accacgcacauugcuccagaaacaaaccggcuuuuuucaaagca

SEQ ID NO: 169190 - RNA, 24 nt, Homo sapiens
uuuuugaaguaccagugucuuauc

SEQ ID NO: 169191 - RNA, 33 nt, Homo sapiens
aguguggcuggugaacuguggagaaauugcagg

SEQ ID NO: 169192 - RNA, 50 nt, Homo sapiens
ggaggaggccuggcacaguuauaaaccuccuguaaagacagggcagggga

SEQ ID NO: 169193 - RNA, 69 nt, Homo sapiens
agcgcuguguucagggaacuccacgucaucauuacaucugacuagaccagagugggaacccaguggagu

SEQ ID NO: 169194 - RNA, 49 nt, Homo sapiens
uccuugagugcacuuugggugccuagugacaugauuuccugggugagug

SEQ ID NO: 169195 - RNA, 34 nt, Homo sapiens
aagagagagaaauagguuuaaaaaaaaugcagaa

SEQ ID NO: 169196 - RNA, 47 nt, Homo sapiens
caaaauguccuuuauagccaccucuuuuucugauccaauuuaucaaa

SEQ ID NO: 169197 - RNA, 48 nt, Homo sapiens
ggacuaucucaaagguuccucaccuuucacaggcucuaccccaaaccu

SEQ ID NO: 169198 - RNA, 46 nt, Homo sapiens
cuaauauuuuuauaaugcuuuacgguuuauaaaagauauucauaua

SEQ ID NO: 169199 - RNA, 35 nt, Homo sapiens
aaagaugaaagggcauggaaauuaauauuucucug

SEQ ID NO: 169200 - RNA, 46 nt, Homo sapiens
aaagggacuucauucugcacacuucggggaggaccaggacccauga

SEQ ID NO: 169201 - RNA, 47 nt, Homo sapiens
ucacauuauuggugugcaucaucguuaagggucuuuggaggggauuu

SEQ ID NO: 169202 - RNA, 82 nt, Homo sapiens
aaaaaaaaaaacuggagaaaagccaggaaaauuccaucauaggcuccaaaauaggggagagucgcuacagaguggucaguac

SEQ ID NO: 169203 - RNA, 54 nt, Homo sapiens
aauaauccauauaagauaguccagaaagguuagagugagagggaggaguuugag

SEQ ID NO: 169204 - RNA, 71 nt, Homo sapiens
uugugugcuuggcaaaugacuuggacauucuuuuguaagcgggaaggugggaggcuuuuaacaagagagac

SEQ ID NO: 169205 - RNA, 44 nt, Homo sapiens
ggauggaaugacaaaucugaagggggugaagaguuggggaacac

SEQ ID NO: 169206 - RNA, 44 nt, Homo sapiens
cauaggaguuacagggguuacauucaaaaugacaacauccagag

SEQ ID NO: 169207 - RNA, 49 nt, Homo sapiens
gaaugauuucauaaaacuuuccaaguugaagagagccugaggggagggu

SEQ ID NO: 169208 - RNA, 84 nt, Homo sapiens
guguguguguaggggaacauaaacaauaaacauuauaaagaagugauuauguuggaugaaauaaguguuauggaaaacguauaa

SEQ ID NO: 169209 - RNA, 29 nt, Homo sapiens
gcagagcuguuuguuacucuagcugaauc

SEQ ID NO: 169210 - RNA, 41 nt, Homo sapiens
gcgaagaccggggcgaggccgggccgggcgcgaaggcgagc

SEQ ID NO: 169211 - RNA, 43 nt, Homo sapiens
uccccacccgcagacaauguccgaguccaagaacggccccgag

SEQ ID NO: 169212 - RNA, 46 nt, Homo sapiens
gcaucaucgccaucuauggccugguggugacaguccucaucgccag

SEQ ID NO: 169213 - RNA, 42 nt, Homo sapiens
acaccggcgucccccaagaugucuauggcaaagccggcugcc

SEQ ID NO: 169214 - RNA, 92 nt, Homo sapiens
uccugauccucaucuuccccgaggugcucggccuguacggucucgucguugcccucauccucuccacagaguagccccucuccgagcccacc

SEQ ID NO: 169215 - RNA, 45 nt, Homo sapiens
ggggugguuuuuacaucauauucgguggcuggugggcucggagag

SEQ ID NO: 169216 - RNA, 45 nt, Homo sapiens
cgcagcguccuagugccgguugucuguugcccuggccuugccccc

SEQ ID NO: 169217 - RNA, 57 nt, Homo sapiens
ugcggagaggcccuggucucccagcugucuauaaccuuagcuagaguguggccuugu

SEQ ID NO: 169218 - RNA, 68 nt, Homo sapiens
ccccgcccgguuugcuuucccucccucgcuggcgcugccgcgaguccaccgagcggccucugaggagc

SEQ ID NO: 169219 - RNA, 46 nt, Homo sapiens
acaaaggaaccaagagacguuguuuuguugugugucucuuucaaag

SEQ ID NO: 169220 - RNA, 49 nt, Homo sapiens
uugauucauugaugauuccucuaacaguucccuuaacuuggaacagaag

SEQ ID NO: 169221 - RNA, 46 nt, Homo sapiens
guacuuuuuguugaauuuuuaguuuuuuguuccuugguagaacuac

SEQ ID NO: 169222 - RNA, 46 nt, Homo sapiens
cucaucagaggguaaaguucacaaaagaccacacugucagacagaa

SEQ ID NO: 169223 - RNA, 42 nt, Homo sapiens
cugauggaaaaaacaaaauacauaaaauucacaggaaaucag

SEQ ID NO: 169224 - RNA, 47 nt, Homo sapiens
auuauuaugcauuauguuguguaucuuuuaguuuuucuuguuaucag

SEQ ID NO: 169225 - RNA, 61 nt, Homo sapiens
uuauguuuuuccccguuuuaauuuucagaauuauugaaguaaaucaaaaucaaaagcaggu

SEQ ID NO: 169226 - RNA, 119 nt, Homo sapiens
aguuagagguaagugacugcccaugggauaguauauugauucaacauaguauuuccuaaaguacugugaaguagaaaucauagugcuuuuuauauaguuguuucauugugauuuaauau

SEQ ID NO: 169227 - RNA, 60 nt, Homo sapiens
ugaaaugaaaauuuugcaucaccaaggugguuuaguggagcagaauuuucuagaaagaua

SEQ ID NO: 169228 - RNA, 48 nt, Homo sapiens
uguauaauauuaauugcaugauuuuuagguauucuuuuaguacguuga

SEQ ID NO: 169229 - RNA, 38 nt, Homo sapiens
cucaaaaguuuuuaacuuguuuuggaaagaaaauugug

SEQ ID NO: 169230 - RNA, 42 nt, Homo sapiens
cauaugcagcaacagguaauggcucagaggcaacaggugcaa

SEQ ID NO: 169231 - RNA, 39 nt, Homo sapiens
aacugagauauccaccaaaccagaacauaccacgacaag

SEQ ID NO: 169232 - RNA, 42 nt, Homo sapiens
uuuucuuuuuugaacuccuuuucuaucagcccguaccaccuu

SEQ ID NO: 169233 - RNA, 46 nt, Homo sapiens
cggaaaauuaugauuucccuguuguuauagugaagcaagaaucaga

SEQ ID NO: 169234 - RNA, 42 nt, Homo sapiens
ugugcaguuugucaaaacggaggggaacuccucugcugugaa

SEQ ID NO: 169235 - RNA, 48 nt, Homo sapiens
augcucagugauuaaaauucaugccaaaugaacaauucuguaucauag

SEQ ID NO: 169236 - RNA, 45 nt, Homo sapiens
accagaaguugaauaugauugugaugcucccagucacaacucaga

SEQ ID NO: 169237 - RNA, 47 nt, Homo sapiens
cauguuuacacaguggaaugcuuuucuggaauuuuaugagaaucuag

SEQ ID NO: 169238 - RNA, 45 nt, Homo sapiens
aauaaauuuagugaugauucagaugaugacuuuguacagccccgg

SEQ ID NO: 169239 - RNA, 52 nt, Homo sapiens
acuaagaaagaaaggaaagaaggagaugaauagaagaaagaaaauggaaaga

SEQ ID NO: 169240 - RNA, 47 nt, Homo sapiens
uuggauuuuuaaaccacagucuggagugauagcuacuguagaaagga

SEQ ID NO: 169241 - RNA, 48 nt, Homo sapiens
cagcuuuagaaauuaauaccacuacccgugaauuauauggccugacaa

SEQ ID NO: 169242 - RNA, 50 nt, Homo sapiens
aaggcacuuaauaguacaucauguaagauggcaacuguauuaaagaaaaa

SEQ ID NO: 169243 - RNA, 39 nt, Homo sapiens
ugagaaauguucugauugaauauugacuuuagucgaguu

SEQ ID NO: 169244 - RNA, 42 nt, Homo sapiens
aucuaaaagggacgccugccucuuguauccacgugggaaugu

SEQ ID NO: 169245 - RNA, 47 nt, Homo sapiens
ugaugguagcccuguuuuaaucuuuaauagaauaagcguuuguggau

SEQ ID NO: 169246 - RNA, 24 nt, Homo sapiens
uaguccagauuucuccuggugaua

SEQ ID NO: 169247 - RNA, 58 nt, Homo sapiens
cuguguaaaguguuguuguuguuuuuaaauucaacuguccugcaguaacauaacauuu

SEQ ID NO: 169248 - RNA, 42 nt, Homo sapiens
ggagggccucggggacgcggaggccgaggcggcggccggcgc

SEQ ID NO: 169249 - RNA, 48 nt, Homo sapiens
cacucaccguggcgccggcggagacggcugagggugguggagggaaga

SEQ ID NO: 169250 - RNA, 50 nt, Homo sapiens
uguaagaggugaacaauggagaaaggauagggguuauguucguaauugua

SEQ ID NO: 169251 - RNA, 48 nt, Homo sapiens
auuuagaaauguuauguggucaaaucauuacaaaauguuuucaaccaa

SEQ ID NO: 169252 - RNA, 45 nt, Homo sapiens
accugaaaaaacaaaaaagcuuaaucuugauugggggaggguguu

SEQ ID NO: 169253 - RNA, 77 nt, Homo sapiens
uucuuauuaaaaauauagauccauguguuuauauuuauacauauaaaaugagucauaccauaguaaguauuugggcu

SEQ ID NO: 169254 - RNA, 44 nt, Homo sapiens
cacacagaagacccauuuaaugaugaacaucaggagaggcaaga

SEQ ID NO: 169255 - RNA, 48 nt, Homo sapiens
cauguacaauaaaaacauaaaauaaucuuuuaaagcaaacugggggag

SEQ ID NO: 169256 - RNA, 47 nt, Homo sapiens
uggccucuuugaauugaauaaauucucuucagccuucuuuaaugccu

SEQ ID NO: 169257 - RNA, 51 nt, Homo sapiens
uggccucuuugaauugaauaaauucucuucagccuucuuuaaugccuuagg

SEQ ID NO: 169258 - RNA, 44 nt, Homo sapiens
gaucaaaaaagaucgucauugugauuuuaaugagaaagcauccu

SEQ ID NO: 169259 - RNA, 48 nt, Homo sapiens
acaguuagaauggaaaggaagcuguagauaugguuaaucauggcaaca

SEQ ID NO: 169260 - RNA, 45 nt, Homo sapiens
uuuccuagccuucguuuuccccauuugucaaaugugaaauaauag

SEQ ID NO: 169261 - RNA, 45 nt, Homo sapiens
uguaucuguucuuugcagggugggaaaccccguaaacaccggaag

SEQ ID NO: 169262 - RNA, 50 nt, Homo sapiens
gcuagauuuugauggguaauguauuuuccacuugggcuguggugaagaaa

SEQ ID NO: 169263 - RNA, 46 nt, Homo sapiens
aguaauauuugccuuucuuaccucacaaggguaucaugaggaccaa

SEQ ID NO: 169264 - RNA, 61 nt, Homo sapiens
cauuuaaucccucaccccucauaucacuuauuugcagaugguacugccccuuuucuguaag

SEQ ID NO: 169265 - RNA, 45 nt, Homo sapiens
gccaugguggaugaauuucuuugacauuuauagaguuaaagacaa

SEQ ID NO: 169266 - RNA, 67 nt, Homo sapiens
cugaagaagaugauauuacagacaaccaaaagcacaagccacccaaggugaguuuaucaaacauugc

SEQ ID NO: 169267 - RNA, 45 nt, Homo sapiens
aaaaaaagaagaaacguuauaaagauucucuuucucuagcugcca

SEQ ID NO: 169268 - RNA, 21 nt, Homo sapiens
acaaaaggugucuguugauug

SEQ ID NO: 169269 - RNA, 44 nt, Homo sapiens
cagcuugacugacugugguugaacacaaguguuuucugaccuaa

SEQ ID NO: 169270 - RNA, 72 nt, Homo sapiens
gaucaaauugggaugcuaugaguuagaaccaaauaaaagccagucugcugaagauuaucuuaagucuuuuau

SEQ ID NO: 169271 - RNA, 75 nt, Homo sapiens
cagcuguccagcagaacuaugugucuccauuacaggccaccaucaguaaaucccagaccaaccccgucgugaagu

SEQ ID NO: 169272 - RNA, 62 nt, Homo sapiens
uaaguaauaauccccaacucuccuguuccuccucacuuauuaagacuucagauaagccacuu

SEQ ID NO: 169273 - RNA, 45 nt, Homo sapiens
uauuuagccaaggcuauggugucacagaucuccacgcaggguuuc

SEQ ID NO: 169274 - RNA, 61 nt, Homo sapiens
acaucuccuaaaccccugcccucgccuaagccuucugccucacccaagcccucucugucag

SEQ ID NO: 169275 - RNA, 70 nt, Homo sapiens
cagcccaguccauaaacagcccaguggaaugaacaucagcagacagucucccaccuugaauuuauugccc

SEQ ID NO: 169276 - RNA, 57 nt, Homo sapiens
uuccaaacaucauucauucauuaagcaaauguuuauugaguguuuacuaugugccag

SEQ ID NO: 169277 - RNA, 60 nt, Homo sapiens
aaaugugguaaaugcugugaaaaaauuguaggauaauaugauaaaagugauugcugcuaa

SEQ ID NO: 169278 - RNA, 108 nt, Homo sapiens
aauaguucaggccagagggaacaguuguaugaagacacugagauggaaaagagccugaagugaaggccugcauggcuggaccauggggagagagugguaggugaugag

SEQ ID NO: 169279 - RNA, 62 nt, Homo sapiens
gauauaaauuucaguuguaaaauuuguuauuuuuauuaacaaauaaaggagaacaggggagg

SEQ ID NO: 169280 - RNA, 152 nt, Homo sapiens
aacuaaggaaacugaagucugucauucuguuugauaauaaaaggaagacaaauuagauaguugcuaggaguuggggaagagcuagaauaacagugugguuauaaaaaaauaauaaguuucuguauaugagaaggcagaggaaacauggaaaa

SEQ ID NO: 169281 - RNA, 45 nt, Homo sapiens
augguguaagucaagugguuagcuuuggagaagggcaggugaggc

SEQ ID NO: 169282 - RNA, 62 nt, Homo sapiens
uugcauggaauuacuuacucaugguucagguguuugggcuaggaggcaaaaguggaggagug

SEQ ID NO: 169283 - RNA, 37 nt, Homo sapiens
uuaguagauugagagagugcguggguguucauguaag

SEQ ID NO: 169284 - RNA, 45 nt, Homo sapiens
caccucgggaucuaccucagccgcuuuccaccauagccuaacuca

SEQ ID NO: 169285 - RNA, 49 nt, Homo sapiens
ucuuucuuauuuguauaggcuuauagauauggauuauacuuuucugaaa

SEQ ID NO: 169286 - RNA, 47 nt, Homo sapiens
ccuuuuaagaggaaggaaauagguagaugagaucuguaacauauaaa

SEQ ID NO: 169287 - RNA, 49 nt, Homo sapiens
cuguuucugucgauguuuacauucucucgucccaagcacuguggugagg

SEQ ID NO: 169288 - RNA, 46 nt, Homo sapiens
auccugaacaaacuugaaucuccuccaguguguagcaacuucccuc

SEQ ID NO: 169289 - RNA, 46 nt, Homo sapiens
ugcugcuuuuagcccuugcagcaacauaaacucuaaguuuccccag

SEQ ID NO: 169290 - RNA, 47 nt, Homo sapiens
aaaauaagacuccuuaguuauuauagcuuccuuaugcaaauagcaua

SEQ ID NO: 169291 - RNA, 45 nt, Homo sapiens
auauguguuuauuauacauuacccuauaccauuagauuuacucaa

SEQ ID NO: 169292 - RNA, 63 nt, Homo sapiens
cguccucccacuucccgguucaaguuucacuggugucccgacccgucccccugcccucugccc

SEQ ID NO: 169293 - RNA, 58 nt, Homo sapiens
aaauauggauguaguaugaaccccaguagauauuuuggaaggauacugggaggauguu

SEQ ID NO: 169294 - RNA, 49 nt, Homo sapiens
caauaauuuccauuauaauucaauuauaauucuuguaugcuuuugaggu

SEQ ID NO: 169295 - RNA, 45 nt, Homo sapiens
aggcuaaucuguagucauaaaauucugauacuuugcggaaauuag

SEQ ID NO: 169296 - RNA, 55 nt, Homo sapiens
ugcguccuuugggaucaucucuuagaacuccagugaucuaucauauuugcugcua

SEQ ID NO: 169297 - RNA, 41 nt, Homo sapiens
gccuuguuuauuccauugcuuuuaguugauuaaagugggug

SEQ ID NO: 169298 - RNA, 34 nt, Homo sapiens
ucgcccuuugaauaucugcuuguagaaguuaaca

SEQ ID NO: 169299 - RNA, 41 nt, Homo sapiens
uagcguuagaaccgcaguuuggugucuaaguuuagaagcag

SEQ ID NO: 169300 - RNA, 66 nt, Homo sapiens
gacccaguacaaauauaccuaguaagugccccccuuucaauacauucuaauugggaagaagaagag

SEQ ID NO: 169301 - RNA, 40 nt, Homo sapiens
uucacgaguguuauucuugaaugacuaugucuagggggaa

SEQ ID NO: 169302 - RNA, 61 nt, Homo sapiens
auuuaaacauuaucuuugaggugggauaaaauguuuaguuucagguuaacaagggagagaa

SEQ ID NO: 169303 - RNA, 41 nt, Homo sapiens
uuuuuagccuuuuacgguguuacugugauuuuucgucaagg

SEQ ID NO: 169304 - RNA, 95 nt, Homo sapiens
agcuggauacucuuguagccauugcaccuuuguaauucaugcuucuucaacccaugaaagagguggagccaucagcugcucagguuguaagaaaa

SEQ ID NO: 169305 - RNA, 80 nt, Homo sapiens
ugggagacggaaggcaggauucacuuucuaacugggucgggguggggaaggucaggguagaaggaaacauguuuucccca

SEQ ID NO: 169306 - RNA, 69 nt, Homo sapiens
gaugcugcaguuuuaguuggggcuaaaugcugagcaacgauuguuggaguguguguguaaauuuaaauu

SEQ ID NO: 169307 - RNA, 79 nt, Homo sapiens
guagcacauauucagggucaggaaagcaaaauguuggggaugaggaaccaguguuaccagguucaagugaguuaguaga

SEQ ID NO: 169308 - RNA, 82 nt, Homo sapiens
guccacugaaucucuaaugauagggugugugugugugugugugugugugugugugugucuguaagucacuuuuuggauuuuu

SEQ ID NO: 169309 - RNA, 111 nt, Homo sapiens
uuuuucacaugucccugucuuuuccauucucagauaacaaauguuaagacccaaagaaauaaggcauaaggguuuuuguugaauguguguuuguucuucuagggaaaauua

SEQ ID NO: 169310 - RNA, 33 nt, Homo sapiens
guuacuuuucaagguuauucuaaagagauggag

SEQ ID NO: 169311 - RNA, 47 nt, Homo sapiens
uuuuauguuuguuccucacaaaauuuucuacacauuauuuguuccca

SEQ ID NO: 169312 - RNA, 43 nt, Homo sapiens
ggcuugcccuuggauuucacuuguuaaacacccucaaacuuaa

SEQ ID NO: 169313 - RNA, 38 nt, Homo sapiens
ugugaauuuugauaagggaaagacuuguuugguagccc

SEQ ID NO: 169314 - RNA, 62 nt, Homo sapiens
cauaaaacccugaugaauuuuggauaugugagagggcauaaacauuccuaaauauggaccug

SEQ ID NO: 169315 - RNA, 54 nt, Homo sapiens
agugcagggauuuuuguguuuuuuuuuuuuuuuuaauuuuuuugcaacagccuu

SEQ ID NO: 169316 - RNA, 41 nt, Homo sapiens
uccugucuauccuuugugacagggccuuuuaaugaguguuu

SEQ ID NO: 169317 - RNA, 78 nt, Homo sapiens
caugauaaguuaaaagauaaugguucaaaaucugucacaaagcuacauuuugguccauuuguguuccauugcuaccug

SEQ ID NO: 169318 - RNA, 42 nt, Homo sapiens
gauuagcuuggcauccacguccuggccguggcggaaugugag

SEQ ID NO: 169319 - RNA, 47 nt, Homo sapiens
acacaccuuaccugauauucccucugccugaaacuuaaccauuugua

SEQ ID NO: 169320 - RNA, 31 nt, Homo sapiens
aauccacacccacaccccccgccgggcccgc

SEQ ID NO: 169321 - RNA, 58 nt, Homo sapiens
ggauuucauuggcuggucuguugccucugcggagggcagucaggaaaguggaauggag

SEQ ID NO: 169322 - RNA, 41 nt, Homo sapiens
acccguccccuagaaaaguuauucuaagaagcauuucuuuu

SEQ ID NO: 169323 - RNA, 44 nt, Homo sapiens
aaauucaccuaguuuuuaaaagguggcaacguuagggucugugc

SEQ ID NO: 169324 - RNA, 57 nt, Homo sapiens
ggaggaaauuaaucagggaccugaaggcuaauuuggaguuagcaaguaaauuggggu

SEQ ID NO: 169325 - RNA, 36 nt, Homo sapiens
guuaagaauuucugacuugcugcuucucuaggucac

SEQ ID NO: 169326 - RNA, 39 nt, Homo sapiens
ugccgagcccugauuggaugggacgggggacggggaccu

SEQ ID NO: 169327 - RNA, 41 nt, Homo sapiens
caaagcucuggguuaaggaauuauaucggggguggaggccu

SEQ ID NO: 169328 - RNA, 44 nt, Homo sapiens
ccuccugacccaggaagaggagggggaagcuucucucuagguac

SEQ ID NO: 169329 - RNA, 35 nt, Homo sapiens
ugaugcccacuguagaagaaaucuccagaacaagu

SEQ ID NO: 169330 - RNA, 35 nt, Homo sapiens
ccuggugagcuuuuuuguguuuuuuaaaauuuuua

SEQ ID NO: 169331 - RNA, 42 nt, Homo sapiens; identical to SEQ ID NO: 90422

SEQ ID NO: 169332 - RNA, 41 nt, Homo sapiens
auuuuguuccagcugaagugucucccuuuugcugcugggag

SEQ ID NO: 169333 - RNA, 264 nt, Homo sapiens
aaguacuugagaaaacagaaguucagcuggcgcaggcaggaucacuugaggccaggaguuaccagccuggacaacauagcaagaucccaucucaaaaaaaaauuaacuugguguggcaugcacauguacuucuagcuagugaggagacuaaagugggaagaucacuuaagccuaggaauucaaggccgcagugagcuaugauugugccacugcacuccagguuggaaggucagagaguuuaagugaauuucucaggaucaaaug

SEQ ID NO: 169334 - RNA, 37 nt, Homo sapiens
uaggggcuuccaaauuacaaaauuucauagacaaaua

SEQ ID NO: 169335 - RNA, 46 nt, Homo sapiens
uccgcucuuaaagccaggucauggacuuucagacauucuccaagau

SEQ ID NO: 169336 - RNA, 77 nt, Homo sapiens
ugucauuaucaugaaguccuaaauaggcagagcagacuucacagacucgaaguuucugcugcugaaaacuggaagcu

SEQ ID NO: 169337 - RNA, 32 nt, Homo sapiens
ucucucucucucuucucuucguuucagccguu

SEQ ID NO: 169338 - RNA, 61 nt, Homo sapiens
agagggcagggggacgggucgggacaccagugaaacuugaaccgggaagugggaggacgua

SEQ ID NO: 169339 - RNA, 51 nt, Homo sapiens
cgcaucuggcugcagccgcugccgcugcccaccuccccacccagccccacc

SEQ ID NO: 169340 - RNA, 42 nt, Homo sapiens
ccacggaccgcacugggagccaccgaaggcagcaggccuaca

SEQ ID NO: 169341 - RNA, 57 nt, Homo sapiens
acgaauaucaggacaggucacuccccucaacccccugacagccuccauaucacacag

SEQ ID NO: 169342 - RNA, 46 nt, Homo sapiens
caggcacccagagcucaucauguugugggauggaauggggcuuggg

SEQ ID NO: 169343 - RNA, 66 nt, Homo sapiens
cuggggggagucuagauaugagcagaccauggggaauguggaggguugagggggaagaagccuccg

SEQ ID NO: 169344 - RNA, 54 nt, Homo sapiens
caggaaggaagcagcagcaggagcaguggcuggcaagaaaguggaaccaccgag

SEQ ID NO: 169345 - RNA, 48 nt, Homo sapiens
acuguaacuccuacucccaucuuucaauccuccuaguuccccuaaaga

SEQ ID NO: 169346 - RNA, 49 nt, Homo sapiens
cacguccaccaaccugaccaugaccuuuaacaaccagcugaccacuguc

SEQ ID NO: 169347 - RNA, 23 nt, Homo sapiens
gaggaaaaguaaguuuaacuaca

SEQ ID NO: 169348 - RNA, 46 nt, Homo sapiens
cauggauaguggggccuccauuucauuucugugccuuacuaucagu

SEQ ID NO: 169349 - RNA, 42 nt, Homo sapiens
aggguuaucauagucauaguggaaugagccagauggaggaag

SEQ ID NO: 169350 - RNA, 29 nt, Homo sapiens
aaaccaguuuaccagguugaaagaccaag

SEQ ID NO: 169351 - RNA, 47 nt, Homo sapiens
ugggaacucauuaaaugauucuucagcaagggaauagcugguuagau

SEQ ID NO: 169352 - RNA, 39 nt, Homo sapiens
acucccaggaaguggccugugaaggaugaggaagaggau

SEQ ID NO: 169353 - RNA, 50 nt, Homo sapiens
guccugccugaugcuucguaccagggaucggcaaacuuuaaaggcccaga

SEQ ID NO: 169354 - RNA, 49 nt, Homo sapiens
caacauguggguggugccucccauaggggcagaguuccugggaacugag

SEQ ID NO: 169355 - RNA, 65 nt, Homo sapiens
cggagccagccccugacacgugugcauaggaaggaggagggauggguugguguggaugaagagag

SEQ ID NO: 169356 - RNA, 51 nt, Homo sapiens
uccaaguccaguggggagccccugaaggcuuacggcaaggggguggggugc

SEQ ID NO: 169357 - RNA, 46 nt, Homo sapiens
aagugagaugcagacccugcccuccaggagguauaguagaggcaga

SEQ ID NO: 169358 - RNA, 66 nt, Homo sapiens
gaacaggaacagccccuguggaagcaaccgacaugugaugaucaacccaaaaaaccauguaaacuc

SEQ ID NO: 169359 - RNA, 42 nt, Homo sapiens
augcuaucccggggggauaaaguaacaaggcuggggacugug

SEQ ID NO: 169360 - RNA, 25 nt, Homo sapiens
gucugucucugugccggguucaucc

SEQ ID NO: 169361 - RNA, 58 nt, Homo sapiens
uuguggguugcuuaggaaaugaaagagggguguguagaccccuccacuugugcgucca

SEQ ID NO: 169362 - RNA, 64 nt, Homo sapiens
caauuagaauuuggauuccgugugauaggcaaguugguucuugaggaaagcugugggaugauga

SEQ ID NO: 169363 - RNA, 387 nt, Homo sapiens
agcugucgggggacugcuaauagaaguggacguagaacuggcaagccaggcaugggggcucaugccuguaaucccagcauuuugggaggccaaggcuggaggaucauuugaggucaggaguucgagaccagccuggccaauguggugaaaccccgucucuauuaaaaauacaaaaguuagccaggcgugauggugcaagccuguaaccccagcuacucgagaggcugaggcaggagaaucacuugaauccgggagguggagguugcagugagccgagauugugccauugcacuccagccugggugacagagcaagacuccaucucaggaaaaaaaaaaaauggagguagaacugaacucugaggauguuuaggauuugaauaagaga

SEQ ID NO: 169364 - RNA, 46 nt, Homo sapiens
acucugacugacguaguaccucccacggagggucagcgugcaaggu

SEQ ID NO: 169365 - RNA, 63 nt, Homo sapiens
gugcagcugaaggugaagucugauaagcucagcguagauaaggccuggggauuugggaccaau

SEQ ID NO: 169366 - RNA, 64 nt, Homo sapiens
auccauuguagugaaucgacuccucuccuggccacugagagugguauauaggaagguuacaguc

SEQ ID NO: 169367 - RNA, 41 nt, Homo sapiens
aauaauauuaaaagacucugggaggagggaaaggcuuuggg

SEQ ID NO: 169368 - RNA, 46 nt, Homo sapiens
cucaguuuuuagaauguaguuguuagguaaagggauuaauccagag

SEQ ID NO: 169369 - RNA, 60 nt, Homo sapiens
agugugcucugugggucgagucacaggaacaucacucauggggggagauaauccccacag

SEQ ID NO: 169370 - RNA, 60 nt, Homo sapiens
cuugcccuuucccacuguggaagacugugcucgguuuggaugaauugcccgguuguaagu

SEQ ID NO: 169371 - RNA, 110 nt, Homo sapiens
auguuauuuaaucaugcagauuuccaaucaguguauugcucauuuacugacaaaaagggaaaauacgaaacacagaaagggaaaauaaacugacuuuuauaaugaaucuc

SEQ ID NO: 169372 - RNA, 84 nt, Homo sapiens
gggcugugaauuccauacuaguuaucaauauuuuaagaucauucuguauauacauauuuuaaauuaugcaagcaaacuaggagg

SEQ ID NO: 169373 - RNA, 54 nt, Homo sapiens
gaaucacaugaauggauuacuagggccugagggguguccguucuuuagaaaaau

SEQ ID NO: 169374 - RNA, 40 nt, Homo sapiens
cuggcacaagcagcuuccuggaguuaccucagcagaagac

SEQ ID NO: 169375 - RNA, 55 nt, Homo sapiens
ugucaggcgucucucaacacugccagccaccugagaugcugaccagcagugaagg

SEQ ID NO: 169376 - RNA, 46 nt, Homo sapiens
uuguggaaugaaugacugauaugcuuggcauauuugauuauaagac

SEQ ID NO: 169377 - RNA, 45 nt, Homo sapiens
cugucacaggaauuguggaugguucggggagcauuggagcugcag

SEQ ID NO: 169378 - RNA, 43 nt, Homo sapiens
ccacaauagcucgugucuccuccuguguuggaauuggucagca

SEQ ID NO: 169379 - RNA, 45 nt, Homo sapiens
cuuaauucauuaucuuucaaauuaaaaagaaaaaucaaaaauagc

SEQ ID NO: 169380 - RNA, 41 nt, Homo sapiens
accauauucuguauccucugaaguugaaauuguccagcugc

SEQ ID NO: 169381 - RNA, 77 nt, Homo sapiens
gguaauaaguaugaacaaggaaguaaggcagaggagcagaauguauuuuaguggguauuacuuacauggcugugcca

SEQ ID NO: 169382 - RNA, 43 nt, Homo sapiens
ucucagugauaucuuagcucuaaagcuaauuguaugucagaga

SEQ ID NO: 169383 - RNA, 50 nt, Homo sapiens
augcaucuacaagauucuuuauuuuggcauuguuuauaauagccaaagag

SEQ ID NO: 169384 - RNA, 40 nt, Homo sapiens
uguucaccaguuuacucauuuccaauguguagaugaauaa

SEQ ID NO: 169385 - RNA, 38 nt, Homo sapiens
cuagucaggaauuuuuguugauuaaaugaaaccaugga

SEQ ID NO: 169386 - RNA, 1045 nt, Homo sapiens
uuuugaggcggaguuuugcucuuuuuuuuuuauuuuuuuauuuauuuuuuuuuuauugaucauucuuggguguuucucgcagagggggauuuggcagggucauaggacaauaguggagggaaggucagcagauaaacaagugaacaaaggucucugguuuuccuaggcagaggacccugcggccuuccgaaguguuugugucccuggguacuuaagauuagggaguggugaugacucuuaacgagccugcugccuucaagcaucuguuuaacaaagcacaucuugcaccgcccuuaauccauuuaacccugaguggacacagcacauguuucagagagcacaggguuggggauaaggucacagaucaacaggaucccaaggcagaagaauuuuucuuaguacagaacaaaaugaaaagucucccaugucuacuucuauccacacaaacccggcaaccauccgauuucucaauuuuuuccccacccuucccgccuuucuauuccacaaaaccgccauugucaucauggcccauccccaaugagccgcugggcacaccucccagacggggucguggccgggcagaggggcuccucacuucccaguaggggcggccgggcagaagcgccccucaccucccggauggggcggcuggccgggcggggggcugaccccccccaccacccucccugacggggcggcuggccgggcagagggguccucacuucccauuaggggcggccgggcagaggcgccccucaccucccggccggggcggccggcugggcggggggcugaccccgccaccucccucccggacagggcggcuggccgacccccccccccgccucccucccggacggggcggcuggccgggcagaggggcuccucgcuucccaguaggggcggccgggcagaggcgccccucaccuccgggacggggcggcuggccaggcggggggcugauccccccaccucccucccggacggggcggcuggccggguggggggcugaccccccaccucccucccggacugggcggcuggc

SEQ ID NO: 169387 - RNA, 46 nt, Homo sapiens
aucuggagcagcaaccauuuguuccccagugcagagaaagcgacuc

SEQ ID NO: 169388 - RNA, 32 nt, Homo sapiens
cugcugucccaguucagccaucaucauguugu

SEQ ID NO: 169389 - RNA, 53 nt, Homo sapiens
gugucaacuaggccauaagauuuuuuucccacaaggccugauuauauggugac

SEQ ID NO: 169390 - RNA, 52 nt, Homo sapiens
uuauugggggauggaggagaagggugguggugaagagaaccggaacugaaaa

SEQ ID NO: 169391 - RNA, 56 nt, Homo sapiens
acagagacaaggaagggcacuguagauucuaaguugguaaggcaggaaaugaggac

SEQ ID NO: 169392 - RNA, 48 nt, Homo sapiens
cuugguugacuauaaggaauggcaguaccuuugcugagauagggaaua

SEQ ID NO: 169393 - RNA, 45 nt, Homo sapiens
auauauuuuggaggugaaaaggacuggauuuaguaauggguugga

SEQ ID NO: 169394 - RNA, 109 nt, Homo sapiens
agcaagaggaggcuugauggguucagggacaggagagggauuugguguggggaguugguguuggugagggugggagguaggugggcacaguagaaaggagacaagcuag

SEQ ID NO: 169395 - RNA, 108 nt, Homo sapiens
guuaucagggagcucacucuagggggugacauuucauugacuagccaagaaaaggaaggagcaagccauuugccaagaagcaggacaaaaacacuccucucguggaag

SEQ ID NO: 169396 - RNA, 38 nt, Homo sapiens
ucugcuggguccuguggauguggcugugagacucagga

SEQ ID NO: 169397 - RNA, 46 nt, Homo sapiens
gucaugucacugcagugaccauuaacuugauuauaaauccuuuggu

SEQ ID NO: 169398 - RNA, 55 nt, Homo sapiens
cgugguaacucuuacugaaaaguuuauaguuuauagggaggagugguuccugggg

SEQ ID NO: 169399 - RNA, 48 nt, Homo sapiens
agaaaagggcuugucguucggaccaggggagaggggaugcuuuucagg

SEQ ID NO: 169400 - RNA, 104 nt, Homo sapiens
cagagacccugacugcccuaggaacuagcaucuacucagaauggggugaggucuggaggaagcucagccuggccaacauggugaaaccuuaguggcagcaggua

SEQ ID NO: 169401 - RNA, 68 nt, Homo sapiens
ucuaaaauauaugucagaucaugcuacuccuguucauagcccugcaaauaguuccccauuucaaccag

SEQ ID NO: 169402 - RNA, 46 nt, Homo sapiens
gaaucuuugcugacucagagacuauccugggaaacaguucagcuga

SEQ ID NO: 169403 - RNA, 77 nt, Homo sapiens
caccacccaaagcuacagugccgaaggccgugugaugagcagagaaacugagccuucuacuguuaaccaauauggaa

SEQ ID NO: 169404 - RNA, 59 nt, Homo sapiens
guugguguguucauaggagaucaaauugauacaaccuuacuugaaaucaguuuggcaau

SEQ ID NO: 169405 - RNA, 53 nt, Homo sapiens
gugcaaauguccugaggcaucgagaugcugguacauucaagaaacugccugga

SEQ ID NO: 169406 - RNA, 42 nt, Homo sapiens
guggguggcaguggacaggguccuguuuaccacaauuugggg

SEQ ID NO: 169407 - RNA, 59 nt, Homo sapiens
cccaggaaguacuugggcauuucauuauaugcaggcccugggcauuagugugggaagcu

SEQ ID NO: 169408 - RNA, 64 nt, Homo sapiens
ucuucaccucugacuuauggauccugaagcugccccccuuucaaguaaggcggggguggggcag

SEQ ID NO: 169409 - RNA, 119 nt, Homo sapiens
cugguuugaguuucagucccaagcugaaguugaccacuggguauguccaucaccaucuaccccucagacaaagguagauggguggauuguguggggcucaguagagggggauuggggcc

SEQ ID NO: 169410 - RNA, 42 nt, Homo sapiens
gcggcggaacccgagggcggcggcagcgguuucccuugaacg

SEQ ID NO: 169411 - RNA, 32 nt, Homo sapiens
agagccgcggggacccaagcaucaggggucgu

SEQ ID NO: 169412 - RNA, 50 nt, Homo sapiens
uugauggguugguugguucauucauucuggcgcuuuacuagguucuggug

SEQ ID NO: 169413 - RNA, 51 nt, Homo sapiens
uagguggaaauacgugaaggaagaaagaaagguggauggaugugugggugg

SEQ ID NO: 169414 - RNA, 45 nt, Homo sapiens
ucuuuaaaacgcuucgaaaucacuggaagaaaacuacagcugggc

SEQ ID NO: 169415 - RNA, 48 nt, Homo sapiens
guuuacacaaaagguaauaaaggccuaaaccagagugauggcauuagg

SEQ ID NO: 169416 - RNA, 46 nt, Homo sapiens
aagacuaggauaauuggugauauagaaauaagaaaguugccaggga

SEQ ID NO: 169417 - RNA, 33 nt, Homo sapiens
cauuucaaaguuuaucuuuuucucucugugcac

SEQ ID NO: 169418 - RNA, 40 nt, Homo sapiens
uuacuaaugggauauugucauauauuuguuucagggguuu

SEQ ID NO: 169419 - RNA, 56 nt, Homo sapiens
aguucguugugucucuuaagaacagcaaaacaugcaguuugccaagagcagaagca

SEQ ID NO: 169420 - RNA, 368 nt, Homo sapiens
acugaugucaugauaauuucaguaaaacaugguucuuaaguuguuuuuuuuuuuuuuuuuuuuuuuuuuugagacagagucucacucuguagccccaggcuggagcgcaauggcgugaucuuggcucaaugcaaccuccaccucccggguucaggcaauucuccugccucagccucccgaguaguugggauuacaggcaugcaccagcaugcccggcuaauuuuuauauuuuuaguagagacggggucucaccauguuggccaggcuggucacgaacuccugaccucaagugaucugcccaccuuguccucccaaagugcuaagauuacaggugugagccacugugcccugcgguucuuagguuucag

SEQ ID NO: 169421 - RNA, 43 nt, Homo sapiens
ugauuugcaaguagguaccaacuuuagacacuaagaaaugagg

SEQ ID NO: 169422 - RNA, 41 nt, Homo sapiens
cguaaauccuuaggccaucucuguccacaggauguucagaa

SEQ ID NO: 169423 - RNA, 39 nt, Homo sapiens
aucguguuguuuccuuuuccucagaauuuacaugucuac

SEQ ID NO: 169424 - RNA, 43 nt, Homo sapiens
ugaagaauuuuaaaugguaaagcuuuagaauuugugagauuua

SEQ ID NO: 169425 - RNA, 43 nt, Homo sapiens
ucauuuucauucucaauauuguuuauuuguacccucucuuuuu

SEQ ID NO: 169426 - RNA, 47 nt, Homo sapiens
guggcucuagguugauaaacucaccaaaggcuuccuugguauuucag

SEQ ID NO: 169427 - RNA, 49 nt, Homo sapiens
uuuucuacaauagcuagaagauccuucucagucccuuugguaauaguac

SEQ ID NO: 169428 - RNA, 45 nt, Homo sapiens
cuagcuuuauuugauuacuggucuaaggauguggaaaggagaugg

SEQ ID NO: 169429 - RNA, 52 nt, Homo sapiens
ggaggaagaaaggcggcgccuggcugugcugugagaugggagaaacaggccu

SEQ ID NO: 169430 - RNA, 50 nt, Homo sapiens
aauugacuuauuuuuggagaauccauuguaugcaaugaaacucuuggcuu

SEQ ID NO: 169431 - RNA, 58 nt, Homo sapiens
ugguuuacacauuuuuaauugagugugcauaugugcauuugugugugugagaggacau

SEQ ID NO: 169432 - RNA, 51 nt, Homo sapiens
agagaaaggaaagggcuggauccaugcauugguccuucuagacuuggggag

SEQ ID NO: 169433 - RNA, 48 nt, Homo sapiens
gcuauaguccucucccacuaauucaguuauuuuuauuuuuacccugug

SEQ ID NO: 169434 - RNA, 46 nt, Homo sapiens
cuguggaggugaaacugcuccccaggaagcugcaguucuucuguga

SEQ ID NO: 169435 - RNA, 47 nt, Homo sapiens
agauuaacaggcacaaccuaggauccuuugcuaccaguucucuacua

SEQ ID NO: 169436 - RNA, 42 nt, Homo sapiens
cugaaauuuuaauucuugaaucaaaugaaaucucuuugcccc

SEQ ID NO: 169437 - RNA, 45 nt, Homo sapiens
ggggaaccggaagacacaaggguuacagaggccggaguucugaca

SEQ ID NO: 169438 - RNA, 41 nt, Homo sapiens
cacaucaguggccuggccaaagauuagggcuggauuaaagc

SEQ ID NO: 169439 - RNA, 40 nt, Homo sapiens
guaggggaaugguaucagugcaggagugaugccuuggaaa

SEQ ID NO: 169440 - RNA, 38 nt, Homo sapiens
aguauagaguuuaauguagucaaacagaaaagacaacu

SEQ ID NO: 169441 - RNA, 60 nt, Homo sapiens
cccuaggaaauagugaugaauuuuaagacagcuggggguuuggucauuucucauuuaaac

SEQ ID NO: 169442 - RNA, 59 nt, Homo sapiens
aguagaaugugaauggaaaauuuggaggacaauuuuaagaugcaaagagcagucguaag

SEQ ID NO: 169443 - RNA, 47 nt, Homo sapiens
ccugcucccuggcaccugauccuuacuuauccagggauggaggagaa

SEQ ID NO: 169444 - RNA, 52 nt, Homo sapiens
ggcacauucacacggucugauuuaguauugguagcuccagugguagagucuu

SEQ ID NO: 169445 - RNA, 46 nt, Homo sapiens
aaggaaacccaggugugacugucaaugucuccagggcagcugcugg

SEQ ID NO: 169446 - RNA, 41 nt, Homo sapiens
ucgacccccgcucgggugagggccgcgccggggccaggcgc

SEQ ID NO: 169447 - RNA, 41 nt, Homo sapiens
gccgcaggcgggaggcuggggccggggcggcggcgggggcg

SEQ ID NO: 169448 - RNA, 46 nt, Homo sapiens
aaaagaacgucccaggucuguugaagcacuaagaaaagcagaaaaa

SEQ ID NO: 169449 - RNA, 43 nt, Homo sapiens
aaugagaaccugugucaugauucuggaaaugucauuugagugc

SEQ ID NO: 169450 - RNA, 38 nt, Homo sapiens
agaugaaguuggcaugucaggcuucagacauuccagau

SEQ ID NO: 169451 - RNA, 42 nt, Homo sapiens
uuuuaguugagaucuuaauaugcuuuauaagagucaggucag

SEQ ID NO: 169452 - RNA, 45 nt, Homo sapiens
aaaaaacuaucagucaagauaauacacagcagaaugauccucaag

SEQ ID NO: 169453 - RNA, 45 nt, Homo sapiens
agcuugucuuugcagaugacaguagcaacggccaccuccuaccgg

SEQ ID NO: 169454 - RNA, 71 nt, Homo sapiens
uuagauacggaggcacuccaugggauuggaaagcagcucugggcauaaacaggggagggagauggcuucag

SEQ ID NO: 169455 - RNA, 44 nt, Homo sapiens
gcucugaaccuccuaauaguuacuuauacuuuccccagccccuc

SEQ ID NO: 169456 - RNA, 42 nt, Homo sapiens
ggaggaagaugaggaagaugaagaggaugaggaggaggagga

SEQ ID NO: 169457 - RNA, 28 nt, Homo sapiens
agccuuaugaaaagaaggcugcgaagcu

SEQ ID NO: 169458 - RNA, 46 nt, Homo sapiens
cgcggggucuugguccaccuuccagcacaaggagcugauggccgcu

SEQ ID NO: 169459 - RNA, 65 nt, Homo sapiens
guauuuucacugcuaucaggugccacccuuccugcuguuacauauguggaaaaugugacggggca

SEQ ID NO: 169460 - RNA, 44 nt, Homo sapiens
aauuguuagaacaucuucuggagaaggacaucaucaccuuggaa

SEQ ID NO: 169461 - RNA, 72 nt, Homo sapiens
aaaugauauauaacucaagaauaacagaaaggacuucacccauacauacacuuuuccuguaaaaagaauucu

SEQ ID NO: 169462 - RNA, 32 nt, Homo sapiens
ucuuaggccaaagugggcaguuucagccagaa

SEQ ID NO: 169463 - RNA, 47 nt, Homo sapiens
aggauauguugcucaccacccuuucugggcuucagcauguacuccca

SEQ ID NO: 169464 - RNA, 32 nt, Homo sapiens
agcuaagaagaagaagcgccuagguagauaug

SEQ ID NO: 169465 - RNA, 36 nt, Homo sapiens
gaaauguggccucucuaaggagcagaccaguuacuc

SEQ ID NO: 169466 - RNA, 47 nt, Homo sapiens
gucugccuuuguuacagaugagacugaucgugggguugaccaacaag

SEQ ID NO: 169467 - RNA, 54 nt, Homo sapiens
uuucagcugcaguugaagagccugacaagugaaguuguaaacacagugugguua

SEQ ID NO: 169468 - RNA, 45 nt, Homo sapiens
ucugucaccacaucuugucuuuuccccucauugcauuuauugcag

SEQ ID NO: 169469 - RNA, 47 nt, Homo sapiens
gaagguaggaugaaugaacaagggaaagggugggaagugugggaaug

SEQ ID NO: 169470 - RNA, 46 nt, Homo sapiens
uagggaugcccaagaagacaggcuccaguucuaccguggacagcaa

SEQ ID NO: 169471 - RNA, 51 nt, Homo sapiens
gcaguuccuggucugggucaccuucccacuaguccucauccucuucagcgc

SEQ ID NO: 169472 - RNA, 46 nt, Homo sapiens
ccucucugggaugaggccucgugagggcaggaccucuguguaacuc

SEQ ID NO: 169473 - RNA, 46 nt, Homo sapiens
acauugccagcaucugugcugcuguccucagcaaauucaugucugu

SEQ ID NO: 169474 - RNA, 39 nt, Homo sapiens
uauucucuagacuaggauuugcacgaauguguuucaugg

SEQ ID NO: 169475 - RNA, 59 nt, Homo sapiens
agguguaguuguggcaugagcauacaugaaauugagagagaaagugugucuaugaguag

SEQ ID NO: 169476 - RNA, 54 nt, Homo sapiens
ggguugggcagagggacaggagcagcagagaagguagagagggaauccagggug

SEQ ID NO: 169477 - RNA, 45 nt, Homo sapiens
auauccauggaggagugugcguagaaaaaaggaaaauacauucaa

SEQ ID NO: 169478 - RNA, 72 nt, Homo sapiens
uacuaugugccaaguacauaauauuucaucauuaaccuuuagcuauaucuuaugcuugcaacagaaaaaaaa

SEQ ID NO: 169479 - RNA, 53 nt, Homo sapiens
auuuugaaaaguccuguagaaacgaaauacuguauauuuuucaacauuucugc

SEQ ID NO: 169480 - RNA, 49 nt, Homo sapiens
agaaacauauacuuccugggcuauauuucaagccuaacaguuugcagca

SEQ ID NO: 169481 - RNA, 50 nt, Homo sapiens
uggaucucguaacaccuuccuuccuuuuaucuucccucuaggagcugcau

SEQ ID NO: 169482 - RNA, 45 nt, Homo sapiens
uguuugaugacaucaucuacaagauccuaccugggggcuaugcag

SEQ ID NO: 169483 - RNA, 45 nt, Homo sapiens
gcucaggucaggggcacuagacggaauuaguucagaucugauggg

SEQ ID NO: 169484 - RNA, 55 nt, Homo sapiens
gggcuccccggcgcgccuccaggccggcccgaguccuucgccuuuguggaugagg

SEQ ID NO: 169485 - RNA, 41 nt, Homo sapiens
gggccucugccuggccacaaacagcagccggaagcaccaga

SEQ ID NO: 169486 - RNA, 75 nt, Homo sapiens
auugggagagucaggaaauacguacacugcagggagaggguagggcagguaaaggaacuccagauggucagaaua

SEQ ID NO: 169487 - RNA, 45 nt, Homo sapiens
cuggcccuggaggagguaaucacgaugugucccauuugagcagca

SEQ ID NO: 169488 - RNA, 44 nt, Homo sapiens
gauacccucuucaacacaaggacaagaaggaagguguguggugg

SEQ ID NO: 169489 - RNA, 46 nt, Homo sapiens
uuuucuacauuuuuauaacuucuugggcacucaggguugaguggag

SEQ ID NO: 169490 - RNA, 90 nt, Homo sapiens
guguggcuguggagaaggaccugggcugugggcuucugggucugugccgacaaagccuccagugugugcacccugaggacgggggcagcg

SEQ ID NO: 169491 - RNA, 48 nt, Homo sapiens
ccaggcuuacacucuagaaacccacaggccugggaacugagaccuggg

SEQ ID NO: 169492 - RNA, 46 nt, Homo sapiens
gaggacaugagugugaacuccacccaggagccauugggcugcaacu

SEQ ID NO: 169493 - RNA, 42 nt, Homo sapiens
agagaacccccaagagagcaucgugggcuuguggguccacca

SEQ ID NO: 169494 - RNA, 44 nt, Homo sapiens
aagcuguagugcaggucuaaauaagaugccuagaaagggauagg

SEQ ID NO: 169495 - RNA, 52 nt, Homo sapiens
aggaggaggggguauccauggaaauaaaccgggucucagggaaaucaggcuu

SEQ ID NO: 169496 - RNA, 43 nt, Homo sapiens
ccccgccccagagggaaaacgcacgugaacaaagcgaaucgga

SEQ ID NO: 169497 - RNA, 46 nt, Homo sapiens
gagagauggggcaaagcacccgagccagauggaggcggcggcgggg

SEQ ID NO: 169498 - RNA, 40 nt, Homo sapiens
aaggaaagugaaggagcuagcagggcaaggcgggugcgga

SEQ ID NO: 169499 - RNA, 59 nt, Homo sapiens
agcuauaaaaucaaaccaauagauguauuaaaaagugauguaacuaucagacauuugga

SEQ ID NO: 169500 - RNA, 51 nt, Homo sapiens
uuaaugcugacaaagggaaagaaagcagaaagagauugagaauuagaggaa

SEQ ID NO: 169501 - RNA, 45 nt, Homo sapiens
ugauuuugaguuauucaugaagaauaagaagaggcuugauaggua

SEQ ID NO: 169502 - RNA, 72 nt, Homo sapiens
cauacugucucgggcuuucugggaagaaugugcauucagugccauagauaguaucauugaagagcugggaug

SEQ ID NO: 169503 - RNA, 46 nt, Homo sapiens
uucuccagcaaaaugaggaugaaaaccaggaaagaagaagaaaugg

SEQ ID NO: 169504 - RNA, 48 nt, Homo sapiens
aaauuuuuguaccuagaauuucauaguaaggcagacugucaagaagaa

SEQ ID NO: 169505 - RNA, 46 nt, Homo sapiens
aauuuuggaauauuaaggauagaaggaagauauuaaaguggccagg

SEQ ID NO: 169506 - RNA, 50 nt, Homo sapiens
uggaagagagaacagagacaguguaggugaagaaauaaaaagaaaaagaa

SEQ ID NO: 169507 - RNA, 59 nt, Homo sapiens
agaaaacugaagggauuugguuauaaguggagaggaucucagcauauuucuggaagaua

SEQ ID NO: 169508 - RNA, 46 nt, Homo sapiens
guugggagccauucauccgucucuucaccgaguacaggaaccagac

SEQ ID NO: 169509 - RNA, 56 nt, Homo sapiens
ggucuugggcauuccucgaagccgugccaauauugcucuguggcccccaguucggg

SEQ ID NO: 169510 - RNA, 51 nt, Homo sapiens
gaagaaaaggaaaacaggcaugaaggaccccaugagccaaagccuagagag

SEQ ID NO: 169511 - RNA, 42 nt, Homo sapiens
agaggcuucauuuccugugauggugaaugacaugggccaggu

SEQ ID NO: 169512 - RNA, 47 nt, Homo sapiens
ugaguucuccaagcugggauuaaucugauuagugugggagccaagag

SEQ ID NO: 169513 - RNA, 41 nt, Homo sapiens
cuaaacuagguuaauggcagugugauuggaaaccaugaaca

SEQ ID NO: 169514 - RNA, 45 nt, Homo sapiens
gugcuacagggucuuaugcuggguacaaugggguaucugggggcu

SEQ ID NO: 169515 - RNA, 45 nt, Homo sapiens
uuuuaggaugauuugaauauuuauuuaugaggcacucauccaguc

SEQ ID NO: 169516 - RNA, 46 nt, Homo sapiens
cuuguuccuaaugauccaauuuggagaaagggaguugaagggagau

SEQ ID NO: 169517 - RNA, 46 nt, Homo sapiens
ggacgccccaacccccaaccgucugcacugcagcccaccucccccc

SEQ ID NO: 169518 - RNA, 49 nt, Homo sapiens
gccgauuggccucacugacccuggcuguacacaucaguucuuugccaca

SEQ ID NO: 169519 - RNA, 28 nt, Homo sapiens
ggcuagcuugucuccguuaagcccaggu

SEQ ID NO: 169520 - RNA, 42 nt, Homo sapiens
ugggccccggguuaguguccggggcggggagcggugggcggg

SEQ ID NO: 169521 - RNA, 46 nt, Homo sapiens
gaugucgacgaccgccaggugugagaggaagaaguacaugggggug

SEQ ID NO: 169522 - RNA, 42 nt, Homo sapiens
ccauaaaagaguccaaccacacagaggugggaggagcagaug

SEQ ID NO: 169523 - RNA, 46 nt, Homo sapiens
ugagaugagccccaggauggccccguuccccagcagggugaagaua

SEQ ID NO: 169524 - RNA, 41 nt, Homo sapiens
ugcggguguaggcgaugucgacgacagccaggugugagagg

SEQ ID NO: 169525 - RNA, 42 nt, Homo sapiens
cugcggcccuccccagacuggauccucaggauggccgccagg

SEQ ID NO: 169526 - RNA, 57 nt, Homo sapiens
gaaaucucugucccccagguaaaggauuccuacuuugugugugucugugugugcaca

SEQ ID NO: 169527 - RNA, 45 nt, Homo sapiens
gccucucugaaaggacaugcccguguccuucuguauucccgaguu

SEQ ID NO: 169528 - RNA, 42 nt, Homo sapiens
ccacagaggguaccagagcugcgcagauacaugagcccagag

SEQ ID NO: 169529 - RNA, 42 nt, Homo sapiens
aacuaaaacacuacgcagauuccuguaccgcucugggacaga

SEQ ID NO: 169530 - RNA, 43 nt, Homo sapiens
aacaaccccggggggauuucgaauucuaucaucugggcaaaag

SEQ ID NO: 169531 - RNA, 52 nt, Homo sapiens
gccacuucggaccucgcgagcggggcugagcugcuugggucggggacaccac

SEQ ID NO: 169532 - RNA, 45 nt, Homo sapiens
auccggcgcgccgggucggggaugucucgggugccgggggcaggg

SEQ ID NO: 169533 - RNA, 42 nt, Homo sapiens
cgggccccucccgcgccucgggcuggcggggcgauggcgacg

SEQ ID NO: 169534 - RNA, 35 nt, Homo sapiens
uggugcaggcggcggcggcgggaggaggagggccg

SEQ ID NO: 169535 - RNA, 42 nt, Homo sapiens
agcuccaggcggggcagccccgguagcugagggacgcagcua

SEQ ID NO: 169536 - RNA, 85 nt, Homo sapiens
uaauagcgcccugcacguucgcaacaaugcaggcggggaacccgagagccgcgggcagggaaccggaaagcgagagagcccggcu

SEQ ID NO: 169537 - RNA, 55 nt, Homo sapiens
aucaauuauuuaagaaguguaugcuaaauaguacaaaugaggaauacuguuguaa

SEQ ID NO: 169538 - RNA, 42 nt, Homo sapiens
uuuggugagacuggaaggaaagguuuggaauccuagaugaug

SEQ ID NO: 169539 - RNA, 92 nt, Homo sapiens
auucagggaauagacaugaagacuaggccauuucccccuccccaaacuucaagcuuaucuauaggaacuuggagacuuuggugugggggaug

SEQ ID NO: 169540 - RNA, 44 nt, Homo sapiens
uagcugcuugcccucagcuuucugcugcuuggagauaccucaaa

SEQ ID NO: 169541 - RNA, 72 nt, Homo sapiens
caucuguguagaguagguccuaccaacaagggacucaaaacacacaaagggaagaaggguuaggaaugcuga

SEQ ID NO: 169542 - RNA, 47 nt, Homo sapiens
ccuuuguuacauguucuauauauaggggacuuugcccuauacagggu

SEQ ID NO: 169543 - RNA, 43 nt, Homo sapiens
guggcuccuggcacuuaccacagucagugacuuuucauaauag

SEQ ID NO: 169544 - RNA, 45 nt, Homo sapiens
aagcucuucaucuucuuucuaguuucaggcuucuucucguaacuu

SEQ ID NO: 169545 - RNA, 79 nt, Homo sapiens
aacuuugacauucguguuuucaccuguuuauauauuguugcaggggaguauaaaccccucucuauugguaaugucuuac

SEQ ID NO: 169546 - RNA, 47 nt, Homo sapiens
uccuuucugugaaugaacugaauuugaaccauaagauuuacagcuag

SEQ ID NO: 169547 - RNA, 39 nt, Homo sapiens
uugcuucuuguccuugacuaauugcaucuucugccuugg

SEQ ID NO: 169548 - RNA, 45 nt, Homo sapiens
gauuucauucucuacauuuaaaggacauccuuucugagcugcugu

SEQ ID NO: 169549 - RNA, 47 nt, Homo sapiens
ccauuagcagucacuccucaugcccucuucccccgaggcccuggcaa

SEQ ID NO: 169550 - RNA, 73 nt, Homo sapiens
uauaacauggaauauuuagaaauaucuugcccucaugccauuuauuagauaaucuaucuuuuacccguugucu

SEQ ID NO: 169551 - RNA, 78 nt, Homo sapiens
uaacuacuguacuaguguucaccagucaaaccaagcacgaggagcuggaguuccuccuucuaagucgaaaaaggggca

SEQ ID NO: 169552 - RNA, 61 nt, Homo sapiens
cugaauggaauuugugccuaccucaauagacauuggguucgccgugaaugugacgaaggac

SEQ ID NO: 169553 - RNA, 58 nt, Homo sapiens
aaaaacaugguaaaaguauagacauuuuguacuuuuuuuucuccagcuugcauuggug

SEQ ID NO: 169554 - RNA, 68 nt, Homo sapiens
aaugcuguuuuaaagcugauugaaaaggaaaggaauggugaaaccaucaauacaagauugauuagugg

SEQ ID NO: 169555 - RNA, 46 nt, Homo sapiens
ugaaucucaauuuuuggcugacacagagagauuuuauaccagagag

SEQ ID NO: 169556 - RNA, 46 nt, Homo sapiens
uggaaauuuuccacacagaauuucagaauuuauuggaugcugacaa

SEQ ID NO: 169557 - RNA, 51 nt, Homo sapiens
uaaauccccugaguugcuggcucgauacugugacuccuuguugaagaaaag

SEQ ID NO: 169558 - RNA, 43 nt, Homo sapiens
aaaacaugguaucuuuuuaaaauuuucaguuccaagaacccag

SEQ ID NO: 169559 - RNA, 40 nt, Homo sapiens
accccacuguggggcuuccauccuacccaggccuggcugg

SEQ ID NO: 169560 - RNA, 142 nt, Homo sapiens
ugggggccacaaguccgagaucagggugccagcugauucgguuccuggugcaggcccucuuccugcuuuguaggcagccaccuucuugcagugccucacgugucagagagagagugcagagcucuugcacaucucuuacaag

SEQ ID NO: 169561 - RNA, 72 nt, Homo sapiens
acagcaucacguuggagguuugggcuucaacauagggauuuugggggcacacaguucagcuucugguaagag

SEQ ID NO: 169562 - RNA, 35 nt, Homo sapiens
ucauuguauucuaccagugucaggacaccuugcuc

SEQ ID NO: 169563 - RNA, 30 nt, Homo sapiens
aauauuaauccaugcauauuuguacuguaa

SEQ ID NO: 169564 - RNA, 46 nt, Homo sapiens
accucuaaacuucagcgcauguuucaagacauuggcgugagcaaag

SEQ ID NO: 169565 - RNA, 51 nt, Homo sapiens
gaguauccgugugucucuauguuguguuuacaggcagaguucucuguagca

SEQ ID NO: 169566 - RNA, 45 nt, Homo sapiens
ggguccuggcccuuccagcagucuuguacauuugccuugccguca

SEQ ID NO: 169567 - RNA, 47 nt, Homo sapiens
aauggcauauuuuagucucugagaaguuuucaccagugaguuucuaa

SEQ ID NO: 169568 - RNA, 53 nt, Homo sapiens
auauuguuaggaaagauaaggaagaggauaugggcaucuuuaauuugaaauag

SEQ ID NO: 169569 - RNA, 46 nt, Homo sapiens
accgaacagaagcaggaacaagaaaccacacacaaaaacaucgagg

SEQ ID NO: 169570 - RNA, 48 nt, Homo sapiens; identical to SEQ ID NO: 90792

SEQ ID NO: 169571 - RNA, 50 nt, Homo sapiens
ucugcuaccuccuccccccuccucugaaacagcugccuuagcuucaggaa

SEQ ID NO: 169572 - RNA, 46 nt, Homo sapiens
gaucaccguuaaccaucauaacugcaaagagacacacuggugucag

SEQ ID NO: 169573 - RNA, 45 nt, Homo sapiens
aaaauucguuuugcaaaucauucgguaaauccaaacugcuaugca

SEQ ID NO: 169574 - RNA, 45 nt, Homo sapiens
aagcugacagaagagggaaaguguaugauaaauacaugugcagcu

SEQ ID NO: 169575 - RNA, 69 nt, Homo sapiens
caggcugggggauuuuuaucaaagauccugugcagaaaaaugaauucaucucagaauacuguggagagg

SEQ ID NO: 169576 - RNA, 51 nt, Homo sapiens
guguccuggggcugaaaauggaauaacuauuaauagaaucacuuggggaaa

SEQ ID NO: 169577 - RNA, 46 nt, Homo sapiens
uuuuauuucugacuggauucaggcuuagaaguagaaggucgcagag

SEQ ID NO: 169578 - RNA, 42 nt, Homo sapiens
ugaauacugcaguucuugcaggacacauuuuuacugucccaa

SEQ ID NO: 169579 - RNA, 46 nt, Homo sapiens
cccugaccucugucuuacuuguggagccgcugaccauugggacagu

SEQ ID NO: 169580 - RNA, 45 nt, Homo sapiens
accgcuuuccgggaugccgcugcaaagcacagugcaacaccaagc

SEQ ID NO: 169581 - RNA, 45 nt, Homo sapiens
ucgucagaguuaggaggguuuuagucuucagauuaaaggaaugua

SEQ ID NO: 169582 - RNA, 47 nt, Homo sapiens
cauguuuacaacuaucaacccugugaucauccacggcagccuuguga

SEQ ID NO: 169583 - RNA, 46 nt, Homo sapiens
gugggcugcacacugcagaaagauacagcugaaaaaggguuagcau

SEQ ID NO: 169584 - RNA, 46 nt, Homo sapiens
ccagcucccgcugaggauguggauacuccuccaaggaaaaagaaga

SEQ ID NO: 169585 - RNA, 42 nt, Homo sapiens
cauaccagaaaaaugucuuugucucuucugugacacugcuag

SEQ ID NO: 169586 - RNA, 69 nt, Homo sapiens
aagccucaauguuuagaguccucauuggcacuuacuaugacaauuucugugccauugcuagguuaauug

SEQ ID NO: 169587 - RNA, 75 nt, Homo sapiens; identical to SEQ ID NO: 90816

SEQ ID NO: 169588 - RNA, 53 nt, Homo sapiens
ugauagggaagcagggacugaaacggggggagagaacaaugauaaagaagaag

SEQ ID NO: 169589 - RNA, 43 nt, Homo sapiens
acugucuguauccuuugauuccagcacauuaauggugggggug

SEQ ID NO: 169590 - RNA, 46 nt, Homo sapiens
gcugagcggauaaagaccccaccaaaacguccaggaggccgcagaa

SEQ ID NO: 169591 - RNA, 50 nt, Homo sapiens
gguggggucuuuauccgcucagcggugagagcagcagcaaacuccuuugc

SEQ ID NO: 169592 - RNA, 51 nt, Homo sapiens
augggccauaugauagacagagcuuucucacccaugcuguuucuuccauag

SEQ ID NO: 169593 - RNA, 41 nt, Homo sapiens
caacaaaccuuguggaccacaguguuaccagcauuugguaa

SEQ ID NO: 169594 - RNA, 45 nt, Homo sapiens
uagagcuguuucuguguucuuccgcuuauaaguguuggguguugc

SEQ ID NO: 169595 - RNA, 52 nt, Homo sapiens
agcagcuuggagagugcuaucauuuauuacaacuagaauuuaucauuuaauc

SEQ ID NO: 169596 - RNA, 46 nt, Homo sapiens
auugcacuuacgauguaggaagcagucauauuuaaaacaucgccua

SEQ ID NO: 169597 - RNA, 60 nt, Homo sapiens
uccugaauguacccccaacauagauggaccaaaugcuaaaucuguucagagagagcaaag

SEQ ID NO: 169598 - RNA, 54 nt, Homo sapiens
uuuagcauuugguccaucuauguuggggguacauucaggaggaagugcgccugg

SEQ ID NO: 169599 - RNA, 49 nt, Homo sapiens
uuuuugaagccauuuccucaauguuuccagauaagggcacagcagaaga

SEQ ID NO: 169600 - RNA, 44 nt, Homo sapiens
uucuucugcugugcccuuaucuggaaacauugaggaaauggcuu

SEQ ID NO: 169601 - RNA, 45 nt, Homo sapiens
auuaugucucuauaacaaagcugauuuucuaagaaaucaucucua

SEQ ID NO: 169602 - RNA, 333 nt, Homo sapiens
ucucuuuuucuuucuuuguuaaauaucacauugauagcaguauaaucaaaauuaacauauuauggccagguaggguggcuaacucuguaauccuagcacuugggaggcuaaggugggcagauugcuugagcccaggaguucaagaccaaccugggcaacauagugagaccccaucucuacuaaaaaguaaaaaaaugagacagggugauugcuugagcccaggagguguaggcugcauugagcugugauugugccacugcacagucuggcugggugacagagugagaccuugccuuaaaaaagaaaaaaaaaagcauaauacuugcaacauua

SEQ ID NO: 169603 - RNA, 70 nt, Homo sapiens
uggucaauauaaugaugaugacgaugaugaugauggagacgauccugaagaaagagaagaaaagcagaaa

SEQ ID NO: 169604 - RNA, 46 nt, Homo sapiens
gaucgucuccaucaucaucaucgucaucaucauuauauugaccaag

SEQ ID NO: 169605 - RNA, 61 nt, Homo sapiens
uucagacccugcuuucugcugauaaugacaauggaugaugauauuacaaauauuauccuuu

SEQ ID NO: 169606 - RNA, 34 nt, Homo sapiens
gaggaucauguuugccaccugauaauuaugcaua

SEQ ID NO: 169607 - RNA, 60 nt, Homo sapiens
ggaugguacuuucauugaagaacuaauaaaaaauuaugaugggaaaguacacggggauag

SEQ ID NO: 169608 - RNA, 48 nt, Homo sapiens
cccaucauaauuuuuuauuaguucuucaaugaaaguaccauccugauc

SEQ ID NO: 169609 - RNA, 50 nt, Homo sapiens
uguagaauguucuuauuuuacauauaaguacauauccuuuuggcauaaac

SEQ ID NO: 169610 - RNA, 46 nt, Homo sapiens
ucaguacccauaauguauucuuggucuccccuacagcagaauuuua

SEQ ID NO: 169611 - RNA, 54 nt, Homo sapiens
uucagagucuuuaaugggaugacuuguguuggaaaauccaagucacuggucacc

SEQ ID NO: 169612 - RNA, 27 nt, Homo sapiens
auucuguauuaaaauucuaugaacaau

SEQ ID NO: 169613 - RNA, 43 nt, Homo sapiens
uuguuuuugagauuauagaaccuaagcauuauuguucauagaa

SEQ ID NO: 169614 - RNA, 48 nt, Homo sapiens
gagagauuggaauuucuuuuucuauaguacuuucugaacgagcuagcu

SEQ ID NO: 169615 - RNA, 23 nt, Homo sapiens
uggacacccugaggucaaugauu

SEQ ID NO: 169616 - RNA, 46 nt, Homo sapiens
auuuccguucuuuccaaaauuuucugacgauuggaacuaaacauac

SEQ ID NO: 169617 - RNA, 44 nt, Homo sapiens
aucgucagaaaauuuuggaaagaacggaaaucuuaaaccaagaa

SEQ ID NO: 169618 - RNA, 52 nt, Homo sapiens
acacgcuuccgccaacaaacuggucccuucucagauuucuucccagucuggc

SEQ ID NO: 169619 - RNA, 49 nt, Homo sapiens
auaaucaugggccagacugggaagaaaucugagaagggaccaguuuguu

SEQ ID NO: 169620 - RNA, 27 nt, Homo sapiens
gcuugagccaaaaaaugagguaaagug

SEQ ID NO: 169621 - RNA, 47 nt, Homo sapiens
gugcaggaguuacaguuucuucacauuuucauugacacuucguguug

SEQ ID NO: 169622 - RNA, 46 nt, Homo sapiens
auuugaggaguuuugacaaauguaugcaccugcaccgcugccugga

SEQ ID NO: 169623 - RNA, 51 nt, Homo sapiens
gggaauugguuuaaaaauucauauuaaauuauuuucugguacaauugagaa

SEQ ID NO: 169624 - RNA, 54 nt, Homo sapiens
gauuauuccccaaaucccgacggguugaaugaggaugaggugguagaaguaggu

SEQ ID NO: 169625 - RNA, 46 nt, Homo sapiens
gcuguuuuggccaacuugugugauacaucugagaauggcgacaggu

SEQ ID NO: 169626 - RNA, 31 nt, Homo sapiens
gccacaggguuacuuuuugaaagcgggagga

SEQ ID NO: 169627 - RNA, 35 nt, Homo sapiens
ccccggcggcggcggcggcggcgcgcgggggcgac

SEQ ID NO: 169628 - RNA, 27 nt, Homo sapiens
gcgccgccgccgccgccgccggggcuc

SEQ ID NO: 169629 - RNA, 45 nt, Homo sapiens
aaauaccauugucauguaaacugagauuccauauugagaguucau

SEQ ID NO: 169630 - RNA, 49 nt, Homo sapiens
ugggguucaugaugucucgcgacuccuuuccguauaugacaaauacagc

SEQ ID NO: 169631 - RNA, 43 nt, Homo sapiens
ccaaggugauuuccucauaaccuauagugauuagugagaaaaa

SEQ ID NO: 169632 - RNA, 46 nt, Homo sapiens
ccuuuagaaguuuuaaauguuuauaacgaaagggcuaaggacagag

SEQ ID NO: 169633 - RNA, 28 nt, Homo sapiens
ccgaaguaaagaugacuaagaaaaggcg

SEQ ID NO: 169634 - RNA, 91 nt, Homo sapiens
cgacaguaucucggauuccuuuuuuuuuuuuuuuaauuuuuuauacuuugguguuucacuucaugcucugaauacugaauaaccaugaaug

SEQ ID NO: 169635 - RNA, 47 nt, Homo sapiens
auuugagcaaguuuauagaagaacaugccacaaaacugagcaggacc

SEQ ID NO: 169636 - RNA, 45 nt, Homo sapiens
caguuuuguggcauguucuucuauaaacuugcucaaaugcuccag

SEQ ID NO: 169637 - RNA, 46 nt, Homo sapiens
cgcuggggacgucguuggcaguggcguccaucuuggcgaugaccag

SEQ ID NO: 169638 - RNA, 47 nt, Homo sapiens
gccaagaaguacaagggccaaaagggccuggucaucgccaagaugga

SEQ ID NO: 169639 - RNA, 53 nt, Homo sapiens
gaagccagucaucaaaucccagccagugcccaagaacaacaagggacccguca

SEQ ID NO: 169640 - RNA, 29 nt, Homo sapiens
uucucuggacgagaagucagagucccucg

SEQ ID NO: 169641 - RNA, 77 nt, Homo sapiens
aaggaccuggggcucagcgagaguggggaggaugucaaugccgccauccuggacgagagugggaagaaguucgccau

SEQ ID NO: 169642 - RNA, 43 nt, Homo sapiens
ggauggcggcauugacauccuccccacucucgcugagccccag

SEQ ID NO: 169643 - RNA, 44 nt, Homo sapiens
ccucuucguccgcaauggcaaagguguacucagggaaguccuug

SEQ ID NO: 169644 - RNA, 70 nt, Homo sapiens
agagguggccaaggacuucccugaguacaccuuugccauugcggacgaagaggacuaugcuggggaggug

SEQ ID NO: 169645 - RNA, 47 nt, Homo sapiens
ucgcuaauauucugacaaugcucaaacccuggauuuaccucaauugg

SEQ ID NO: 169646 - RNA, 45 nt, Homo sapiens
cauguuucccuccaauugagguaaauccaggguuugagcauuguc

SEQ ID NO: 169647 - RNA, 46 nt, Homo sapiens
gaaguccacacuguaguagacgaccaccagggggcgccugguguag

SEQ ID NO: 169648 - RNA, 46 nt, Homo sapiens
cgcccugccccugguuggccaccgcaaggugucaaacgaugcuaag

SEQ ID NO: 169649 - RNA, 46 nt, Homo sapiens
ccaggggcaguugguuguaaugcagccugagaaauuccaguccaag

SEQ ID NO: 169650 - RNA, 46 nt, Homo sapiens
ccgggccucccuccaaggagauucugacccugaagcagguccagga

SEQ ID NO: 169651 - RNA, 46 nt, Homo sapiens
ucauaaggccuuccuuugcggaaaauuuucagggugggauagccag

SEQ ID NO: 169652 - RNA, 42 nt, Homo sapiens
ugaugucucuggcuaucccacccugaaaauuuuccgcaaagg

SEQ ID NO: 169653 - RNA, 42 nt, Homo sapiens
agcaagcguucuccuccaauuccccuggcaaaggucgacgcc

SEQ ID NO: 169654 - RNA, 41 nt, Homo sapiens
cugaagccaucuaugacuuacauccuugcuggcccccaacu

SEQ ID NO: 169655 - RNA, 43 nt, Homo sapiens
ccuuguuucgcuaugcauggggcccuggccugaugggugggag

SEQ ID NO: 169656 - RNA, 46 nt, Homo sapiens
guguugaccaaagagaacuuugaugaaguugugaaugaugcagaua

SEQ ID NO: 169657 - RNA, 90 nt, Homo sapiens
gccagcagguuugaugugaguggcuaccccaccaucaagauccuuaagaaggggcaggcuguagacuacgagggcuccagaacccaggaa

SEQ ID NO: 169658 - RNA, 72 nt, Homo sapiens
agcaguuugcuccggaauaugaaaaaauugccaacauauuaaaggauaaagauccucccauuccuguugcca

SEQ ID NO: 169659 - RNA, 72 nt, Homo sapiens
gaugaugaugaggaagaagacgacuuggaaguuaaggaagaaaauggagucuugguccuaaaugaugcaaac

SEQ ID NO: 169660 - RNA, 45 nt, Homo sapiens
ucaucaucuuccuccuccuccuccucuucauccucaauggcauuu

SEQ ID NO: 169661 - RNA, 55 nt, Homo sapiens
agauucuucuaacagagaaaaugccauugaggaugaagaggaggaggaggaggaa

SEQ ID NO: 169662 - RNA, 44 nt, Homo sapiens
ccaggggcagguuuucagacccugaccucauccacagcccaaaa

SEQ ID NO: 169663 - RNA, 41 nt, Homo sapiens
gaaccccgcguggacucuguggcugccuagccacggaggca

SEQ ID NO: 169664 - RNA, 41 nt, Homo sapiens
gugcagcugcuggccguggcgggugccgagggcccggacga

SEQ ID NO: 169665 - RNA, 119 nt, Homo sapiens
gcagcaggagcaggaaggcuuuccggggccucaugguagcgggggcggagcgcggccuccuagcgucggcggccgcugagcgcaccgagaacucggggucuggccgacagcccgucgcu

SEQ ID NO: 169666 - RNA, 38 nt, Homo sapiens
auuuaaaugacagaaacaguucugaagaaaaagacaga

SEQ ID NO: 169667 - RNA, 54 nt, Homo sapiens
cuggacacagaaucugugugaugcuguaccccucaagcauuuaaauuaaugaaa

SEQ ID NO: 169668 - RNA, 46 nt, Homo sapiens
gagcaauuguacugggucaggagccacccuggcacaugagggguga

SEQ ID NO: 169669 - RNA, 53 nt, Homo sapiens
gcuuauucagccauuacugaauggugugguuguaguuuguaaacagggugauu

SEQ ID NO: 169670 - RNA, 770 nt, Homo sapiens
aaucagucaauuugaggcugggcgcgguggcucaucccagcacuuugggaggcugagaugggcagauaccugaggucaggaguuugagaccauccuggccaacgugaggaaacccugucucuacuaaaaauacaaaaauuagccgggugugguagcacaugccuauaauccuagccacucgggaggcugaggcuggagaauagcuugaacccaggaguuggagguugcagugagucgagaucaugccacugcaugccaggcugggcaacaagagcaaaacuccuucuaaaaaaaaaaaaaaaaggccuggcgagaugacucacaccuguaaucccagcauuuugggaggcugaggcagguggaucuccugaggucaggaguucaagaccagccuggccaacauggugaaaccccgucucuacuuaaaauacaaaaauuggccaggugugguggcucacaccuguaaacccagcacuuugggaggccgagaaaggcagaucacaaguucaggaguucaagacuggccuggccaacaaggcgaaaccccaucucuauuaaacauacaaaaauuagcugggcuugguggugggcgccuuuaaucccagcuacuugggaagcugaggcaggagaaucgcuugaacccgggagacagagguugcagugagcugagauugcgccacugcacuccagccugggcaacagagugagacuccgucuccaacaacgacaaaaaagaagaaucaccugguaggcuuuuaaaauuuugguga

SEQ ID NO: 169671 - RNA, 289 nt, Homo sapiens
gaguagaggaacuuguuugagaaaaaguccauuuguuucagaaauuaaaauaauucauaggcuggcugggcacagugguucacgccuguacucccagcacuuugggaggccgaggugggcagaucgccugaggucaggaguuugagacuagccuggccaacauggcaaaccccuggguggggggaggggggcggcggagguugcagugagcugagaucgugccauugcacuccagccugggcaacagagcgagagucugucucaaaaaauauauauauauucauucaga

SEQ ID NO: 169672 - RNA, 46 nt, Homo sapiens
gaaauaacagccaugaaacuagaggcagcaagagugagcuagaaag

SEQ ID NO: 169673 - RNA, 24 nt, Homo sapiens
ccaaguuaccucacuugcagaguu

SEQ ID NO: 169674 - RNA, 60 nt, Homo sapiens
ccucaagaaaagguaccagcuuuauuuaagggacucgugcuguauugcaugaguacuagg

SEQ ID NO: 169675 - RNA, 106 nt, Homo sapiens
cacucugucuucacacacuucaaauucugguuucaagccaaaauaugaccaauuaaugcuugcuaacuaggaaucauaaucucucuuuuuaccaaauuguaggaca

SEQ ID NO: 169676 - RNA, 43 nt, Homo sapiens
auccacagcugaagauggauagaugggaagaagugauaugaaa

SEQ ID NO: 169677 - RNA, 54 nt, Homo sapiens
gaacauaauacagaggaccaggcagggccagaggaaagugagauucccacagac

SEQ ID NO: 169678 - RNA, 55 nt, Homo sapiens
aaugagaauugucagaagaagaaaaacaagugcauacagacgaaccaaaauuaug

SEQ ID NO: 169679 - RNA, 43 nt, Homo sapiens
uugcaccuugauuuccccagugaaaagggagaagagccaaagu

SEQ ID NO: 169680 - RNA, 49 nt, Homo sapiens
caguccacacaagccucguugauauuaaaaaaaaaaaaaaaaaaggacc

SEQ ID NO: 169681 - RNA, 47 nt, Homo sapiens
uguagcaaaggagcagucauuucucacaggguuuauacacagaggcu

SEQ ID NO: 169682 - RNA, 36 nt, Homo sapiens
uuaagagauaagaaggcaauaagguguaaauuaggu

SEQ ID NO: 169683 - RNA, 45 nt, Homo sapiens
gugugggaucagcaggauuuggcagacagagauauucccacggau

SEQ ID NO: 169684 - RNA, 45 nt, Homo sapiens
aacagagucucucaucucagcacaugacauuuugucauggaucaa

SEQ ID NO: 169685 - RNA, 41 nt, Homo sapiens
aggucacuggagaaugauggcgucuguuucaccgagcagga

SEQ ID NO: 169686 - RNA, 87 nt, Homo sapiens
ggcucacacugugcuguuucccacccagagguccuuggccagacagagggagaagcggaguuggguacagagaugcugggugacuug

SEQ ID NO: 169687 - RNA, 62 nt, Homo sapiens
uuuucagcgugagaaaacagucuguauagagggguggguuccucugcguguugggggccugg

SEQ ID NO: 169688 - RNA, 686 nt, Homo sapiens
gcuagcaccagcauuuuaucuuuguuuuuuuuuuuuuuuuuuuuuuaauuuuuuuuuuuuuauugaucauucuuggguguuucucgcagagggggauuuggcagggucauaggacaauaguggagggaaguggggaaguggacacagcacauguuucagagagcacaggguuggggguaaggucaccgaucaacaggaacccaaggcagaagaauuuaucuuaguacagaacaaaaugaaaagucucccaugucuacuucuuucuacacagacacggcaaccauccgauuucucaaucuuuuccccaccuuuccccccuuucuauuccacaaaaccgccauugucaucccggcccguucucaaugagcuguuggguacaccucccagacgagaugguggcugggcagaggggcuccucacuuccuaguagggguggccgggcagaggcgccccucaccucccggacggggcggcuggccgggcggggggcugacccccccaccucccucccggacagggcggcuggccgggcggggggcugacccccccaccucccucccggacggggcggcuggccgggcagaggagcuccucacuucccaguagggguggccgggcagaggcgccccucaccucccggagcaccagcauuuuaucuuugauuaagccagaaggagagucuuuag

SEQ ID NO: 169689 - RNA, 41 nt, Homo sapiens
ccauucccggguggcacauuuguggcagggcauugcaggga

SEQ ID NO: 169690 - RNA, 50 nt, Homo sapiens
gacggugcugccuccucugagcuccacuucauuguaucagacagaggcca

SEQ ID NO: 169691 - RNA, 42 nt, Homo sapiens
gauccugcaguugcccccgggcagcaagggggaggcccccaa

SEQ ID NO: 169692 - RNA, 34 nt, Homo sapiens
ucauagaaggaguucugcaaauguguugugaagg

SEQ ID NO: 169693 - RNA, 79 nt, Homo sapiens
auucaaucacaugagacuccugaaucucagagcaggaagcauguggagaucauuucuucagcccucugucuucaggcag

SEQ ID NO: 169694 - RNA, 40 nt, Homo sapiens
aguucuguugggagucucuuuggugucauggucccaacug

SEQ ID NO: 169695 - RNA, 45 nt, Homo sapiens
aggccagcuggaacguccccaggcguucuguccuggaucaagcaa

SEQ ID NO: 169696 - RNA, 97 nt, Homo sapiens
acucuaccaggauaacuuguaacgaaacaagccacgccaaggggguuuccccagguggagacugggccguggguaccggcggcggagagcuggagag

SEQ ID NO: 169697 - RNA, 43 nt, Homo sapiens
aacaggaaacugugguaugaggaggccuuaggauggggccaug

SEQ ID NO: 169698 - RNA, 49 nt, Homo sapiens
caccuucuccaugaagcuacguagugugaggauauuccccucaucagau

SEQ ID NO: 169699 - RNA, 39 nt, Homo sapiens
gacuguggccaggguaggcgcuucugccaguggccuccc

SEQ ID NO: 169700 - RNA, 46 nt, Homo sapiens
acaaaggccugggcugaggaggcuguggaugaagggauucacugcu

SEQ ID NO: 169701 - RNA, 46 nt, Homo sapiens
ccaggaugcugccccugguuccccacaggacucccaaaauccaggu

SEQ ID NO: 169702 - RNA, 46 nt, Homo sapiens
uggggccucccacgcaggcgaagcgcaagggccuuacaggcaagau

SEQ ID NO: 169703 - RNA, 45 nt, Homo sapiens
ucaccagggcugccgccacugcugccagcaggggucccaccagga

SEQ ID NO: 169704 - RNA, 40 nt, Homo sapiens
caaagcgacaggcaggacucaaaggauccagucuggacuc

SEQ ID NO: 169705 - RNA, 42 nt, Homo sapiens
ugaguagcacagagaugucuagcauaugccaccugucuguaa

SEQ ID NO: 169706 - RNA, 48 nt, Homo sapiens
gacacugacuggaugacaguggcauacucccagaagggagacucggug

SEQ ID NO: 169707 - RNA, 49 nt, Homo sapiens
gcugccuggccgugaacggggaggguaggacgauggggagccuauggag

SEQ ID NO: 169708 - RNA, 37 nt, Homo sapiens
cgcacuugauucggcaccagcgcauccauacgggcga

SEQ ID NO: 169709 - RNA, 42 nt, Homo sapiens
ggugaagguggaggacgaagaucaggaggcagaagaggaggu

SEQ ID NO: 169710 - RNA, 40 nt, Homo sapiens
ccgggcucgggcgggcggagccugaggggcggggccgggg

SEQ ID NO: 169711 - RNA, 56 nt, Homo sapiens
gcagccuggagucugagagggggaggggagcgcugccgccgaggcggcccggagcg

SEQ ID NO: 169712 - RNA, 47 nt, Homo sapiens
cuggggacggggagggaagcgaagcuggagccugcuggggagacaga

SEQ ID NO: 169713 - RNA, 74 nt, Homo sapiens
agggucccgucgggaggaaaacuugggaggggugagaaguccgaggggagcagaaauagggagggggcgccgcg

SEQ ID NO: 169714 - RNA, 22 nt, Homo sapiens
ggggaggagagagggagugugg

SEQ ID NO: 169715 - RNA, 44 nt, Homo sapiens
gagggaagggcgggggcugggagggggucgggcgggaggcaggu

SEQ ID NO: 169716 - RNA, 47 nt, Homo sapiens
cacccuccccuccccuccccuccccucccccguccugagcucccacu

SEQ ID NO: 169717 - RNA, 39 nt, Homo sapiens
gcgcaccugcagcgcccgcugcucggcccugcauccugc

SEQ ID NO: 169718 - RNA, 27 nt, Homo sapiens
auggagccgggggagccuggacagagg

SEQ ID NO: 169719 - RNA, 63 nt, Homo sapiens
ugacuugggcuuuuggcugcaguggggguggauuucagagccucucauggcagcaucuaagug

SEQ ID NO: 169720 - RNA, 45 nt, Homo sapiens
ugcguggugccuccaggaccgcugcgggugguaaccaguggaaga

SEQ ID NO: 169721 - RNA, 39 nt, Homo sapiens
gggagggaguagcgguuggggagaaggcugagcggggaa

SEQ ID NO: 169722 - RNA, 25 nt, Homo sapiens
uuacagcgugcgucccugucgugca

SEQ ID NO: 169723 - RNA, 42 nt, Homo sapiens
gcccugcccugaguguggccgucgcuuucgccaugcccccuu

SEQ ID NO: 169724 - RNA, 46 nt, Homo sapiens
cccggcccgguggagaugccgucgaccgccccuuccagugugccug

SEQ ID NO: 169725 - RNA, 42 nt, Homo sapiens
cggccgccgcuuccggcacaaacccaaccugcugucucacag

SEQ ID NO: 169726 - RNA, 46 nt, Homo sapiens
ugccuagugcuggaguaggggacaaugggaauccuagaggggaugg

SEQ ID NO: 169727 - RNA, 42 nt, Homo sapiens
aagacccuccauccucugguauuaacgccuuaaugccccugu

SEQ ID NO: 169728 - RNA, 20 nt, Homo sapiens
ugcccccugcguaggcaccc

SEQ ID NO: 169729 - RNA, 77 nt, Homo sapiens
gaaccccaaugcucgcugcagagugacagacacauaguaggugaccaauaaaugugugauuaaacgagcggggauaa

SEQ ID NO: 169730 - RNA, 54 nt, Homo sapiens
gugcgaggacacggugaguucaagagccacgagaggauggggcgugucggggug

SEQ ID NO: 169731 - RNA, 47 nt, Homo sapiens
auucgugcugcccugguucacaguggcacguuugugugucuguggau

SEQ ID NO: 169732 - RNA, 28 nt, Homo sapiens
cauagcagucagguaugggcugcaggag

SEQ ID NO: 169733 - RNA, 25 nt, Homo sapiens
ugggcaugggcugggacuggagagg

SEQ ID NO: 169734 - RNA, 38 nt, Homo sapiens
cccagcaagugaggaccugcugggaccucagggcugag

SEQ ID NO: 169735 - RNA, 38 nt, Homo sapiens
gugcgauagacaaagcggccuuccaagacuuggugugg

SEQ ID NO: 169736 - RNA, 41 nt, Homo sapiens
cccacugcucgccuuuucucugcaccacaagcagguucugu

SEQ ID NO: 169737 - RNA, 324 nt, Homo sapiens
uuggcagaaggcuuauuuagcuuuuuuuugagacagagucucacucugucacaaucucggcucacugcaaccucugccuccugaguucaaacaauuuuccugucucagcuucccgaguagcugggauuacagacaugugccacuacacccagcuaaguuuuguauuuuuaguagagacgggguuuccccacgucggccaggcuugucucaaacuccugaccucaggugaucuacccaccucagccuuccaaagugcugggaauacaggcaugaaccaccgugcccagccuuauuuaacuuuuaaaaagauuuauuucuacuuga

SEQ ID NO: 169738 - RNA, 56 nt, Homo sapiens
gggcaaaacuacagagagaauuuaaaaaccagugguagccagggguugggggguag

SEQ ID NO: 169739 - RNA, 46 nt, Homo sapiens
auagggcauuauccugacuucuaacucguggguucauuuugccagu

SEQ ID NO: 169740 - RNA, 42 nt, Homo sapiens
gagagaggucacugcugcuccgcugggugggauggagagaag

SEQ ID NO: 169741 - RNA, 45 nt, Homo sapiens
aaggucaagcaggagaagccggagcggcugcugcagacgcuggcg

SEQ ID NO: 169742 - RNA, 42 nt, Homo sapiens
gggccggagaccgcggcccgggccccgggcuggccccaccag

SEQ ID NO: 169743 - RNA, 86 nt, Homo sapiens
agcagcgcagacuguagagcaaagagcugcggccggagaccggaggagcaggggcucagcugggcugugaguguggcaugggagga

SEQ ID NO: 169744 - RNA, 40 nt, Homo sapiens
ggagagacggggggccuuucggcgugcaggcggggccuca

SEQ ID NO: 169745 - RNA, 40 nt, Homo sapiens
gaaguggcccuuuggaaugcauggcucugugacggcuggg

SEQ ID NO: 169746 - RNA, 20 nt, Homo sapiens
ugguggggguggagugcgug

SEQ ID NO: 169747 - RNA, 44 nt, Homo sapiens
uuuuagucauucccuucucccagaccuaacgaauggugcgucag

SEQ ID NO: 169748 - RNA, 49 nt, Homo sapiens
caggcagcagggcaaggacuccucccaucuucacaccugaaccagucag

SEQ ID NO: 169749 - RNA, 47 nt, Homo sapiens
guucucucaacaucagcuuguguaaggaguggucauuuggggcuuag

SEQ ID NO: 169750 - RNA, 42 nt, Homo sapiens
ucaagcagccuccuuggagaaaaccugaaaauucaacuuguu

SEQ ID NO: 169751 - RNA, 83 nt, Homo sapiens
ggggugaguagaaggggagugaggagauuuguuugcauggagcccaugcaucucauauguaacaggacacacauggcugcaua

SEQ ID NO: 169752 - RNA, 45 nt, Homo sapiens
ccuaaguucuagagccuccugacgugagcauggcugagagugagg

SEQ ID NO: 169753 - RNA, 42 nt, Homo sapiens
ggagggccagagcuuccaugacuucauagcagaugcggaugu

SEQ ID NO: 169754 - RNA, 45 nt, Homo sapiens
aaaggagaaagaaauuaaauuacuaaaauuaaaauaugaugaaaa

SEQ ID NO: 169755 - RNA, 45 nt, Homo sapiens
uauacaccucgugcgccaugaaaggccuuucuuugugucgcuaug

SEQ ID NO: 169756 - RNA, 56 nt, Homo sapiens
uccccacauccgcaccugcuguucccacucugggguucucaaguccaugaacagau

SEQ ID NO: 169757 - RNA, 95 nt, Homo sapiens
cuacugggggagaauucagugcccccuucgcccucuagggagcagaccuccacugccauuguccugugagcugccaaagaccccacggggugccc

SEQ ID NO: 169758 - RNA, 45 nt, Homo sapiens
aguaggucuucgaaacuuguguggccagagcucccagccccuggu

SEQ ID NO: 169759 - RNA, 45 nt, Homo sapiens
ucacagcaauccgugcccuguuccuggcugucugugucuugaagg

SEQ ID NO: 169760 - RNA, 51 nt, Homo sapiens
cuucccuaccacuggguacagauggaugcggcgaagucaagagaaccaaug

SEQ ID NO: 169761 - RNA, 31 nt, Homo sapiens
gaauagcuucaucuggcaaacugaacccuuu

SEQ ID NO: 169762 - RNA, 42 nt, Homo sapiens
ggccucuaggccaucccagcccacccacgucaacguccacau

SEQ ID NO: 169763 - RNA, 43 nt, Homo sapiens
ugucuaacuccuguccuuucuaaccccaaggaggccagguggg

SEQ ID NO: 169764 - RNA, 28 nt, Homo sapiens
ugcucggccgcgggcucccggaggacug

SEQ ID NO: 169765 - RNA, 43 nt, Homo sapiens
aauucugucauauuucacuucuagccuuuuaguauggcaaauc

SEQ ID NO: 169766 - RNA, 54 nt, Homo sapiens
auuugauuuuuuuccccaauauuugauuuuuuaaaaauauacacauaggugcug

SEQ ID NO: 169767 - RNA, 83 nt, Homo sapiens
aaguaguaaaguauaacaggauuucuguauacugugcaaucaguucuuugaaaaaaaagucaaaagauagagaauacaagaaa

SEQ ID NO: 169768 - RNA, 66 nt, Homo sapiens
gcuuuagcuugucuuauaggaugcuuaguuugccacuacacuucagaccaaugggacagucauaga

SEQ ID NO: 169769 - RNA, 59 nt, Homo sapiens
auugaaugcauaauaaaugcuuugugcuucugacuaucaauaccuaaagaaagugcauc

SEQ ID NO: 169770 - RNA, 44 nt, Homo sapiens
acggcugguuuaaauggcuucaggagacuucaguuuuuuguuua

SEQ ID NO: 169771 - RNA, 44 nt, Homo sapiens
gaucagaauaauuaucacaggaacuuaaauguuaagccauuagc

SEQ ID NO: 169772 - RNA, 46 nt, Homo sapiens
gugagaauguauacuuuaugcucucugaaauguaugacacccagcu

SEQ ID NO: 169773 - RNA, 42 nt, Homo sapiens; identical to SEQ ID NO: 91113

SEQ ID NO: 169774 - RNA, 42 nt, Homo sapiens
agugaggauggugauuaucacuggaccaccagaggcucaguu

SEQ ID NO: 169775 - RNA, 33 nt, Homo sapiens
auuuccauugcccagaacuuggccagacgaagu

SEQ ID NO: 169776 - RNA, 26 nt, Homo sapiens
uuuccaaagcuucacacaacauuucu

SEQ ID NO: 169777 - RNA, 82 nt, Homo sapiens
aacuuaaauggaaggaauguguaacaagacuggguaacgcuaaugggccuuuuccaaccuaggucucauagacuuaaauuca

SEQ ID NO: 169778 - RNA, 44 nt, Homo sapiens
ccacgguuucccuuuggcuuguaaaauagauacuccuggguuuu

SEQ ID NO: 169779 - RNA, 45 nt, Homo sapiens
cagugaacuucugcuuuuauuuuaaauguauauugccugucaaga

SEQ ID NO: 169780 - RNA, 39 nt, Homo sapiens
uuuauuuuguaaagagguagguuauauaagaaauaaauc

SEQ ID NO: 169781 - RNA, 53 nt, Homo sapiens
uuaauauagaagaaauguuacaugaacuggauuugaaucacagcugaaccauu

SEQ ID NO: 169782 - RNA, 42 nt, Homo sapiens
gcacuauuacaguuaaaggcaauguugagacaugugccaaag

SEQ ID NO: 169783 - RNA, 50 nt, Homo sapiens
uuuaaaauauggacuugauugaacuauauguauccaguaaucguuaguug

SEQ ID NO: 169784 - RNA, 103 nt, Homo sapiens
ggggucucacaaugcugcugacaaguugaugcuggcuguuggcagaaggccucaguuccucccacaugggcuucuccacagagcugcuugaguguucucaaga

SEQ ID NO: 169785 - RNA, 45 nt, Homo sapiens
cauaaggaagcucaagauauaaaauugugaguaaagaagauuguc

SEQ ID NO: 169786 - RNA, 45 nt, Homo sapiens
auuucaguuagagaauuucaccuugaaaguagccuauaucccuga

SEQ ID NO: 169787 - RNA, 49 nt, Homo sapiens
uggggacuucuuucuuuuuguuuuucauuuuguugugcacuggggaguu

SEQ ID NO: 169788 - RNA, 30 nt, Homo sapiens
ccuugucuagugacuuuguuuacaaggaga

SEQ ID NO: 169789 - RNA, 45 nt, Homo sapiens
uuaaauuuuuuccacagcuagguaccaagauugauucugcaccua

SEQ ID NO: 169790 - RNA, 46 nt, Homo sapiens
gaguaagacaucaaagauccacugaaauccaucuauggggcuaugu

SEQ ID NO: 169791 - RNA, 124 nt, Homo sapiens
uuuaagauuuuauuuagguaugggaacuugugaaaguguuggaaauauagaguggaaagcuuuuuguuuuuuuucgugguuuuuuuuuuggccuuuaagacuguuuaaaagaaguauuuguggc

SEQ ID NO: 169792 - RNA, 45 nt, Homo sapiens
ugcuucccuuggcuaccagagacagcuuuguagcgcaugauggag

SEQ ID NO: 169793 - RNA, 116 nt, Homo sapiens
ugauuugcuuuuuucuuguagauaaccuuugguugaauugagacugaacaggacuuacccucuuaaaagaaaugcguguucaauuuuuccaugugacucagcacuagagaugugua

SEQ ID NO: 169794 - RNA, 44 nt, Homo sapiens
ucuuugaauauuguuuuuugaugccuuuuaaauuucaaaagagg

SEQ ID NO: 169795 - RNA, 49 nt, Homo sapiens
gucuaggcuggggcauagcagagggaaaaaaagaagcaaaucacuucag

SEQ ID NO: 169796 - RNA, 45 nt, Homo sapiens
agaaucacacaggugcugaaaggcgaaagaacaaagagaauccag

SEQ ID NO: 169797 - RNA, 62 nt, Homo sapiens
caaauaugggcacgcaagauaaaguuaauuaagcaagagcacauacugaaucguaagaugcu

SEQ ID NO: 169798 - RNA, 42 nt, Homo sapiens
acuucagauacgaaauaucccgccucauuuacagugggaggu

SEQ ID NO: 169799 - RNA, 43 nt, Homo sapiens
acuguucaacugcguguguuucugugguuguaauacugguggu

SEQ ID NO: 169800 - RNA, 41 nt, Homo sapiens
uaauuuuuaaguuauuuauguguguaaagccuucccaaguc

SEQ ID NO: 169801 - RNA, 368 nt, Homo sapiens
gcuagggagacagaaaagcauuaauuuacaauuuugaaagagaaaaauuaacuuuuuaaaaaaauuuucuugagacagaguuucacucuuguugcccaggcuggagugcaauggcaugaucuuggcugacugcagccucugccucccagguucaagugauucucaugccucagccucccgaguaggugggauuacaggcaugcaccaccacacccggcuaauuuuuuuguauuuuuaguagagacgggguuucuccuuguuggccaggcuggucucaaacucacgaccucaggugauccgcccgccucugccucccaaagugcugggauuaaaggcaugagccaccccgcccagccagaauaauuaac

SEQ ID NO: 169802 - RNA, 17 nt, Homo sapiens
aaggauugagauuagga

SEQ ID NO: 169803 - RNA, 43 nt, Homo sapiens
uaucuaggugcauggaucuuagaaucccuaaaauguguuuagu

SEQ ID NO: 169804 - RNA, 52 nt, Homo sapiens
ucugugugcacguacuacuaccuaaaguuggggacagcaguacagcacagug

SEQ ID NO: 169805 - RNA, 51 nt, Homo sapiens
agauauaucaauuuggagcucagggggagaugggacauagaagugacauuu

SEQ ID NO: 169806 - RNA, 47 nt, Homo sapiens
uguauagcuguaaggaacagccaacaggauuugcugauggauuagcu

SEQ ID NO: 169807 - RNA, 37 nt, Homo sapiens
aacuugauuaggaaauaguuuaaaguuauuguagaaa

SEQ ID NO: 169808 - RNA, 48 nt, Homo sapiens
uggucugaaauugcuguuuggcaaguauucaguauugguaaauaaaca

SEQ ID NO: 169809 - RNA, 41 nt, Homo sapiens
uaucagcuaaggcuuaaaaauaucuuuuggaauuacagaga

SEQ ID NO: 169810 - RNA, 22 nt, Homo sapiens
accuuggaaguaaggguaggug

SEQ ID NO: 169811 - RNA, 58 nt, Homo sapiens
gggcaucugaggcaggcacacccacaugugcagcagugaccuuuguacuugauauaca

SEQ ID NO: 169812 - RNA, 60 nt, Homo sapiens
aauuaaaaaaaaaaaaaaaaaaaagaggaaaaaaaauguccuuaauugcaaccauuccgu

SEQ ID NO: 169813 - RNA, 24 nt, Homo sapiens
uugggaucuggauuugccuauuga

SEQ ID NO: 169814 - RNA, 42 nt, Homo sapiens
uguauaugaucuacuucgagaucgucuccuaugagagugaga

SEQ ID NO: 169815 - RNA, 80 nt, Homo sapiens
uucagcucaauaccaaccuuucccauuuagcuaccuacaagucuuucacugcaucucagauacucuaaaccacucaacag

SEQ ID NO: 169816 - RNA, 26 nt, Homo sapiens
aauucaguaacaucuuaaaauuccaa

SEQ ID NO: 169817 - RNA, 57 nt, Homo sapiens
gcauuaacauuuuuugagcucaaaauccgaauuuuaguugaagcuguauugaggcaa

SEQ ID NO: 169818 - RNA, 58 nt, Homo sapiens
guauuucuccgaccccaaauauauuaauaaaaacuuuuuucugagcccucuucggugg

SEQ ID NO: 169819 - RNA, 53 nt, Homo sapiens
uuuaccguaaaaaccuguaaaggaguggucaguuuuuagaugaaaggucauag

SEQ ID NO: 169820 - RNA, 41 nt, Homo sapiens
ccgcucacugaaauagagagccaaggagacacaggccccag

SEQ ID NO: 169821 - RNA, 29 nt, Homo sapiens
cgagacccucuacgaugcucggggucgcc

SEQ ID NO: 169822 - RNA, 44 nt, Homo sapiens
ccucgaaguuguuuuccuccacaucacucaugucgacgaggcgc

SEQ ID NO: 169823 - RNA, 25 nt, Homo sapiens
uggcggcggcgaccgugacgagaag

SEQ ID NO: 169824 - RNA, 43 nt, Homo sapiens
ugguuacuuaaaggcucuaagcuugaguuuucucauccaucaa

SEQ ID NO: 169825 - RNA, 42 nt, Homo sapiens
uugaguuuacuguugcuuguauuuggacucauuuggggauug

SEQ ID NO: 169826 - RNA, 41 nt, Homo sapiens
cuauuaauguuaauuuuauucugauuuauuccccuagcgga

SEQ ID NO: 169827 - RNA, 46 nt, Homo sapiens
ccaccaaugguacuagugggaauuuggugccaguaaccacaaauaa

SEQ ID NO: 169828 - RNA, 59 nt, Homo sapiens
uaauuugguugaugugguaagcagauaggugaguuuuguauaaaucuuuuguguuugag

SEQ ID NO: 169829 - RNA, 45 nt, Homo sapiens
aguauuuauucucuauaguaacugcuuaagugcagcuagcuucua

SEQ ID NO: 169830 - RNA, 57 nt, Homo sapiens
gcuuuucagucaguugaauuuaaaaacugcuuuuugaccaguagaaaagaacccuug

SEQ ID NO: 169831 - RNA, 42 nt, Homo sapiens
guuggaagucacauagaagaugcaguaacauuuugggcccag

SEQ ID NO: 169832 - RNA, 54 nt, Homo sapiens
ggacugcuccugagagcucuaggcuuccucaacuuuucgaugguggccgauugu

SEQ ID NO: 169833 - RNA, 46 nt, Homo sapiens
aaguuugcccccaggccaguucaguuuuggggaaucuugacccaaa

SEQ ID NO: 169834 - RNA, 45 nt, Homo sapiens
cucaggcugaguauggcaguguggauauaggggaagaggugcuua

SEQ ID NO: 169835 - RNA, 41 nt, Homo sapiens
cauucuuggcaauagaaccuggacaacauuuaucaaacacg

SEQ ID NO: 169836 - RNA, 105 nt, Homo sapiens
caucauccucuucaucaucaucgucaucaucuucaucagcagcaaguuuuacuuuuuucuguggaaccuugcuaccaccuccaggggcagaccgcuuuccagaua

SEQ ID NO: 169837 - RNA, 46 nt, Homo sapiens
uuucaucauuauccaccuuaaagugaucaucuuugucggccuuuag

SEQ ID NO: 169838 - RNA, 46 nt, Homo sapiens
gacauugaaaagcuuaaaagcucuacucagauggaaauugguugaa

SEQ ID NO: 169839 - RNA, 31 nt, Homo sapiens
aaaaucagugauuauguaucuuacuggauau

SEQ ID NO: 169840 - RNA, 56 nt, Homo sapiens
aaauauaagacccagggucuguugguagccagaagaauggaugcauuucaacagca

SEQ ID NO: 169841 - RNA, 32 nt, Homo sapiens
aaagacuuuuuuuuuuccagauauggaaaacg

SEQ ID NO: 169842 - RNA, 67 nt, Homo sapiens
gauauacacaaauuuuaaaauuaugugugaucacaagacuaaagauaauuaaaaagaaaaccacaga

SEQ ID NO: 169843 - RNA, 28 nt, Homo sapiens
aacuguguauuugauugggaauggugcu

SEQ ID NO: 169844 - RNA, 46 nt, Homo sapiens
uugugaaaaguugaacauuacuaacgaagucuaaucauaucuuuaa

SEQ ID NO: 169845 - RNA, 49 nt, Homo sapiens
auauuuuguugggcaguccugauuuaaaacuaagacuggcuugugguua

SEQ ID NO: 169846 - RNA, 52 nt, Homo sapiens
guacaucccuggaacaaaaaugaucuuugucggcauuaagaagaaggaagaa

SEQ ID NO: 169847 - RNA, 85 nt, Homo sapiens
auuaugaaguguucccagugccacaccguugaaaagggaggcaagcacaagacugggccaaaucuccauggucucuuugggcgga

SEQ ID NO: 169848 - RNA, 51 nt, Homo sapiens
cuuuaacguuccuucacguauacacacaaaaauacguuuuugaggagguac

SEQ ID NO: 169849 - RNA, 53 nt, Homo sapiens
uccccgggggaccgugcagccugccccugagcucccauucacaaguucgagug

SEQ ID NO: 169850 - RNA, 69 nt, Homo sapiens
uagaaggaguuucaucaaucaccuugaaaccgaccuggacgggugaccucguggucgccccaggagauc

SEQ ID NO: 169851 - RNA, 48 nt, Homo sapiens
aaaaaugauauguuaagcacccaaaucuucacauggagggggaggggg

SEQ ID NO: 169852 - RNA, 28 nt, Homo sapiens
cauguuccugcuaccaccaaaguuucca

SEQ ID NO: 169853 - RNA, 46 nt, Homo sapiens
ccauuauagccauccccaaauccacguccacugccauauccaucug

SEQ ID NO: 169854 - RNA, 46 nt, Homo sapiens; identical to SEQ ID NO: 91281

SEQ ID NO: 169855 - RNA, 42 nt, Homo sapiens
auuuuauaaacgugcuuagggucaaagaaaauaaccagguag

SEQ ID NO: 169856 - RNA, 46 nt, Homo sapiens
gcccgauuucccgcagccgagcgagaugagagagaucuccgcggac

SEQ ID NO: 169857 - RNA, 65 nt, Homo sapiens
aagaaaaaaaagaaccgugguggggcggggggcggcgggcggugaaugggaacaacgaccgcaaa

SEQ ID NO: 169858 - RNA, 30 nt, Homo sapiens
ugaaacuugcuuuuaauaagacaguccucc

SEQ ID NO: 169859 - RNA, 91 nt, Homo sapiens
ggaguugcuaucauuuaagggguaggagaagccauagaaauaaacaaacuuguucaucuagagcuucuggaaugagaagagaaagcucuaa

SEQ ID NO: 169860 - RNA, 46 nt, Homo sapiens
ucaccaaucaguuacugauggccaauuuggcuuguggguuuuagaa

SEQ ID NO: 169861 - RNA, 63 nt, Homo sapiens
ggaagguucuauuucuuuuccaauuuugugaucaaggaacaagguuccuuuuucuagggggga

SEQ ID NO: 169862 - RNA, 44 nt, Homo sapiens
ucauaguuuugauauggauucaugguuucauacuguugauaaau

SEQ ID NO: 169863 - RNA, 43 nt, Homo sapiens
auuaaccacagguaaacuucuuucaacagacugcuaccaauuc

SEQ ID NO: 169864 - RNA, 45 nt, Homo sapiens
cuauguaauuugauguaugggggucauuuggcucccgacgaggga

SEQ ID NO: 169865 - RNA, 32 nt, Homo sapiens
agacacccagcaccacccucccagacccgcaa

SEQ ID NO: 169866 - RNA, 51 nt, Homo sapiens
gccgcggacaaggccgacgaggaggacgaugaugaagaagaggaagacgag

SEQ ID NO: 169867 - RNA, 45 nt, Homo sapiens
uggaagaaagagcauaaggacgaagguccgacugccgccgcagcu

SEQ ID NO: 169868 - RNA, 28 nt, Homo sapiens
cuugcuccuuugcucccaacucacagag

SEQ ID NO: 169869 - RNA, 46 nt, Homo sapiens; identical to SEQ ID NO: 91298

SEQ ID NO: 169870 - RNA, 53 nt, Homo sapiens
agggcucacuagcaggagucggcgggggggcgggguggggggugcugcguggg

SEQ ID NO: 169871 - RNA, 45 nt, Homo sapiens
cugagcaguaaaagguggccgggcuuccagcgcagccgggcaguu

SEQ ID NO: 169872 - RNA, 52 nt, Homo sapiens
uccaggcccagccucucccagacccuaggcggggaacacgcuucggccuccu

SEQ ID NO: 169873 - RNA, 38 nt, Homo sapiens
uaaaguagcuguaagaauuucccagugaaauaaaaaaa

SEQ ID NO: 169874 - RNA, 42 nt, Homo sapiens
gauagaauucaauuugaacucagguuguuuaugaggggaaaa

SEQ ID NO: 169875 - RNA, 49 nt, Homo sapiens
aauuucauucuauacagcguuuugagagugggaggaaggagaaggggga

SEQ ID NO: 169876 - RNA, 29 nt, Homo sapiens
cguagagggacagguugggaaagaaagac

SEQ ID NO: 169877 - RNA, 45 nt, Homo sapiens
auuugaucuuuuaaucgucguuggccacaauuaaaacaaacccca

SEQ ID NO: 169878 - RNA, 79 nt, Homo sapiens
gaagcugguauaaaacuccuucaaacugacccuuuuugagcuccaagcaagugugcuggggccaggugggugggcugag

SEQ ID NO: 169879 - RNA, 48 nt, Homo sapiens
ggcaguagcuuucaccgcgcuauuuugggcagggguucagccuccccg

SEQ ID NO: 169880 - RNA, 67 nt, Homo sapiens
ggcucccugggucuccagcggccggacggaucuugguugcaagagggagaaagaaaggccgggugcc

SEQ ID NO: 169881 - RNA, 26 nt, Homo sapiens
acagagggaaacucccuuccgggcua

SEQ ID NO: 169882 - RNA, 46 nt, Homo sapiens
cgccuccccagccuggaccccgcauaccuugauggugguuuccggc

SEQ ID NO: 169883 - RNA, 47 nt, Homo sapiens
uauuuuuuucuuucuuguucauucuuacuacguauuuuuugacuuaa

SEQ ID NO: 169884 - RNA, 50 nt, Homo sapiens
gacucccaugaugcaucguuuaucugucaguauuucuuucugaaauauau

SEQ ID NO: 169885 - RNA, 45 nt, Homo sapiens
gcagacuugcuucauaagcaagauugucuaauaaagauuuaauaa

SEQ ID NO: 169886 - RNA, 42 nt, Homo sapiens
ucucauuuauaaaaugacaaaagugauuacaucuauccacug

SEQ ID NO: 169887 - RNA, 31 nt, Homo sapiens
agacccuaaaaaugaaugcuucugcuauugu

SEQ ID NO: 169888 - RNA, 42 nt, Homo sapiens
aggagcugcacgaucugggaaccucacguuuauggugggagg

SEQ ID NO: 169889 - RNA, 102 nt, Homo sapiens
augucaacuauaaguagguguggaagggaagaaagaaggcaguuuagcaaauggaguccucuaugauacuuuuuuuuuuuuuuaagagagagagaggcugac

SEQ ID NO: 169890 - RNA, 74 nt, Homo sapiens
cguugaaucuuuacacauagcacagagaucuagcaaguuguuaaaggcacugaauaaauauuugcugaugauau

SEQ ID NO: 169891 - RNA, 23 nt, Homo sapiens
uuuauucuuaauacugauuuugu

SEQ ID NO: 169892 - RNA, 52 nt, Homo sapiens
uuuuacuucuuuuauagguauaaggcuaagauuagccugaaaaggguauaaa

SEQ ID NO: 169893 - RNA, 52 nt, Homo sapiens
ugagccuguuuucauucuuauaucaaauaaaacugcccaaagauuaggagac

SEQ ID NO: 169894 - RNA, 74 nt, Homo sapiens
gcauugagugguaguuuuuguugcaaggguuagaugaggagaccagagaaguaauuaggauucacugacaagga

SEQ ID NO: 169895 - RNA, 47 nt, Homo sapiens
agcuuugagaucuugcugggaggaaaugaucccaaacaugccccuga

SEQ ID NO: 169896 - RNA, 46 nt, Homo sapiens
uuagaauaaaagaaaaccauuucaucucugauuugcccucccuuua

SEQ ID NO: 169897 - RNA, 43 nt, Homo sapiens
ggggcuaccaagaauggcagaguggaccauacucaacucauug

SEQ ID NO: 169898 - RNA, 121 nt, Homo sapiens
gaauuagcugauagauaguugaaauuuugacucuagacuuggaacugacaaguugagucuugucuuuguacucaguguucuacugaaacaaguuguauguagucaggagguggguuguauu

SEQ ID NO: 169899 - RNA, 45 nt, Homo sapiens
cuuuacauagccaucuacugcuucuggcaauaugguagacuaggu

SEQ ID NO: 169900 - RNA, 32 nt, Homo sapiens
aauuaaccuuguuaccgccuccacauccacac

SEQ ID NO: 169901 - RNA, 348 nt, Homo sapiens
aagauuuguauucauuuuaagagagaaaugaugcuuggccaggcacaguggcucaugccgguaaucccagcacuuugggaggccgaggucggcagaucaccugaggucaggaguucaagaccagcauggccaacauggagaaaccccaucuccacuaaaaauaaaaaauaagucaggugugguggcgcaugccuguaaucccagcuaccugggaggaugagguaggagaauugcuugaacccgggaggcggagguuguggugagccgaaaucaugccacugcccuucagccugggcaacaagagcgaaacuccaucucaaaaaaaaaaaaaagagagaaaugaugcuu

SEQ ID NO: 169902 - RNA, 45 nt, Homo sapiens
uuuauuucaaagaauaacaagacaucuuauagaaagaaaaaagug

SEQ ID NO: 169903 - RNA, 38 nt, Homo sapiens
uuucucuuugaaucgucuuacaaaugcuuuuuacuuuu

SEQ ID NO: 169904 - RNA, 46 nt, Homo sapiens
uuggaaauuuggggccuacucuuuuugcuuuguaaaauggacaguu

SEQ ID NO: 169905 - RNA, 49 nt, Homo sapiens
gauguuuugaucguacccauuuaccuaauugaauuuauauggugccuca

SEQ ID NO: 169906 - RNA, 46 nt, Homo sapiens
gauguugccagucuuuucaucaaaguuuuuacuuccaccaacaaug

SEQ ID NO: 169907 - RNA, 72 nt, Homo sapiens
ugcuacgcugucucuuuuuaaaaucuuucucuauguacuuuuauuccugccuuaauuuuuauuuucuuugcu

SEQ ID NO: 169908 - RNA, 46 nt, Homo sapiens
ugucuuugacuaugauuauggcaucugagauacaggaugcaaagga

SEQ ID NO: 169909 - RNA, 29 nt, Homo sapiens
uuggaggaaaguagugaacuaugaucaaa

SEQ ID NO: 169910 - RNA, 42 nt, Homo sapiens
uuaguuuugucuaaaauaaaacaaaugguagaaauagucaaa

SEQ ID NO: 169911 - RNA, 46 nt, Homo sapiens
uuuguugguauuuguagguuccuaaucuucuaagagucuugggaug

SEQ ID NO: 169912 - RNA, 44 nt, Homo sapiens
ugugauuauaagacaauauauacaauuauaaaggaccaacaaac

SEQ ID NO: 169913 - RNA, 30 nt, Homo sapiens
auaugggaaaaccauagcaauaaaggugaa

SEQ ID NO: 169914 - RNA, 47 nt, Homo sapiens
cuuacugggauaaaguuccaagggaauaaggauuauugcuagccaga

SEQ ID NO: 169915 - RNA, 56 nt, Homo sapiens
uaaauuguuucuagaaaugcuuacuagauagguugcugugaaaggaaagguuucga

SEQ ID NO: 169916 - RNA, 46 nt, Homo sapiens
aaaaaaacaaugaaauugugcccaaccugaguuagccugguaaaau

SEQ ID NO: 169917 - RNA, 42 nt, Homo sapiens
aaaaauaaagaaugaaaacaacaaaaccuaacauaaaaucuu

SEQ ID NO: 169918 - RNA, 31 nt, Homo sapiens
auaaaaauucucacaaauauuucaaaucccc

SEQ ID NO: 169919 - RNA, 46 nt, Homo sapiens
uaccuagggagauuuuaaaaaaucaaacuuaguaugaggccagaau

SEQ ID NO: 169920 - RNA, 47 nt, Homo sapiens
aagaaguccgauuuucuugagguuugauaauguuaacagaugaaaag

SEQ ID NO: 169921 - RNA, 56 nt, Homo sapiens
uauguauuauaugucuucauuuuguuuuguuugugaucccuggauagcauuggcag

SEQ ID NO: 169922 - RNA, 42 nt, Homo sapiens
auuugaaugaaaagguuuagagaagaguguuucacugaaagg

SEQ ID NO: 169923 - RNA, 49 nt, Homo sapiens
caaggacaacuguguuaugcuuauguuugugccugucucuucuacuaga

SEQ ID NO: 169924 - RNA, 48 nt, Homo sapiens
auugagauccaccugacuagugcuguuucaucaaauaagccuccagag

SEQ ID NO: 169925 - RNA, 57 nt, Homo sapiens
auuagguuagguccauccuggaauguuuguuaacuggcucuaaggggcauuuguucu

SEQ ID NO: 169926 - RNA, 47 nt, Homo sapiens
aucaguuuuccagcuaaaucuaauguucuucccacacuaugucacac

SEQ ID NO: 169927 - RNA, 26 nt, Homo sapiens
aacaugguauguuacaaacuguucca

SEQ ID NO: 169928 - RNA, 46 nt, Homo sapiens
cuauugauccugcaguuucaaaagaauuggccaaagaaguugagaa

SEQ ID NO: 169929 - RNA, 37 nt, Homo sapiens
aaguuauguccuguggguuaguacguuuguaguaaga

SEQ ID NO: 169930 - RNA, 93 nt, Homo sapiens
aauuagagacuguuaggauguaccaaauacacacacacacacacacacacacaugcacagagagagagagaaagagagagaguguguguuauu

SEQ ID NO: 169931 - RNA, 109 nt, Homo sapiens
uuaagaugagaucaucguggauuuaggguggacccuaaagcuaaugacaaguguccuuaccagagacagaaaagaagacacagagacacagaggggaaggccauaugaa

SEQ ID NO: 169932 - RNA, 48 nt, Homo sapiens
cggauagaauguccaaacaaaauguguuauauccauacaaugaugauu

SEQ ID NO: 169933 - RNA, 45 nt, Homo sapiens
aguagccuuguuggagagauuugaucagucguauaguagagaauc

SEQ ID NO: 169934 - RNA, 26 nt, Homo sapiens
gaguuguaaaccuaauucaguguuaa

SEQ ID NO: 169935 - RNA, 48 nt, Homo sapiens
uguugcacagaaaugacacccacauuuaauggaaguguuagagucagu

SEQ ID NO: 169936 - RNA, 47 nt, Homo sapiens
uaaugccacauuuucuuucuggcuauuauugcuaguuuguuuaugag

SEQ ID NO: 169937 - RNA, 50 nt, Homo sapiens
accaugaauucucauuuuucaucagcauuguguuuuuaucuuuaacuguc

SEQ ID NO: 169938 - RNA, 43 nt, Homo sapiens
guuuucuacaaugaaaaugcauuacuuugaauagaaaagaagc

SEQ ID NO: 169939 - RNA, 42 nt, Homo sapiens
gcaagagaccagaugucugauacagaaccacaguaacaagau

SEQ ID NO: 169940 - RNA, 58 nt, Homo sapiens
aauucuuaacagcuucccauucucccccucagugaaaccucugaauuuccuuucuggc

SEQ ID NO: 169941 - RNA, 46 nt, Homo sapiens
uuagaagaagauaaaaauguccucuacccuaauaugugugggccaa

SEQ ID NO: 169942 - RNA, 47 nt, Homo sapiens
acacacauaaagaaauucuagaggcauuggaacuuggggaaguguag

SEQ ID NO: 169943 - RNA, 36 nt, Homo sapiens
cuauauuguaauuuaauaagaguaaaaaaugacaag

SEQ ID NO: 169944 - RNA, 54 nt, Homo sapiens
cuuuucugguugcauacaggauugagauuacuuggggcgauguaggggcagggc

SEQ ID NO: 169945 - RNA, 45 nt, Homo sapiens
acauaggaaggaaauguuaauugacccauagccaguaaaauacug

SEQ ID NO: 169946 - RNA, 49 nt, Homo sapiens
guuucuguuucuuaguguuuguuacuaggagccagcagguuuauauugg

SEQ ID NO: 169947 - RNA, 40 nt, Homo sapiens
gcuugggauaaugguguaaaucaauaaaucuaacuguaau

SEQ ID NO: 169948 - RNA, 29 nt, Homo sapiens
uguuggaacagguagaagagucauucaga

SEQ ID NO: 169949 - RNA, 89 nt, Homo sapiens
auaccuaucuuaguuuaaaggacaaacucaagaaggcacaacaugaaagagaacaacuugaaugucaguugaagacagagaaggaugaa

SEQ ID NO: 169950 - RNA, 53 nt, Homo sapiens
uauugccuguugcuucaaaagaaaugaccccagaacuuaggggcuguagguca

SEQ ID NO: 169951 - RNA, 23 nt, Homo sapiens
aaccugggucuccuaaauccuag

SEQ ID NO: 169952 - RNA, 60 nt, Homo sapiens
uccagacuuuaaaaaauuuagaugggaacaaagaaagcgugauuacucauuucaaagaag

SEQ ID NO: 169953 - RNA, 34 nt, Homo sapiens
auauacguauauuuauauuuuaacacaaauuaga

SEQ ID NO: 169954 - RNA, 46 nt, Homo sapiens
aaagaacucagugaugcugucaacguacgagacagaacgauggcag

SEQ ID NO: 169955 - RNA, 42 nt, Homo sapiens
aaaggcuccaaaaacaaauaaacaaacuuucagaucaaucag

SEQ ID NO: 169956 - RNA, 54 nt, Homo sapiens
ugcauaugauacuuuccugguccuacuuuuuuaaaucagaggagacaagcaagg

SEQ ID NO: 169957 - RNA, 29 nt, Homo sapiens
uuugaguacguuauaacuuuguaguagau

SEQ ID NO: 169958 - RNA, 46 nt, Homo sapiens
auaggcuaauaauaauaaugucuucacaaagaaaacggggaaucag

SEQ ID NO: 169959 - RNA, 46 nt, Homo sapiens
augagaaagcaaaaugcaauaaauaugcugaugaacuugcaaaaau

SEQ ID NO: 169960 - RNA, 58 nt, Homo sapiens
aaauggaaagaacaagugaaaauugcugaaaauguaaaacuugaacuagcugaaguac

SEQ ID NO: 169961 - RNA, 45 nt, Homo sapiens
agauuugguaaugagauggaggacucuuaauaugcacaccucgag

SEQ ID NO: 169962 - RNA, 31 nt, Homo sapiens
gaugagaaugugccuacugcuccugauccuc

SEQ ID NO: 169963 - RNA, 40 nt, Homo sapiens
uuguauuuauccuuacagucuuacaaaaggcauuuucugu

SEQ ID NO: 169964 - RNA, 40 nt, Homo sapiens
ucuaauuguaaaauugaauuuagaggcucuauaaaugggu

SEQ ID NO: 169965 - RNA, 46 nt, Homo sapiens
uccccucugugaguuaauguuuccuccuaacuaugaucagagcaaa

SEQ ID NO: 169966 - RNA, 57 nt, Homo sapiens
agcaguaaaaaaaaaaaaaaaaaccacaccuaaaauagaccacugaggagaccauag

SEQ ID NO: 169967 - RNA, 40 nt, Homo sapiens
ggagcuacuuugaguuugguguuacuaggaucagggucag

SEQ ID NO: 169968 - RNA, 42 nt, Homo sapiens
augaaaugauagguuuuuaauuuucagaaauggagcugcaug

SEQ ID NO: 169969 - RNA, 45 nt, Homo sapiens
uauuuuaugacuguuuagcuguugaacuacugauccagccugcag

SEQ ID NO: 169970 - RNA, 48 nt, Homo sapiens
aaggaaggaggcggugaccauggaguuaggugagcugcucuacaacaa

SEQ ID NO: 169971 - RNA, 32 nt, Homo sapiens
cuugauauacucagacuuguuguagagcagcu

SEQ ID NO: 169972 - RNA, 46 nt, Homo sapiens
caacuuuucacaacacaauggaguccaucucuuauguuuuccagau

SEQ ID NO: 169973 - RNA, 43 nt, Homo sapiens
cuccauuguguugugaaaaguuguagugucauaaggccaccau

SEQ ID NO: 169974 - RNA, 46 nt, Homo sapiens
cacacacucuuccucaauaaagacaugguccccaauauguaaagga

SEQ ID NO: 169975 - RNA, 72 nt, Homo sapiens
uggggaccaugucuuuauugaggaagaguguguggucaacgcagcucagauugguucuugcauucauguugg

SEQ ID NO: 169976 - RNA, 24 nt, Homo sapiens
uucauggacagugcgggcggcggc

SEQ ID NO: 169977 - RNA, 42 nt, Homo sapiens
ggaggcccugcgcgagcugcgccuggaggguaaucggcugag

SEQ ID NO: 169978 - RNA, 35 nt, Homo sapiens
gaugcgcggcccgaggugcugcagguuguuggccg

SEQ ID NO: 169979 - RNA, 42 nt, Homo sapiens
aaacaguuuuauacagaaaugcaacaaguaguacccgggguc

SEQ ID NO: 169980 - RNA, 44 nt, Homo sapiens
agaccccggguacuacuuguugcauuucuguauaaaacuguuuc

SEQ ID NO: 169981 - RNA, 25 nt, Homo sapiens
cggggcggaaauucguucuucccac

SEQ ID NO: 169982 - RNA, 48 nt, Homo sapiens
caucuaaacauuuggacacaaguauaaaaugaaaacauaugcacaagu

SEQ ID NO: 169983 - RNA, 45 nt, Homo sapiens
auuacaucauauguagaccacuuucacugauuauauguugacauu

SEQ ID NO: 169984 - RNA, 48 nt, Homo sapiens
uuguuuaucuuugagucuucauucucugaagauggcuuucugccuguu

SEQ ID NO: 169985 - RNA, 47 nt, Homo sapiens
uucuuuguaauaaaauguaucaauauguuauagaugagguagaaagu

SEQ ID NO: 169986 - RNA, 44 nt, Homo sapiens
uuauaaauuuaaaauguugcaacugggaauauaccacgacauga

SEQ ID NO: 169987 - RNA, 55 nt, Homo sapiens
uugcuuuauucacacaauauauccuagaaauacauucuacauuaauccauagagu

SEQ ID NO: 169988 - RNA, 46 nt, Homo sapiens
uacccagauuuaguaaccaugguacucaugaagcguaguacaguga

SEQ ID NO: 169989 - RNA, 41 nt, Homo sapiens
cuggaaaucuuacuuuagugcuuuccaauuucuuccaaaau

SEQ ID NO: 169990 - RNA, 45 nt, Homo sapiens
guuaagguuauuagaccagaaaaaauguuaacuacagauuaagug

SEQ ID NO: 169991 - RNA, 43 nt, Homo sapiens
ccuggugugcacgcagaugacucugaaggugacaaagggaaag

SEQ ID NO: 169992 - RNA, 49 nt, Homo sapiens
aaggaaaagggagcuuuucuuuuugcagaaaccaaaguucuguucuccg

SEQ ID NO: 169993 - RNA, 39 nt, Homo sapiens
cuucaacauauaguccuaaauugcucuaaaaggagagua

SEQ ID NO: 169994 - RNA, 43 nt, Homo sapiens
ugcauuuggaaguaaauuuaccaccacgccuacucacaggccg

SEQ ID NO: 169995 - RNA, 41 nt, Homo sapiens
ggguccugugguccuuguagauucucacucaguuggcccaa

SEQ ID NO: 169996 - RNA, 57 nt, Homo sapiens
gagacucuccaggcuccccaguaaaaccuagcccuuugggcacuaauccauugaaag

SEQ ID NO: 169997 - RNA, 31 nt, Homo sapiens
ggccgcuuguuaaaucaugaaaacauccaga

SEQ ID NO: 169998 - RNA, 45 nt, Homo sapiens
aacauaaaauguauuuuaucaaaaaaguguuuagacuuugaccaa

SEQ ID NO: 169999 - RNA, 45 nt, Homo sapiens
ggggcauuugcccuuccagcuguaaacacugcccuucugugccug

SEQ ID NO: 170000 - RNA, 72 nt, Homo sapiens
guuauccaguagagagaaagugacagugaaaguaacgugagagagaaagaguguguguguauaugugagaga

SEQ ID NO: 170001 - RNA, 49 nt, Homo sapiens
cagaaaagaugacaagagcaaaggaugaugaguucacagcauuaauaga

SEQ ID NO: 170002 - RNA, 33 nt, Homo sapiens
cacuccgcaacacuuaguuucccagguuuacga

SEQ ID NO: 170003 - RNA, 46 nt, Homo sapiens
uaccgauggaugauuuucacugcaguuccaggcuaacguggcagag

SEQ ID NO: 170004 - RNA, 31 nt, Homo sapiens
auauagcguauugaguccagcauuugcaggg

SEQ ID NO: 170005 - RNA, 47 nt, Homo sapiens
uacgucuuucaccaugaagucagcaaauuugucuacauggccagagg

SEQ ID NO: 170006 - RNA, 46 nt, Homo sapiens
cauuauaguucacaaaaagauccgcaaguucuugcuguccauaguu

SEQ ID NO: 170007 - RNA, 56 nt, Homo sapiens
gaaagucuugaacauuaaguuaaaagacacuggaggggauagaucauuuccaguaa

SEQ ID NO: 170008 - RNA, 42 nt, Homo sapiens
ugaaauucaagaaaauccccugugcaguuucuggucucaagu

SEQ ID NO: 170009 - RNA, 45 nt, Homo sapiens
ugguuucccaaagagauuucucugaaugcaauuuaguagcuauuu

SEQ ID NO: 170010 - RNA, 45 nt, Homo sapiens
guccgcugaccugggcuuuugcugaauacaaauaaaggugaaggu

SEQ ID NO: 170011 - RNA, 41 nt, Homo sapiens
aagaucucuuuucuuuucccuuuguuccucugugacauaaa

SEQ ID NO: 170012 - RNA, 39 nt, Homo sapiens
auacaguacuuaccugcaaaaaaucuuaagaaauuaauc

SEQ ID NO: 170013 - RNA, 46 nt, Homo sapiens
ggccauguccaccugcugcugaauaaaaggcaugccuguuacagac

SEQ ID NO: 170014 - RNA, 58 nt, Homo sapiens
guccccagcagauggguuaccuaacuucccuuuuacauaacuagccgagucccuucca

SEQ ID NO: 170015 - RNA, 43 nt, Homo sapiens
accucucagagaucaaggggacagagaaaugggaugauggguu

SEQ ID NO: 170016 - RNA, 29 nt, Homo sapiens
uugguggguggguagauggauguauggau

SEQ ID NO: 170017 - RNA, 43 nt, Homo sapiens
ggauggauguauagauggguggguggguggaugaauggguggg

SEQ ID NO: 170018 - RNA, 51 nt, Homo sapiens
gggagggggacuccaugagggauagccucaaaaaucacacaccucuugguu

SEQ ID NO: 170019 - RNA, 46 nt, Homo sapiens
cuguauuuuaucuauucauuuagugaaaucacaccagaaggaagaa

SEQ ID NO: 170020 - RNA, 43 nt, Homo sapiens
uaauacaauggcucaaauucaaaaugcuuguuguugauaggaa

SEQ ID NO: 170021 - RNA, 45 nt, Homo sapiens
cuucaucacgaugugaauucuugauccuauacauuuguccacaag

SEQ ID NO: 170022 - RNA, 57 nt, Homo sapiens
cccgcuccuccccgccccacagagucgaucucuccucuccuagacccaccccgcucc

SEQ ID NO: 170023 - RNA, 60 nt, Homo sapiens
aaguccgcggcuuuccgcacacgguggggucgucagacccgcugcccuuggcggucgaag

SEQ ID NO: 170024 - RNA, 47 nt, Homo sapiens
guccaucauugucuccacuggcuuucuggguguccaccuauaauggg

SEQ ID NO: 170025 - RNA, 51 nt, Homo sapiens
uggaauauuauuuuauugagucaaagauuagcugacuuacagacagggcaa

SEQ ID NO: 170026 - RNA, 46 nt, Homo sapiens
aagaauacucacaacuacaggguguggaacagcaacaagcauccag

SEQ ID NO: 170027 - RNA, 52 nt, Homo sapiens
ggagcuuguaaaaaauguguugauguuugagccccacccaagacagaccaaa

SEQ ID NO: 170028 - RNA, 52 nt, Homo sapiens
acauuucuagcuaagaguuugacucuuaguggucacuuuacugacuuuccaa

SEQ ID NO: 170029 - RNA, 58 nt, Homo sapiens
guuuuucaaggaacacuggcuguuguauuguuggcaggggccccaaggcagcucgcac

SEQ ID NO: 170030 - RNA, 91 nt, Homo sapiens
cacuauccaggugacuuaaaagaguguuuggaaaaugucccugguauacuucaauuccuacuagacauuguaaugacaaugguguagguaa

SEQ ID NO: 170031 - RNA, 47 nt, Homo sapiens
gcauaugcaguuggcucacauaaccagcaugaacagucucuccccaa

SEQ ID NO: 170032 - RNA, 47 nt, Homo sapiens
agugagaaauuguugcauggcugaggaacaagaugcuuaaaaucuga

SEQ ID NO: 170033 - RNA, 49 nt, Homo sapiens
acacaugacuuccugcuuucauuaugaaggaggggaaacuaguucccuu

SEQ ID NO: 170034 - RNA, 23 nt, Homo sapiens
uuacaacuguucuacaaaacagg

SEQ ID NO: 170035 - RNA, 38 nt, Homo sapiens
ucuguggccuggcagagcagcacaaagacuggaagcag

SEQ ID NO: 170036 - RNA, 41 nt, Homo sapiens
aauuccucacaacugaagagaucagcaaaacucaacaaucg

SEQ ID NO: 170037 - RNA, 45 nt, Homo sapiens
ugccucgauaaaagaaaauaucauuuuggucagugcacagcguug

SEQ ID NO: 170038 - RNA, 54 nt, Homo sapiens
acacccuuuuaaaguucauuuuguauuuugaauucuuuuccuauuuucacugga

SEQ ID NO: 170039 - RNA, 28 nt, Homo sapiens
cuaagcccaagggaaaaaaagauguuaa

SEQ ID NO: 170040 - RNA, 53 nt, Homo sapiens
ccgccccucccuuacucuagcugcccccgcccuuuuccucugccggaugccac

SEQ ID NO: 170041 - RNA, 71 nt, Homo sapiens
ggccgccgcggcuacucggagugccccucugccgcgcacgcgccccucaagggcucucccaugaccuuucc

SEQ ID NO: 170042 - RNA, 49 nt, Homo sapiens
cgagaccaugucaaagaggcugaagcuccaccugggaggggaggcagaa

SEQ ID NO: 170043 - RNA, 37 nt, Homo sapiens
ccgccgucacggccguccccuguguggggagccaggu

SEQ ID NO: 170044 - RNA, 44 nt, Homo sapiens
ugugaaaagacauggcgagaagcggagucaagcacacaccacga

SEQ ID NO: 170045 - RNA, 55 nt, Homo sapiens
uacuugaaagaggccauggaguguagcgaugugauuuggcagcgagguuugcugc

SEQ ID NO: 170046 - RNA, 46 nt, Homo sapiens
uggcaacggcuauuccuuccugucccuuuaccgucucacgcaggau

SEQ ID NO: 170047 - RNA, 44 nt, Homo sapiens
ucuuuagaguccucagcaccuuucccacaugcuugcagccccug

SEQ ID NO: 170048 - RNA, 42 nt, Homo sapiens
ucucugauguccugggaccagagacaucacgguuuccagcau

SEQ ID NO: 170049 - RNA, 87 nt, Homo sapiens
aggugcaaaaagacaacuaaaauacccauuuggaccaaaagccaccagauugcuuagugccugacacagaaacaacugggaauccug

SEQ ID NO: 170050 - RNA, 33 nt, Homo sapiens
gcagacaccgucacaggccccucugguuagacu

SEQ ID NO: 170051 - RNA, 46 nt, Homo sapiens
aaauucagugacucaaacaugucuggagacaaaaacuccauugcag

SEQ ID NO: 170052 - RNA, 46 nt, Homo sapiens
ugggcacugcgaaugcaagacuggagaauuaacagccaccccucag

SEQ ID NO: 170053 - RNA, 59 nt, Homo sapiens
gcagcuggaagauggccgcacucuuucugacuacaacauccagaaagagucaacccugc

SEQ ID NO: 170054 - RNA, 52 nt, Homo sapiens
ugacugguguuucggagccucgucauauccgcuaacaggucaaaaugcagau

SEQ ID NO: 170055 - RNA, 52 nt, Homo sapiens
uugaccuguuagcggauaugacgaggcuccgaaacaccagucauguccagcc

SEQ ID NO: 170056 - RNA, 62 nt, Homo sapiens
gcgucaacuuccgggcggaugcccgccagcacggccuccgccgcuccccuucuuuggccccu

SEQ ID NO: 170057 - RNA, 100 nt, Homo sapiens
agcagggcaaacacuccugauucagauauaacugaaaaaacaggugaguuacaauguuaaaauugauguaacaucaaggacaguuuuuaaaagaugaaag

SEQ ID NO: 170058 - RNA, 46 nt, Homo sapiens
cggugugcccuuuuaaauacagcuuugggacugccauaagcaccau

SEQ ID NO: 170059 - RNA, 46 nt, Homo sapiens
uauugaucaucuacugugagcuagacauugagcaaggugccuaaag

SEQ ID NO: 170060 - RNA, 43 nt, Homo sapiens
uuuuaaccucaucagcagauugucagagacaaaaguauuugag

SEQ ID NO: 170061 - RNA, 47 nt, Homo sapiens
ugacuuuugggaguacagugaguuuggagggauugaaauaauggcag

SEQ ID NO: 170062 - RNA, 26 nt, Homo sapiens
ugagaauuuugauuuuuagauuggaa

SEQ ID NO: 170063 - RNA, 46 nt, Homo sapiens
agaaacuccagauaaugaaagaaaagcaaguauaucauauuucaaa

SEQ ID NO: 170064 - RNA, 34 nt, Homo sapiens
guguauaacugcuuuaugauuuauucuaaagucc

SEQ ID NO: 170065 - RNA, 38 nt, Homo sapiens
guucagugacuauauuaugccugguguuuuugaggaaa

SEQ ID NO: 170066 - RNA, 54 nt, Homo sapiens
uauugaacagagagguaaaauuaucugaguuagauguuuaaaaggucuuaauga

SEQ ID NO: 170067 - RNA, 53 nt, Homo sapiens
uagacgucuaaauggagaugucaaguagguauaauuagauuugggacauuuga

SEQ ID NO: 170068 - RNA, 52 nt, Homo sapiens
uggugaaagaagaugaguaaagaggaagugggcaugcaauaaaugcguguga

SEQ ID NO: 170069 - RNA, 25 nt, Homo sapiens
gagucccaaggccuuccuaccaugg

SEQ ID NO: 170070 - RNA, 46 nt, Homo sapiens
auggauggagcaauugcugcugccuugcugauguuuggugaugcag

SEQ ID NO: 170071 - RNA, 19 nt, Homo sapiens
uuccacuaaguggccugua

SEQ ID NO: 170072 - RNA, 51 nt, Homo sapiens
uaucaagauucuuuuuugucuucuauuuauuaauagcugugugaccuugag

SEQ ID NO: 170073 - RNA, 35 nt, Homo sapiens
auuaguccauaaacauuucauuaaaaacagguugu

SEQ ID NO: 170074 - RNA, 45 nt, Homo sapiens
aauuuaaugaugaucaaucuauaaaaaagacaagacuggaucaug

SEQ ID NO: 170075 - RNA, 56 nt, Homo sapiens
agugccaaauaugucuguuccaacuaugauucuggagauggaaaaauaagcacugg

SEQ ID NO: 170076 - RNA, 23 nt, Homo sapiens
uacuaaauauuugauuccgaaga

SEQ ID NO: 170077 - RNA, 43 nt, Homo sapiens
uacauucacaguguuguauaccaucauuccugucuaguuccaa

SEQ ID NO: 170078 - RNA, 32 nt, Homo sapiens
ucuuuuuuaugacuuagugauauuccauuuua

SEQ ID NO: 170079 - RNA, 53 nt, Homo sapiens
ggaaaguauuguacugaaauugcaaaaggaauuucccaauuuugauaaacagg

SEQ ID NO: 170080 - RNA, 89 nt, Homo sapiens
cuaaguguuuuuauuauaaaauaguguuaagaguucaaccacauaaaagcuuagggugaguuuuguauucuucuaauuaaauguucucc

SEQ ID NO: 170081 - RNA, 67 nt, Homo sapiens
auaaaaauugugaacucauuuauaacauguaagucaucuagaaagucaucuguaacccugcccccau

SEQ ID NO: 170082 - RNA, 46 nt, Homo sapiens
auggauguacacagaagcuuuagaaucucuaaaaguguuugcagaa

SEQ ID NO: 170083 - RNA, 71 nt, Homo sapiens
gucaaaauuacccuaaaaaugcaacuaaaacaaaacuaaaacagaaauuuucaaugaaagcacaaaauggc

SEQ ID NO: 170084 - RNA, 81 nt, Homo sapiens
uuuaacaagaaacguaaaaaaaauguuuuuaauccaaagagaguuguugaagacucugaauaugauucagguucugauguc

SEQ ID NO: 170085 - RNA, 61 nt, Homo sapiens
uugauuccucaguguucucagaaaaaggcucagaagauaacagaacuccggcccuuuaaua

SEQ ID NO: 170086 - RNA, 49 nt, Homo sapiens
cuuuauaaaauuuuuuaggaaguuuuauucccuaaguuagggagcaaag

SEQ ID NO: 170087 - RNA, 46 nt, Homo sapiens
uaauuuuauacuugaaacaaaucuaaaugagcauuaaaugcccuga

SEQ ID NO: 170088 - RNA, 53 nt, Homo sapiens
uauuaaauauauuaagaacaaccugcuaacaaauagucugcucuuucuugaaa

SEQ ID NO: 170089 - RNA, 44 nt, Homo sapiens
gaaaauuauauugugccuuuuaaaacaacauuugaaaaguugua

SEQ ID NO: 170090 - RNA, 47 nt, Homo sapiens
uuuuuuccauuuuacuuacaguuuuucugcauaauagcaguaaugua

SEQ ID NO: 170091 - RNA, 52 nt, Homo sapiens
uagaucuuuccccugaaaagcacaaaguagggggaguaggagaucauauugu

SEQ ID NO: 170092 - RNA, 39 nt, Homo sapiens
guauuuuccuaauagaugguuuuauuuuaguuuccuaga

SEQ ID NO: 170093 - RNA, 91 nt, Homo sapiens
ucugauauagcuuuuacauaugaaguauucagugccuccuuuugaaaaauaaauacaacuauauuuugaaagaaauucugugaguuuucac

SEQ ID NO: 170094 - RNA, 43 nt, Homo sapiens
uuuuaagauuaaucuuaauauguaauagucauaggaaaugaca

SEQ ID NO: 170095 - RNA, 69 nt, Homo sapiens
ugggauuaugcauuuuuugagguaagauauauuuuacuuuaacauaaugaguuugaugugugacaguag

SEQ ID NO: 170096 - RNA, 46 nt, Homo sapiens
agauuugauauggcacuguaaaacacugauccaagaaagagaugua

SEQ ID NO: 170097 - RNA, 45 nt, Homo sapiens
uuagggaauaauugaaaugaauuaugguauauccauacuuugcaa

SEQ ID NO: 170098 - RNA, 41 nt, Homo sapiens
aaaaaacaagaugauuacuggccuuuaauaguaagcuacaa

SEQ ID NO: 170099 - RNA, 92 nt, Homo sapiens
gacaacuguauuuaacuuuaucauguuuuauauagguagaagagaguguguguaagggugugugucggagggguguugugguuucuuaguuu

SEQ ID NO: 170100 - RNA, 64 nt, Homo sapiens
auagauaacugguuaagggaaguuaauuuauggugcccuacuuugaagguccucuguuacuaug

SEQ ID NO: 170101 - RNA, 42 nt, Homo sapiens
aaauagucauguguuuauuguuuuuaaauucuagguucucaa

SEQ ID NO: 170102 - RNA, 26 nt, Homo sapiens
uggauauuuaugcagcccccaaauuu

SEQ ID NO: 170103 - RNA, 46 nt, Homo sapiens
cgcuguugaauuuuguuaugccacacauguuuaguaguagcaccag

SEQ ID NO: 170104 - RNA, 48 nt, Homo sapiens
aauauaaugggaaagaaaauagcaauuucccuaaucaauggccagaag

SEQ ID NO: 170105 - RNA, 63 nt, Homo sapiens
gcaguugaggaaaauggccaaucauccuuuauuacaucgccaauauuacacagcugaaaaacu

SEQ ID NO: 170106 - RNA, 45 nt, Homo sapiens
aggaaccuacacauugugaggcuaacccugaccugaucuuugaag

SEQ ID NO: 170107 - RNA, 25 nt, Homo sapiens
agauagaugccauagaguaggccag

SEQ ID NO: 170108 - RNA, 50 nt, Homo sapiens
cucucacagugagguccuuuuccucuauaaacaaaaauguauauuuguaa

SEQ ID NO: 170109 - RNA, 85 nt, Homo sapiens
uaaagaccaugauuccucucaaauaugcuuaucagauuuuuguguuccuagagcuugccuuaguuguuaccagaguaccagcagc

SEQ ID NO: 170110 - RNA, 51 nt, Homo sapiens
ggcaccuaauaauacuugguuuaacaggcuauugaagugauucugauaaag

SEQ ID NO: 170111 - RNA, 248 nt, Homo sapiens
uuuaaaaauauauauauauuaccacaaucaugacuacauacuuuuugaauuuuuuuauuacagaaauagucauacaaaaaugaaagcaguggcugggcgugugguucaugcuuauaaugccagcacuuggggagacaggcgggaggaucguuugagcccaggaguucaaaaccagccugggcaacauagcaagacuccaucucuauuaaaauauauauauauuuuuuuaauuguugaaaguauaguau

SEQ ID NO: 170112 - RNA, 75 nt, Homo sapiens
ugguacaauaccauuguagcaucuaagaaaauaaacaguaauuuucagacauuaucauauauuauucauauccag

SEQ ID NO: 170113 - RNA, 46 nt, Homo sapiens
auuuggauuuuaugggcuauuuucaagucuguggaugagcuuggaa

SEQ ID NO: 170114 - RNA, 46 nt, Homo sapiens
cccuugaaagaugaguaagaauucaccaaagaaaaaaaauaauuga

SEQ ID NO: 170115 - RNA, 46 nt, Homo sapiens; identical to SEQ ID NO: 91677

SEQ ID NO: 170116 - RNA, 46 nt, Homo sapiens
aaugcuuuagaaaugucaguauuuuuguaauuauuucuaccuccaa

SEQ ID NO: 170117 - RNA, 46 nt, Homo sapiens
ucaaccugaauuuaaagguggcauuccauauacuaacaucccccag

SEQ ID NO: 170118 - RNA, 78 nt, Homo sapiens
gccuaaucuugugcauguuuucauugauuucccucucccggcuuuugcuucucuugaaacuguugcccagucacuucu

SEQ ID NO: 170119 - RNA, 92 nt, Homo sapiens
ucuccaugcaucagcaaaauguuggugacauuuuucuagccuggcagaacagauuacuuaaagcuauuucauuucaaagcagacugaaugug

SEQ ID NO: 170120 - RNA, 88 nt, Homo sapiens
acuucaucuaaaggcagcauuagguacugcauggaaauaggucauuaacuugaaacucuuaucaaaauauauuuuaccaguuuccaga

SEQ ID NO: 170121 - RNA, 49 nt, Homo sapiens
uauuuaacucuuuauuaaaucuuucuuuaaauuucugccugucagucua

SEQ ID NO: 170122 - RNA, 47 nt, Homo sapiens
uuuauuauguaaauaucauuauaaauaaacuuauuuauaaaucaaag

SEQ ID NO: 170123 - RNA, 46 nt, Homo sapiens
uccuguuuccccuccugagcggguggaggaggcccaagcgaugcug

SEQ ID NO: 170124 - RNA, 29 nt, Homo sapiens
aaaauucagucucagcagaauaaugccaa

SEQ ID NO: 170125 - RNA, 45 nt, Homo sapiens
cugccuuaauauauaccugcacugucuguaggacacgaaugccag

SEQ ID NO: 170126 - RNA, 58 nt, Homo sapiens
uaggccacugcaaagccuuugacuuuuacuuugcgugaaaugagagggcacugcagag

SEQ ID NO: 170127 - RNA, 44 nt, Homo sapiens
gugauagcaguuuagaccaagauaguggcuacuuugguagugug

SEQ ID NO: 170128 - RNA, 38 nt, Homo sapiens
uggcugcuucagccccagcuaucaugcucauauuccag

SEQ ID NO: 170129 - RNA, 46 nt, Homo sapiens
uuuaugaugaaucauaugaaaaacuuucauuuuguaggucaaaaau

SEQ ID NO: 170130 - RNA, 42 nt, Homo sapiens
cugcccaguugugcagcuggacaggggaagggacagauucug

SEQ ID NO: 170131 - RNA, 48 nt, Homo sapiens
guggguaaauuuagauugguuaugggagucauuucugcuaugccccau

SEQ ID NO: 170132 - RNA, 49 nt, Homo sapiens
augccagugguugugguggacaaggccaagagccccuggggagccauuu

SEQ ID NO: 170133 - RNA, 46 nt, Homo sapiens
cugguaggugugagccuuugugagcuugggacaggguaugaaggga

SEQ ID NO: 170134 - RNA, 67 nt, Homo sapiens
agguuuugagcuuggucucugaauagacugaguguugugggucuuuaauccuucuugaucaccucag

SEQ ID NO: 170135 - RNA, 68 nt, Homo sapiens
uauuuucuuagauauuucaaaccacaauucaaguacguuuucuccaggcacuggcucugugcuuccag

SEQ ID NO: 170136 - RNA, 45 nt, Homo sapiens
aggagugauuugaugguggcuuggaguugggcccuaacaguagau

SEQ ID NO: 170137 - RNA, 47 nt, Homo sapiens
cuuaguguagaccuugguggaaaaauaccaccuaugaagccuuauag

SEQ ID NO: 170138 - RNA, 65 nt, Homo sapiens
gacucaugaaaauugagcacauaucuugagcccacugucuguacaacuagagugaagggagggga

SEQ ID NO: 170139 - RNA, 45 nt, Homo sapiens
guaguguuaaguauauuuacauuguuaucaagcagaucuccagaa

SEQ ID NO: 170140 - RNA, 57 nt, Homo sapiens
uagaaacauauguuuugguuuuuuaaaauuuuauuuuauaagaggaacugauuuucu

SEQ ID NO: 170141 - RNA, 48 nt, Homo sapiens
uuuuggaaaugaaugcaguucauuuguauguccuuuauagugaucagu

SEQ ID NO: 170142 - RNA, 59 nt, Homo sapiens
uaugagaauuaccuuaguaacugggaaguauuugguugccuuaggugcauuuuuaugcu

SEQ ID NO: 170143 - RNA, 67 nt, Homo sapiens
gaaauaauuuugaccagaaaacaacuaucaacguaggauguuucugagaguucauugcaauugugag

SEQ ID NO: 170144 - RNA, 47 nt, Homo sapiens
ccaaaugaaauaguaggcuguauuucuacauguguuuaagagaagaa

SEQ ID NO: 170145 - RNA, 44 nt, Homo sapiens
aacucaggagccuuuaauguuucagguucgugggaguaagggag

SEQ ID NO: 170146 - RNA, 47 nt, Homo sapiens
uccaacuggcuucgcuucguucaugaggcaccaucucaggagcagaa

SEQ ID NO: 170147 - RNA, 40 nt, Homo sapiens
uuauuaaugacuuaacaagaggagugaggggggauuagaa

SEQ ID NO: 170148 - RNA, 42 nt, Homo sapiens
gacggaucuaguaagcaaacaguucuucccacaugcacacuu

SEQ ID NO: 170149 - RNA, 78 nt, Homo sapiens
uuauaacuaaccauguacaaaucacuuaucuauaaaauaaugguuaacaucuacuccuuaauucacaaauagaucaca

SEQ ID NO: 170150 - RNA, 62 nt, Homo sapiens
cuguaaaccaagacauucccacuauuuagacuagguuuuaacucaaagguuaagaacucaaa

SEQ ID NO: 170151 - RNA, 105 nt, Homo sapiens
uauuuaccaguugcauaccuuaauucugcagauggauaaucugguugagauaagcauugccaucucucaauuuuuacaaaacaaaaagcuaccaacaagaaguua

SEQ ID NO: 170152 - RNA, 41 nt, Homo sapiens
aggagaacaacaccaugaagaguugcaggauuuguaggaug

SEQ ID NO: 170153 - RNA, 46 nt, Homo sapiens
uuacuaucagaaacaaaugaaugguucagcauuuaaaaaaauuugu

SEQ ID NO: 170154 - RNA, 41 nt, Homo sapiens
agcuucugauuggcuaccuggauagugacauggaggcugag

SEQ ID NO: 170155 - RNA, 46 nt, Homo sapiens
aaucaacagcgggcagaaaagguauugcaucuuuaauuggugaucu

SEQ ID NO: 170156 - RNA, 46 nt, Homo sapiens
cugaucacagaagccuggaggauugcuagguugcccuagugugguu

SEQ ID NO: 170157 - RNA, 67 nt, Homo sapiens
uuaaguuuaaaaauaugccaacauuugacuugagaagauguuaaaugggaaaacauauaaaauugua

SEQ ID NO: 170158 - RNA, 46 nt, Homo sapiens
uauaugggaccguguagcauaauucacucuacuagcuuaaucagca

SEQ ID NO: 170159 - RNA, 40 nt, Homo sapiens
gugaagguaaaaaugagcuaaaaaugaccaauuucaggaa

SEQ ID NO: 170160 - RNA, 36 nt, Homo sapiens
ugaucugaaaaguuaacauuauaggaugaauuaaau

SEQ ID NO: 170161 - RNA, 52 nt, Homo sapiens
uaauguaaauugucccaucucaucaacauaucucuucucuuaugugcuccca

SEQ ID NO: 170162 - RNA, 48 nt, Homo sapiens
uaacacauuuugacauuggaauugaauauguauggauuaacaaaacaa

SEQ ID NO: 170163 - RNA, 46 nt, Homo sapiens
uuauucuuauauucaggagaagaugauaaucugcacccagcaucug

SEQ ID NO: 170164 - RNA, 47 nt, Homo sapiens
aguauucacuuuaauaauaauacaguuauagaggcuagcgugaacaa

SEQ ID NO: 170165 - RNA, 44 nt, Homo sapiens
uuuuucugaauucaguauacuggggucuucccuaugauugcaaa

SEQ ID NO: 170166 - RNA, 47 nt, Homo sapiens
caugucaguuuuaaagcuuaaguuugcugaacuaaguaaaaaaccag

SEQ ID NO: 170167 - RNA, 84 nt, Homo sapiens
ccuuuccuccaugggcugcacaggcauuggaggaaagaauauucccuauuggagauagcaagcaaagcagcucucauauacaug

SEQ ID NO: 170168 - RNA, 56 nt, Homo sapiens
guuguagaauccuuuauuauagaaaggcaaaggcacucaaagaaagagaucuuuga

SEQ ID NO: 170169 - RNA, 55 nt, Homo sapiens
agaagcugaauuuuucaauauggaucacauuuuuccauagcaaccauaacauggg

SEQ ID NO: 170170 - RNA, 43 nt, Homo sapiens
ugugucuucucagaggagcuaggauucuucuagggugaaaaag

SEQ ID NO: 170171 - RNA, 41 nt, Homo sapiens
uaguaggaccuggaaaagagggaauauucuuucugaauggu

SEQ ID NO: 170172 - RNA, 53 nt, Homo sapiens
uaguagccauguuacuuuucaaucacugagaagcauuuucuuggcuaucauau

SEQ ID NO: 170173 - RNA, 52 nt, Homo sapiens
gcccuuccuccauuucagccauaguccuucacuauucagccuuuccgaaucc

SEQ ID NO: 170174 - RNA, 47 nt, Homo sapiens
caauuuuuaucuuuauuauaaugccuuugacauacuuucggucacag

SEQ ID NO: 170175 - RNA, 51 nt, Homo sapiens
uuucuaccuuuuuaugauaaugcugucuacuuauuguuuuguagaaaaucu

SEQ ID NO: 170176 - RNA, 50 nt, Homo sapiens
uuagcagauaucaugcuguauuagugugcauguacauauaauuuguguau

SEQ ID NO: 170177 - RNA, 33 nt, Homo sapiens
ucuucuauaauaucacuccuuguuaagaguacu

SEQ ID NO: 170178 - RNA, 52 nt, Homo sapiens
gauaaguauugacaaaguuuggacaagguuuagacauacucaguauaggugg

SEQ ID NO: 170179 - RNA, 47 nt, Homo sapiens
ccacauagagacaggaagagcagcuuguggguuuagagaggaaggag

SEQ ID NO: 170180 - RNA, 29 nt, Homo sapiens
gggggcgggguagauguugcuugguggga

SEQ ID NO: 170181 - RNA, 48 nt, Homo sapiens
uuuuccugucuuuuauaaaucucugauuuacagugauuaugauggugc

SEQ ID NO: 170182 - RNA, 90 nt, Homo sapiens
ugaucuguuucugguuacuacugaugacaguagggucauuuuauuuuggagguaggagugguguuuugcagaggugugaaguauauaucu

SEQ ID NO: 170183 - RNA, 51 nt, Homo sapiens
aagaugcuaauuuucuaaguaaaaaaaaaaaacuucugcaguuaccuuugg

SEQ ID NO: 170184 - RNA, 53 nt, Homo sapiens
cugcuagcagugauauagacuagggaagaggcucagguaggaagcagagucac

SEQ ID NO: 170185 - RNA, 45 nt, Homo sapiens
uguaaagugagaauaaccauagcaaauuugcagcauugcuuaaca

SEQ ID NO: 170186 - RNA, 59 nt, Homo sapiens
agccagcagaaaguaggcaguuugugaacauaggcagcagugucggggugguagaguau

SEQ ID NO: 170187 - RNA, 48 nt, Homo sapiens
aauuucauauuuaagaaauucacaccaaaucugugccucauggauuuu

SEQ ID NO: 170188 - RNA, 39 nt, Homo sapiens
caauucaugauaaagacugggaaagagaaggaagaaaaa

SEQ ID NO: 170189 - RNA, 42 nt, Homo sapiens
auggacaauauccaugguguagcugacagcuaauaggggcug

SEQ ID NO: 170190 - RNA, 47 nt, Homo sapiens
acuugcggacaggcguccugggcacgaagagacuggacucggauucg

SEQ ID NO: 170191 - RNA, 56 nt, Homo sapiens
gguacuucguacaauuucagccacccaggccaguguccuccagcaaugguucccgu

SEQ ID NO: 170192 - RNA, 43 nt, Homo sapiens
cuuuucagggaucacuagcgacauggcggcagcacaagcggcg

SEQ ID NO: 170193 - RNA, 47 nt, Homo sapiens
cacguuccaccucaucaucagugaguucucccgcccucuuggugagg

SEQ ID NO: 170194 - RNA, 41 nt, Homo sapiens
ucugcacacuccuuugcuacugguccuguaauggcagaacc

SEQ ID NO: 170195 - RNA, 47 nt, Homo sapiens
uuugccuuucuugacuguggccaucaccgugucacccacaccagcag

SEQ ID NO: 170196 - RNA, 43 nt, Homo sapiens
gguuuuuggcuccuguguugucagcacaacugaucacacuccu

SEQ ID NO: 170197 - RNA, 27 nt, Homo sapiens
uuccacauaaaagaaaaaugaaauaga

SEQ ID NO: 170198 - RNA, 33 nt, Homo sapiens
accgagucccggcggcgacggcggggcagcgca

SEQ ID NO: 170199 - RNA, 42 nt, Homo sapiens
ccuugccagcgcuucgcagcucucgaaguaaauuaucgcagg

SEQ ID NO: 170200 - RNA, 46 nt, Homo sapiens
ugcuucucaaagccccuguagccacaguaguccucuagaugccauc

SEQ ID NO: 170201 - RNA, 46 nt, Homo sapiens
uaaaagaugcagaaacgugaaugccuuucacauuuaaccugguuaa

SEQ ID NO: 170202 - RNA, 35 nt, Homo sapiens
uuuuuaguuauuucaccagaaaacaaugcggaaga

SEQ ID NO: 170203 - RNA, 49 nt, Homo sapiens
aguuggcauucucuaaaauuucuaaacaggaagggcucauggcuggcag

SEQ ID NO: 170204 - RNA, 70 nt, Homo sapiens
uguuucuguaauguuuucuaaugauguuuuaaauuuuuacuuuuaaaggugggaaaagguucauugucag

SEQ ID NO: 170205 - RNA, 46 nt, Homo sapiens
cgagaggggcuuuggggauagguucuucaccaucuuaagugguucu

SEQ ID NO: 170206 - RNA, 78 nt, Homo sapiens
aucuggagcuuuggggacagaauuaugggauguuacaacagaaaggggccaucgucauuauggagccuaacuucuuuu

SEQ ID NO: 170207 - RNA, 46 nt, Homo sapiens
uuaaucacuggaacccauugauccauguagcgacuuucccggcaaa

SEQ ID NO: 170208 - RNA, 111 nt, Homo sapiens
ucuagucggacaaaggcagccacccuccugacccccaccuaccacagauccacaaucaggcaacccagcccugacucccguccuuccggggcucuacccugcaggcugcag

SEQ ID NO: 170209 - RNA, 51 nt, Homo sapiens
gcaggucgcccagggagagagcgcggcgugcgggcugcuccugccacggcu

SEQ ID NO: 170210 - RNA, 43 nt, Homo sapiens
gaaugcauuaagguaauguuuacguacuuuagaaucaauuaaa

SEQ ID NO: 170211 - RNA, 54 nt, Homo sapiens
uggcuucuucugaagagggcuucucagcuccagcagauggauggcccgugggaa

SEQ ID NO: 170212 - RNA, 48 nt, Homo sapiens
agagauagggacaagagugaggcccaucucacuaugguuauaaagaaa

SEQ ID NO: 170213 - RNA, 26 nt, Homo sapiens
auacuuuggaaccugaagaaaauuua

SEQ ID NO: 170214 - RNA, 25 nt, Homo sapiens
aggaaggccauguaagaagcuugug

SEQ ID NO: 170215 - RNA, 52 nt, Homo sapiens
augucucagagaaaaacuggaaccacuauggagaaguugcaaggaagaaagc

SEQ ID NO: 170216 - RNA, 75 nt, Homo sapiens
ggccacucuccuggggcccacaucccuccucaauauugaucaucugaagugcauucagaggugcacccaggaugg

SEQ ID NO: 170217 - RNA, 56 nt, Homo sapiens
agaacucauuaguucaacccccucauugagcagaugaggaccuuucugccccagag

SEQ ID NO: 170218 - RNA, 28 nt, Homo sapiens
aucuagaauaguaacaucaggcccuauc

SEQ ID NO: 170219 - RNA, 52 nt, Homo sapiens
auuauuuuuaaagcaaauaaucuauaaaugacaucuacuuaggccuccuuua

SEQ ID NO: 170220 - RNA, 47 nt, Homo sapiens
acuggcaaaaauugaacuaagauuuacuuuuuuuccguagcugggau

SEQ ID NO: 170221 - RNA, 55 nt, Homo sapiens
ucucagcgugggaccugggaacguguggaggagguucuguuuaaugacaucgaau

SEQ ID NO: 170222 - RNA, 36 nt, Homo sapiens
uugaaguagaaugcauuuccaagggucaauucccaa

SEQ ID NO: 170223 - RNA, 45 nt, Homo sapiens
uccacaguuuguuguguggauuuuaaucuagggacaguaggaagc

SEQ ID NO: 170224 - RNA, 88 nt, Homo sapiens
uacagagguggacaggacaaauagggcccugugaacauagagcuuauguuuuguaggagugacaaucaucagcaaacaaguaugcaag

SEQ ID NO: 170225 - RNA, 102 nt, Homo sapiens
ugacuaugcuguaccuggauggcuacgcugugcuguguagaaggaagaugggaagugaucaaaugucacugaaguagaagaugaagucaucaaagaugguug

SEQ ID NO: 170226 - RNA, 879 nt, Homo sapiens
ccuguuuguguucgccuuacucuucuuccuuacagggaaccaggccaggaaugacaaucauuuccaaggacugccucuccggaugcuugagaccuugaacaagaaugacuaaaaaauugaagggauuauaguaagcccugaguugaugaugaaaacagguaaacacuggcuucuugagcagccaauaagggaaaacacagguguacaucaucccaacccacccugcucggggagccucuauccccaccaacagcuuuagaggcccaccugcagaaaccagacagccagagcccugggacuauagugagguuaguguguaugauucccagggaguguggaaauuccucagcucuucuccaaccugcacagaacugguuuuacgcaucagaacucuguaucaucaccaagaagaccuggugagaucccagcuucaccucauauaagugaaccaaggagaguaaaacuaaccaaaugcaaguggaaggggagagggagaagaaaggguaggaggcagaggcaagaagaaaccuaaaucauaauagugguaguaguaagauuggcuaacauuuagugaacacuuacacugugccaagcauugugccuuacauucagcccuuacaaagagaccucaaacucugaucacugcuguggauacaacccuguguucuuagccaugaugccaaaaucugugccgggaaucaagucaagagaaggcuaauggcuuggagaugugaggaaaauggagcaauuggauugucugcuuucauggaggugggguaaaggaggcuuggaaaagauggggguuuugaagaacagagaaauuccaagcuggagaugguugaaugagagccccagauuaugaugaugaaggcuggaaua

SEQ ID NO: 170227 - RNA, 46 nt, Homo sapiens
aaguuaaaaauucuucacuauugggaucugagauauaucugaggcg

SEQ ID NO: 170228 - RNA, 101 nt, Homo sapiens
cauacccaaggcugggcucuauccaagaccaaugaaaccagaaccucuggccguggagcccuaacaggcugcuucugaguuccagcagagcaacacccacu

SEQ ID NO: 170229 - RNA, 46 nt, Homo sapiens
uuauucucagaugauucagaccugcuuucuuuaaaaugccucauau

SEQ ID NO: 170230 - RNA, 45 nt, Homo sapiens
gaacuuagaucuaugcagaccaaaaaccaaaaauagaaucaccau

SEQ ID NO: 170231 - RNA, 44 nt, Homo sapiens
gccuucauuaaugaauaccugccuuagcgagagcaccuggauug

SEQ ID NO: 170232 - RNA, 50 nt, Homo sapiens
gccccaaggaggcccugcgugcuuggggacaggcucuacuaagguuggac

SEQ ID NO: 170233 - RNA, 61 nt, Homo sapiens
uuauacaauaucaucugacagacaugauggaaaaggcauguuacuagagggcugggagaaa

SEQ ID NO: 170234 - RNA, 34 nt, Homo sapiens
acucaguauucaugagauuacuuucagucuuugg

SEQ ID NO: 170235 - RNA, 45 nt, Homo sapiens
guaucuuaguguuuuuugucucuuaguguacuuguaauuuaaugu

SEQ ID NO: 170236 - RNA, 40 nt, Homo sapiens
gcgcuaaaaagcuuauacaaagagacauacucaaaagcac

SEQ ID NO: 170237 - RNA, 43 nt, Homo sapiens
ugcccacucccugcuuaucgcauagucagugaucaguaaaugc

SEQ ID NO: 170238 - RNA, 46 nt, Homo sapiens
ggagagaaaagugccacuuacuagaaucuaauuauuuccuccaguu

SEQ ID NO: 170239 - RNA, 52 nt, Homo sapiens
aagaaaggagacccugaggccaggaucuauuaaaccuggugugugcgcaaaa

SEQ ID NO: 170240 - RNA, 46 nt, Homo sapiens
cucagcucggcguccaggucugagugguugaaggcgccggcggugg

SEQ ID NO: 170241 - RNA, 46 nt, Homo sapiens
aagauucaagaagaaacaaggaucugugcucuggggaagacugaca

SEQ ID NO: 170242 - RNA, 44 nt, Homo sapiens
uucaagaagaaacaaggaucugugcucuggggaagacugacaca

SEQ ID NO: 170243 - RNA, 46 nt, Homo sapiens
ugagcagggagccucauugugagaaggugaacugaggaguccugau

SEQ ID NO: 170244 - RNA, 44 nt, Homo sapiens
gacaaguucaguggcagugggucggggacagauuucaugcuaaa

SEQ ID NO: 170245 - RNA, 45 nt, Homo sapiens
cgcugaaccuugaugggaccccacuuuguaaacuggaugcagcau

SEQ ID NO: 170246 - RNA, 47 nt, Homo sapiens
aggaugugcaauguucaaucauaagugugacaaaaacugacaagcag

SEQ ID NO: 170247 - RNA, 56 nt, Homo sapiens
ucuugcugaaagcacugguuccccuguugaagcuugcuagggauuacaguggguuu

SEQ ID NO: 170248 - RNA, 42 nt, Homo sapiens
auacucuggauuucccagagagucggguaaucagucagccag

SEQ ID NO: 170249 - RNA, 128 nt, Homo sapiens
aaaucggaugugaguaguuauauauugcuucaauaauuauuuaaaugugaauagucuuuccauucuuaacacugugaacuuuuucucucagggaacuuauuggacuauucacaucacuccagaaccag

SEQ ID NO: 170250 - RNA, 48 nt, Homo sapiens
uccuaugaugaccugaucaggaaaguuguagaagucuucaagccagga

SEQ ID NO: 170251 - RNA, 44 nt, Homo sapiens
uuuuguuuuuaccaguuuugcuaagaagcagcaacaacagcaga

SEQ ID NO: 170252 - RNA, 42 nt, Homo sapiens
guaucauccaaaauuccccacagacaaggcuuucguccucau

SEQ ID NO: 170253 - RNA, 43 nt, Homo sapiens
gaagagugggaggcaagugccuugugaccgggaggaggucgac

SEQ ID NO: 170254 - RNA, 47 nt, Homo sapiens
ggaaacagcaagaggcacagaggccggagauuauguuuggaaaacau

SEQ ID NO: 170255 - RNA, 44 nt, Homo sapiens
ugugacucggaggugcaggcaggacauccagagggagguaggcg

SEQ ID NO: 170256 - RNA, 33 nt, Homo sapiens
ggaggacugggaagaaagauuuggcgaugagca

SEQ ID NO: 170257 - RNA, 408 nt, Homo sapiens
ugagguaauuuuuaggagaaggaaccuccgaacuuacuuauguacugaaaagagggagccuguguagauagaaugaaaaugaaaggggcugggcgcauuggcucagccuguuaucccagcacuuugggaggccaaggcggguggaucaccugaggucaggaguuugagaccggccuggccaacaugaugaaaccccaucucuacuaaaaauacaaaaaauuagccaggcaugguggcgggugccuguaauccgagcuacucgggaggcugaggcaggagaaucacuugaaccugggaggcggagguugcagugagcugagaucgugacacugcacuccagccugggcaacaagagcgaaacuccgucucaaaaaaaaaaagaaaaggaaaaugaaaggaacaggugau

SEQ ID NO: 170258 - RNA, 372 nt, Homo sapiens
aaugagaaucuucuagagcaagagcugugguaaugaagaaggcaaagauuuuuuuuuuuuuuuuuuuugagacggagucucgcucugucgugcaggcuggagugcaguggugcaaucuuagcuuacugcaaccuccgccucccagguucaagugauucuccugucucagccucucccaauuagcugggauuacaggugcaugccaucacacccggcuuacuuuuguauuuuuaguagagauaggguuucaccauguuggccggguuggucuugaacuccugaucucaggugauccauccgccuuggccucccaaagugcugggauuacaggggugagucaccgugcccagccagaaaagauuuaagagaagc

SEQ ID NO: 170259 - RNA, 66 nt, Homo sapiens
guuuaaauguagaggaugagggagcacaaagaguugaugucugauuuaaauguuagguaauaggau

SEQ ID NO: 170260 - RNA, 74 nt, Homo sapiens
gugaacuauaaauccuguacagguuugggggcugucauacuauagauggaggugaagcuguagacauugaccau

SEQ ID NO: 170261 - RNA, 46 nt, Homo sapiens
caggaaaaugccugcucuauagauagaaaacuauaaggaugauagg

SEQ ID NO: 170262 - RNA, 89 nt, Homo sapiens
acaggccugaugaggggagugaaucuggcaguuaggaaaccauugaaaaucuuucuugagaguggcuuccaaggauuggaucaugggug

SEQ ID NO: 170263 - RNA, 28 nt, Homo sapiens
aagaaagaagugagggcauggugguagu

SEQ ID NO: 170264 - RNA, 42 nt, Homo sapiens
guuccuuaugggaauuagaguguggaaugaagggugaccuau

SEQ ID NO: 170265 - RNA, 65 nt, Homo sapiens
aggaauaauaagauaaauauaaauaaaaacuuuauugaauuuuacuaguuagaaaucugugcugc

SEQ ID NO: 170266 - RNA, 38 nt, Homo sapiens
uuuaaagcuucucuuacuuuuacugaaagcuguccaag

SEQ ID NO: 170267 - RNA, 41 nt, Homo sapiens
uaaccuacauuuuuuucuaccaagagauuugcagcugacua

SEQ ID NO: 170268 - RNA, 72 nt, Homo sapiens
uuuuuaauugaagauaagguugguuggucagucuguugguugauuggcugguuuuacuuuuggaguugcaga

SEQ ID NO: 170269 - RNA, 49 nt, Homo sapiens
uuuugcacuuaggagacauuguauucccuaaggacccgcuacugcuuua

SEQ ID NO: 170270 - RNA, 86 nt, Homo sapiens
ugaugcuagguugaaggcuagauaggauuucuguggacaaaguugguacagaaggauguuccagaaagaagaaaugacauugacaa

SEQ ID NO: 170271 - RNA, 54 nt, Homo sapiens
uuaaauaaccaugccugauuuccacccauugggggagaacuaaaagacagggau

SEQ ID NO: 170272 - RNA, 43 nt, Homo sapiens
aaucuggaagauacauagaagauuaaggaaauuuccaguuaag

SEQ ID NO: 170273 - RNA, 49 nt, Homo sapiens
ugagguauaucuguucagcucuggguugucgccaaugggauagugacga

SEQ ID NO: 170274 - RNA, 46 nt, Homo sapiens
accuuuaagcccaaugagaacacagaagagucuaaaauuauuucag

SEQ ID NO: 170275 - RNA, 47 nt, Homo sapiens
gaagcugccauaauggacauagugauaaagguuucgguugcugacug

SEQ ID NO: 170276 - RNA, 77 nt, Homo sapiens
caucagucuuuuugaugauacaaguuauacaucuaaugaugauguuuuagaagaugaagaagacauuguagaagcug

SEQ ID NO: 170277 - RNA, 46 nt, Homo sapiens
caaacgaagcacacagauuacagucagauuccucgacaacccacau

SEQ ID NO: 170278 - RNA, 49 nt, Homo sapiens
aaugccuggcucgaagcaccaccagagaaguggcaagaaaagauggaug

SEQ ID NO: 170279 - RNA, 116 nt, Homo sapiens
cacagacuggccacucagcucuccuagcccaauggaugcaccaucaguuaaaauacgcagaauggauccuuucgcuacaaaagaacauauugaaaucauagcuccuucaccacaaa

SEQ ID NO: 170280 - RNA, 44 nt, Homo sapiens
uucaucugagagccaguucucaccacuggaauucucaggaaugg

SEQ ID NO: 170281 - RNA, 69 nt, Homo sapiens
ccaaagguguaucuuuacauucaaaugcagcugugcagaaaagaaaaccucaaagacuggaugaaugga

SEQ ID NO: 170282 - RNA, 94 nt, Homo sapiens
ucaugagcuaaauggcuuccuuuuuccucauuucaagggcuaugaaugguggucauauuacccgcagaguagaguagacucugagggagaggug

SEQ ID NO: 170283 - RNA, 45 nt, Homo sapiens
aauaugaguuuagaacucagggcagagaucugggaguagauauag

SEQ ID NO: 170284 - RNA, 45 nt, Homo sapiens
uggucaagguuggagacuuuggguuagugacugcaauggaccagg

SEQ ID NO: 170285 - RNA, 42 nt, Homo sapiens
acaggacaaguagggaccaaacuguauaugagcccagagcag

SEQ ID NO: 170286 - RNA, 45 nt, Homo sapiens
uuaggccugauucuauuugaauugcuguauccauucagcacucag

SEQ ID NO: 170287 - RNA, 37 nt, Homo sapiens
cuuuuuauguaaauugguugaaaggucuaguuuuggg

SEQ ID NO: 170288 - RNA, 44 nt, Homo sapiens
gccaaaugcuggacuauucugagugccugcagacaauguccccu

SEQ ID NO: 170289 - RNA, 42 nt, Homo sapiens
cugcaggcacucagaauaguccagcauuuggcauagcgacgu

SEQ ID NO: 170290 - RNA, 77 nt, Homo sapiens
cugaaccccugguaauagaauuguucaccuuuauaccaagaagguugggaaagcaccaaaaucugcauguggugugu

SEQ ID NO: 170291 - RNA, 42 nt, Homo sapiens
ggguacacaccacaugcagauuuuggugcuuucccaaccuuc

SEQ ID NO: 170292 - RNA, 67 nt, Homo sapiens
cguguucgugacagggucaagcgugcuuuccuuaucaaggagcagaaaaucguugugaaaguauuga

SEQ ID NO: 170293 - RNA, 59 nt, Homo sapiens
aggcauaagcacagagucggaaagcuaaauaaauacgaaacuuuuuugaguaauaaaaa

SEQ ID NO: 170294 - RNA, 36 nt, Homo sapiens
gcuuacaagaggaacgguucuucaggccagaagagu

SEQ ID NO: 170295 - RNA, 51 nt, Homo sapiens
cuuccuuggaaagacugaggaccguggaaagccggguaccucccuggccug

SEQ ID NO: 170296 - RNA, 152 nt, Homo sapiens
gaacacaggcguccgcggggcgcacggcagggaagguuccuguugccucuucugggagccccgcggcagcgcccagcaggcggaccguggggaccgaggccugaggaggaggcacggggaggugggaggacgaagagcggccggggaggagc

SEQ ID NO: 170297 - RNA, 28 nt, Homo sapiens
aagugcugagcaggaguggagagugaag

SEQ ID NO: 170298 - RNA, 48 nt, Homo sapiens
ugaccuggaaguagacuggcuuucacaaagacugaagaccaguuucaa

SEQ ID NO: 170299 - RNA, 42 nt, Homo sapiens
auuccauaugucuucaguccaccuagaaugaauuucagugaa

SEQ ID NO: 170300 - RNA, 47 nt, Homo sapiens
uuauguucuguuuuacuuaauuauaagggccucauuuacuacugaaa

SEQ ID NO: 170301 - RNA, 65 nt, Homo sapiens
cccaggucaaugaguggucauugaagauaagaaaggaaaugagaguuguugacaggcaaauaagg

SEQ ID NO: 170302 - RNA, 55 nt, Homo sapiens
aguaucaagugagcuaauguguauaauuugagucucaggagaagaggggucagga

SEQ ID NO: 170303 - RNA, 95 nt, Homo sapiens
agauauccaaagagaagaagaaaaagugaaacgaucugugaaagaugcugccaagaagggccagaaggaugucugcauaguucuggccaaggaga

SEQ ID NO: 170304 - RNA, 24 nt, Homo sapiens
aacuauuaaguuugugggggugug

SEQ ID NO: 170305 - RNA, 50 nt, Homo sapiens
uaagacgugcuguagcaaugcagauaaagugcaaugggaguuaagaggaa

SEQ ID NO: 170306 - RNA, 42 nt, Homo sapiens
aguguaagacagaugaugaguguguuuugauuggaagagagg

SEQ ID NO: 170307 - RNA, 64 nt, Homo sapiens
cauagcagcagcauucacaauagccaaaagguagaagcaacccaaguguccauugacagaugaa

SEQ ID NO: 170308 - RNA, 26 nt, Homo sapiens
cuugcgaguggcugguucccugcaga

SEQ ID NO: 170309 - RNA, 51 nt, Homo sapiens
ggcugggucagauugccagaguguucuguagaagaagcaaaagucuaccca

SEQ ID NO: 170310 - RNA, 46 nt, Homo sapiens
aucccuguuuuaaacuaaaaaaggagagacugagaaucaaauagaa

SEQ ID NO: 170311 - RNA, 52 nt, Homo sapiens
agaggagauguuagaggacacuuuugaaagcauggacgaucaggaagaaaug

SEQ ID NO: 170312 - RNA, 40 nt, Homo sapiens
gccagaaccuccaggagcgauggcugccucagaggaugag

SEQ ID NO: 170313 - RNA, 50 nt, Homo sapiens
cauuguagauugcccugugcaguaaacuuucaaggugucggcugccccag

SEQ ID NO: 170314 - RNA, 44 nt, Homo sapiens
uguuggcugguggcugcauuauguccuggggugugcaugugggu

SEQ ID NO: 170315 - RNA, 54 nt, Homo sapiens
cgagcugguugucuugugcgugggacaugggccuuccuaucuguguuuucucaa

SEQ ID NO: 170316 - RNA, 42 nt, Homo sapiens
uuauuuggguuguguuuugugucugaguccccucccucaucc

SEQ ID NO: 170317 - RNA, 46 nt, Homo sapiens
gauaucugucacagacucauaccaaucacgaagauaaauuacaggu

SEQ ID NO: 170318 - RNA, 52 nt, Homo sapiens
aaagagaagccaggagcacuguggcacauauaugcugcaaaggacacggaga

SEQ ID NO: 170319 - RNA, 64 nt, Homo sapiens
aguccuuaagaccauccaagauggagauucugacgaacucacaauaaagcgauuuauugaagga

SEQ ID NO: 170320 - RNA, 48 nt, Homo sapiens
ucuuuuaaggggguuggggaugugaaaggaggggacacaggaauggca

SEQ ID NO: 170321 - RNA, 42 nt, Homo sapiens
agugcaucauaaauugaacucugaacuuuggaaaccugaauc

SEQ ID NO: 170322 - RNA, 32 nt, Homo sapiens
gagaggugauccuuucuccuagaugcuuaccc

SEQ ID NO: 170323 - RNA, 46 nt, Homo sapiens
auuggcuuugugauaaucgcuugcugugcuugcaagaccccaacaa

SEQ ID NO: 170324 - RNA, 43 nt, Homo sapiens
acuggcuggccgaccuaaccagcgggaaugucaacaaggaaaa

SEQ ID NO: 170325 - RNA, 24 nt, Homo sapiens
uguucaaacaggcaauucaaacuc

SEQ ID NO: 170326 - RNA, 44 nt, Homo sapiens
cucgguguggguuuggaguauguguggacugcuaccggaugaag

SEQ ID NO: 170327 - RNA, 46 nt, Homo sapiens
cacugugagugauacugaaauaugccaccauacccagaagaguuua

SEQ ID NO: 170328 - RNA, 51 nt, Homo sapiens
gcuuuuucuuugauaaagaugagucaucuaaaaaauguuuuuuucauauag

SEQ ID NO: 170329 - RNA, 50 nt, Homo sapiens
auauuaguuuuccauuuucaauagagauacaaaguuucuuuauuaaauau

SEQ ID NO: 170330 - RNA, 25 nt, Homo sapiens
ggggcaucugucuuguaagccucau

SEQ ID NO: 170331 - RNA, 47 nt, Homo sapiens
ggcagccauuaagccacaggaaucaggguagguggcacauuagagcc

SEQ ID NO: 170332 - RNA, 46 nt, Homo sapiens
uggccaacauuggagaccacuucugucaaauggugauuucugaaaa

SEQ ID NO: 170333 - RNA, 42 nt, Homo sapiens
gaaggacucaccuguguuuugccgcuucuuucacuucaggag

SEQ ID NO: 170334 - RNA, 44 nt, Homo sapiens
ucgguuuugacagacccagcuaaacucaaaaagcugcaacagag

SEQ ID NO: 170335 - RNA, 49 nt, Homo sapiens
auuguacuuuuaaaaacacaccuuaaaccagucuuuuuugaauuuggaa

SEQ ID NO: 170336 - RNA, 44 nt, Homo sapiens
uuugacuuucguuuguuugccuaaaaacccacuucccucuucuc

SEQ ID NO: 170337 - RNA, 45 nt, Homo sapiens
agaguuagaagaacaaaauguuuucagcaugucaaaagguuuaga

SEQ ID NO: 170338 - RNA, 72 nt, Homo sapiens
cagaagugaaagcaggugucaauagugauagcccuaauaacuguucaggaaaaaagguagaaccuucagcuu

SEQ ID NO: 170339 - RNA, 47 nt, Homo sapiens
ugagccaaaaggcagcuguacucagccuaagacaaacacugaucagg

SEQ ID NO: 170340 - RNA, 48 nt, Homo sapiens
aauuucuuccugucuaaauacaaagucugaagcucugagaacaaaacc

SEQ ID NO: 170341 - RNA, 47 nt, Homo sapiens
auauauuuuagaauuuuuaucuugacacauugaccuuuacuagaggu

SEQ ID NO: 170342 - RNA, 45 nt, Homo sapiens
uagugcaucaauucuaaacauauucagaauaaggaaggugaccaa

SEQ ID NO: 170343 - RNA, 47 nt, Homo sapiens
uugcaaauagaggcaagauuuauugguuuauugauuacauaugggaa

SEQ ID NO: 170344 - RNA, 87 nt, Homo sapiens
cucugugguagaagagaucuuggguaggaugcagaggauucaacaagaauggaaggaagguugguuaggacauguguagcuuagggg

SEQ ID NO: 170345 - RNA, 46 nt, Homo sapiens
ucagacaaguuuuggauacacuggccuggccuagauuucaggaggg

SEQ ID NO: 170346 - RNA, 55 nt, Homo sapiens
uguuggcagucuagaguuagaaguaguaaauaucaguuuggagaaguugguugug

SEQ ID NO: 170347 - RNA, 41 nt, Homo sapiens
aaugaaguagguagaacaaauggaaugucugccucaaagaa

SEQ ID NO: 170348 - RNA, 68 nt, Homo sapiens
gaggugaggcgguagcuaaggggguggagagcuauuuaggagacagcaguaguuggauuugguggaag

SEQ ID NO: 170349 - RNA, 171 nt, Homo sapiens
uaaguacucacugugugguggauacuugguccuggagauugaaagguaucuggaguuccugucucagauuccauaggauagugagggagacagacuuccagagggcucccacaagugcagggagagugcucuggucaggagcucugcaggugccucaagaagcagccuggg

SEQ ID NO: 170350 - RNA, 37 nt, Homo sapiens
guaaauugaguugugugugucaaugccuggcaugaaa

SEQ ID NO: 170351 - RNA, 42 nt, Homo sapiens
acuauuuuauguaaaaaaguuucauuuuuugguauuugcugg

SEQ ID NO: 170352 - RNA, 338 nt, Homo sapiens
auuuuuauuuuuuuagagauaggaucucacucugucacucagacuggagugcaguggugcaaccagagcuuacugcagccuugaacuccugccuccauaguagcugggacugcaggcaugugucaugcaugacaccuggcuaauuuuuguguuuuuuguagagacagggucuugguauguugaccagacuggucuugaauuccugggcucaagcgauccucccgccucagcuucccaaacugcugagauuacagucaugagugagcuacugccccuggcugcguggcaaauuuuuuuaguguuauauugcugucugcucuucuuugcuaguuccagau

SEQ ID NO: 170353 - RNA, 63 nt, Homo sapiens
acuuuauugaagcccuuugcggcucuuuccauugauacauacuuucaucuuguaguaggaauu

SEQ ID NO: 170354 - RNA, 43 nt, Homo sapiens
uacugaguaauaaaaggaauuuuuuauucuuagugcuguuuuc

SEQ ID NO: 170355 - RNA, 72 nt, Homo sapiens
gaacauaauuugguuuuagcugaacgaaagucaccugaaauuucugaacgaauuguacaguggccugcaaua

SEQ ID NO: 170356 - RNA, 86 nt, Homo sapiens
agguguguguggaauuugauggggaaucuuggaggaaaagaagauggauagaagucuacagccuucuaaggagagcauuuuuagua

SEQ ID NO: 170357 - RNA, 96 nt, Homo sapiens
uaaagcuugguuggguuugagguugaugugaauauggagcagaaagacuagccaauuuaggggagaugucagagcauauggauucuguggcuagga

SEQ ID NO: 170358 - RNA, 70 nt, Homo sapiens
auuguguugaagauccucuuuccccugcuccuaacuuaauaagugauaccuugauaagauuugaauuaac

SEQ ID NO: 170359 - RNA, 48 nt, Homo sapiens
ccagaccuuaaacacuaggcuuuaauauucagguagagcgagguuaga

SEQ ID NO: 170360 - RNA, 47 nt, Homo sapiens
guguuuguccguauauggugggucagggcaggaguggguuccugguu

SEQ ID NO: 170361 - RNA, 32 nt, Homo sapiens
cuguuucccacaccgacguuaccaagaaggau

SEQ ID NO: 170362 - RNA, 41 nt, Homo sapiens
gagcgccgcggccucggcugcggggagaggggagagaaagg

SEQ ID NO: 170363 - RNA, 46 nt, Homo sapiens
caucuucggucgacagccuacgcgguugaagaacaauccaguaggc

SEQ ID NO: 170364 - RNA, 29 nt, Homo sapiens
gcgaggcgccugcgcacgagccuccagag

SEQ ID NO: 170365 - RNA, 48 nt, Homo sapiens
uuugacuuguguuuuaucuuaaccaccaggucauuccuucuguagcuc

SEQ ID NO: 170366 - RNA, 46 nt, Homo sapiens
guccauggcaaaugcuggacccaacacaaauggaucccaguuuuuc

SEQ ID NO: 170367 - RNA, 50 nt, Homo sapiens
gguggugacuucacacgccauaauggcacugguggcaaguccaucuaugg

SEQ ID NO: 170368 - RNA, 47 nt, Homo sapiens
uuugcagacgccgccgccgaggaaaaccguguacuauuagccauggu

SEQ ID NO: 170369 - RNA, 69 nt, Homo sapiens
ucuccuuuggagauagacguggcuguuccaagucccuguucuucccuaaccauccuggccugagucaga

SEQ ID NO: 170370 - RNA, 28 nt, Homo sapiens
ggcugaagaucuggcuaaguuccaggac

SEQ ID NO: 170371 - RNA, 47 nt, Homo sapiens
uaguacacugugggagcuggguaaauguuucgguugaauugugaaag

SEQ ID NO: 170372 - RNA, 43 nt, Homo sapiens
uccaacugaucauauguggugaggaugcucucucauaaaugau

SEQ ID NO: 170373 - RNA, 65 nt, Homo sapiens
uuugccccugacccuggcaggaacuggaaggaagaccuugcaagcuggcugccauuaucugcucc

SEQ ID NO: 170374 - RNA, 42 nt, Homo sapiens
cauagugggccaguucugcuguuuuccuauuuucucccucca

SEQ ID NO: 170375 - RNA, 45 nt, Homo sapiens
ggugguaugagauaguccccaaggcauacuguugauuguauguau

SEQ ID NO: 170376 - RNA, 63 nt, Homo sapiens
ccuuggugaggaaaggaggcguggguaaggcuacugacugggggauaggggugucugugugag

SEQ ID NO: 170377 - RNA, 45 nt, Homo sapiens
agaaacagaggcacagcacaccaugcagagccauguugggggcca

SEQ ID NO: 170378 - RNA, 44 nt, Homo sapiens
guuuccauucuauuaugaacuaaaaauagcauuuguagccuggc

SEQ ID NO: 170379 - RNA, 40 nt, Homo sapiens
cagguccuagaauaaguugagugguccagacauggagguc

SEQ ID NO: 170380 - RNA, 43 nt, Homo sapiens
aaggaaguuugucccuuguggugaugugaggguuuuggggaag

SEQ ID NO: 170381 - RNA, 76 nt, Homo sapiens
ggggccaugcagagccccaggaucccucagcagacaggaacauuuucuaggaguuguaaauucaggucuuaauuca

SEQ ID NO: 170382 - RNA, 35 nt, Homo sapiens
gcugugguuucuaucuggaggccucacggugauug

SEQ ID NO: 170383 - RNA, 59 nt, Homo sapiens
gcuggguccucaagaggccuagaaauaugcaagacagaggagggagggaagggcuucca

SEQ ID NO: 170384 - RNA, 47 nt, Homo sapiens
ggaguguggucuauauucuuuagauaguuguuuagucaaaagaccag

SEQ ID NO: 170385 - RNA, 41 nt, Homo sapiens
aucuccucccuggauucuggauuaggagcuucugaaucuuu

SEQ ID NO: 170386 - RNA, 37 nt, Homo sapiens
gagcugcuggaaggaguaauucugugcuugacaaagg

SEQ ID NO: 170387 - RNA, 72 nt, Homo sapiens
agcaccuuguuuuagcgaacucuagcaaaacuuguuuagcuuagcaaaaacaaacacacaaaaaacugagaa

SEQ ID NO: 170388 - RNA, 57 nt, Homo sapiens
ggagcaccuguggcucacaccuucuguuccccuccuggccugugcagaauguaaaca

SEQ ID NO: 170389 - RNA, 49 nt, Homo sapiens
cucauaauauuuggauuguauuuguucguagauaugcccagaagacuag

SEQ ID NO: 170390 - RNA, 49 nt, Homo sapiens
cuaaaucuguuaaggaagacagaaaauguuuucuuugugcucauugagu

SEQ ID NO: 170391 - RNA, 86 nt, Homo sapiens
ugcauuuuuaguccuguauucuauguuugacaaaaucacuguaaaauaaagcagcaguaagaaaagaagcagauucagaggacuaa

SEQ ID NO: 170392 - RNA, 70 nt, Homo sapiens
uugcuuuccuguccuuugccaacucuuaaccuaguuaauccuaguucuguugacauuggaccaggcucag

SEQ ID NO: 170393 - RNA, 67 nt, Homo sapiens
uacugagccugguccaaugucaacagaacuaggauuaacuagguuaagaguuggcaaaggacaggaa

SEQ ID NO: 170394 - RNA, 45 nt, Homo sapiens
ucguauguaugaaauucccuuucccguaaguuaugugccugucag

SEQ ID NO: 170395 - RNA, 51 nt, Homo sapiens
uguuuauuaaaaggagaaaggauaacaauagaauguucuaaaaccagaagu

SEQ ID NO: 170396 - RNA, 47 nt, Homo sapiens
gcaaaaauggauaaguacaaaacuugauguaaauuguaccaaugaau

SEQ ID NO: 170397 - RNA, 40 nt, Homo sapiens
uuauccauuuuugcaaagauauguacacaaagauacauau

SEQ ID NO: 170398 - RNA, 46 nt, Homo sapiens
guuuguucgaucaugauacuucugauaaggaucaucaacguaccag

SEQ ID NO: 170399 - RNA, 45 nt, Homo sapiens
gcaauaaaacccagaguaaacucuuagauaaaaugacgacguccu

SEQ ID NO: 170400 - RNA, 48 nt, Homo sapiens
agauauuacaaagaaauguaaaacaucauacuauguaugaaacaacag

SEQ ID NO: 170401 - RNA, 44 nt, Homo sapiens
acaaugaagucgaagaaaccuaucgaugacagcuuucacggucu

SEQ ID NO: 170402 - RNA, 26 nt, Homo sapiens
ucuaacauacuucagugcaagaaaag

SEQ ID NO: 170403 - RNA, 25 nt, Homo sapiens
ugcccacaugucagguuucucucag

SEQ ID NO: 170404 - RNA, 41 nt, Homo sapiens
uuagucauauucagacaccaguuguuuccuccacucccaga

SEQ ID NO: 170405 - RNA, 66 nt, Homo sapiens
aggaaacaacuggugucugaauaugacuaaaacguccaguggacaaugcagaaauaagagaggcau

SEQ ID NO: 170406 - RNA, 47 nt, Homo sapiens
ccaucaucacaaccaagucggaugucugcuagcucuauguccaguac

SEQ ID NO: 170407 - RNA, 43 nt, Homo sapiens
uuagacuggagguuaacaagcaaaaagggucauuauuuaaguu

SEQ ID NO: 170408 - RNA, 23 nt, Homo sapiens
gcaccagcaaaggcagaggcagc

SEQ ID NO: 170409 - RNA, 43 nt, Homo sapiens
augcugcgggccugucaguuaucgggugugaccgccgccgccc

SEQ ID NO: 170410 - RNA, 46 nt, Homo sapiens
guaauugccaaaguuacuuucuaaaauugaaaauuaaaaagccugu

SEQ ID NO: 170411 - RNA, 39 nt, Homo sapiens
guuuauguuaauaguuuaguacuuaagagagcucuggag

SEQ ID NO: 170412 - RNA, 47 nt, Homo sapiens
guugggagaggggcacguuucuggaacagcaugugguauaggaagua

SEQ ID NO: 170413 - RNA, 41 nt, Homo sapiens
cugugggaaguuuguccuccguccauugcgaccaugccgca

SEQ ID NO: 170414 - RNA, 32 nt, Homo sapiens
uuuucacugugugcugcuuagggagugugugu

SEQ ID NO: 170415 - RNA, 46 nt, Homo sapiens
agacauggugguaaacuuggcugcuaugaucugaauuagugguaga

SEQ ID NO: 170416 - RNA, 42 nt, Homo sapiens
uguuucuuucacuuagguugacuacuggcaaaauugcuggag

SEQ ID NO: 170417 - RNA, 46 nt, Homo sapiens
uagcuaccuuggagaacauuucuaguuaauaacucagcauguuugu

SEQ ID NO: 170418 - RNA, 54 nt, Homo sapiens
guugcucuccaugcgcacacagucuuucccaucuuccucccagucucuacccac

SEQ ID NO: 170419 - RNA, 44 nt, Homo sapiens
aacuccaaaaacaaaagggagauacuccagcuucagcaacaggu

SEQ ID NO: 170420 - RNA, 47 nt, Homo sapiens
auucaaacauguggcaguacaaauauuugugucucuaaggagucaga

SEQ ID NO: 170421 - RNA, 46 nt, Homo sapiens
aauaccaugaguaacauauauuuauagcaccuacagaagcggcuca

SEQ ID NO: 170422 - RNA, 48 nt, Homo sapiens
auacaugauacacucaucagaacuauuuaaugccuaggcaacacguag

SEQ ID NO: 170423 - RNA, 26 nt, Homo sapiens
ucgccuugcacaacaggaaaaacaag

SEQ ID NO: 170424 - RNA, 46 nt, Homo sapiens
ucugaggcaaacugcaagugucacucugcaggcuauugcagcucag

SEQ ID NO: 170425 - RNA, 45 nt, Homo sapiens
aaugcacacuccaacauauugaaagccgccauggacaauucugag

SEQ ID NO: 170426 - RNA, 45 nt, Homo sapiens
ugcugggugacagcaggugcauggugugaggaacuggugcuaaag

SEQ ID NO: 170427 - RNA, 60 nt, Homo sapiens
auauaaauuuuuaccuuugaauuuaaugucacauguuucuguguucaaucuuguuggccu

SEQ ID NO: 170428 - RNA, 64 nt, Homo sapiens
uauuauauaauuaaaauuuuuuguuuagauugcaggcgagaagaaaucugcucaguggcgcaca

SEQ ID NO: 170429 - RNA, 45 nt, Homo sapiens
cagagaagaguuagagaagaugaaaagugugauugaaaaugcaaa

SEQ ID NO: 170430 - RNA, 45 nt, Homo sapiens
cucauauaacugcugcagaggguaaacuucacaacaugauaguug

SEQ ID NO: 170431 - RNA, 45 nt, Homo sapiens
gucugaggcuaagguuguaucucaguaucaugagcugguggucca

SEQ ID NO: 170432 - RNA, 42 nt, Homo sapiens
agcuggacaguauuacuccagaaguccuuccuggguggaaag

SEQ ID NO: 170433 - RNA, 41 nt, Homo sapiens
gauaaaagaaaauuauaguuucuaugaaaugcuuaaguuga

SEQ ID NO: 170434 - RNA, 34 nt, Homo sapiens
auugguuuaagccuagaugagaaucuuugggugu

SEQ ID NO: 170435 - RNA, 93 nt, Homo sapiens
auuuuaaaaagcuuugcagugauucugauggacagcucugguugcuguguugggauuuaaucuagaucauauguguuuaagaaaaguaaaaaa

SEQ ID NO: 170436 - RNA, 36 nt, Homo sapiens
aauauaauuccaaauucuuaaccaguacccaaaagg

SEQ ID NO: 170437 - RNA, 46 nt, Homo sapiens
uuuacucuggauauaaauacugccuaugccagacucagaggaaucg

SEQ ID NO: 170438 - RNA, 46 nt, Homo sapiens
cccugacccgugggguguacagugaagagacccuuagagcccguuu

SEQ ID NO: 170439 - RNA, 42 nt, Homo sapiens
agucccugcuccuauucccaccucagcaacugaagccgcccc

SEQ ID NO: 170440 - RNA, 48 nt, Homo sapiens
uggugaucuggagcuagcagcaaaguuugucaaucagcugaaggggga

SEQ ID NO: 170441 - RNA, 46 nt, Homo sapiens
ccagcgccguaggaauaggaaccacucaggugcagccagagugagg

SEQ ID NO: 170442 - RNA, 70 nt, Homo sapiens
uacugacagcagcagugacagcgacagugacaccagugaaggcaaaugaaaguggagauucaggagcagc

SEQ ID NO: 170443 - RNA, 46 nt, Homo sapiens
uacaguauaguuaagaaaagggcauuuagucucugauuucagagag

SEQ ID NO: 170444 - RNA, 154 nt, Homo sapiens
ugcugguacagguugaauauuccuaauccaaaaaugcuccaaaaucuaaaaccccauacacuucuggucuuaagcauuuuggaaaagggauacuccaacuguauuuguccucuuguagaggaucaccacuguccuucuaaggagggaauccauc

SEQ ID NO: 170445 - RNA, 42 nt, Homo sapiens
gggagcacuuacaugagacuguugccucaaucugagccugca

SEQ ID NO: 170446 - RNA, 67 nt, Homo sapiens
ccuuaugcauauucauguuuccaaaaaugagcaaaaggaucuuuuguagggguagugacaggugguu

SEQ ID NO: 170447 - RNA, 46 nt, Homo sapiens
caagauaguaaagaauauggucauacuuuccgcagugaccugagag

SEQ ID NO: 170448 - RNA, 46 nt, Homo sapiens
uccaagcauuggauguggccaaucggcuagaagugauuccuaaaau

SEQ ID NO: 170449 - RNA, 32 nt, Homo sapiens
augugugagaauuguuuucuguguauccaaau

SEQ ID NO: 170450 - RNA, 45 nt, Homo sapiens
aaauuacgauguugaucagguccaaugaauuuccaguugucuccg

SEQ ID NO: 170451 - RNA, 46 nt, Homo sapiens
augauauaaugaaugaauuaaugggaaagagauuuucuccaaagga

SEQ ID NO: 170452 - RNA, 27 nt, Homo sapiens
auuuguguucccuuuaaauauaaucag

SEQ ID NO: 170453 - RNA, 54 nt, Homo sapiens
guuugcaagaucgccagccuuacagguuuuacgugaaaugaaagccauuggaau

SEQ ID NO: 170454 - RNA, 44 nt, Homo sapiens
ucuguuacaaaguaaugcauauuugcugucaaauccuaucaggu

SEQ ID NO: 170455 - RNA, 66 nt, Homo sapiens
agauccagagaggagaguaguuuuccaguuuuguggacaugugauuagucaagggacacauaggaa

SEQ ID NO: 170456 - RNA, 43 nt, Homo sapiens
ugugcaauaggaauguucauuuuucucuggcauuagagaaaag

SEQ ID NO: 170457 - RNA, 43 nt, Homo sapiens
cagugucuuacagugcauggaauaugccccaucacccugugaa

SEQ ID NO: 170458 - RNA, 46 nt, Homo sapiens
gcccucaacugauuaccauuuucaacaaacuggacagucagaagca

SEQ ID NO: 170459 - RNA, 44 nt, Homo sapiens
uucuagcucuaaaauugugugguucucugaauuggagcuggaug

SEQ ID NO: 170460 - RNA, 56 nt, Homo sapiens
uuagagcuagaaguuuugagaaauuaaguaacuuuuugaaugcuaagaacaauuag

SEQ ID NO: 170461 - RNA, 45 nt, Homo sapiens
ucuuguuuuccuaguguuuaaugccugaguacuuugaaccucaga

SEQ ID NO: 170462 - RNA, 110 nt, Homo sapiens
acauaauacuauuuuaaauguaaauuaaaccaggcuuucauggcuaauauuucaguagcuauuugaauacccucaauauuuggaugauaagccuuuuaaaguguggaguu

SEQ ID NO: 170463 - RNA, 50 nt, Homo sapiens
ucaaaaagauguacauaucgucaauggggaaaggauuuuugguuuugguu

SEQ ID NO: 170464 - RNA, 27 nt, Homo sapiens
ccuugcauaauuaaaggcaagucuugu

SEQ ID NO: 170465 - RNA, 33 nt, Homo sapiens
ucuagugaccuugugacauaaccagcuucagau

SEQ ID NO: 170466 - RNA, 36 nt, Homo sapiens
uauggcauuaugcaccaggccagagaggacaggcaa

SEQ ID NO: 170467 - RNA, 39 nt, Homo sapiens
guaaaggcaacaguagucccgaaagcugcaguaagaauc

SEQ ID NO: 170468 - RNA, 43 nt, Homo sapiens
cagauuuuauucugguagugcaacccucucaaagguugaagga

SEQ ID NO: 170469 - RNA, 88 nt, Homo sapiens
gacuccgggcuugagguugaauuaagaauagucagguggugaguggaacgucucuuggggugucggaauucaaaacggaccuggagga

SEQ ID NO: 170470 - RNA, 45 nt, Homo sapiens
cuggcggcggcugcagggcauuuccuucgggauguauucggcuga

SEQ ID NO: 170471 - RNA, 76 nt, Homo sapiens
uacgauucccagaagcgcuuuugcccagucuauccucuugaguccaggcuugucuggcgcuuguccugcugggagc

SEQ ID NO: 170472 - RNA, 79 nt, Homo sapiens
cuuaggaaauuaaguguuaaauccauuacgaacccucgauaccuggacagccuggggaacccaucggcaaacggccugu

SEQ ID NO: 170473 - RNA, 61 nt, Homo sapiens
ggaacacaacagcaaguugacuaucacguuuccagccauggugcacaggacagcuggccag

SEQ ID NO: 170474 - RNA, 99 nt, Homo sapiens
ucuuucugaacuaccuuuuuucgggaauggaugaugaugguauggaauccagauucaaucccaguguguucuuucuagauuucuugguggugccgcccu

SEQ ID NO: 170475 - RNA, 46 nt, Homo sapiens
ucgcccagucagucgccuaggagaccagauguuuacuaauggccag

SEQ ID NO: 170476 - RNA, 46 nt, Homo sapiens
aaggauguaguucugauucgaaaacuucuggcauugauggcccaag

SEQ ID NO: 170477 - RNA, 46 nt, Homo sapiens
gccuucagagccacgucaauauuguguuugauagcgagauggacaa

SEQ ID NO: 170478 - RNA, 41 nt, Homo sapiens
auaaagauccuggagaagaaagaaggccuguuccgaaaaca

SEQ ID NO: 170479 - RNA, 44 nt, Homo sapiens
ugcgcgcucagucaucugcccagacauguacaucaacaccaacg

SEQ ID NO: 170480 - RNA, 74 nt, Homo sapiens
uggaagcugcaugauggcauugcugucacuccuugcuaggcuuacagacaccuccuaccaacaagucagcacca

SEQ ID NO: 170481 - RNA, 55 nt, Homo sapiens
gagguugaugggaaggaaacacugaggucucguccggggaggaaccacaggcuag

SEQ ID NO: 170482 - RNA, 51 nt, Homo sapiens
aauuuguuguuuucuccugccugcuaucuguugugauuuagaggagauuug

SEQ ID NO: 170483 - RNA, 54 nt, Homo sapiens
aauguguuuuaaguguuuuaauugcuauuuucaaacucuguucccaaaagacua

SEQ ID NO: 170484 - RNA, 78 nt, Homo sapiens
uuuaugguuaugucuucauuuuguuaugguuauaucuucaggaguuguauccauuucuuucuuuggauuaguuuucag

SEQ ID NO: 170485 - RNA, 46 nt, Homo sapiens
agcccacacugcacagacccuccauccaggcccaccgugcccgcau

SEQ ID NO: 170486 - RNA, 52 nt, Homo sapiens
uuacacuugaaggauucguguaacuuguccaaggacacucagcugagaagca

SEQ ID NO: 170487 - RNA, 47 nt, Homo sapiens
auggugguaauaggcaguggugcugguggaguaauaguaauauuugu

SEQ ID NO: 170488 - RNA, 86 nt, Homo sapiens
gucaacgcugcucauaaauauaaucccagaggaccacaucccacugaacuuaucuggaaaggcgaaaaucacugggaaagccuggg

SEQ ID NO: 170489 - RNA, 27 nt, Homo sapiens
acaaaaggacaggcccagggcagagag

SEQ ID NO: 170490 - RNA, 33 nt, Homo sapiens
uccgccuacggccugguccacugcugcuaugag

SEQ ID NO: 170491 - RNA, 46 nt, Homo sapiens
gaagacauuuuggugaagccaaaggcagaugucaagaggcaacgua

SEQ ID NO: 170492 - RNA, 41 nt, Homo sapiens
cagagggauuuuaacaugauugaucugaaguucaaggagga

SEQ ID NO: 170493 - RNA, 30 nt, Homo sapiens
agggucuauacaggccucagaauagugcca

SEQ ID NO: 170494 - RNA, 53 nt, Homo sapiens
agugaaggcucagguuccaguccuggcucugccuugaacuugcugugugaccu

SEQ ID NO: 170495 - RNA, 24 nt, Homo sapiens
ucaggacccuccaguccuuuacag

SEQ ID NO: 170496 - RNA, 47 nt, Homo sapiens
aaaaugaaggcuuccugguuuguuuagaaauguagguuagccuucaa

SEQ ID NO: 170497 - RNA, 47 nt, Homo sapiens
uguggauuuccuguccuccagaucucgugccugcugggccagauuga

SEQ ID NO: 170498 - RNA, 46 nt, Homo sapiens
uuacaggugcaucaucaagcaccuagaggggcuggucgugcaguau

SEQ ID NO: 170499 - RNA, 45 nt, Homo sapiens
aaugaaaucacagcaucuccaugaaguuuuauccagagcagaucc

SEQ ID NO: 170500 - RNA, 46 nt, Homo sapiens
cagaaaauucaggaagcugugaaagcccugaaacuugagagugaaa

SEQ ID NO: 170501 - RNA, 24 nt, Homo sapiens
cagagaagaguuaugagaaaucag

SEQ ID NO: 170502 - RNA, 44 nt, Homo sapiens
gcccuccacccagaugacccucaacaccuuccacuuugcaggca

SEQ ID NO: 170503 - RNA, 46 nt, Homo sapiens
acccaugaugagcgugcccgugcucaacaccaagaaagcccugaag

SEQ ID NO: 170504 - RNA, 45 nt, Homo sapiens
gaaaauugacguccaggaguccuucuguauggaagaaaaacagaa

SEQ ID NO: 170505 - RNA, 50 nt, Homo sapiens
gguuuucugggaaaugggaauucagauuucauggccucuagagaauaacu

SEQ ID NO: 170506 - RNA, 45 nt, Homo sapiens
cucagcagaauggggcugagggguuaggcagagcuaaaagauggg

SEQ ID NO: 170507 - RNA, 51 nt, Homo sapiens
aauccaucaaaaagaagaauaauaaagcaucagcuuucaggaacguaaaca

SEQ ID NO: 170508 - RNA, 79 nt, Homo sapiens
ugaugaggaagaggaggggcacauuguggaugcugaagcugaggagggggacgccgaugccucugaugccaaacgcaag

SEQ ID NO: 170509 - RNA, 41 nt, Homo sapiens
agguugauuaugagagugaggaagaggaggagagggagggc

SEQ ID NO: 170510 - RNA, 44 nt, Homo sapiens
uccagguccuggaucugcgccgccucuacuccaacgacauccac

SEQ ID NO: 170511 - RNA, 38 nt, Homo sapiens
caugcgugcagugagugcaccuguaggagacugcagau

SEQ ID NO: 170512 - RNA, 42 nt, Homo sapiens
cuuugggguuucaguucccaagugaaaacagugcgguuagau

SEQ ID NO: 170513 - RNA, 28 nt, Homo sapiens
ggguccguggauuccaucucucccaggc

SEQ ID NO: 170514 - RNA, 77 nt, Homo sapiens
acucuagagggugcuuuguaggaaggacagaguggagaggacaguggggagguacuuggguguucaacagccagaag

SEQ ID NO: 170515 - RNA, 38 nt, Homo sapiens
gcauucauuguacgccuugcguguguaaguaacgcagg

SEQ ID NO: 170516 - RNA, 38 nt, Homo sapiens
aaugacccuuggauauucuggguuaugaucagcauuuc

SEQ ID NO: 170517 - RNA, 40 nt, Homo sapiens
aucugaaacaucaucugacacucugcccgcauguccaaca

SEQ ID NO: 170518 - RNA, 37 nt, Homo sapiens
uuaauagcuaagagugaacauaaauggggaaauuaag

SEQ ID NO: 170519 - RNA, 39 nt, Homo sapiens
uaauuggcuguacuuuucaaaaaugccaaggucaugaaa

SEQ ID NO: 170520 - RNA, 49 nt, Homo sapiens
cacaaaugugguaaaaugguaacaacuggggagucugguuaaagggcag

SEQ ID NO: 170521 - RNA, 78 nt, Homo sapiens
acuucucccacuuauuccagcuuucugguuuucuccccuagauggcuauaacauauuagcaucaauugaguaagcuaa

SEQ ID NO: 170522 - RNA, 44 nt, Homo sapiens
uuuagcuugcgguuugugucacuggagaacuuaguaaaaaugag

SEQ ID NO: 170523 - RNA, 58 nt, Homo sapiens
uuaucguggauguauaugggcagaagaaggucucagagccauaaggguggggcccugu

SEQ ID NO: 170524 - RNA, 50 nt, Homo sapiens
cauugucuggugacgcugguccccgccuucauuacugcagcagaggaagu

SEQ ID NO: 170525 - RNA, 66 nt, Homo sapiens
cggagcaucaccugcugggcaggccuggccaggggugagccccuccauucgggggcucagggucaa

SEQ ID NO: 170526 - RNA, 30 nt, Homo sapiens
gcucagaaauaugcucagcaagucuugcag

SEQ ID NO: 170527 - RNA, 44 nt, Homo sapiens
aaggcccccaaagacagugaagcugaguccaaguacgauccucc

SEQ ID NO: 170528 - RNA, 53 nt, Homo sapiens
ugaacacuugaaagccaagaccugucggcgcugugugguuauuggaagcggag

SEQ ID NO: 170529 - RNA, 336 nt, Homo sapiens
auugguuuuuuuuguuuguuuguuuacuuauuuuuauuguuuuuauuuuauuuuauuuuuugaggcagggucucacuccuguuguccaggcuggagugcaguggugugaucucagcucacugcagccucaacuucccaggcucaggagauccucccaccacagccuccccaguagcugggaccccaggcacacaccacgcguggcuaauuuuuuauauuuuuaguagagaugggguuucuccgaauugcccagacugggguacaucgcuuuuaaaaccaaccuuucuccucuagaacucagugcacugcucuuggucaguguggcuccaggaacag

SEQ ID NO: 170530 - RNA, 44 nt, Homo sapiens
auccagagggcgcaccacugucugaccuugaauauuauuccaau

SEQ ID NO: 170531 - RNA, 48 nt, Homo sapiens
guuuuaagauuuucuaaauuccguggacgauuuuuauuuugcagccua

SEQ ID NO: 170532 - RNA, 42 nt, Homo sapiens
uggcugcuaugaacuuucagaccaugcauaaugugacaacgg

SEQ ID NO: 170533 - RNA, 46 nt, Homo sapiens
aguguuuguuuuugcacaccauuuuguaaaugaaacuuaagaauug

SEQ ID NO: 170534 - RNA, 46 nt, Homo sapiens
ggugacuuaaaaaaucagaacaaaacuucuauuauccagagucaug

SEQ ID NO: 170535 - RNA, 44 nt, Homo sapiens
guucauguccagccgccccccaggcuugcagcagugccccggcc

SEQ ID NO: 170536 - RNA, 45 nt, Homo sapiens
gcccacccacgcaacccagacuaugaagaguccggugaaagcagc

SEQ ID NO: 170537 - RNA, 53 nt, Homo sapiens
guauccaggaggagauugcaaagcgccagagccaacacugaccauguugaagg

SEQ ID NO: 170538 - RNA, 33 nt, Homo sapiens
gcucauuuccacccauguguuuauagaccuuuu

SEQ ID NO: 170539 - RNA, 47 nt, Homo sapiens
caaauaggccucaaaaauggaggucucccacuuuauugguaucagaa

SEQ ID NO: 170540 - RNA, 30 nt, Homo sapiens
aacucagauccuuagcauaaagauccccag

SEQ ID NO: 170541 - RNA, 47 nt, Homo sapiens
cuguuguauccuuuuaaguguuuguugugguaauccucacaaagacc

SEQ ID NO: 170542 - RNA, 48 nt, Homo sapiens
acacuagagcuugaguuguuauccagcuggcaagcacggaagucuuug

SEQ ID NO: 170543 - RNA, 54 nt, Homo sapiens
gagggcuuugugugcagaaagaggaauaaguacagauuauuuuccuaccacuag

SEQ ID NO: 170544 - RNA, 48 nt, Homo sapiens
cuagaauugaagaccuucugaguaaagggcuucucugccuucucagag

SEQ ID NO: 170545 - RNA, 44 nt, Homo sapiens
aacaucuccgcaacaagacagaggaucuggaagccacagugaga

SEQ ID NO: 170546 - RNA, 55 nt, Homo sapiens
ggaggaaaugaucgugugcggaaccugcaaagugagguggagggaguuaagaaua

SEQ ID NO: 170547 - RNA, 44 nt, Homo sapiens
uacaugaaaacauucucuuuguaaacauuucaagcauuuuacaa

SEQ ID NO: 170548 - RNA, 55 nt, Homo sapiens
cuggaagggaacauugugagaugcuggcccugcuguauucuacggcccucucuag

SEQ ID NO: 170549 - RNA, 104 nt, Homo sapiens
accagcacgugaagaucaccuaccgugauggccgcacuggcgaacugggcuaccuuaacccuggggugagaugucugaugcugacaauuuacuguucuucagag

SEQ ID NO: 170550 - RNA, 45 nt, Homo sapiens
ugccugagccgccugcuucccaaguauaaugucacugagccccag

SEQ ID NO: 170551 - RNA, 46 nt, Homo sapiens
gucuaugucaacacuacagagcuugcacuggagcaagaccuggcau

SEQ ID NO: 170552 - RNA, 45 nt, Homo sapiens
cugaaucccucaaacacggauucuucacauucuaauccuccugag

SEQ ID NO: 170553 - RNA, 46 nt, Homo sapiens; identical to SEQ ID NO: 92381

SEQ ID NO: 170554 - RNA, 58 nt, Homo sapiens
cuagagugguuagccuaagccauggagcaccguaauuuuaaauuucucaaauaacuaa

SEQ ID NO: 170555 - RNA, 46 nt, Homo sapiens
aagauaccuggucuccagcaccaaugucuucuucauuucugucaag

SEQ ID NO: 170556 - RNA, 27 nt, Homo sapiens
accuggguggccuuccccgaccgacuc

SEQ ID NO: 170557 - RNA, 42 nt, Homo sapiens
gagcuguccguucauguuggugucggugugcggaaguggccu

SEQ ID NO: 170558 - RNA, 40 nt, Homo sapiens
ccuucgugguucguggacuuaaaaguggaggcagcgcucc

SEQ ID NO: 170559 - RNA, 47 nt, Homo sapiens
acccagagagaagauggcacuuccaaaacaacagaaaugcucaguau

SEQ ID NO: 170560 - RNA, 46 nt, Homo sapiens
uaaagggauauggggauugagcccuggaaagguggcugaggaagug

SEQ ID NO: 170561 - RNA, 45 nt, Homo sapiens
gauaacacacagcccagucuauccgaggaaccacauguuccucag

SEQ ID NO: 170562 - RNA, 97 nt, Homo sapiens
gaagaggagaagcaugacccacacggagcagguuggcuccagaaggggacacauuggggaaccugcaagaggggcagugcagacccgccuuuuaccu

SEQ ID NO: 170563 - RNA, 70 nt, Homo sapiens
ccuuucagcugaguggccucaggacuguaauuaaucuguaugggccucaguuuccccaacauuaaaugcu

SEQ ID NO: 170564 - RNA, 45 nt, Homo sapiens
uucuuuuucuucugugcccggauccuagaaucaagauucuuaagg

SEQ ID NO: 170565 - RNA, 46 nt, Homo sapiens
ugauucuaggauccgggcacagaagaaaaagaauuaguuccaucag

SEQ ID NO: 170566 - RNA, 55 nt, Homo sapiens
cauuagucucccuuuucccuugacaguguagaacugugcagcguagcacuaaaug

SEQ ID NO: 170567 - RNA, 48 nt, Homo sapiens
uuggugaugagagagaaaaagggcaaaagucugcaguuaggaauuuag

SEQ ID NO: 170568 - RNA, 52 nt, Homo sapiens
aaccuuuagaaaaguuuaguugacagacagagaccgaagugaguuaguaaaa

SEQ ID NO: 170569 - RNA, 48 nt, Homo sapiens
guggauggaaaggagcugguacagaugggcacaaccagaaaacaugag

SEQ ID NO: 170570 - RNA, 45 nt, Homo sapiens
cucgcuacccguggaauccgaaagugucccuucacgguucucacu

SEQ ID NO: 170571 - RNA, 67 nt, Homo sapiens
acccgacuuauuagggacaucuuuuguggucugcgccuccgaaccugacuugcuagggcugucuuuu

SEQ ID NO: 170572 - RNA, 43 nt, Homo sapiens
aucgucucccccaucgucaagcaggaaccggcaccccccagcc

SEQ ID NO: 170573 - RNA, 46 nt, Homo sapiens
gaccacuucucccccggcuccccucccacccaccucuccccagaga

SEQ ID NO: 170574 - RNA, 54 nt, Homo sapiens
gguagugguuggguacguagccaucuguaucagccacagcauccuccacaugcu

SEQ ID NO: 170575 - RNA, 44 nt, Homo sapiens
gcaccaugucccagaguuaaccacuccuuugucuacuuucccag

SEQ ID NO: 170576 - RNA, 57 nt, Homo sapiens
gggagguucugaacuaggguuaaaagacaaaagcucuuccccccuccccucccccag

SEQ ID NO: 170577 - RNA, 42 nt, Homo sapiens
guguucuucuccugcgucuccguuuucuucagcuuggccuua

SEQ ID NO: 170578 - RNA, 47 nt, Homo sapiens
caccaaauguagucucagagauggcuggggaguagaccagaggugga

SEQ ID NO: 170579 - RNA, 66 nt, Homo sapiens
aaugugugugucucacugacaugcuggaggcuggguggggggguuggggggcguggguaggcuuug

SEQ ID NO: 170580 - RNA, 75 nt, Homo sapiens
uuaggccgcuggcagauggagauauuggguggcugagccaggauucggguccgggagcccugcaaauuugggagc

SEQ ID NO: 170581 - RNA, 44 nt, Homo sapiens
gccaaucacuugaggacaaaggucuggcuagauaacguuagcaa

SEQ ID NO: 170582 - RNA, 46 nt, Homo sapiens
acuuaugguacauuacuugcugaaggucauaguguugcaauauuga

SEQ ID NO: 170583 - RNA, 45 nt, Homo sapiens
uuagugccgcagaauggaauucggcauuguuccuacacagcuucu

SEQ ID NO: 170584 - RNA, 47 nt, Homo sapiens
aacagguauguauaucuagauuuuuauuuucaaauguagacuagaga

SEQ ID NO: 170585 - RNA, 46 nt, Homo sapiens
aucucaaaaauaacacaugauuguugcagaaaaauauacuguacag

SEQ ID NO: 170586 - RNA, 90 nt, Homo sapiens
aguugucaauuauacuuugaagauagagaaauaagcucuacuaauggaucuaauaugggacauaugagaaagagaauaaucaaggauggc

SEQ ID NO: 170587 - RNA, 50 nt, Homo sapiens
aaguggaggugucagguaggcaguugacaaugugaauauggaguucaagg

SEQ ID NO: 170588 - RNA, 52 nt, Homo sapiens
ccaugauaagggaugacaucaccaagggcaugaauuuagaugaaaaagagaa

SEQ ID NO: 170589 - RNA, 58 nt, Homo sapiens
gucauuaacuggauggaauuaugagaguuaggagggugugcuacuggcaucuaaugag

SEQ ID NO: 170590 - RNA, 52 nt, Homo sapiens
gaaauuugaauugccaucaaaaccaguguguuauuuuuguuucuagguauga

SEQ ID NO: 170591 - RNA, 58 nt, Homo sapiens
ucucacaacugauuaaguggcaggcuuaggauggcuuggaguagaguggucccgugug

SEQ ID NO: 170592 - RNA, 45 nt, Homo sapiens
cuucuugcuaagcaauccauuuauaauuuauagugacacaaauag

SEQ ID NO: 170593 - RNA, 69 nt, Homo sapiens
ggcaaaauguguaggaauggaauugcuaagucauguucauaugaacauaagucaaguauauuuaacuuu

SEQ ID NO: 170594 - RNA, 46 nt, Homo sapiens
gguggaggugaaacacuccaucuuaagcagaacaaauaugaaaaga

SEQ ID NO: 170595 - RNA, 41 nt, Homo sapiens
uacuuuaacccuguccaugaauuuguucuuaaauguggugu

SEQ ID NO: 170596 - RNA, 45 nt, Homo sapiens
ucaguaugucuccugcacagcugggaaccacgaucuacaagguga

SEQ ID NO: 170597 - RNA, 58 nt, Homo sapiens
uuucuagggagaggagguuggaggcugaguaacaagaaauggaaauuggaugaagaag

SEQ ID NO: 170598 - RNA, 47 nt, Homo sapiens
gauguccugaauuaagauguuuucaccacauuguauuacagagacag

SEQ ID NO: 170599 - RNA, 46 nt, Homo sapiens
uuuggaucuucaacagauauuagaaagugaaaaagacuuggaagaa

SEQ ID NO: 170600 - RNA, 45 nt, Homo sapiens
uuaugacaucaaaaagcaggcagagauccuacaagaaucccggau

SEQ ID NO: 170601 - RNA, 71 nt, Homo sapiens
ugcuucucaucuucagcuuuuuaauucucagcuuccuggaccauacguucaaugucuuccuugcucaaaug

SEQ ID NO: 170602 - RNA, 40 nt, Homo sapiens
gcuugguaggaauggugguauuacaguugaugaggauggu

SEQ ID NO: 170603 - RNA, 45 nt, Homo sapiens
uuggagaagcuucugaaucuuggggauacuaauagaaccaccaac

SEQ ID NO: 170604 - RNA, 50 nt, Homo sapiens
uguauucuacuuggaccuggggccugucagcaucauucacuaccaugaag

SEQ ID NO: 170605 - RNA, 46 nt, Homo sapiens
agccccaggaaaaaugguggaaaauucacugucaccauugccagaa

SEQ ID NO: 170606 - RNA, 33 nt, Homo sapiens
aacaggucuauccaggaaaauggugaacuaaaa

SEQ ID NO: 170607 - RNA, 1071 nt, Homo sapiens
uuuucucucuuagugguucaaccaucuagaacaauaauaacaaaaaucaguuuuaaagcaaaaacacaguucucaaccccuuucaccccauucugauguuucagauaaggcaaaacagguuuuaauuucuucuacaaauuaacuuccaguuugaaauuaagauacaccacuugcaucacaaugcuagaauugaacagauaaacuguccauuugaacucuuacuccauaaaugccucgguuucugagacaauuaauguuuuugcucacccauccuacuaggaagaauguaaaagguguuucaggcucauaaaaacagaucaacacuauccaucucuuuuuaggaacaauccccuaagcauggcccacaaaagcuuaacaucuuguuucugcaauuacuguguauacucauguuaucagcugcagcacauaaauugcaggcugugagucaaccuacauccacgucuguagacacuguggacucaggcagaaagacagcaacucaagggcuucccaggacucccuaaguuggcuucaaauccaaaguaaguaaccucccauccccucccccacagcccauguuacaacggucuggcuguaucuacauguauuuaaauaggaggugcauaacugagcauaggugcuagccuucagcugggugggugugcaacgucuccaucugugcacguggccuagcauccgauugguggccauuguucuuuucagcaccugugccagugagaggauguuuguacucaucucuaucucccaaaggcaaucacuucccuuucucuaaaaaacgcuuaccugaaaagucauguaaaagucuaaauccauuuugccuuugagguagaauuuguuuuaauacaucaaaaauggaccaacaguaacagacugcauguccucuuaaauaagggaguaauuuuuugagacacgguugcaaaaucacagaacagcaucaagcugccacaauaagaaugacagcacgagcaaaggaaguaaaauugacaaguauacagaugaaauagauacaaaaauagaaaaaagacuaaccucuucaaucuugcuuucaau

SEQ ID NO: 170608 - RNA, 46 nt, Homo sapiens
ccagaaauacccaccaguaaaguuuuuaucagaaaaggaucggaaa

SEQ ID NO: 170609 - RNA, 43 nt, Homo sapiens
cggccacgaggugaccgugguggacaauuucuucacgggcagg

SEQ ID NO: 170610 - RNA, 45 nt, Homo sapiens
gcagcagguccucccgcaggcccauggugucgaacguggggguca

SEQ ID NO: 170611 - RNA, 46 nt, Homo sapiens
accaacauuuugauagcacguguccuuaggcuucugcgacgaauca

SEQ ID NO: 170612 - RNA, 41 nt, Homo sapiens
gaagaugaccgccugagugauggucagugugucguagaggu

SEQ ID NO: 170613 - RNA, 49 nt, Homo sapiens
uauguacaauucucuguuauuagggagaucauaguuaaugaugagggac

SEQ ID NO: 170614 - RNA, 40 nt, Homo sapiens
gucuaaugaaacugccugcaguuccugcaucaucacuccu

SEQ ID NO: 170615 - RNA, 45 nt, Homo sapiens
caggucucagggggaggagggucuccuucaggagaguuccuuggg

SEQ ID NO: 170616 - RNA, 46 nt, Homo sapiens
aggccaacaggcucaaagaagaagaacgaaccagaagaugaggagg

SEQ ID NO: 170617 - RNA, 698 nt, Homo sapiens
aauugggugaaauguggucugagcagucagccaaagauaaacaaccauaugaacagaaagcagcuaagcuaaaggagaaauaugaaaagguacagugucaucuuuuuuaaagccguggauaagacuagguauagguaauaacuguagaaaaccugggaaauuuaguuaaucuuguauuaaugguugucagcuauguuuugaaaaggccuaaugaaaauuguacacuucaacacaagguaauugaaaccuuccuuuugacugaaaccaguguuuguagcacuaguauauuccugcagacagacuuguaguuacuuguaguuauuguauagucuguauagucuguuauuuuuuuuuuuaagcagagagucaaagaaauuguuuuauguagauauauauaaaaugugaagguacaggagggacuauggcacugugugugauguaaaaggguauugguagugaaaguacugauacugcuguaucgcaacccuugucauuuuacgucauuaacuuguuaaagccuagugggauaagugcucuaaaaacuuagacugguuaccuuuuuagacaguuauuaggguuauuggucaaucaucuuagauuguuuacaacuaagugguuuuucacaguugaguaaugauaccggaugcuuuauuuuuuugacaauauuucaggauauugcugcauaucgugccaagggc

SEQ ID NO: 170618 - RNA, 117 nt, Homo sapiens
accguaaguuuaaaauaacccaaauugcuccuuggauuuuuccuucaguuuauuaaacucuguugcuuccuuucagaucugccuucuuccuguuuugcucugaacaucgcccaaaga

SEQ ID NO: 170619 - RNA, 45 nt, Homo sapiens
caugucugcaaaggagaagucgaaguuugaagauauggcaaaaag

SEQ ID NO: 170620 - RNA, 52 nt, Homo sapiens
ccggguucugcggaggaagagccgcccucuggaggaggccgcgcgcaggugg

SEQ ID NO: 170621 - RNA, 45 nt, Homo sapiens
gcuucaugauucacucaaggacuuuuaauuuucccuagggcugau

SEQ ID NO: 170622 - RNA, 37 nt, Homo sapiens
acaugggagcuuuugugcaucuccaaguacauggcau

SEQ ID NO: 170623 - RNA, 92 nt, Homo sapiens
cuccuccaucucugguaugaagagagagagcgaagaugacccugagagugagccugaugaccaugaaaagagaauaccauuuacucuaagac

SEQ ID NO: 170624 - RNA, 45 nt, Homo sapiens
uauuaugaagaauaaauaacacgucaaguggugcuaagccuuugu

SEQ ID NO: 170625 - RNA, 85 nt, Homo sapiens
cuuuuuuuccgcuaguaagcagaaaugaagaaacaagugaagaaagucaggaagaugaaaagcaagauacuugggaacaacagca

SEQ ID NO: 170626 - RNA, 48 nt, Homo sapiens
aacaguuggguaaauucaggaaaaaugaaacacauuuuuccucuguaa

SEQ ID NO: 170627 - RNA, 46 nt, Homo sapiens
caugguucaaaucuguagaagaauuuauggauagcaguguggaaga

SEQ ID NO: 170628 - RNA, 45 nt, Homo sapiens
aaguuaauguguuuguuuuuccagccacuuuuuaucugcaugguu

SEQ ID NO: 170629 - RNA, 25 nt, Homo sapiens
gcuguuaauuucuagauuguuggaa

SEQ ID NO: 170630 - RNA, 77 nt, Homo sapiens
ucaaaaauuagagaugcacauauagauuuuaaguacaaagaauauuguuauagcauuauuuauaauagaaaauaguu

SEQ ID NO: 170631 - RNA, 50 nt, Homo sapiens
uuucacuucuauaaagagaguucauggauucuguaugcucucaacaacuu

SEQ ID NO: 170632 - RNA, 46 nt, Homo sapiens
cuuauuuuggugaaaauaaaagcuuugaaucaagcagaauccuuca

SEQ ID NO: 170633 - RNA, 26 nt, Homo sapiens
uaaaucauauugugcuuaugaauugu

SEQ ID NO: 170634 - RNA, 52 nt, Homo sapiens
agucagagcaucaccagaauggucuuuaaugagcauggaaccugagcaaagg

SEQ ID NO: 170635 - RNA, 54 nt, Homo sapiens
ggcucuaagaggauauauuuugagaccaauuuaauuucauuuauaagaacauag

SEQ ID NO: 170636 - RNA, 46 nt, Homo sapiens
ugauacuucaaaaauugaagcugcaauauggaaggaaauugaagcg

SEQ ID NO: 170637 - RNA, 32 nt, Homo sapiens
uaauuaggcugauaggcaugagcaaaaauucu

SEQ ID NO: 170638 - RNA, 45 nt, Homo sapiens
uaggaaguauucuucguguuacuacagcugacccauaugccagug

SEQ ID NO: 170639 - RNA, 46 nt, Homo sapiens
aacagauccucugaaauuucaaauagaaagaaaagauauguuagaa

SEQ ID NO: 170640 - RNA, 18 nt, Homo sapiens
gagaguggguuugggaag

SEQ ID NO: 170641 - RNA, 51 nt, Homo sapiens
gaacaaguauccuaguagagaaaaaugucagacauaaccgaaauggggaga

SEQ ID NO: 170642 - RNA, 33 nt, Homo sapiens
uaaauuggguuuuuguuuucucuuaaugucccu

SEQ ID NO: 170643 - RNA, 26 nt, Homo sapiens
uaaggcaugaaaaggacaaggccugu

SEQ ID NO: 170644 - RNA, 37 nt, Homo sapiens
ccugaauguguuacauuacaugacagauuuugcaggu

SEQ ID NO: 170645 - RNA, 53 nt, Homo sapiens
uucagugguauuuaguauauucacaaauauguacaccagucaucacagucgau

SEQ ID NO: 170646 - RNA, 45 nt, Homo sapiens
ugcucuuuguauguuuagguacuuuagauugauugccgagcgggg

SEQ ID NO: 170647 - RNA, 46 nt, Homo sapiens
gccucuucugcauuaaguuugcccagcuuguuacacuaauccagcu

SEQ ID NO: 170648 - RNA, 46 nt, Homo sapiens
ggggaauuaaaauuucuaccugaaaauugcuaaccauaaagaaaua

SEQ ID NO: 170649 - RNA, 36 nt, Homo sapiens
auguugaugugaaauucaaaaucucauaaaacggau

SEQ ID NO: 170650 - RNA, 45 nt, Homo sapiens
gugaaggccuuggugaaggcagaucccgacgugacgcuagcggga

SEQ ID NO: 170651 - RNA, 39 nt, Homo sapiens
gccucgcagccccaggccccaacgagugugccuggggcu

SEQ ID NO: 170652 - RNA, 59 nt, Homo sapiens
ccaaaagcccuaccccuccuucaagagcaucuauaacugguuauccuugaauuuggucc

SEQ ID NO: 170653 - RNA, 31 nt, Homo sapiens
uccauaaauguaaucugaaaagaacccagga

SEQ ID NO: 170654 - RNA, 61 nt, Homo sapiens
cugaauggugagaucuucauugaccugaccuccucugugcugaaguuugcugacuugagga

SEQ ID NO: 170655 - RNA, 46 nt, Homo sapiens
accagccuggaacagaguggacugcagaggcaauaaacaaggaugu

SEQ ID NO: 170656 - RNA, 46 nt, Homo sapiens
ccaaauagaaacaaauauuuguuucuauuauuagaguaaaacaaca

SEQ ID NO: 170657 - RNA, 45 nt, Homo sapiens
augcaucagcucucugagcuuaauuaauuagaguugaagcugagg

SEQ ID NO: 170658 - RNA, 45 nt, Homo sapiens
gaggacacuagacugaaauuggaacaaauaugacccuucucuugg

SEQ ID NO: 170659 - RNA, 42 nt, Homo sapiens
uauagguuggaggauuagguuccauaggaaagaaagaaaaug

SEQ ID NO: 170660 - RNA, 24 nt, Homo sapiens
ugagugaauuuauucuaagguccc

SEQ ID NO: 170661 - RNA, 42 nt, Homo sapiens
aguuguuggcaggauugguuccuucugagggcagugagggaa

SEQ ID NO: 170662 - RNA, 102 nt, Homo sapiens
auaugaggacuucaagguccuggcauaucaggacaggucuuuaggaguccuguugacauaaauaaaauagguagauuauugagacugaggccaggcccuaaa

SEQ ID NO: 170663 - RNA, 85 nt, Homo sapiens
agcccuguaaaggguagccugcaaaggagauugaaaaggaguggccaaaaaagacagcagggaaacuagggcauuggauguuaua

SEQ ID NO: 170664 - RNA, 48 nt, Homo sapiens
gaauuuguggacauguuuucaaaugaccacaaacuaugaccuaaagaa

SEQ ID NO: 170665 - RNA, 46 nt, Homo sapiens
aaaacaaugacagaaauuacauuacucaugaaucugcaguuuaggc

SEQ ID NO: 170666 - RNA, 59 nt, Homo sapiens
ccagggaggagggggcggagggacgcauccuuuuccagugaggagggggaggaggggcg

SEQ ID NO: 170667 - RNA, 80 nt, Homo sapiens
cuuccagggaggagagggaggagggacacagccauuuccagggaggagggggagcagggacauggccauuuccagggaag

SEQ ID NO: 170668 - RNA, 39 nt, Homo sapiens
ggaggagggggaggagggacgcggccauuuucagggagg

SEQ ID NO: 170669 - RNA, 61 nt, Homo sapiens
gagggggaggaggaacacggccauuuccagggaggagggagaggaggggacgcauccauuu

SEQ ID NO: 170670 - RNA, 75 nt, Homo sapiens
ucagggaagagggggaagagggacgcacccauuuccagggaggaggggggagagggacgcauccuuuuccaggga

SEQ ID NO: 170671 - RNA, 58 nt, Homo sapiens
cagggaggagagggaggagggacacagccauuuccagggaggagggggaggagggacg

SEQ ID NO: 170672 - RNA, 31 nt, Homo sapiens
agggaggagggggaggagggaagcggccauu

SEQ ID NO: 170673 - RNA, 42 nt, Homo sapiens
ugguaucuuuuagaaaaugacagggaaucaauucauuauuua

SEQ ID NO: 170674 - RNA, 45 nt, Homo sapiens
caccuggagagacgguucuagauaaucaauuagaaauaucccaag

SEQ ID NO: 170675 - RNA, 85 nt, Homo sapiens
aauugaaguauaaugcacaugggaaacugaaagcagcagguaaccaccauccagauccaguaacagaucauuaccugaaccagcc

SEQ ID NO: 170676 - RNA, 46 nt, Homo sapiens
guggcauggcugcccuggcgaggacaaguuccuugucccaucugaa

SEQ ID NO: 170677 - RNA, 86 nt, Homo sapiens
gagguggcacuagggaucaaagaagaugguuagaaccagcagaagccagagggugggaggggccaugcugugugagaccaggggac

SEQ ID NO: 170678 - RNA, 26 nt, Homo sapiens
cugggacugugggcucucuagaguag

SEQ ID NO: 170679 - RNA, 28 nt, Homo sapiens
cuggacugcaaagugauccgucuggcug

SEQ ID NO: 170680 - RNA, 50 nt, Homo sapiens
ccuugggaaacuucgcccccaaccccguuuggaagccccagaucccaaau

SEQ ID NO: 170681 - RNA, 35 nt, Homo sapiens
uauccgggcuaguagugggugagagagcccagaaa

SEQ ID NO: 170682 - RNA, 39 nt, Homo sapiens
agggggagggggcgcggcaguggccagcuccacggggag

SEQ ID NO: 170683 - RNA, 46 nt, Homo sapiens
ucuccaggaccagcacucuucucccagcccuuaggguccugcucgg

SEQ ID NO: 170684 - RNA, 41 nt, Homo sapiens
agauccccugaaugggagcccagaguccuaacccagcagau

SEQ ID NO: 170685 - RNA, 24 nt, Homo sapiens
cugguuuucucucucucauuccca

SEQ ID NO: 170686 - RNA, 84 nt, Homo sapiens
ucccucucuuucugacucugggccccacucaaucuguuucucucacgcacacuuugucucuggggcacccaggccuucccugcc

SEQ ID NO: 170687 - RNA, 47 nt, Homo sapiens
gcugugcaguucgugcuuggggucuccguccccuuccacgggcccug

SEQ ID NO: 170688 - RNA, 46 nt, Homo sapiens
ggggcugggggaacagugacuguacgcacgaugaggaugcuggggu

SEQ ID NO: 170689 - RNA, 42 nt, Homo sapiens
uccgucacgggcaggggucgucugccccacccaacggcgggu

SEQ ID NO: 170690 - RNA, 46 nt, Homo sapiens
gcccacaacagccacguggucugcgggaugcugggcuuccccagcg

SEQ ID NO: 170691 - RNA, 52 nt, Homo sapiens
ugucuacaaugaacaaaauaaaaauggcaguguguacuuuaaugugcagguc

SEQ ID NO: 170692 - RNA, 29 nt, Homo sapiens
accagaccucauuuucuucccuuucucug

SEQ ID NO: 170693 - RNA, 23 nt, Homo sapiens
cugcuagcccaacggcagcaaca

SEQ ID NO: 170694 - RNA, 45 nt, Homo sapiens
acagggccuggcacacagcucaccacugcagggccccccccaggg

SEQ ID NO: 170695 - RNA, 46 nt, Homo sapiens
uggugagcugugugccaggcccugucuacgcggcauccaguggcca

SEQ ID NO: 170696 - RNA, 44 nt, Homo sapiens
gcccguguccgucuaaagggcggcgcccacccuggagagggccg

SEQ ID NO: 170697 - RNA, 46 nt, Homo sapiens
agaacaucacagcugaggauuguucacauagccaggaugccggggu

SEQ ID NO: 170698 - RNA, 77 nt, Homo sapiens
cagauccgacucagugggggccgcagccaacaugaggggcgagucgaggugcaaauagggggaccugggccccuucg

SEQ ID NO: 170699 - RNA, 46 nt, Homo sapiens
uacaggccaccauggccuccagggucccccagucauccccacagau

SEQ ID NO: 170700 - RNA, 46 nt, Homo sapiens
caggagaccugguacugggacucugggaauauaacagaggugguga

SEQ ID NO: 170701 - RNA, 45 nt, Homo sapiens
ucccuggaucagugugcccaucauggcacccacaucaccugcaag

SEQ ID NO: 170702 - RNA, 383 nt, Homo sapiens
cuuccaucccucccuaguguguaagacuaguuuuuuguuuuuguuuuuguuuguuuguuuguuugagauggagucucacucuguugccgaggcuggaaugcagcggcgugaucuuggcucacugcaaccucugccaccuggguucaagugauucuccugccucagccucccgaguagcugggauuauaggcgccugccacugcgccuggcuaauuuuuguaguuuuaguagagacaggguuucaccaucuuggucaggcuggucuugaauuccugaccucgugauccauccgccuuggccuccuaaagugcugggauuacaggcgugagccacugcacccggcgaaacuggcucuuuuauggggaagaagugccccuccagau

SEQ ID NO: 170703 - RNA, 45 nt, Homo sapiens
cgauguaggcggucuccugcaccagugcugagugcagcaacagau

SEQ ID NO: 170704 - RNA, 44 nt, Homo sapiens
ucagcacuggugcaggagaccgccuacaucgaagaccggccccu

SEQ ID NO: 170705 - RNA, 45 nt, Homo sapiens
ccuauggucaccggcgucugcuccgauucuccucccagauccaca

SEQ ID NO: 170706 - RNA, 42 nt, Homo sapiens
cacccauggcacucgugccacacccaggaguggcgcccagcc

SEQ ID NO: 170707 - RNA, 46 nt, Homo sapiens
accacagcauggacaucuucacucacuaugauauccucaccccaaa

SEQ ID NO: 170708 - RNA, 42 nt, Homo sapiens
gccaaucccuccagaugucuccaagcgguaugagugugccaa

SEQ ID NO: 170709 - RNA, 46 nt, Homo sapiens
ccgugaugucaauccacugacagucaaugucaugccgguagagauc

SEQ ID NO: 170710 - RNA, 46 nt, Homo sapiens
uaacugcaaauaugauggacauagaaucugggugcacaacugccac

SEQ ID NO: 170711 - RNA, 46 nt, Homo sapiens
guagcguucaaaccuccuguuggccucuucacugaaggcaucaccu

SEQ ID NO: 170712 - RNA, 51 nt, Homo sapiens
aagaggccaacaggagguuugaacgcuacccuggccagaccagcaaccaga

SEQ ID NO: 170713 - RNA, 47 nt, Homo sapiens
gaggcugccauuaccucaggagcuuaccaagaaacccaugucagcaa

SEQ ID NO: 170714 - RNA, 81 nt, Homo sapiens
uggcuacagauacugacagcuggccucugaaggagggugaaaacuucugcuugacaguuccacauccauagugcauggucu

SEQ ID NO: 170715 - RNA, 69 nt, Homo sapiens
ccuucagaggccagcugucaguaucuguagccaagcaugggaaucuuugcucccaggcccagcaccgag

SEQ ID NO: 170716 - RNA, 90 nt, Homo sapiens
cagaacagaccagagcccaccacaccacaaagagcagcaccugacuaacugcccacaaaagauggcagcagcucauuuucuuuaauagga

SEQ ID NO: 170717 - RNA, 46 nt, Homo sapiens
cuuuucccccaccaaaaggcuagagguaaagcuguaucccccuaaa

SEQ ID NO: 170718 - RNA, 42 nt, Homo sapiens
ucugagggcaccgagacagaggguuaaaugaaccaguggggg

SEQ ID NO: 170719 - RNA, 73 nt, Homo sapiens
agaacagcauaaauaaaaaacaugggaguaggaaaucagguuggcugaguauucauauaggaagguauuacag

SEQ ID NO: 170720 - RNA, 25 nt, Homo sapiens
aagacagaaaugagaacaaagcuca

SEQ ID NO: 170721 - RNA, 41 nt, Homo sapiens
ccugucaucugaagaugcgagcaaauaagcagcuccaacca

SEQ ID NO: 170722 - RNA, 46 nt, Homo sapiens
cguccuacuguccgccugcucgcguccugggugccgccucugagua

SEQ ID NO: 170723 - RNA, 44 nt, Homo sapiens
ucagaacugcuguggucacuuuucgucccuuucacgguguauca

SEQ ID NO: 170724 - RNA, 42 nt, Homo sapiens
cuaggggaagcgaaugaggaguuugcacuccguguacaacag

SEQ ID NO: 170725 - RNA, 45 nt, Homo sapiens
gcagagcacaugaagcgacaaagacaccccagauugcgcccccag

SEQ ID NO: 170726 - RNA, 45 nt, Homo sapiens
caucaccaagggaacucagucccuacccacagccucugccuccaa

SEQ ID NO: 170727 - RNA, 59 nt, Homo sapiens
caguuucccagcucuggcccggugaccccucagccaacagcccuaacauuugccaaguc

SEQ ID NO: 170728 - RNA, 46 nt, Homo sapiens
gagcccaggaggcugacugagcucaaaggaacaggauggcacccag

SEQ ID NO: 170729 - RNA, 47 nt, Homo sapiens
cgggugagguugucugaccccuccagcgucacgcccgacucugaccc

SEQ ID NO: 170730 - RNA, 53 nt, Homo sapiens
gaggguggaugauuggugacggaggguguaucuucaggaggagguucgaguga

SEQ ID NO: 170731 - RNA, 40 nt, Homo sapiens
guggccugggcugggacaaagguuugagacggggaaccag

SEQ ID NO: 170732 - RNA, 50 nt, Homo sapiens
ggugcgaaaggcagcaggcugagggcauauuguaggggcaaggaagugaa

SEQ ID NO: 170733 - RNA, 54 nt, Homo sapiens
guagguggcugcuggggauauacugaagccagauuaauggugagaauaggguuu

SEQ ID NO: 170734 - RNA, 689 nt, Homo sapiens
aagcuuggaggaaagcauacuggagaauaagcuacaaagagccugggcuuaagaauccaagauuaggggcugggcgagguggcucacgccuguaauccagcacuuugggagaccgaggcaggcggaucaugaggucaggagaucaagaccauccuggcuaacacggugaaacccuguuuccacuaaaaauacaaaaaauuagccgggcgugguggcgggugccuguagucccagcuacucgggaggcugaggcaggagaauggugugaaccugggaggcggagcuugcagugagcugagauccagccacagcacuccagccugggugacagagcaagacucugucucaaaaaaaaaaaaaaaaaaaauccaagauuaggcagggcaugguggcucacaccuauaaucccagcacuuugggaggcugaggcaggcggaucaccugaggucgggaguuccagaccagccugaccaacauggagaaaccccgucucuacuaaaaauacaaaauuagccaggugugguggcgcaugccuguaaucccagcuacucaggaggcugaggcaggagaaucgcuugaaccuaggaggcgaagguugcggagagccgagauugugccauugcacuccagccugggcaacaagggcaaaacuucgucucaaaaaaaaaaaaaaaaaaaaaaaaaaucca

SEQ ID NO: 170735 - RNA, 60 nt, Homo sapiens
auaguaauaggaagggcaguacaggguaauacuguccuuggggcugauccagguauagaa

SEQ ID NO: 170736 - RNA, 36 nt, Homo sapiens
caagccgggcgcugauacuggucgcugacagcgcca

SEQ ID NO: 170737 - RNA, 42 nt, Homo sapiens
aauaaaguuuaaaacccugcuaccacaauguuucuggaacaa

SEQ ID NO: 170738 - RNA, 41 nt, Homo sapiens
gcgcggagugcagcgugaccgcccgccgcgcacgguaccac

SEQ ID NO: 170739 - RNA, 43 nt, Homo sapiens
caccgucccccugcucacacgugugccugagcuuaggaguccc

SEQ ID NO: 170740 - RNA, 42 nt, Homo sapiens; identical to SEQ ID NO: 92710

SEQ ID NO: 170741 - RNA, 45 nt, Homo sapiens
uucuucuauguggugacagauggcaaggaaguccuacuaccagag

SEQ ID NO: 170742 - RNA, 42 nt, Homo sapiens
acuucaacugccccuuggccccaaccucugguaguaggacuu

SEQ ID NO: 170743 - RNA, 46 nt, Homo sapiens
gggccugccuggcucugauggagccaggaaaaccaggcaugcaggc

SEQ ID NO: 170744 - RNA, 45 nt, Homo sapiens
uggcggggacgggacccugccuuaccaaccuuacugaaccccaag

SEQ ID NO: 170745 - RNA, 42 nt, Homo sapiens
gagccuggaugagcugcacugggccccagagcuaggagucuu

SEQ ID NO: 170746 - RNA, 43 nt, Homo sapiens
cuugcugucaucccacauagcccuggggugaaugugaauccag

SEQ ID NO: 170747 - RNA, 40 nt, Homo sapiens
acugugcuagcuuuacccccgcaggacauacacaggagcc

SEQ ID NO: 170748 - RNA, 75 nt, Homo sapiens
gagccagucaaggaggugaggguuagugccacccugccagaucuggaggacuacuccccgugugcacuaccccca

SEQ ID NO: 170749 - RNA, 81 nt, Homo sapiens
gcaccuucaagcccccagccuacgaggaugugguucaccgcccaggcacaccaccccccccuuauacuguggccccaggcc

SEQ ID NO: 170750 - RNA, 41 nt, Homo sapiens
caguggcccuccccaaaccagaaccccaaaucgucucacau

SEQ ID NO: 170751 - RNA, 42 nt, Homo sapiens
gugagaguggucacugcugcggggagacuggcugcugcaccu

SEQ ID NO: 170752 - RNA, 35 nt, Homo sapiens
ccaguugcgggugggggguagugaaccgcgcagga

SEQ ID NO: 170753 - RNA, 42 nt, Homo sapiens
ucacaacagaguccggcagcgucuucucuugagggagcaauu

SEQ ID NO: 170754 - RNA, 67 nt, Homo sapiens
auguauacaguauugagaacucuccacgacccacgcacuuugcguggcauuggggauaucgauagua

SEQ ID NO: 170755 - RNA, 42 nt, Homo sapiens
cauccagccaccucuguuccuccucuuccuccugacccccua

SEQ ID NO: 170756 - RNA, 59 nt, Homo sapiens
ggguauaauaagaaacccaguuuccccaccuccagauccucacccagccaggcacggua

SEQ ID NO: 170757 - RNA, 46 nt, Homo sapiens
acuccuuccauagguuccucuucauuauccacaaccauaaggggag

SEQ ID NO: 170758 - RNA, 48 nt, Homo sapiens
caagaaaaaacacaagaagcacaagaagaaacacaagaagaaacacca

SEQ ID NO: 170759 - RNA, 44 nt, Homo sapiens
guuacuucccacacgcaaaauuuccgccuccuuuucuggggccu

SEQ ID NO: 170760 - RNA, 39 nt, Homo sapiens
aggagagcccaguuccaagccuucccuuccgggucugga

SEQ ID NO: 170761 - RNA, 42 nt, Homo sapiens
gagcuggggccgccccugggauuagcccggccuucggggaca

SEQ ID NO: 170762 - RNA, 42 nt, Homo sapiens
agcagccagagggguuuaacaggagugcagagggauaagggc

SEQ ID NO: 170763 - RNA, 45 nt, Homo sapiens
gcagaacccuggugcagacaaaacuagacugggaggaccuaugua

SEQ ID NO: 170764 - RNA, 38 nt, Homo sapiens
ggaggccuucuggguggugguggugcagcaugugcgug

SEQ ID NO: 170765 - RNA, 37 nt, Homo sapiens
uuagaccuccggauuccacucauguggaaggacacag

SEQ ID NO: 170766 - RNA, 45 nt, Homo sapiens
aagugcauggaguucugaaaggcacaaaccucuucuguuaccggc

SEQ ID NO: 170767 - RNA, 42 nt, Homo sapiens
ucugcccuaccucccugcacuaaccagcuuugaggauggcac

SEQ ID NO: 170768 - RNA, 47 nt, Homo sapiens
gagaugucggaaaggggagagcaggagcaauggcagaggaguccgga

SEQ ID NO: 170769 - RNA, 76 nt, Homo sapiens
ggcgcauccugugguggugggcgcucagccgcacauccgagugcccggcccgcugcugcuggcaggacgcggaggg

SEQ ID NO: 170770 - RNA, 54 nt, Homo sapiens
gaccacuggcuacucagguauacuuaagguaccgagaggcgaagagcuaggagg

SEQ ID NO: 170771 - RNA, 147 nt, Homo sapiens
caggauuguuugauuauaguaagaaaugagauuaucagugaaagaugucgggcagauggguguagggacaaagcaguauuuuagcagauguaugugcuuuacugugauguauaaggugguuggaacuagggaaggagggggagacgg

SEQ ID NO: 170772 - RNA, 36 nt, Homo sapiens
ugauaauaauaaugccuuauauuuauguaugacacu

SEQ ID NO: 170773 - RNA, 64 nt, Homo sapiens
ugauuugccuuaauuuucaaagcuauuacauggcagacugaaguagugauagugauaauggagg

SEQ ID NO: 170774 - RNA, 46 nt, Homo sapiens
agcucuaucauugcuagcagcugcuuggaguuauagguugaaaggg

SEQ ID NO: 170775 - RNA, 65 nt, Homo sapiens
aggagggaaugauuagcuccacauggagaagccaggagagucuuuaggaaagaggugagaauugg

SEQ ID NO: 170776 - RNA, 49 nt, Homo sapiens
uaacauuugcagaugcauaaagggaaaggcagauagauccaaguggcug

SEQ ID NO: 170777 - RNA, 27 nt, Homo sapiens
ccacuggagacuuuuaggcaggaagau

SEQ ID NO: 170778 - RNA, 59 nt, Homo sapiens
guagaugggaagugaagauagagaauguguacucacuuugaguaguucagcagagaaag

SEQ ID NO: 170779 - RNA, 34 nt, Homo sapiens
uacaaggcacuguucuaagugcuuuucaggcauu

SEQ ID NO: 170780 - RNA, 61 nt, Homo sapiens
ugacuuuuagaggucugggcccuuggaggugggccuggaagucacuggauauuucugggga

SEQ ID NO: 170781 - RNA, 54 nt, Homo sapiens
gaggaaaauggauuagaaauccaagaggugucugucuccucccuggcuggggua

SEQ ID NO: 170782 - RNA, 31 nt, Homo sapiens
ucuuauuuaaucuucaaaaugucccugugag

SEQ ID NO: 170783 - RNA, 39 nt, Homo sapiens
cuaucuuaagaggguagagcgggguaaagucacuguucu

SEQ ID NO: 170784 - RNA, 68 nt, Homo sapiens
gugaaguugccuucauuacugcccuucucuugcugccuccugggcagggccugccuccucuggcucag

SEQ ID NO: 170785 - RNA, 63 nt, Homo sapiens
agcauggagaagaaucuccagagcuuggggauagagaguugaccaaacaagacucaggccagg

SEQ ID NO: 170786 - RNA, 56 nt, Homo sapiens
gaugaagcaaagggcaaaaaugauggaacuguucaaggcaggaaguacuucacuug

SEQ ID NO: 170787 - RNA, 61 nt, Homo sapiens
agccguccuugaucuggcuauauugaaacuauugaucuggcuauauugaaucuggccucag

SEQ ID NO: 170788 - RNA, 53 nt, Homo sapiens
uagaguuacaguaaagaugguagaagggaaaaacucauaggcuccagaaguuc

SEQ ID NO: 170789 - RNA, 45 nt, Homo sapiens
uccuuugauuauugucuccugguuggggcuuccauuucaccucag

SEQ ID NO: 170790 - RNA, 92 nt, Homo sapiens
gccccauagaaugccauuucugggauagccccuggcccaguuuuuuggagcacgcucuugggggugggcaagggagggaagagaggagccaa

SEQ ID NO: 170791 - RNA, 58 nt, Homo sapiens
augagggcacguguaugagcaagugaaaguucgucauaguguauccuggguucucuuc

SEQ ID NO: 170792 - RNA, 42 nt, Homo sapiens
uuuggcuuuuaggagguugucuaagccaguagcuugaaugca

SEQ ID NO: 170793 - RNA, 33 nt, Homo sapiens
cauagaccuggagcaaggaugggacugagagua

SEQ ID NO: 170794 - RNA, 45 nt, Homo sapiens
aucauccccacgccgguccucaccucuccuggagcaguccccccg

SEQ ID NO: 170795 - RNA, 44 nt, Homo sapiens
gagggacuaagggcucaggugcgggaccuggaggagaaacuaga

SEQ ID NO: 170796 - RNA, 39 nt, Homo sapiens
agcuggagaaacacaaaauccagcuggagcaggugcagg

SEQ ID NO: 170797 - RNA, 44 nt, Homo sapiens
aaggaggcgcuggaggcaaaggaacgcuauauggaggagauggc

SEQ ID NO: 170798 - RNA, 48 nt, Homo sapiens
cgggcugagucccugcagcaggagguggaggcacugaaggagcgggug

SEQ ID NO: 170799 - RNA, 34 nt, Homo sapiens
aggcugagauugaagagaaggguaaggggcccac

SEQ ID NO: 170800 - RNA, 65 nt, Homo sapiens
uccucagagaagcaggagcaugugaagcuccagaagcucauggaaaagaagaaccaagagcugga

SEQ ID NO: 170801 - RNA, 49 nt, Homo sapiens
guggagaugcugacagaucggaaccugaaucuggaagagaaagugcgcg

SEQ ID NO: 170802 - RNA, 45 nt, Homo sapiens
gcgaugaaugagaugaacgaugagcugcaggagaaugcacgugag

SEQ ID NO: 170803 - RNA, 47 nt, Homo sapiens
cagcagaccaucaagaaguaccgccagcugaccgcccaucuacaggu

SEQ ID NO: 170804 - RNA, 46 nt, Homo sapiens
gcagccaccuccagagaccuuugacuucaaaaucaaguuugcugag

SEQ ID NO: 170805 - RNA, 42 nt, Homo sapiens
aguguggauguguauaagaaagugggcagccuguacccugag

SEQ ID NO: 170806 - RNA, 46 nt, Homo sapiens
gcuacuuguggcugcucuggaggaacuggcuuucaaagcaagcgag

SEQ ID NO: 170807 - RNA, 45 nt, Homo sapiens
ugugcggcugagccuccuggagaagaaguuggacagugcugccaa

SEQ ID NO: 170808 - RNA, 45 nt, Homo sapiens
ucgagaaaguccagacucggcuggaggagacccaggcacugcugc

SEQ ID NO: 170809 - RNA, 63 nt, Homo sapiens
uuggagaugagagcaaaaguauguugauauagaggacuaagucccugccccccugguauuagu

SEQ ID NO: 170810 - RNA, 45 nt, Homo sapiens
uggugccgcucugcccgaugcacagccaccucagccagcccccag

SEQ ID NO: 170811 - RNA, 49 nt, Homo sapiens
ccucagggcuugugggggguaggcugagaccccaccaccaaagguuaag

SEQ ID NO: 170812 - RNA, 30 nt, Homo sapiens
gcuugacaaagugaagcauccauccuccau

SEQ ID NO: 170813 - RNA, 45 nt, Homo sapiens
aguucgcuugauuauuucccacacaccccauggaguagccgguaa

SEQ ID NO: 170814 - RNA, 46 nt, Homo sapiens
gcccugguuuuguugaggacauaggagugacuugcaggauucucgc

SEQ ID NO: 170815 - RNA, 42 nt, Homo sapiens
cucuucuaccuccugccgcacuuccugcuugaucugcugggc

SEQ ID NO: 170816 - RNA, 46 nt, Homo sapiens
ggacuauuauaauaacacuguaauacagaagaugaaacugaggaua

SEQ ID NO: 170817 - RNA, 45 nt, Homo sapiens
augaagcuuacuuguucuuucagaaagguagugaaaagagcauuu

SEQ ID NO: 170818 - RNA, 74 nt, Homo sapiens
gggagcagcugugcgcgggcugcagcagccgggcagccaaagcagacauuagagaagucgcagccauagaccgc

SEQ ID NO: 170819 - RNA, 55 nt, Homo sapiens
cuccgaauccugauccaggcgggggccaggggccccucgccuccccucugaggac

SEQ ID NO: 170820 - RNA, 64 nt, Homo sapiens
uggguacucccuguuuucauuuuuauguugcaucauaguaagucugaauguuuuauuauaggaa

SEQ ID NO: 170821 - RNA, 50 nt, Homo sapiens
guuuuuaguugaucuuuuaauauuugauuauuuuuucuugugcuuauuua

SEQ ID NO: 170822 - RNA, 47 nt, Homo sapiens
guuaauauuuuugaaaaauuuaucaguaaaacauuuuucucuucaga

SEQ ID NO: 170823 - RNA, 42 nt, Homo sapiens
ugguacuaauauuaaaaagccaaucaaauguucugcaccaaa

SEQ ID NO: 170824 - RNA, 45 nt, Homo sapiens
cgcuuugucguauguguuguauaucuuuuuccccggguuaccuuu

SEQ ID NO: 170825 - RNA, 35 nt, Homo sapiens
uucuccauuuuuuaauaaaaauauucugcuggaag

SEQ ID NO: 170826 - RNA, 47 nt, Homo sapiens
ugccuguaagcuccaggauaaugucugaaaagucacguuaaugagga

SEQ ID NO: 170827 - RNA, 40 nt, Homo sapiens
guuucagguuauugagaacuggcugggaaaaaaaugcaag

SEQ ID NO: 170828 - RNA, 46 nt, Homo sapiens
uauucuaaagcgucuguucaggguuuaugcccauauuuaucaccag

SEQ ID NO: 170829 - RNA, 49 nt, Homo sapiens
uguucacagagguuauuucaucauucuuuuggacuucagaaaacuagag

SEQ ID NO: 170830 - RNA, 63 nt, Homo sapiens
cuuuuuaggaguuuaaucugauugauaggcgugagcuggcaccucuucaagaauuaauagaga

SEQ ID NO: 170831 - RNA, 52 nt, Homo sapiens
aaacuuuaagaaaacaggauaaaaagauacccauugccugugucuacugaua

SEQ ID NO: 170832 - RNA, 54 nt, Homo sapiens
uacucagucauuucuuuacaagaaaaugauugaaucuguuuuaggugacagcac

SEQ ID NO: 170833 - RNA, 31 nt, Homo sapiens
agcuuaauucagauaguagcuuuuggcugag

SEQ ID NO: 170834 - RNA, 50 nt, Homo sapiens
cacuauuuuuauuauuucauuauuuuucagaggccuuaaaauucuggaua

SEQ ID NO: 170835 - RNA, 49 nt, Homo sapiens
agguuagauuugauguuuuuuuuuagauuuauuuuucuuacuccacuaa

SEQ ID NO: 170836 - RNA, 85 nt, Homo sapiens
aggcuagggagccaaggggaggaggagaauuggaggaaggggagauaaugggaagaggauggcgccuuccugaguuggcuagagg

SEQ ID NO: 170837 - RNA, 71 nt, Homo sapiens
ggugguaguacuaaguuuugucaauauugugguuuccugauuguauuguuggcuuucucucugagcauuga

SEQ ID NO: 170838 - RNA, 41 nt, Homo sapiens
auaaaaauuuauguuguguuuuaaaauccuuaggggcuuua

SEQ ID NO: 170839 - RNA, 46 nt, Homo sapiens
uguuagacuuugccauuguuuucuuuuguaccugaagcauuuugaa

SEQ ID NO: 170840 - RNA, 48 nt, Homo sapiens
ccuaaaacuagggaaaugagacuacuggauucuauucccagcucugcc

SEQ ID NO: 170841 - RNA, 41 nt, Homo sapiens
gucuuuuagguuuguuugaagagacuguaccagagggccag

SEQ ID NO: 170842 - RNA, 50 nt, Homo sapiens
uggacugaaagaagcaggagguucucaggacgagcugagcauuaggagaa

SEQ ID NO: 170843 - RNA, 47 nt, Homo sapiens
uguugugguacuagguugauuucaucuccaaaauauuucucgaaaca

SEQ ID NO: 170844 - RNA, 24 nt, Homo sapiens
caaauauuuuaagcgagggcuuac

SEQ ID NO: 170845 - RNA, 64 nt, Homo sapiens
cuuccaccuuuuuuuaagguuguggcaauauaacaacagagaacacugguggccaggguccuaa

SEQ ID NO: 170846 - RNA, 43 nt, Homo sapiens
uuuuugccuuuuuuuuuucguaaacaguuuuucaugaaaaaag

SEQ ID NO: 170847 - RNA, 38 nt, Homo sapiens
aucuucuugugauuaucuuacgauuacaagcguaaauu

SEQ ID NO: 170848 - RNA, 46 nt, Homo sapiens
agauaggguugccauauuuagcagaaauuaaaaauaauauccaguu

SEQ ID NO: 170849 - RNA, 66 nt, Homo sapiens
cacucaggagccagacaggaaacuuauucuauuccuguuuucucuuucugcccaccacauccaauc

SEQ ID NO: 170850 - RNA, 43 nt, Homo sapiens
aaggauggugaggaauuuagaguugaccuccagccccaacauc

SEQ ID NO: 170851 - RNA, 47 nt, Homo sapiens
aagcuucgcuucuagguggcacuguuugccuuaauacccugacaguu

SEQ ID NO: 170852 - RNA, 115 nt, Homo sapiens
ccugcccuggcuuucuuccccucaacucuggagccccauccccacccuccuuggggggcucagcuuggcucagaucugaugcuucaagaggcuguaaccucagagggcaccaagg

SEQ ID NO: 170853 - RNA, 47 nt, Homo sapiens
ggggcaagaucaggagagucaggccccugggccucuaugccaggugg

SEQ ID NO: 170854 - RNA, 87 nt, Homo sapiens
cacucuugaccaacacgcagucaccacacccagcccacucuuggcaccuccggggcacccucuucucagucucucuuguugccaggu

SEQ ID NO: 170855 - RNA, 27 nt, Homo sapiens
uuaccuagcauuucaguuuuuugcaga

SEQ ID NO: 170856 - RNA, 44 nt, Homo sapiens
ucagacagggagggcuuucccagagagguaaguuugaaggagag

SEQ ID NO: 170857 - RNA, 46 nt, Homo sapiens
uuggccuccuccagaccuuccccuucaucaugcugaccucgccuaa

SEQ ID NO: 170858 - RNA, 41 nt, Homo sapiens
uucucuuacugaagacacaguccuugccacugauaucaaag

SEQ ID NO: 170859 - RNA, 36 nt, Homo sapiens
auuccgcuccccuuccuugcgcugcgucgggaaagg

SEQ ID NO: 170860 - RNA, 46 nt, Homo sapiens
guggcagaugucagcucccaugauggcgucuccugcucggccaggu

SEQ ID NO: 170861 - RNA, 58 nt, Homo sapiens
uguauuuaaagagauaacaaaagagauugcaccuacaaaauaagaacaggucgcuaug

SEQ ID NO: 170862 - RNA, 41 nt, Homo sapiens
gccauagcugcauccgagccagggcgaggguagcacugcca

SEQ ID NO: 170863 - RNA, 46 nt, Homo sapiens
ccagaguuacgucucuagcucauaaaccucagagccccagccuagg

SEQ ID NO: 170864 - RNA, 49 nt, Homo sapiens
gugaugagauucucuaugucauugagacagagccccauuuagguuaaca

SEQ ID NO: 170865 - RNA, 55 nt, Homo sapiens
caaugacuggguuuucauauugguguaguacagccaccucgagaagauaaaacau

SEQ ID NO: 170866 - RNA, 62 nt, Homo sapiens
auguuauuauugaaggcacaaaugaucagggaagacuucaugaaggaggugagacaauauag

SEQ ID NO: 170867 - RNA, 72 nt, Homo sapiens
gagcgcggugccagcgguacgcaggcgccgggagccuacgagggcucgcaggagcugggaggcgcgcaugcg

SEQ ID NO: 170868 - RNA, 48 nt, Homo sapiens
gaucccauccgcgccccacacaguuuagcacucagccuccagucucga

SEQ ID NO: 170869 - RNA, 45 nt, Homo sapiens
gaggcugagugcuaaacuguguggggcgcggaugggauccagcug

SEQ ID NO: 170870 - RNA, 82 nt, Homo sapiens
gggugucgggaugaaggagggaauguuaggauccagcggcuuuuccgggcugguguucugugcugcguagugcagguaugaa

SEQ ID NO: 170871 - RNA, 40 nt, Homo sapiens
gaacguuagugaauuguuuuugugugauucuuagcuuggg

SEQ ID NO: 170872 - RNA, 75 nt, Homo sapiens
cagguacucuagguuaaaaagguuuagguacuguaguuuaaaaaagucaucacuuuguacuugacuaucuuaggg

SEQ ID NO: 170873 - RNA, 52 nt, Homo sapiens
auuuuguuuuuauguaaguggaagaaaaugagacaaguaguuuaguggaaag

SEQ ID NO: 170874 - RNA, 60 nt, Homo sapiens
ucuaaaauggugacauuauuacuuccugcuugggauuuuugugagugacuguuaagugag

SEQ ID NO: 170875 - RNA, 50 nt, Homo sapiens
ugugauggaaaauuaaaauggaaggaaaauaaguauauagaagaugagaa

SEQ ID NO: 170876 - RNA, 48 nt, Homo sapiens
uuuuguuuacuguugagcauuuuuugagcaccuguugcaugucaggau

SEQ ID NO: 170877 - RNA, 57 nt, Homo sapiens
uuauuauggauugcauaauaggcugacuaacagucaauaguuaggaagugaacauga

SEQ ID NO: 170878 - RNA, 54 nt, Homo sapiens
uugccauauugccuauaguuuuuuuuuuuuuuuugacuuuguauaaaguaagaa

SEQ ID NO: 170879 - RNA, 43 nt, Homo sapiens
gcaaaaugauuuucuacuccaacuguuauucuacauuuaguag

SEQ ID NO: 170880 - RNA, 43 nt, Homo sapiens
accacuuuucucauuucuaguuuaacaaaaaauccuagggaag

SEQ ID NO: 170881 - RNA, 44 nt, Homo sapiens
aguaaagaaguuggcugaguggcuuuaucugcgugguaggagag

SEQ ID NO: 170882 - RNA, 49 nt, Homo sapiens
agauuuacacuuaauguaucugguauauggaaagaacaccaaugggaga

SEQ ID NO: 170883 - RNA, 43 nt, Homo sapiens
gagagauugguuagauugguuggaccuuaaacaauaaagcuaa

SEQ ID NO: 170884 - RNA, 26 nt, Homo sapiens
gaaaauguccuuuugcaaagguuaaa

SEQ ID NO: 170885 - RNA, 46 nt, Homo sapiens
uaauaggaacauaaguguaguuuaauugcccuaugggauuuauuag

SEQ ID NO: 170886 - RNA, 41 nt, Homo sapiens
aggaguuguaauuacugcucagcaccuaggacagcacccag

SEQ ID NO: 170887 - RNA, 33 nt, Homo sapiens
cguugccucacaugguucaacaccaccuuauac

SEQ ID NO: 170888 - RNA, 112 nt, Homo sapiens
uuaugaggccuggaucuaugggucucccaagauuuuacccagcagggagagcacguggaauuccacacagauuugcuggccaugaaucuuaucagaacauggggccacagag

SEQ ID NO: 170889 - RNA, 139 nt, Homo sapiens
aaugaauguucagguaacucaacacagaacugauccaagauugaccaaagaaaaacuggauuuucaugaagcacaacagaagaaggggaagccucaugguagccggugggaugaugagccucauauaucugcaucagug

SEQ ID NO: 170890 - RNA, 49 nt, Homo sapiens
gagagugccucaaguaucuuagcaaguuuuggauuaucuaaugaagacc

SEQ ID NO: 170891 - RNA, 81 nt, Homo sapiens
acuccugaaaauaugccauuaauuuugagggauauaagaaugcgaaaaauggggcgccgauuaccuaauuuaccuucucag

SEQ ID NO: 170892 - RNA, 55 nt, Homo sapiens
uucaaguaaugugaucgauuaugggcaugcaagcaaauauggcuacacagaagau

SEQ ID NO: 170893 - RNA, 57 nt, Homo sapiens
caauccaaaugugauauguaauucuauguuuccuguugaagacguauuucgccaaau

SEQ ID NO: 170894 - RNA, 74 nt, Homo sapiens
uuucaggaggacagucaguccuugaacccauaaaauccgucaaccaauccauuaaccaaacaguuagccagaca

SEQ ID NO: 170895 - RNA, 74 nt, Homo sapiens
augagucaaucucugauuccuccaucuaugaaccagcaaccuuuuucgucggaauuaauuucaucuguaagcca

SEQ ID NO: 170896 - RNA, 56 nt, Homo sapiens
ugaaagcauccuggcuaccaaaguuuucacaugcugaugcccagaagaugaagaga

SEQ ID NO: 170897 - RNA, 44 nt, Homo sapiens
aguguuuuuaaaaaaagaucacuguauaaugaugcucagcgcca

SEQ ID NO: 170898 - RNA, 49 nt, Homo sapiens
uauguacuuauggauaccaguuuuguacuugacuccaauuagguacugg

SEQ ID NO: 170899 - RNA, 46 nt, Homo sapiens
aacaagugguuuugugauugauuuaacuuguuuggauaugcuguag

SEQ ID NO: 170900 - RNA, 49 nt, Homo sapiens
ucuugacuagaaugaugugggagagaagacuucauggaguagguugaag

SEQ ID NO: 170901 - RNA, 59 nt, Homo sapiens
agaaauaaguacgaaaggcuuugaagagcuagccuaggaguuuagacuugaggugagag

SEQ ID NO: 170902 - RNA, 59 nt, Homo sapiens
agugacauguuggaaguauauuuuagggagaucugacugaaguaugcaggguaaauaga

SEQ ID NO: 170903 - RNA, 48 nt, Homo sapiens
uauuugcaguaaguuuuuucugauccaugcuuuuauuuucuccaaguu

SEQ ID NO: 170904 - RNA, 48 nt, Homo sapiens
uuucuguacuaaaauauuuucaaaugggaucagugagguaugguauua

SEQ ID NO: 170905 - RNA, 29 nt, Homo sapiens
uucuuucacauagcaaaauggaccccacg

SEQ ID NO: 170906 - RNA, 46 nt, Homo sapiens
ucuaauauauaagccaaauucauauuuucccauuucuuuccagaau

SEQ ID NO: 170907 - RNA, 40 nt, Homo sapiens
aauagguauccugauuggaauccugagauccucccaucga

SEQ ID NO: 170908 - RNA, 71 nt, Homo sapiens
agacguucucauucccccaguccuaggcguucuagaagaucaagcucaagucacagauuccgucggucucg

SEQ ID NO: 170909 - RNA, 72 nt, Homo sapiens
aagcccaaugcauuacauguauaggccgagaagucgaaguccaagaauuugccaucguuucauuucuagaua

SEQ ID NO: 170910 - RNA, 51 nt, Homo sapiens
caaaaugcuuucgaucaguuagcccugagaggaugucaaggagaucaguga

SEQ ID NO: 170911 - RNA, 24 nt, Homo sapiens
uuucuuuauccagaagcagauaua

SEQ ID NO: 170912 - RNA, 44 nt, Homo sapiens
ugucagaauguaaacaggugucugauaaagcuguuucucuccag

SEQ ID NO: 170913 - RNA, 34 nt, Homo sapiens
ggaaaaagaaaaauggguaaaaaauauggaaaag

SEQ ID NO: 170914 - RNA, 52 nt, Homo sapiens
uguacugcauauauaauuguucuuugagaguuauauaaaugucuggauguga

SEQ ID NO: 170915 - RNA, 46 nt, Homo sapiens
aaaggaaaaagugugaaaauauguguuccaggaaagaaaaaagcac

SEQ ID NO: 170916 - RNA, 46 nt, Homo sapiens
ugcucacuaaauaacuguuauaauuuacucccugguaauuuaugag

SEQ ID NO: 170917 - RNA, 119 nt, Homo sapiens
ggauaugccaaagagaaggggaaaaauguuuccuuuaagugaaaaguugaaaguucuggacuuaauaaggagagaaaaaaauuguaugcugaagucgcuaagaucuacaguacaguaag

SEQ ID NO: 170918 - RNA, 48 nt, Homo sapiens
gguucagcacgagcacgguuucaaggcauccaccaggggucuuggaua

SEQ ID NO: 170919 - RNA, 68 nt, Homo sapiens
uguaaucacaaauugaaaaaaaugucuuuauaaauaggaaaagguaauaaucauguguccuuuagaau

SEQ ID NO: 170920 - RNA, 64 nt, Homo sapiens
agacuauuaguuaaaacuuuaauguauuuuaaaaucguauggcaguaguagucuuggauuucac

SEQ ID NO: 170921 - RNA, 383 nt, Homo sapiens
uuaucuuucaagccaggcaugguggcucacgccuauaaucccaucacuuugggagaccgaagaggguggaucaccugaagucaggaguuaaguccagcuuggccaacgaggugaaauucugucucuacugaaaauacaaaaaaacuagccaggcaccagugaugcacgccuguaaucucagcuacugggaaggcuggggcaggagaaucgcuugaacccgggagguggaaguugcagugagcugagaucuugccacugcacuccagccuaggggacagagugagacucugucucaaauaaauaaacaaacaaauaaucuuucauauaauguuaaaaaggaaaggaaacagccuggaacuggcaaaaaucauuauuaguggcag

SEQ ID NO: 170922 - RNA, 66 nt, Homo sapiens
aucagcaaguucuguaaaaucugugguaacgguagcuguuaaagguaauaaagcuucaaucaaaac

SEQ ID NO: 170923 - RNA, 54 nt, Homo sapiens
ugcauguaaacaaucacauauauauaaagcuauauaacuguacauuuuugacag

SEQ ID NO: 170924 - RNA, 49 nt, Homo sapiens
aaaucugguggaaagaagucucuagaagccaaaaagacugggaauguca

SEQ ID NO: 170925 - RNA, 48 nt, Homo sapiens
uuaagaugcugcuuuggaggccacagagaaugaaccacuuaacaaggu

SEQ ID NO: 170926 - RNA, 46 nt, Homo sapiens
gugaugcuugucucuaauuugccuaauaaaggauauucuguagaag

SEQ ID NO: 170927 - RNA, 50 nt, Homo sapiens
aagcugcugagucuaugguaaaauuuuauaccugcuucccaguauugaug

SEQ ID NO: 170928 - RNA, 46 nt, Homo sapiens
uuaggaagcuauauuuauaaccuugguaaaagaaaaugacccagag

SEQ ID NO: 170929 - RNA, 46 nt, Homo sapiens
uuuaccggaagauggacuucaguguguacuuuguguuggacuucag

SEQ ID NO: 170930 - RNA, 102 nt, Homo sapiens
uuuaaggaaaaauaagacuuacgcaagggggaaagguaauauaguguagacagcauuaucuuacugggaaguuuagaccugaguuccuuuggcucugauuuu

SEQ ID NO: 170931 - RNA, 40 nt, Homo sapiens
gaaguuuucuauccuuuugacaauaacucgccauuaauuc

SEQ ID NO: 170932 - RNA, 45 nt, Homo sapiens
acgcauguaacacauuuuuauauccacucauccauugauggacag

SEQ ID NO: 170933 - RNA, 46 nt, Homo sapiens
aaucugcucagucaauguauagcuuucugaaacaaaauccacaaaa

SEQ ID NO: 170934 - RNA, 164 nt, Homo sapiens
auuuguuguuuuuguuguguuuuuuuuuagagacagggucuugcuauguugcucaggcuggccuugaacuccugggcacaagcuguuuucccaccucagcuuccuguguagcugguacuacaugcacuuguuuuguuuuguuuuaaagcacuugugguugccaa

SEQ ID NO: 170935 - RNA, 48 nt, Homo sapiens
uucuuuuuagguaagguucacuuauaaaauuuuaaaucauaaugcaug

SEQ ID NO: 170936 - RNA, 52 nt, Homo sapiens
gggguuaacuugacagaggagggaaaauauuggcuguaaucacaugagcgca

SEQ ID NO: 170937 - RNA, 49 nt, Homo sapiens
agaagaaaguacucccagcauucaaacagaaacuuugguacagcaggaa

SEQ ID NO: 170938 - RNA, 68 nt, Homo sapiens
aaaaugccgaggagugugcuuuaaaucagcagauguuuaacagugacuuggagaagaaaggggcagaa

SEQ ID NO: 170939 - RNA, 95 nt, Homo sapiens
guggacaaaaagaauauuucugaaaaaaaagguaacauggaugaaaaggaggagaaggaauuuaauacuaaggaaaccagaauggaucuucaaau

SEQ ID NO: 170940 - RNA, 49 nt, Homo sapiens
auagcaguuaaucauuaauaacauacuaaauguauaggagcccugguag

SEQ ID NO: 170941 - RNA, 53 nt, Homo sapiens
ugauaaauggaacagccuaauuagcuguuuacuuucuaacuauauuugaggug

SEQ ID NO: 170942 - RNA, 50 nt, Homo sapiens
cuccucgugguguugagggagaacuaucuuuugugacauuggaugagauu

SEQ ID NO: 170943 - RNA, 63 nt, Homo sapiens
gaacgcuugguaacuguggaugaaauuggagaaguggaagagcuaccuuugaaugagucagca

SEQ ID NO: 170944 - RNA, 46 nt, Homo sapiens
acccuucuacuuuaguuacuguagaugaaauacaagaugacagcag

SEQ ID NO: 170945 - RNA, 46 nt, Homo sapiens
cuuaauuuuguuacuguugaugaaguuggagaggaggaagauggag

SEQ ID NO: 170946 - RNA, 46 nt, Homo sapiens
gcuguggacacaaaaaagacaaaacuugaauccuugucccaagugg

SEQ ID NO: 170947 - RNA, 35 nt, Homo sapiens
aauuuuccaaagaaauguguacaaguuucacaguu

SEQ ID NO: 170948 - RNA, 46 nt, Homo sapiens
cuuauggaacaaauuagaaaaacauuuauggacauccugggaaaag

SEQ ID NO: 170949 - RNA, 46 nt, Homo sapiens
uacuagagcaauaaauuaggacuuucuuuuuaaagcuaaaacucca

SEQ ID NO: 170950 - RNA, 48 nt, Homo sapiens
agguaaagcaggauuguuggaaugggaaggaaaguuacacaacacagg

SEQ ID NO: 170951 - RNA, 45 nt, Homo sapiens
ggaaaugauccucgaaagguuuucugaccauguugcagcaucaga

SEQ ID NO: 170952 - RNA, 45 nt, Homo sapiens
uguauaaaagauucuaucugucuuguugcccaccgaauccucagg

SEQ ID NO: 170953 - RNA, 46 nt, Homo sapiens
uuauauugcaaauugcuuuuaacagaaauucauggccaagcaaaga

SEQ ID NO: 170954 - RNA, 44 nt, Homo sapiens
ugggggaaaggaaagaauucacuagaaauuuguuuaggguccag

SEQ ID NO: 170955 - RNA, 43 nt, Homo sapiens
uaacucuaugaaggcccuccuauaggaggucccaaucugauaa

SEQ ID NO: 170956 - RNA, 64 nt, Homo sapiens
gauuucuggaagucugggauguaguuagaagucagaucucuggggagaaggggaguggcaggua

SEQ ID NO: 170957 - RNA, 41 nt, Homo sapiens
aaauuuggacauggguuaggagcuuggcuaaugcaggacgu

SEQ ID NO: 170958 - RNA, 63 nt, Homo sapiens
gugggcuccucuggcucucaccacccacuccucggcccccaucuugcuccaggguuuccagau

SEQ ID NO: 170959 - RNA, 74 nt, Homo sapiens
aucuacagauaagggcuuggacuaacaugcugaauggggcaggcuggccaggccuugggggccacaguggggug

SEQ ID NO: 170960 - RNA, 29 nt, Homo sapiens
aguccuucucucaguccagucccaggucc

SEQ ID NO: 170961 - RNA, 31 nt, Homo sapiens
uucuccaucucacggugggcucugaggagcg

SEQ ID NO: 170962 - RNA, 45 nt, Homo sapiens
guuggggagaaugcuuuuguagaaacaaugauagggaaucugagc

SEQ ID NO: 170963 - RNA, 24 nt, Homo sapiens
caggcagcgggagggugggcggcc

SEQ ID NO: 170964 - RNA, 36 nt, Homo sapiens
aaagggagaggcagccccccgucccugagcgguggc

SEQ ID NO: 170965 - RNA, 48 nt, Homo sapiens
aggcgaggcacgagcggggaucaaagcgcacccacccccccccgaaag

SEQ ID NO: 170966 - RNA, 36 nt, Homo sapiens
gugcucgucugugugaguguguuugguggggagagg

SEQ ID NO: 170967 - RNA, 45 nt, Homo sapiens
ggaucugguuaccugcgcgggucgcccugcccggucccgccccgc

SEQ ID NO: 170968 - RNA, 48 nt, Homo sapiens
gaggagggggaccaacccgggcuagggggacugaguuguccccucggg

SEQ ID NO: 170969 - RNA, 55 nt, Homo sapiens
gagaauccagggcucuaggcuuucggggaaaagggucuauuuacuuauugggugg

SEQ ID NO: 170970 - RNA, 49 nt, Homo sapiens
cuauaaaggaacaaacaaacaaacaaacaaacaaaguugcaccccaguc

SEQ ID NO: 170971 - RNA, 45 nt, Homo sapiens
ggacaaaguuuuccaaaguuuuccgagugugaugguagcggggag

SEQ ID NO: 170972 - RNA, 45 nt, Homo sapiens
ggagggacugcucggagcuggaggaggggaccgcugaccugggaa

SEQ ID NO: 170973 - RNA, 44 nt, Homo sapiens
gugcggaaagggagcagagggaauuguuuccccgaaucuguagu

SEQ ID NO: 170974 - RNA, 41 nt, Homo sapiens
ggagcgcccucuaagcugcccuugaggacugggcacuggau

SEQ ID NO: 170975 - RNA, 51 nt, Homo sapiens
aaugaggguaagggaugagcacugccacccagaacuugauaagccaagaga

SEQ ID NO: 170976 - RNA, 78 nt, Homo sapiens
ccccagcugacccugcauuugugcauucuucuucaaagagagcauauguauuuuuuuauuaaccccugugcaguauuc

SEQ ID NO: 170977 - RNA, 55 nt, Homo sapiens
ggaugaaggauacuagccgcaagaacaacauguuugcacaguuucggaaaaauga

SEQ ID NO: 170978 - RNA, 45 nt, Homo sapiens
aguaccuccggguaaacccagugacugcucugacccugcuugaga

SEQ ID NO: 170979 - RNA, 47 nt, Homo sapiens
ucauacuacccuuugcuucccauggaaucuuugcagguuuucuggaa

SEQ ID NO: 170980 - RNA, 47 nt, Homo sapiens
acauaaaaacuaauuaguaaauagaauugaaaggaggaaaaugaacu

SEQ ID NO: 170981 - RNA, 47 nt, Homo sapiens
gaaugaaaaaagcaaguugcagaauauuauguauaaugucacauaug

SEQ ID NO: 170982 - RNA, 54 nt, Homo sapiens
auucccuugacuauacucgaugcuaaguauaucacgcauaccaugggcucagac

SEQ ID NO: 170983 - RNA, 50 nt, Homo sapiens
auuuucauuacauuuauaugauuuaggaauagggcaaggaagcaugguau

SEQ ID NO: 170984 - RNA, 41 nt, Homo sapiens
guuucauucugaggcagagggcuggaucuuagguucuagaa

SEQ ID NO: 170985 - RNA, 46 nt, Homo sapiens
uguaagguuaaaauccacagaaaaggaguuucuuaaugcuuaguga

SEQ ID NO: 170986 - RNA, 46 nt, Homo sapiens
auccuggaaaacaccuagucccuuagcuuugaaauagauggcaggu

SEQ ID NO: 170987 - RNA, 42 nt, Homo sapiens
ccaggcaguuagugaagauaggaugcauuucagguugagagg

SEQ ID NO: 170988 - RNA, 46 nt, Homo sapiens
uaagauuaugcuaccugaccacauaucaaauuuaccaugggaauua

SEQ ID NO: 170989 - RNA, 46 nt, Homo sapiens
ucuccucacauaccugauucauucuaacugcagaucagcugauaag

SEQ ID NO: 170990 - RNA, 47 nt, Homo sapiens
cauuaacaaugaccucaacuguuuguuuuaaagaguucacaacccca

SEQ ID NO: 170991 - RNA, 54 nt, Homo sapiens
cucucugucuucuauuugauuguuuuuuaaauccccuuuccccucuuuuuccag

SEQ ID NO: 170992 - RNA, 34 nt, Homo sapiens
cugcuuuuaaggauacccaucauuggguucaggg

SEQ ID NO: 170993 - RNA, 19 nt, Homo sapiens
aagaauaucuucaaucuag

SEQ ID NO: 170994 - RNA, 44 nt, Homo sapiens
auugcauuaacucuaagucuaaagucucaucuaaacaucaucag

SEQ ID NO: 170995 - RNA, 29 nt, Homo sapiens
uuuagccuuaaauuacuuaaaagacuaug

SEQ ID NO: 170996 - RNA, 72 nt, Homo sapiens
ccauuuaggugaggcuuaauacaaaggaaauucaauuuuauucauuuucugaucaucauaauuuuugaagau

SEQ ID NO: 170997 - RNA, 47 nt, Homo sapiens
aaaacccagagugauaaugcuauugagguacagaccauaaacuauau

SEQ ID NO: 170998 - RNA, 68 nt, Homo sapiens
gaagcauacuagguggauucacuuuuuuaccucccugauaaagcaauaggaacuugccacacccagac

SEQ ID NO: 170999 - RNA, 71 nt, Homo sapiens
gggcacuuauccaagaugaacuccuagugacccccuggcaccuuggcucaccucacugcacuucacagcca

SEQ ID NO: 171000 - RNA, 48 nt, Homo sapiens
uaauuggauuuaauucaggaaggggauguuuucuguacacaccaaaca

SEQ ID NO: 171001 - RNA, 41 nt, Homo sapiens
uaaguaccuucucaggccagccccugccugccuuuccaguu

SEQ ID NO: 171002 - RNA, 69 nt, Homo sapiens
aaaugguucaaguaacuucauagaacauguuugcaagcaguguuuugguaaacugaaaacugacuccaa

SEQ ID NO: 171003 - RNA, 43 nt, Homo sapiens
ugucagcaaauuauguuuucucccucuuuaaaauauaccagaa

SEQ ID NO: 171004 - RNA, 51 nt, Homo sapiens
aaguccaggaaccaggaauggguaaagguaugagguaggaccgauuaugaa

SEQ ID NO: 171005 - RNA, 66 nt, Homo sapiens
agucuaaccaaacgcuggcuugcccagcacuuuccgcuucauccuuggaggcagagcccuacuacu

SEQ ID NO: 171006 - RNA, 40 nt, Homo sapiens
uuugcagaugcagagccacugcauguccugcagaccauau

SEQ ID NO: 171007 - RNA, 23 nt, Homo sapiens
gagaaguguggggguagguagca

SEQ ID NO: 171008 - RNA, 50 nt, Homo sapiens
gaacuacuuaugaagcucaaauuucuacagauucucaauuuaggguaggu

SEQ ID NO: 171009 - RNA, 47 nt, Homo sapiens
agaaggaagcaugguuauucucucuaguuugugguuuuggucccuau

SEQ ID NO: 171010 - RNA, 42 nt, Homo sapiens
uggauauagggaacagggugagcgggggccuagugagggaga

SEQ ID NO: 171011 - RNA, 24 nt, Homo sapiens
gacauaaguuuucaacucauuuga

SEQ ID NO: 171012 - RNA, 48 nt, Homo sapiens
uuucuacuuuggaaaaauaauuauagcaaaagggugauaaauccauag

SEQ ID NO: 171013 - RNA, 45 nt, Homo sapiens
aauagaaauagauuguccuuuaaaaccuggaucuucaauuuagua

SEQ ID NO: 171014 - RNA, 32 nt, Homo sapiens
cuuuaaaagaaagaacucuauucuaugucuuu

SEQ ID NO: 171015 - RNA, 45 nt, Homo sapiens
caauaccacugguuaaauaacaaagucuggugaacuuuugcgaau

SEQ ID NO: 171016 - RNA, 51 nt, Homo sapiens
gcacugugaugaaguuuccucuuuuacagcuccuuuuugggccauucagaa

SEQ ID NO: 171017 - RNA, 40 nt, Homo sapiens
cgggaagcucacuggcauggccuucuguguccccacugcc

SEQ ID NO: 171018 - RNA, 51 nt, Homo sapiens
cugucccugcuuuuccaguuagcaauuuuauaauuucauauguccacagca

SEQ ID NO: 171019 - RNA, 45 nt, Homo sapiens
aaaguuuccuuucucugaauuugugccaaaaguuuacaaccaaau

SEQ ID NO: 171020 - RNA, 48 nt, Homo sapiens
auauuuaaauuaaauaugaauuuaguaaaucaaguagccagugaauug

SEQ ID NO: 171021 - RNA, 42 nt, Homo sapiens
agagaugaugggcaaauauguuuaacaguuugcuucaaagau

SEQ ID NO: 171022 - RNA, 68 nt, Homo sapiens
auggagcuuuuaguggaaaagcuuuccugagaauaguaauuugaaaugaauaggugucauuuucaaau

SEQ ID NO: 171023 - RNA, 36 nt, Homo sapiens
gguuuaaaucuucacauucacguacaguuuagauuu

SEQ ID NO: 171024 - RNA, 44 nt, Homo sapiens
uugaacucaguggacccccuacuccuucacauaggauucagugu

SEQ ID NO: 171025 - RNA, 143 nt, Homo sapiens
aauuuuuuuauuuuuauuuuuugagacagcgucucacucugucgcccagguuggagugcaguggcgcgaucuuggcucacugcaagcuccgccucccggguucacacacuuauuuauuuuuuacuugugucauccagcaguuu

SEQ ID NO: 171026 - RNA, 40 nt, Homo sapiens
aaacucuuggguuuuucugaauaccauccaaucuccaaau

SEQ ID NO: 171027 - RNA, 61 nt, Homo sapiens
acucuguaucucccuguguuuuaaaaugaaggcauuaugucuugccccuccugcccaucug

SEQ ID NO: 171028 - RNA, 50 nt, Homo sapiens
uccuuguuuaaaaaaacacuuacugaauuucucuucuucaugaaaucaau

SEQ ID NO: 171029 - RNA, 47 nt, Homo sapiens
gaggaaauguuuaacuauucuaaucauguuucuguaucucagaaaga

SEQ ID NO: 171030 - RNA, 51 nt, Homo sapiens
guaaauagacaguuaauacauuguuaaccugaaauaaaguuuguacuagaa

SEQ ID NO: 171031 - RNA, 46 nt, Homo sapiens
cccacugugacguucugaccuucauucuugucauucuucaacagac

SEQ ID NO: 171032 - RNA, 48 nt, Homo sapiens
aauuuuugugccaugcuccuucuuugccuuguccugugagguccagag

SEQ ID NO: 171033 - RNA, 72 nt, Homo sapiens
cugucagauacuguggcuuaugggcuagacauagucugugcccuuggauaauacaguaccugaagagauggu

SEQ ID NO: 171034 - RNA, 45 nt, Homo sapiens
agaggaaaucuaagaaagaugcauauauaaucuuugauacagaga

SEQ ID NO: 171035 - RNA, 57 nt, Homo sapiens
aauagaauauucuauuuaacuugguuucugaaaggcuuggaggauauugugucuuau

SEQ ID NO: 171036 - RNA, 23 nt, Homo sapiens
uuacuauguguaugccacuuucu

SEQ ID NO: 171037 - RNA, 62 nt, Homo sapiens
aacuucuaauggguagaaaagcacucaagucaagucuuuuauaaguuuuuauugggccaaau

SEQ ID NO: 171038 - RNA, 105 nt, Homo sapiens
aguaaccugaugucagguuauauuaugugaugcuuccaggccuguucagaacugguugcugaugguagcuggaauaagaggugaaacagaggauuuaaguggagc

SEQ ID NO: 171039 - RNA, 50 nt, Homo sapiens
guuauaucagaucuguuauaucauuuuuuuuuggugcaaacauaugagga

SEQ ID NO: 171040 - RNA, 44 nt, Homo sapiens
uauggcacuuuuuacagaacagguaauagagauguucucuguau

SEQ ID NO: 171041 - RNA, 55 nt, Homo sapiens
cuucauugguggauaaagauaagacauuuaaaaaucacauauguagacagauggu

SEQ ID NO: 171042 - RNA, 47 nt, Homo sapiens
uucaaaggguuauuauaaaugguuucuuaauauugugugucucaguc

SEQ ID NO: 171043 - RNA, 48 nt, Homo sapiens
auuuuuuguuaacuuuguacucuuuuucuucuuauagaaaggcugcuu

SEQ ID NO: 171044 - RNA, 51 nt, Homo sapiens
gauauuaagggggaauaaaagagccauaagggaaaaguguagugggugggg

SEQ ID NO: 171045 - RNA, 41 nt, Homo sapiens
aguggguuuaagauugugaauaaugcuagcucucaggggga

SEQ ID NO: 171046 - RNA, 38 nt, Homo sapiens
ucaagagaauacauuacauuugggaucuuggacaaaag

SEQ ID NO: 171047 - RNA, 25 nt, Homo sapiens
aggaguugcugaaaucuuguuagac

SEQ ID NO: 171048 - RNA, 53 nt, Homo sapiens
aauagcaaauaaacacaaacauccuaggcaguuccuagugaaggugaucagaa

SEQ ID NO: 171049 - RNA, 42 nt, Homo sapiens
aaaaaacaauauaaaaacaaaaaagggguuuucucccauuua

SEQ ID NO: 171050 - RNA, 50 nt, Homo sapiens
uuaaaacagauaaagcacagauauuacuuuauguaauugcggguccauag

SEQ ID NO: 171051 - RNA, 230 nt, Homo sapiens
uucuaaguuugcugauacuuauuauaccuuuuuccuuuuuuuguuuuuuuuuaaauauaaaaauaaagauaggguuucaccauguugcccaggcuggucuugaacuccugggcucaagggaucugccugccuuggccuccugaagugcuggauuacagaugcgagccauugcacacugcugauacuuacucuuugcuauccuacacucauucccccaucuguguacaacu

SEQ ID NO: 171052 - RNA, 47 nt, Homo sapiens
uuaagcugcugaaaugccuuuuaggcauuguuuaugagucugcacuc

SEQ ID NO: 171053 - RNA, 57 nt, Homo sapiens
uuagucauagcuggaaugagaagcuuagcaauacuccacuggauauuuuauguaugc

SEQ ID NO: 171054 - RNA, 46 nt, Homo sapiens
cagaaaaauaagugcucugaacaaaagcaacuucuuugggcaagcc

SEQ ID NO: 171055 - RNA, 32 nt, Homo sapiens
uuuauguuauuauugacauuuuuggaaguagg

SEQ ID NO: 171056 - RNA, 45 nt, Homo sapiens
cacuugcagaauacuaggugacaaaguagcucuggggcagguauu

SEQ ID NO: 171057 - RNA, 43 nt, Homo sapiens
uuugaaauuuauuucuggauuucacuuauuauggaauugauuu

SEQ ID NO: 171058 - RNA, 113 nt, Homo sapiens
ccuguguaaauuucugcaguucuuuuucugcauugcucuuuuuuuggggaacucugccacacaacuucaagcugaaucaacuuuccugagcuacuaucacugauucuuuaagu

SEQ ID NO: 171059 - RNA, 46 nt, Homo sapiens
aucaagugacggauacuaauagaaaacuacaacaugagggaaagga

SEQ ID NO: 171060 - RNA, 42 nt, Homo sapiens
auggacguuucauggagaagcuugaaacucguauccguaauc

SEQ ID NO: 171061 - RNA, 45 nt, Homo sapiens
ccuuuauuucaaaggaaggagaaugaauccagauugcucugccuu

SEQ ID NO: 171062 - RNA, 23 nt, Homo sapiens
aauaacuauucugcuaggauuau

SEQ ID NO: 171063 - RNA, 43 nt, Homo sapiens
uuuuagauaauuauugaaaauuagacuuguaguuacacugaau

SEQ ID NO: 171064 - RNA, 44 nt, Homo sapiens
acuagguuuaacucuguuaucuugcuguuuguuuuuuguuuguc

SEQ ID NO: 171065 - RNA, 406 nt, Homo sapiens
aauaucauaaacagguaugcagaagaccuggagagguauucauuuauuuauuuuuauuuuaaauuuuuuuuugagagaggguguugcucuguugcccuggcuggaguguacuggagcucacuacagccuugaacucuuggccuaaagcuauccuccugccucagcauuccaaguagcugggacuacaggcaugugccaccaugcccggcuaauuuuuuaaaaauuuuucuuccuaaauggaagggaccuuaucaagucccuuuuuuuuuguagugauggggucucaccauguugcucaggcugguauugaacucuugggcucaaguaauccucccaccuuggcuucccaaagagcuuggauuauaggugugagccaccacaccuggcugggaguaucaguuuagau

SEQ ID NO: 171066 - RNA, 34 nt, Homo sapiens
ccauaaauuuggcugcuuguuuagauaaaaagaa

SEQ ID NO: 171067 - RNA, 34 nt, Homo sapiens
uaguucuuagucuguauucagaaugcucuuagaa

SEQ ID NO: 171068 - RNA, 41 nt, Homo sapiens
uuguauacuaguuuuuguagagacauauguuuucauuuuug

SEQ ID NO: 171069 - RNA, 30 nt, Homo sapiens
uauccuuaguaguuugccuuuugucucuuu

SEQ ID NO: 171070 - RNA, 44 nt, Homo sapiens
aacuauccuacccuccuugcacagucuugggucacugccccucc

SEQ ID NO: 171071 - RNA, 42 nt, Homo sapiens
cguauuagguagguucuauuacucuccuuuuacagacagggc

SEQ ID NO: 171072 - RNA, 32 nt, Homo sapiens
gcggcagagcacgagcggauccugcgagagau

SEQ ID NO: 171073 - RNA, 46 nt, Homo sapiens
cgggggccuacgggucccggccccggucacuauggacaguuuuuuc

SEQ ID NO: 171074 - RNA, 393 nt, Homo sapiens
cacagccugguagaaauaacagugaguaugccugagcguguguacggggcugggcagcgggggaugucaccaacccgccgucacguguaaccuugggcggacgggucauuuacacguccaccuccgucucuucucucagaacaccugggacgcucugccgugggccccgcccaacacaucuggggcagggaucucgccacccccuuuggcugugcgugcgaggcccccucuccugcgggaacagcgaagcagcccuccgcccacacccacgccuugaaacccuccgcauucccgccucacaucccuaccucuuaccgccccaguaccacccucagccucucccuucacuaauaccgaagaaaaaacuguccauagugaccggggccgggaccc

SEQ ID NO: 171075 - RNA, 288 nt, Homo sapiens
gagcacgugcuggcacuaaccauggugaggggcaggggagugggguuuuaaugaauaagcccaggcaggcaauauaggucucuacccaaccuccggauccccuuuacuuggagacacauccucagccuaaccccccggcaugggcggcuccccuggccaggugaaccgggaccucugaggcugggcaggugcuaggguagaugccuuuaguuguggugucaacccucacuugaggagacccugaggcccuguguaccguucccagcucugccucaccgagggagccaa

SEQ ID NO: 171076 - RNA, 172 nt, Homo sapiens
ucgcagucccuguggccaaccucaagcuguccugccaacccauggugaguuccccagcucugccuuggugguggugguggugguggugaggggauugaggacguuagcacucauuacaguguggggugggcuaggagugggccaggccuucauccuugucuuccucccagcu

SEQ ID NO: 171077 - RNA, 45 nt, Homo sapiens
cuggugccgcccagugauccgcacagggccagagcccgacuucag

SEQ ID NO: 171078 - RNA, 450 nt, Homo sapiens
uuggugagaagaggggagggcccucuccuuugcuuccaguggacucucccaucaggcuucccccacuccgcacuccugccccaucccacccucaucucccagugcagcccuguacaggucugugugcccuccacgcugugcccugugcaugacaugcccucuccuuuccgucuacucaagccuaccuccuccauggaacauggcccaacuucuccagcuccaauaaugaagacuccuuuggcucuuugugacccaguuuagggucugagguucuucccaccuagcccauaagcacugggaggucauggucccuguaagccuaacaccacggcgugaagaaauggcaugcggugugaaacggucuggucuuaacaccccauccuucuacugcuuguguguccaccaguuacgaugagcaaugauguuucugaggaggagagcgaggaagag

SEQ ID NO: 171079 - RNA, 103 nt, Homo sapiens
uaaaugcugauuccuuguuuccucuuuucaggucagcuccaugugccaugcaccgccaugcacccuguucccugacaaguuucaacaauuguaaauauuucuu

SEQ ID NO: 171080 - RNA, 44 nt, Homo sapiens
gugguuuucugauuuucaccaugcccggggccucccuucccacc

SEQ ID NO: 171081 - RNA, 65 nt, Homo sapiens
cuucucauucugcagcuugggauggcuagguuccccagcugugucuuuccgcagagcuggggaag

SEQ ID NO: 171082 - RNA, 83 nt, Homo sapiens
ucuuggggauguguccaaaggcuucguggaccugagugacuccacucaagugaacaacuacugggcacugaacuugaccucca

SEQ ID NO: 171083 - RNA, 53 nt, Homo sapiens
cccugcaaccuuucaaaggcugggcgcuguacugugcaggaaaggcugcucgu

SEQ ID NO: 171084 - RNA, 46 nt, Homo sapiens
guaggugggaaguccugccgucccuguccuccagaacccacuggug

SEQ ID NO: 171085 - RNA, 30 nt, Homo sapiens
ccuuccacaaauagccccugagcuguagcu

SEQ ID NO: 171086 - RNA, 49 nt, Homo sapiens
aacuuaagaaagacggcaacaccugaugagcccaggcaggcaaccaggg

SEQ ID NO: 171087 - RNA, 46 nt, Homo sapiens
acuguggccaccauccuagccaucaacaugaugcuugcagucucag

SEQ ID NO: 171088 - RNA, 113 nt, Homo sapiens
gggaguggagagcucguuuugccuguagucuuuuuuuuuuuuuuuuuuguaacuuaaagaccagugugauaguaugccuguaguuucugauauagaagaugccuugugcagua

SEQ ID NO: 171089 - RNA, 90 nt, Homo sapiens
aaaaagcggugcuuauaaaucaaaugcaugaauugcuacugcacaaggcaucuucuauaucagaaacuacaggcauacuaucacacuggu

SEQ ID NO: 171090 - RNA, 45 nt, Homo sapiens
agccaauucaacaacacuuggaaaacaggagaaagaggcugagga

SEQ ID NO: 171091 - RNA, 121 nt, Homo sapiens
cuuucuccuguuuuccaaguguuguugaauuggcuaucuuggcuacaacuggggagaugguugugggugggcagcauugggaggaagccucaggcagaggaagggccccuauaaguuccug

SEQ ID NO: 171092 - RNA, 42 nt, Homo sapiens
gugacccuuaaguauguuuguucacugcaggcgaaggacaag

SEQ ID NO: 171093 - RNA, 83 nt, Homo sapiens
ugaagaggaggaaauuguccauaaacuucugggagacaaauucaagguuauuauucucccguggccugucuccuucccucccc

SEQ ID NO: 171094 - RNA, 36 nt, Homo sapiens
aggacucgucauaggauagcagugggcaaaucaggu

SEQ ID NO: 171095 - RNA, 49 nt, Homo sapiens
ucaggacaugggcaguuucacacugcucucugauucugcggccccauuc

SEQ ID NO: 171096 - RNA, 53 nt, Homo sapiens
guuaugaaagcuguauaauuacaaauuauguugaaaguccccauuuauuaaaa

SEQ ID NO: 171097 - RNA, 73 nt, Homo sapiens
uccccacucgccccuccccgcccacuagcgccgacccaggugacuuagggugcgaccagaagggacagcuaag

SEQ ID NO: 171098 - RNA, 42 nt, Homo sapiens
caggccuaagaugcccgacaugagguugaagagugccuccgg

SEQ ID NO: 171099 - RNA, 50 nt, Homo sapiens
ugugcauguuucuaugugcuccuugggacguaugcgggccccugcugaau

SEQ ID NO: 171100 - RNA, 45 nt, Homo sapiens
ugcggaggcgcuggcggcccagugugggugggaaugggggugcgc

SEQ ID NO: 171101 - RNA, 40 nt, Homo sapiens
ggcgaacguggacgacguaguggucguggaggagguggag

SEQ ID NO: 171102 - RNA, 45 nt, Homo sapiens
guuuccucccccucgguggguccugggccuuuugaacucccguag

SEQ ID NO: 171103 - RNA, 38 nt, Homo sapiens
gggagacagugaacagaugagcuugacugaauugcagg

SEQ ID NO: 171104 - RNA, 46 nt, Homo sapiens
aggcuuugugugcuaugccaaggauuuaggggcuuuaucucuggag

SEQ ID NO: 171105 - RNA, 51 nt, Homo sapiens
ggagaccauugcagcauugcccggcaaaagaugaugaaaguuuggaauagg

SEQ ID NO: 171106 - RNA, 56 nt, Homo sapiens
gccagauuuaugguggaggugguggcugugagugggugguggaauugguuggguga

SEQ ID NO: 171107 - RNA, 46 nt, Homo sapiens
ucaagaaauggacucuucccaaaccuuggauacaucccagacuagg

SEQ ID NO: 171108 - RNA, 94 nt, Homo sapiens
gcugcuuuccucuguuuaguauggaacugauuuauuagcucuuuauaaaagauaaacuuuaaguacuuuuaaaaucauuaagggauucaauuau

SEQ ID NO: 171109 - RNA, 54 nt, Homo sapiens
aauuuuagguccacauuuuaagaaagguugacaaaauuagaguaccuuuguggg

SEQ ID NO: 171110 - RNA, 46 nt, Homo sapiens
agaaauaauuuaguaucuucagaagugcaacccagauucuuagaaa

SEQ ID NO: 171111 - RNA, 50 nt, Homo sapiens
caucaauaaauauuuaacagaugacagccgagagagagccaaaaaaucca

SEQ ID NO: 171112 - RNA, 45 nt, Homo sapiens
aaacauccaugcuaucagucuacuccugggguguuugaaccagca

SEQ ID NO: 171113 - RNA, 47 nt, Homo sapiens
aguauuaacuucagaaucuuugguuuuacaagauuuaaagcagccaa

SEQ ID NO: 171114 - RNA, 48 nt, Homo sapiens
gccuaaaugaaaaugcuguuguaugcagugaaagaguugcugaacuac

SEQ ID NO: 171115 - RNA, 46 nt, Homo sapiens
uucauuuuuauugccuucauuuguuccacauaagccaacaagagag

SEQ ID NO: 171116 - RNA, 45 nt, Homo sapiens
uuuuuaccaacaagaguucgcagacagucaucaaacugaagagac

SEQ ID NO: 171117 - RNA, 57 nt, Homo sapiens
ucuaauucucacucacauagcgagaaaucuaguguuuucuaccagcaagaguugcca

SEQ ID NO: 171118 - RNA, 42 nt, Homo sapiens
cugcuccuggaccagcugaccagaagacugagacauuaccag

SEQ ID NO: 171119 - RNA, 49 nt, Homo sapiens
ugaagaagcuuuaaauguuuuuguuguuccuggacaaggugaccggaag

SEQ ID NO: 171120 - RNA, 46 nt, Homo sapiens
uuacucacauggugagaaucacaagcuuguuucagaacauguccaa

SEQ ID NO: 171121 - RNA, 45 nt, Homo sapiens
ucugcagguuuuagagauguuggcucugaagaaauccaggaugca

SEQ ID NO: 171122 - RNA, 46 nt, Homo sapiens
ggaaagcccaagcagcaggugcauacagaaggauauuggcacacag

SEQ ID NO: 171123 - RNA, 46 nt, Homo sapiens
ugugaauccucacugaaucaugcuaaagaaauacucagaaaugcag

SEQ ID NO: 171124 - RNA, 87 nt, Homo sapiens
aauuuagcacaugauuguggauacuccauuucagaauuaaaugaagaugacaggaggaaaguagaagagaucaaggcagaguuauuu

SEQ ID NO: 171125 - RNA, 42 nt, Homo sapiens
auuaugaaagcuugaaagaugcaaugggaggagguagagcau

SEQ ID NO: 171126 - RNA, 46 nt, Homo sapiens
aaguggauuuucauucuucaucacaaaugccguccccagaacccau

SEQ ID NO: 171127 - RNA, 71 nt, Homo sapiens
uaacuccagaucuuccuucuugcauuuuucuugaacaacgagagcucuuugaacaaagcaaagccccacgu

SEQ ID NO: 171128 - RNA, 46 nt, Homo sapiens
uuucuugaacaacgagaacucuuugaacagugcaaagccccauaug

SEQ ID NO: 171129 - RNA, 72 nt, Homo sapiens
gauuucucugaguggagguugugucuggcuaauuacuagaagucuuucaaggaauaaauguguuaaguaaga

SEQ ID NO: 171130 - RNA, 51 nt, Homo sapiens
auuacgaauuuauuuacuguguuggacauaugcugaagaucuccuuuggag

SEQ ID NO: 171131 - RNA, 41 nt, Homo sapiens
aaggaggaagaaagaaauguuuauucauaaucuacaugugg

SEQ ID NO: 171132 - RNA, 87 nt, Homo sapiens
ugauguguccacaauauauuccuauagcuacuuaaauauuccuugaaaccacuuuuggaaagagauuucagucucuaauggccaagg

SEQ ID NO: 171133 - RNA, 43 nt, Homo sapiens
gcuuuguauacuuuguagcuuuuucuccccuuuucauccuaaa

SEQ ID NO: 171134 - RNA, 63 nt, Homo sapiens
aagugcuaaucacuggggaugagaaccucucagacaaaaaacagcaagagauucacaguacaa

SEQ ID NO: 171135 - RNA, 73 nt, Homo sapiens
agugcugcugcugcugcagagcacucagcucaaguaggagacccagaaaugaagaacuugccagacacuaaag

SEQ ID NO: 171136 - RNA, 57 nt, Homo sapiens
uucagcaucauccagacaaacauagagaacacaugugucuuccucuuccuuaucaaa

SEQ ID NO: 171137 - RNA, 46 nt, Homo sapiens
aauuugggaaacaaagaagugauggauacuacuaaaagucaaguua

SEQ ID NO: 171138 - RNA, 56 nt, Homo sapiens
gaaaguacacaugaugauagcagaggggaacgaagugugaaggaauggagugguag

SEQ ID NO: 171139 - RNA, 59 nt, Homo sapiens
acaacagcagagaaauaagcuucagaaaaagaagcgguuuaaaagccuagagaaaagcc

SEQ ID NO: 171140 - RNA, 127 nt, Homo sapiens
ucucaucaucgagcugggaggucuaaucaaauuaaaauugaacagauuaaauuugauaaauauauucugaguaaacagccagguuuuaauuauauaagcaacacuucuucggauugucggcccucag

SEQ ID NO: 171141 - RNA, 46 nt, Homo sapiens
cuuuccggcaccacuucuacugucgaaucagauauauugacccaaa

SEQ ID NO: 171142 - RNA, 49 nt, Homo sapiens
uguucagacaauuuauuauaaauauuauuucuccucauugagcuuuugg

SEQ ID NO: 171143 - RNA, 82 nt, Homo sapiens
uaaauaauagaguaugcuuuuuuucuaaaguaagugaagaauugggaaugguacagaguaaggcuuuuguuccauaggggag

SEQ ID NO: 171144 - RNA, 35 nt, Homo sapiens
acacaguguuuugaauauucauccaugacauaaca

SEQ ID NO: 171145 - RNA, 53 nt, Homo sapiens
aaugcugggccauaugguaauucuguggauuagcuuauugaggaacugccaga

SEQ ID NO: 171146 - RNA, 52 nt, Homo sapiens
uguauaaggguuccuccaacccuccuccuuuuuuccacagcgacugcuuuag

SEQ ID NO: 171147 - RNA, 50 nt, Homo sapiens
ccguucaaaacaacugaaauaacauauggacaccuuauaaaaauugacag

SEQ ID NO: 171148 - RNA, 59 nt, Homo sapiens
uguuugaauuuuggauucacucaaaauuauuuguucucugcaaucuuuacuucuucaca

SEQ ID NO: 171149 - RNA, 48 nt, Homo sapiens
uaccaaaauaaauuuuucaagaaccuguuaugcaggcacaguacauug

SEQ ID NO: 171150 - RNA, 71 nt, Homo sapiens
uuaaauguaugucacagcauuauuuuuuggacagacacuuggucauugugucaccccuuggugaugaguaa

SEQ ID NO: 171151 - RNA, 46 nt, Homo sapiens
cucugacuguuuuaucaaugugugucucugguccuaagccugagug

SEQ ID NO: 171152 - RNA, 46 nt, Homo sapiens
aguuuccugagcucaaacucuacuuuuugcaacaagcagaauguac

SEQ ID NO: 171153 - RNA, 62 nt, Homo sapiens
ugcuuaaaugugcaaaacgaauucucuggaaccauaugggguugugaacagaauaaauggag

SEQ ID NO: 171154 - RNA, 41 nt, Homo sapiens
uguugggauaacuuucccaacuccaaguuccagcgaggcua

SEQ ID NO: 171155 - RNA, 45 nt, Homo sapiens
ccugaggacagaaaguuaaaaaagaacaagaagaauucccaugaa

SEQ ID NO: 171156 - RNA, 44 nt, Homo sapiens
gaaguuaauaguccaggagaggaagcugcagagcauguuacaga

SEQ ID NO: 171157 - RNA, 44 nt, Homo sapiens
gaagaacaagccuaucagcaagaaggaaaugauucagaggucca

SEQ ID NO: 171158 - RNA, 70 nt, Homo sapiens
ccaccaaguggucgggagcucuggcuugcacccagaauaaauguauuauacucaaguuuaaacauuauga

SEQ ID NO: 171159 - RNA, 36 nt, Homo sapiens
aaaacugguaauacugauugccuuuggaaaggauaa

SEQ ID NO: 171160 - RNA, 43 nt, Homo sapiens
aaggauuuaugagcagcuuccagaaguacagaaaaagagagaa

SEQ ID NO: 171161 - RNA, 49 nt, Homo sapiens
cuccuuaugcuacuguaugugggaacugauggauuaucugugucucuau

SEQ ID NO: 171162 - RNA, 40 nt, Homo sapiens
uuguugucucaaaccugggucugcaaagaacccagggcaa

SEQ ID NO: 171163 - RNA, 38 nt, Homo sapiens
cagcccuucucacugcagagacagguuccucuccuuga

SEQ ID NO: 171164 - RNA, 45 nt, Homo sapiens
ugcuugcugcuacagcugaauggauucuauucugaccaauacaca

SEQ ID NO: 171165 - RNA, 60 nt, Homo sapiens
ggagcucuggcuugcacccagaauaaauguauuauacucaaguuuaaacauuaugagaaa

SEQ ID NO: 171166 - RNA, 28 nt, Homo sapiens
agcaggcugcauugugaacggggcaggg

SEQ ID NO: 171167 - RNA, 44 nt, Homo sapiens
aagcuuugcccuuucuuuuguuaaccuuggccaugacuguccag

SEQ ID NO: 171168 - RNA, 36 nt, Homo sapiens
gguugaaaaauggguuaaaguaggcagcuacagcau

SEQ ID NO: 171169 - RNA, 42 nt, Homo sapiens
ccauccauccauccauccauccuacugguucuaucauucugg

SEQ ID NO: 171170 - RNA, 44 nt, Homo sapiens
aagcauucuucuggagcaaguuucuuuucaaaacucugucacag

SEQ ID NO: 171171 - RNA, 45 nt, Homo sapiens
ucuucuuggcugaggagcguccugaaaagucgcgucuccggcccc

SEQ ID NO: 171172 - RNA, 43 nt, Homo sapiens
gaugaugacccuuuuggcuccccccugcaaaugaggcccagcc

SEQ ID NO: 171173 - RNA, 43 nt, Homo sapiens
ugguuguugagggcaaugacagccccagcauugaagguggaag

SEQ ID NO: 171174 - RNA, 47 nt, Homo sapiens
gcauuucucgaguguguuuggcacaaagauaaagucaacucuccuag

SEQ ID NO: 171175 - RNA, 26 nt, Homo sapiens
uuaauaccuuucucuuccucguaggu

SEQ ID NO: 171176 - RNA, 47 nt, Homo sapiens
aagcccuuccucacuuuggcaaaauuaacaggauuuaucaaccuuuu

SEQ ID NO: 171177 - RNA, 39 nt, Homo sapiens
acuuuuuaggauucuuauaaauuaaaauguggaaguaaa

SEQ ID NO: 171178 - RNA, 52 nt, Homo sapiens
uuugaucccuuuaugaaccuugugauagaugaauguguggagauggcgacua

SEQ ID NO: 171179 - RNA, 42 nt, Homo sapiens
auccuuuuugagcuuuauucugcaauagaggcucauaguugg

SEQ ID NO: 171180 - RNA, 49 nt, Homo sapiens
cccauguccucucuccauagggccuguuuuacuaugauguaaaaauuag

SEQ ID NO: 171181 - RNA, 61 nt, Homo sapiens
agaaucuuauuaaaugugaaacauggcaaggauuccuucuguccaucaucuuucaacacug

SEQ ID NO: 171182 - RNA, 46 nt, Homo sapiens
uggcacucaucuccauggcacuugcugcacacucuaugccauugag

SEQ ID NO: 171183 - RNA, 46 nt, Homo sapiens
auagugaggauaugcaagccauggcuucuucacagcauaaucauag

SEQ ID NO: 171184 - RNA, 45 nt, Homo sapiens
agugguuaaaacuguauuaaggccaaauuuaucuaugggucuaga

SEQ ID NO: 171185 - RNA, 40 nt, Homo sapiens
cauuguucccgcugggccgggcgguuuaguguaauugccg

SEQ ID NO: 171186 - RNA, 41 nt, Homo sapiens
gggagcuggaccuggaggcgccgccgcgacagcagcagcca

SEQ ID NO: 171187 - RNA, 46 nt, Homo sapiens
uuccagagaugugacagaagcucuaauucugcaacucuuuagccag

SEQ ID NO: 171188 - RNA, 57 nt, Homo sapiens
uauauguggugucaacugguuggcuaauaaauucagcucuuacaauuaaauuggaaa

SEQ ID NO: 171189 - RNA, 69 nt, Homo sapiens
uauuuuuaaaggucaucauucaaguuuuucuuguauuuaggcaauuccuauuuaugagacaauguauua

SEQ ID NO: 171190 - RNA, 46 nt, Homo sapiens
cagguucuauuuaucacauagccucaccuaccuggaacaccagcag

SEQ ID NO: 171191 - RNA, 62 nt, Homo sapiens
cucuucaguuuucagagccuauuuaccuauauuuuaaaacagguuuaagaagguuggcuaag

SEQ ID NO: 171192 - RNA, 58 nt, Homo sapiens
gcagcaaggagcaauguacauuuguagcaguaaaaaguaacuuauaacagggagggga

SEQ ID NO: 171193 - RNA, 45 nt, Homo sapiens
ggguaagguaagcugucguaauuaaagaaggugacuugcacugaa

SEQ ID NO: 171194 - RNA, 47 nt, Homo sapiens
uuuaggaagucaaagugaauugggcaacaaccccuagcagucaaaag

SEQ ID NO: 171195 - RNA, 46 nt, Homo sapiens
guucacaagguaauuguaucuucuuaaacauaaaaugaaaucucuu

SEQ ID NO: 171196 - RNA, 45 nt, Homo sapiens
aaauuacaacugaagauauaaaagcugcuuuugcaccauuuggaa

SEQ ID NO: 171197 - RNA, 45 nt, Homo sapiens
acauuaauuuuauaacuugaauauaauguauuacauuguuuagag

SEQ ID NO: 171198 - RNA, 47 nt, Homo sapiens
ugccuuaauaauauuuuaugaagcacugccuugcuugcacuuguuau

SEQ ID NO: 171199 - RNA, 69 nt, Homo sapiens
uuuaaaauuuugaaaagcaugccauauuagaguaagaauaacaaguuguuuacaguacuuucuguagag

SEQ ID NO: 171200 - RNA, 40 nt, Homo sapiens
aaaucucuaugcacaauuuuguguuuucauuuuggugugg

SEQ ID NO: 171201 - RNA, 54 nt, Homo sapiens
aaguuuaaaaaguuuuuugaagagagaggcaauuucuguacaauauaaauauac

SEQ ID NO: 171202 - RNA, 45 nt, Homo sapiens
aauugacucaugcucacacaguggauuuuaaaaugcuccgagaaa

SEQ ID NO: 171203 - RNA, 44 nt, Homo sapiens
guaucgaguggcaggguaugaaacccagugaauaaggacuccag

SEQ ID NO: 171204 - RNA, 46 nt, Homo sapiens
cguuguuuacuuaaagauuuaucaaaucagucagugcaaaugucag

SEQ ID NO: 171205 - RNA, 44 nt, Homo sapiens
ggaguucauugugaccuccaaauuuugccugaaggaccagcugg

SEQ ID NO: 171206 - RNA, 46 nt, Homo sapiens
ucauuauuuugauucguuugguaccuguuuuccuggaguucccgau

SEQ ID NO: 171207 - RNA, 46 nt, Homo sapiens
uguguauuuuuaaguguugauacauuaaaagucgcuuuauggaaga

SEQ ID NO: 171208 - RNA, 58 nt, Homo sapiens
aaauuuuuuaaauacuuggaaauuuuauuuccuuguuaacuucuacagaucagggcau

SEQ ID NO: 171209 - RNA, 49 nt, Homo sapiens
ugagcaaggaccggggcggcgguggggcagggguguagagcucggguuc

SEQ ID NO: 171210 - RNA, 46 nt, Homo sapiens
cacguuugugaguuaccugcuggcugugacgcuuccgucaaaucug

SEQ ID NO: 171211 - RNA, 39 nt, Homo sapiens
uguuuucaccugaucauuagaaacuaaugaaacaccuuu

SEQ ID NO: 171212 - RNA, 29 nt, Homo sapiens
aacaguugcuagauaauucaaaugaaaag

SEQ ID NO: 171213 - RNA, 40 nt, Homo sapiens
aaaaaaacggcuccccaacuccaccacagguacaggauuu

SEQ ID NO: 171214 - RNA, 51 nt, Homo sapiens
uccccucguacugggccagccugaaaguguaagucccacaucuggguccuu

SEQ ID NO: 171215 - RNA, 40 nt, Homo sapiens
agcuuugcucacauucaggagaauuauauuauccacacaa

SEQ ID NO: 171216 - RNA, 81 nt, Homo sapiens
ggugaguaggacuugcaaaauguuugugcuaucaguagauggagaugcaggagauggagaggaacuacccacuguuuuggu

SEQ ID NO: 171217 - RNA, 68 nt, Homo sapiens
cucaaaaugacuugcuuuuagacucacauuugauuuuguaaaaucuuucaccgaacacaccuggcaga

SEQ ID NO: 171218 - RNA, 36 nt, Homo sapiens
uaaugaaagcugaaagcuaugacacuguuaugacaa

SEQ ID NO: 171219 - RNA, 61 nt, Homo sapiens
guuaacaacuggauucagaaaugccgaugaguggauuugccuaucgguuuuguuuuucuaa

SEQ ID NO: 171220 - RNA, 45 nt, Homo sapiens
uuggcgcccgauuaugcagccaauuaaguuauuuggaauggugag

SEQ ID NO: 171221 - RNA, 99 nt, Homo sapiens
gagacuguugucuugccaccugguucagcuuggccagaucgagcggagaaaugguguguuguccuugaaucgaguaggcaucuagagguggucccucca

SEQ ID NO: 171222 - RNA, 46 nt, Homo sapiens
ggccggcaugggcugguacggaauggucaugacucucccuugcgga

SEQ ID NO: 171223 - RNA, 45 nt, Homo sapiens
gcggaucucuuugaucuuacacccgccuuucccaaucagggagcc

SEQ ID NO: 171224 - RNA, 77 nt, Homo sapiens
gcuugucgaugaucauagcgaaagccuuaaagauggcauugguggggccggucagagugaugauucucuccggacaa

SEQ ID NO: 171225 - RNA, 50 nt, Homo sapiens
ucagucacaccggcauccauggcgagcggcgggcggcguucgggggaguu

SEQ ID NO: 171226 - RNA, 41 nt, Homo sapiens
gugauuucugccuuuuccccuuccuccuugggcuaagccag

SEQ ID NO: 171227 - RNA, 60 nt, Homo sapiens
uccugaacacaaaauggcgacacgugguuagcauucgucgccaacgagaaauuggggucg

SEQ ID NO: 171228 - RNA, 45 nt, Homo sapiens
caauauuuguuacuacaugcaguauauguacuuggguaauuucua

SEQ ID NO: 171229 - RNA, 59 nt, Homo sapiens
cacugccccaccccugccuggagccucacacaugacucgccuccucucagugaccacag

SEQ ID NO: 171230 - RNA, 57 nt, Homo sapiens
uauuccaggcagaggaagcaaaggccugaagucaaagaaagcacagucaauugagaa

SEQ ID NO: 171231 - RNA, 47 nt, Homo sapiens
gcuuuauuuuauagcaauaauucucuuuuaaggugaagacaucagaa

SEQ ID NO: 171232 - RNA, 49 nt, Homo sapiens
uagauauuagauuuauugcaauagaaauaguuucauauugcagcuauug

SEQ ID NO: 171233 - RNA, 55 nt, Homo sapiens
uacugaggaacgguguguucuguuuugaagauuggauggagugguuaugugcaca

SEQ ID NO: 171234 - RNA, 58 nt, Homo sapiens
guacccauuucuagcagggaauuucuuccacuugcagaccaaguguguuggggacuug

SEQ ID NO: 171235 - RNA, 47 nt, Homo sapiens
uggcuauuuucaaaacaguaauaaacacaaaaggucaacauacauaa

SEQ ID NO: 171236 - RNA, 42 nt, Homo sapiens
ggugauauauacaagaaguuacagcagauauauaaagggaag

SEQ ID NO: 171237 - RNA, 61 nt, Homo sapiens
ugaccuugucaaaugcagcuuccucacuguaagauggggacaguaagaguaccugacuuaa

SEQ ID NO: 171238 - RNA, 25 nt, Homo sapiens
aaggucugggaggaauaguaacaag

SEQ ID NO: 171239 - RNA, 39 nt, Homo sapiens
cucuuacuuuaccuuuggguuuguauaucaacccucccu

SEQ ID NO: 171240 - RNA, 70 nt, Homo sapiens
aaaauauuauuuauggguaugcauauaaggacaugcauggacaugauauacaacauucucagcacaguga

SEQ ID NO: 171241 - RNA, 135 nt, Homo sapiens
cgguuugaaucucgccuguacauuuccagacgagacacugucuuacugagcguucucacagcgccuagcucagagcugaccgcagagccggcucucaauaacaucgagacgcaaaagcagcuuuugagguuaggg

SEQ ID NO: 171242 - RNA, 35 nt, Homo sapiens
acgcgccaccccacaaaucuccuucgaggccgugg

SEQ ID NO: 171243 - RNA, 45 nt, Homo sapiens
auugcuaaucaauaacuugguucaugggcuuagaccugauccucu

SEQ ID NO: 171244 - RNA, 54 nt, Homo sapiens
augaagaaguugugagagaaaauaauugcuuaauaagcauuucuucaauugucc

SEQ ID NO: 171245 - RNA, 55 nt, Homo sapiens
accuauuaaccuccauuuccaggggacaauugaagaaaugcuuauuaagcaauua

SEQ ID NO: 171246 - RNA, 50 nt, Homo sapiens
aaauuuuuuucuugaaacgaaaugcucuguauauaggacauaaaccauga

SEQ ID NO: 171247 - RNA, 37 nt, Homo sapiens
uaugggggauuauugugguaaaacaaaauucgugaag

SEQ ID NO: 171248 - RNA, 47 nt, Homo sapiens
ugauucggcaaaaauguuuagcaaagcccuucuagaaacaaguguag

SEQ ID NO: 171249 - RNA, 45 nt, Homo sapiens
ccugcaaaauccagcuuauuaagaagaaaggaaaaguuaaggcac

SEQ ID NO: 171250 - RNA, 65 nt, Homo sapiens
acauaugguguuuguugcacaucccaacaaccgaccccagugcucucguuagaaguauucucaaa

SEQ ID NO: 171251 - RNA, 41 nt, Homo sapiens
auuuaggccugaucaugaaguccuaagugaggcgcccuaag

SEQ ID NO: 171252 - RNA, 55 nt, Homo sapiens
aaaauuaaaauacauuguuacagaacagguguuggcaaguuuucuggagugggcc

SEQ ID NO: 171253 - RNA, 61 nt, Homo sapiens
acugauuuuuuuaaaaaauucuuuuuaucuaguucuuauaucugaaguugagcuuggggag

SEQ ID NO: 171254 - RNA, 67 nt, Homo sapiens
aaugaggauaaaauaaaaucaccgaaauugcaaacaaguauuugagucauccacuguaccugaaaau

SEQ ID NO: 171255 - RNA, 45 nt, Homo sapiens
acaccaaucgcgucaucuuucuggaagaugaugauguugcagcag

SEQ ID NO: 171256 - RNA, 44 nt, Homo sapiens
gcagaaggaaauauuugagcagccagagucugucgugaacacaa

SEQ ID NO: 171257 - RNA, 54 nt, Homo sapiens
gggaggggaaauggggagucacuguuuaaaggguacagaguuucaguuguggga

SEQ ID NO: 171258 - RNA, 43 nt, Homo sapiens
auguagaacaguuccaucacucccaaaauuuccuugcacccua

SEQ ID NO: 171259 - RNA, 46 nt, Homo sapiens
uuuuauuucagugaauuugggugguuugaaggaucacauaaaggag

SEQ ID NO: 171260 - RNA, 46 nt, Homo sapiens
cacaggugagacagcagauacuuugaugggucuucguuacuguaag

SEQ ID NO: 171261 - RNA, 274 nt, Homo sapiens
gaaaucuuagaaaguuguauaaauacaagagauguuaucccuccacaaguguuuuuuugggguuuuagguuuguuugguuguuauuuagagacagggucuuguuuugucacccaggcuggggcuggagugcagugacaggaaucauagcucccugcagccucagacucaugggcucaagugaucucugccucagcuuccugaguggcugggacugcagaugcaccaggcuaguuuuuuuuuuuuuuuuaagauggggucucacuauguugucca

SEQ ID NO: 171262 - RNA, 50 nt, Homo sapiens
uuaaguuugauauuucuugcugauuaucuaauaagauguugggauauugg

SEQ ID NO: 171263 - RNA, 46 nt, Homo sapiens
gugauguuugcccuuaugaugugugaugaucggaucuccaugcaag

SEQ ID NO: 171264 - RNA, 49 nt, Homo sapiens
agcuauuauuuucuuuaaagaaugcuggguguugcauuucuggacccuc

SEQ ID NO: 171265 - RNA, 32 nt, Homo sapiens
cuaaaaauugguacuuguuucaccauacuuca

SEQ ID NO: 171266 - RNA, 47 nt, Homo sapiens
ccccaaaauugugaguaauaauuucuuaauggagcuuuucuggccag

SEQ ID NO: 171267 - RNA, 55 nt, Homo sapiens
gcugaaucauacuuuaaacuauaagaaaugcuacaaacccacacaaauuguguuu

SEQ ID NO: 171268 - RNA, 29 nt, Homo sapiens
gcauucuaaguuaaaacuaauaugugaag

SEQ ID NO: 171269 - RNA, 707 nt, Homo sapiens
uucuaaacugaauaucaaaaaccaaaaucaagaacaaagaagugauauuuuccaaacaaacauggauucucugccgggugcaguggcucagccuguaauaccagccuccacuuugggagucugaggugggaguauugcuugagcucaagaguuggagaacagccugggcaacauggugagaccuggucuuuacaaaaauuuuuuuggccggacgcaguggcucacaccuguaaucccagcacuuugggaggccgaggcagguugaucaugaggucaagagaucgagaccauccuggccaacauggugaaaccccgucuuuacuaaaaauacaaaaauuagcugggagugguggcgugcgccuguagucccaacuacuugggaggcugaggcaggagaaucgcuugaacccaggaggcggagguugcagugaggcgagaucacgccacuacacuccagccuggcgacagagcaagacucucucaaaaaaaaaaaaaaaaaauuuuuuuuuuaaaugggcugggcaugguggcuugugccuguagucucagcaacuugggaggcuuaaguaguaggaucgcuugagccugggagguugaggcugcagugagcugugauugugccacugugcuucagcuugagugacagagugagacccuccugacucaaaacaaaaaacaugguuucuccucucucuccugucuucuua

SEQ ID NO: 171270 - RNA, 93 nt, Homo sapiens
cucucuaucccauuugauguagugauuuuuaaaugcuuuuguaaguuaauucuuaacacaaaagagacauuguaaugaggcacaccacuaaag

SEQ ID NO: 171271 - RNA, 33 nt, Homo sapiens
uacucuacauaaagaauccuucauauaaaaagu

SEQ ID NO: 171272 - RNA, 71 nt, Homo sapiens
gcguguggcccaguaagugauuauuacauuggaaucaguuuuucagucuuuuaaaauaaauucugugccau

SEQ ID NO: 171273 - RNA, 168 nt, Homo sapiens
uguuuguuaaagcaaacauuucaguugguuuccuuucuuugaagaauaauagaaauaaaugucagaggaguauuacuaaggagccaaaacaaacaaacaaacaaaaaaacaaaaaacuccuuuauuacucccauccucagaacuaacucaagacaagagaucuguauu

SEQ ID NO: 171274 - RNA, 38 nt, Homo sapiens
uaugauccuuuucaauaauacuuucaaugacauugugc

SEQ ID NO: 171275 - RNA, 55 nt, Homo sapiens
gaaaguauuauugaaaaggaucauagucacauugaauuugugaaggccaaagaaa

SEQ ID NO: 171276 - RNA, 36 nt, Homo sapiens
uaguaaauuuuguguacaagaauaccaggcagagug

SEQ ID NO: 171277 - RNA, 46 nt, Homo sapiens
uuugaagcuaauauuaucaguccuauuggcugucacugucacagau

SEQ ID NO: 171278 - RNA, 99 nt, Homo sapiens
cuucaaaccaauaauauccaggguuaaaauaaaaaucauagugaaaguacgauuguaaaauuaugcuauauuaacuuuuaagucuguaauaacuugaca

SEQ ID NO: 171279 - RNA, 46 nt, Homo sapiens
auguagaaaugauccuguuagcuuucugaauguucugugguugaau

SEQ ID NO: 171280 - RNA, 43 nt, Homo sapiens
uuccucaugucguuaaguccagugaguaagccugaacugugaa

SEQ ID NO: 171281 - RNA, 71 nt, Homo sapiens
uuuuucaaaauguucccacuuguuuuccauuuuaguuucuuaacugagagggauaggaaaagggcagaagg

SEQ ID NO: 171282 - RNA, 65 nt, Homo sapiens
acucagcucugguuccaaagauucugcucuuuucaugacauuuggccauaaaugucugaggaaau

SEQ ID NO: 171283 - RNA, 264 nt, Homo sapiens
uguagccuuaugcuuuuccagagaaagaggacauucgccuucucuagguuuagguccuugaugggcaugcacaucauuagguaagggaacagcuucccugcaguugcagugacuucuuuuugagccaaaaaauauagggggaauuccagcuggucuauagggauccuacauccccuauguuccugugagguguugacuucacacggccaccgaaggccucugaucucagaagcccccaugucuuguaacugguaugugcuguag

SEQ ID NO: 171284 - RNA, 44 nt, Homo sapiens
gaggaugggaguuagagaucauuaaaagaaggcuccagccccag

SEQ ID NO: 171285 - RNA, 67 nt, Homo sapiens
augguccuuccccaugugcgcaucaagugguuggucagguugccuaauauuuagcccagugauuagc

SEQ ID NO: 171286 - RNA, 46 nt, Homo sapiens
agcuaggggggguguauaugcgaggggccuaacuggacuuggggag

SEQ ID NO: 171287 - RNA, 46 nt, Homo sapiens
ugauuaauuuaccucaugagacuacuggugccucacaacuggaagg

SEQ ID NO: 171288 - RNA, 67 nt, Homo sapiens
uauuagaauaaauauacugaugucuggcuuacaguuaaaauucauacacuaguuuuuuuagucagaa

SEQ ID NO: 171289 - RNA, 51 nt, Homo sapiens
uuuuuuagcuuuuugaauuuuauuaagguauuaacuucugacuuacacuug

SEQ ID NO: 171290 - RNA, 46 nt, Homo sapiens
acaaauacauuuuccgcauucucucuauacccucugaaguggaaau

SEQ ID NO: 171291 - RNA, 51 nt, Homo sapiens
ucuuuuuuaauuuguuagauacacacaaauccauguuuuuaccagucuuca

SEQ ID NO: 171292 - RNA, 44 nt, Homo sapiens
ucacaggauuaccucucagccaugguggagccccuggacuugaa

SEQ ID NO: 171293 - RNA, 56 nt, Homo sapiens
ugcuccaacauggcuggguaccguggcuggauaaccguucccggugcagguaacag

SEQ ID NO: 171294 - RNA, 56 nt, Homo sapiens
auauuguccaccuguuaccugcaccgggaacgguuauccagccacgguacccagcc

SEQ ID NO: 171295 - RNA, 41 nt, Homo sapiens
aagcgcagacgccaggaacgccccgugagugaggagaggag

SEQ ID NO: 171296 - RNA, 46 nt, Homo sapiens
gagcuccucuuggugaugucguaggcaaggauggccccauuggcac

SEQ ID NO: 171297 - RNA, 41 nt, Homo sapiens
uacacagcucuucugcucccugggccccgggcugcuuccua

SEQ ID NO: 171298 - RNA, 40 nt, Homo sapiens
ccuguauuuucacacucccauuucccugcagcugcuggca

SEQ ID NO: 171299 - RNA, 41 nt, Homo sapiens
aaugaauggcuacuacaggcgggcauuguccuggggccuug

SEQ ID NO: 171300 - RNA, 55 nt, Homo sapiens
aaacaaggccugcccccagcucagagcagcuaccacagcacaaaaugguguggaa

SEQ ID NO: 171301 - RNA, 45 nt, Homo sapiens
caaaaucgauugccuucaugagcucagcacgugucuuucugggag

SEQ ID NO: 171302 - RNA, 61 nt, Homo sapiens
aguaaauaaaaaagacaaaagaagcuagaaacaaacaaaaaagauacaugagaaagcccua

SEQ ID NO: 171303 - RNA, 46 nt, Homo sapiens
ccuuucucccuuagcagcuuguuaauuucaucauucaggucacgaa

SEQ ID NO: 171304 - RNA, 42 nt, Homo sapiens
acaaguugauacuuacauggccuuuucugcauuucgggccug

SEQ ID NO: 171305 - RNA, 45 nt, Homo sapiens; identical to SEQ ID NO: 93723

SEQ ID NO: 171306 - RNA, 43 nt, Homo sapiens
auaauguguucuaaaccuuugccaucaccaucuauguguccaa

SEQ ID NO: 171307 - RNA, 51 nt, Homo sapiens
aauccaagaccaucauuauacuaaaauuaaaguuauuuauggaaguucaua

SEQ ID NO: 171308 - RNA, 46 nt, Homo sapiens
uuccaccccuuuccuccuuuuacacggcaaguaaagcucacuggcc

SEQ ID NO: 171309 - RNA, 46 nt, Homo sapiens; identical to SEQ ID NO: 93727

SEQ ID NO: 171310 - RNA, 45 nt, Homo sapiens; identical to SEQ ID NO: 93728

SEQ ID NO: 171311 - RNA, 41 nt, Homo sapiens
augccuuggcaucauucuucuggcucucuacuuacugucag

SEQ ID NO: 171312 - RNA, 45 nt, Homo sapiens
caagauggggauauucauuagaccuccuucacuuugagaaagaca

SEQ ID NO: 171313 - RNA, 57 nt, Homo sapiens
uagcuaaaaucacagacgauuacugagcaauguucucuuuuuacaagacccccaaga

SEQ ID NO: 171314 - RNA, 43 nt, Homo sapiens
uacaaaucucagaggcugcaucccacagccgugaccaccguga

SEQ ID NO: 171315 - RNA, 43 nt, Homo sapiens
aauaccacaacuaaacugaagucuauuccugaauaugacagac

SEQ ID NO: 171316 - RNA, 36 nt, Homo sapiens
caggcgcagagcgcggaaugcgccugcgcagagcgc

SEQ ID NO: 171317 - RNA, 29 nt, Homo sapiens
ggcuccaacccauuccagcaccuugagaa

SEQ ID NO: 171318 - RNA, 44 nt, Homo sapiens
gaaacucccaucaacccucggaaaugugcccacauccucaccaa

SEQ ID NO: 171319 - RNA, 710 nt, Homo sapiens
uccucccagaggaaugaucuaaguggaguccugaaggaugaguaagaaauaguaggacaggacaggcgcaguggcucaugccuguaaucccagcacuguauccacaauguaauccacagacugcgauggguggaucacuugaggucaggaguuugagaccauccuggccaacauggugaaaccccguuucuacuaaaaauacaaaaauuagccaggugugguggcgcacaccuauaaucccagcuacuggggaggcugaggcaggagaauugcuugaacuggggagguggagguugcagugagcugagaucaugccacuuacacuccagccugggugacagaacgagacugcgucucaaaaaaaaaaaaaaaaagccaggagugauggcucaugccuguaaucccagcaguuugggaggccgaggcggguggaucacaaggucgggaguucaagaccagccuggccaacauagugaaacccccucucuacuaaaaauacaaaaauuagccggguaugguggcaugugccuguagucccagcugcuggggaggcugaggcaguagagcuugagcucgggauguagagguugcaaugagccaagaucgcaccccauugcgcuccagccugggcgacaaagcgagacucugucucaaaaaaaaaaagaguaggacagaguggaggugaggggugaggaaugcuacaggcugag

SEQ ID NO: 171320 - RNA, 46 nt, Homo sapiens
aaagaagacaacuaccggggcccggccgugcgagcccucugccaga

SEQ ID NO: 171321 - RNA, 59 nt, Homo sapiens
aguauuucuguaucuguaagccugagagucccacccuucucagugaagacagccaagaa

SEQ ID NO: 171322 - RNA, 42 nt, Homo sapiens
gccuacugcaugaugauccggguggccagcaagcagcuggaa

SEQ ID NO: 171323 - RNA, 150 nt, Homo sapiens
ggccuuccgagaaaugugcguaguccugccuccaggccuccauccauaucguccccuuguacugaaagaacaguaguuuccaggccaguuaaggguucauugauuuguuguccaaguauuucuugagcacuugcugucugcuauguagag

SEQ ID NO: 171324 - RNA, 85 nt, Homo sapiens
gggaugauccuaggaagagcacagucugggaaggcccuucuggagggugacauuugagcucaaaccugaaucagugcaaagaacc

SEQ ID NO: 171325 - RNA, 220 nt, Homo sapiens
acuguuggaguaauucagaaggagaggauggugccugaaccggcgggaguaggagaggugggacagugcaagagcuuuuugagggauaaugccuguuggcaggguuggugugaggguugagggguggaugucaacagagaugaugccauuuucuacuuugagcugacaguggugcucuugacuaguuugcaggggaggaaaagaugggguauuggaugag

SEQ ID NO: 171326 - RNA, 47 nt, Homo sapiens
aguuuggagcccagaaugaagagauguuacccaguaucuugguguug

SEQ ID NO: 171327 - RNA, 46 nt, Homo sapiens
caucacagcagucaaacagccugagaaaguggcagcuaccaggcag

SEQ ID NO: 171328 - RNA, 61 nt, Homo sapiens
uccgcggucuugggccccucuucaaguccucgccugagcccguggcccucaccgagucaga

SEQ ID NO: 171329 - RNA, 52 nt, Homo sapiens
ugaaguucacugucaaggacugugaucccaccacuggggagacugaugacga

SEQ ID NO: 171330 - RNA, 45 nt, Homo sapiens
cugaacuucgaagcagccugggaugagguaggggaugaauuugag

SEQ ID NO: 171331 - RNA, 45 nt, Homo sapiens
ucacaagggugcauucccaagaacuucacaauauuacccacagcc

SEQ ID NO: 171332 - RNA, 54 nt, Homo sapiens
ugggaaugcacccuugugagaggucagacaaagugccggauaacaagaacaccc

SEQ ID NO: 171333 - RNA, 42 nt, Homo sapiens
gcugcugcuuuuggacacagugacaaugcaggugacagccag

SEQ ID NO: 171334 - RNA, 49 nt, Homo sapiens
guaguguuggggaaggguaugagguccuaugcaggcuggccucuuaucc

SEQ ID NO: 171335 - RNA, 97 nt, Homo sapiens
cucccacccgggacuacuugcuggugacuuuuuuuuuuuuuuuuuuuaaauaggggaugauuuuagcuuguccuaaaucuugcuguccacccuucca

SEQ ID NO: 171336 - RNA, 48 nt, Homo sapiens
uccccaucuaagaagaggaagaauagcaagaagaagaaccagccgggc

SEQ ID NO: 171337 - RNA, 35 nt, Homo sapiens
agguaaagcauguuuguguugcuccaaaacccagg

SEQ ID NO: 171338 - RNA, 45 nt, Homo sapiens
cagaucuguccuagugauuuuaccuuuguucuagaaggcgcuccu

SEQ ID NO: 171339 - RNA, 56 nt, Homo sapiens
ggucuuguggucuuuuuacccccccuuuccccucccuccuugaaggcuaccccuug

SEQ ID NO: 171340 - RNA, 42 nt, Homo sapiens
caucaaacacaguuacaccccacauaucucucacacacacac

SEQ ID NO: 171341 - RNA, 110 nt, Homo sapiens
gcaguugcugagggggcagugagaguugagcacagaguccuucacaaaccaagaacacacguaggccuucaacacaauuccccucuccucuuccaaacaaaacauacauu

SEQ ID NO: 171342 - RNA, 64 nt, Homo sapiens
gcuguacaacgaauuuccugaaccuaucaaacuggacaagaaugaccgggccaaggccucggca

SEQ ID NO: 171343 - RNA, 44 nt, Homo sapiens
caggcguuccagacgauugcacggaaugcacuuaagcagguggg

SEQ ID NO: 171344 - RNA, 49 nt, Homo sapiens
aggccuggugcuacagcaaaaacaacauucccuacuuugagaccagugc

SEQ ID NO: 171345 - RNA, 61 nt, Homo sapiens
auucaaaacccuagauagcuggagagaugaguuucucauccaggccaguccccgagauccu

SEQ ID NO: 171346 - RNA, 82 nt, Homo sapiens
aacgguuccagucucucgguguggccuucuacagaggugcagacugcugcguucugguauuugaugugacugcccccaacac

SEQ ID NO: 171347 - RNA, 36 nt, Homo sapiens
uguagauuaaauggagcugaaaaaagcaguaagccg

SEQ ID NO: 171348 - RNA, 45 nt, Homo sapiens
ucuaggaagaaaguguugcugaagguuaucauccugggagauucu

SEQ ID NO: 171349 - RNA, 52 nt, Homo sapiens
uuggaaaauaaaugcaaaaaauaguaaauaaaauuuaauauggucucaugug

SEQ ID NO: 171350 - RNA, 35 nt, Homo sapiens
ugcccccaaaugacuucauaauuccacaaaagugg

SEQ ID NO: 171351 - RNA, 82 nt, Homo sapiens
agaugagaguuacuuaguuuagaguuguucaaugccugggguggugaggggcauguugaguggauuuuuaaauaaauuggua

SEQ ID NO: 171352 - RNA, 15 nt, Homo sapiens
aaguaaaaagacuga

SEQ ID NO: 171353 - RNA, 44 nt, Homo sapiens
gguauucagucagccuaccaacaguucuucuguucacuuacaga

SEQ ID NO: 171354 - RNA, 64 nt, Homo sapiens
uccugggacugucuacaguugggaccaagcaaauccaagggagccuauuuaaggggagccuggg

SEQ ID NO: 171355 - RNA, 48 nt, Homo sapiens
aaacauauuuaagaauagcuacuugcaaaauaucuccuugugggagga

SEQ ID NO: 171356 - RNA, 52 nt, Homo sapiens
uguggcgagugaaaucaaaacaaguuuuuuagcagugucuguuaccaguuuc

SEQ ID NO: 171357 - RNA, 61 nt, Homo sapiens
ugcucuuaaaucuucuauucuguuuuuccccacacuccauauggcauuaaagacagaaaaa

SEQ ID NO: 171358 - RNA, 74 nt, Homo sapiens
cuugcuguugaugauucuuaccucucauguaaggaaggcuaccauuguauucucaggcauccauuccuuugugu

SEQ ID NO: 171359 - RNA, 55 nt, Homo sapiens
uuccuaugauaaaguauuuaucuccccauucauuuaauucaacaaauacagcuga

SEQ ID NO: 171360 - RNA, 65 nt, Homo sapiens
guccaugucacuacuguaauuaccuugcacugccaugucuuugagcaaagguacauuuggcaugc

SEQ ID NO: 171361 - RNA, 64 nt, Homo sapiens
cgugguuccuguccucaaggaauuuuuaaaaggugaaugaucuuggccagaaauucuguugugg

SEQ ID NO: 171362 - RNA, 43 nt, Homo sapiens
caccuuuuuauucauucauuaaguauuuugaguauccauugag

SEQ ID NO: 171363 - RNA, 129 nt, Homo sapiens
gaaggugaguuaggaguacuucuucugaagaagggaccggcuaaguuaaagcuuagcguucacaauccuguuguauucauauuugucuuuuuuuuuuuuaacuuugcuaccuagccuaaaauauuuaag

SEQ ID NO: 171364 - RNA, 65 nt, Homo sapiens
ggucacaggcgcugggggccgagccgcguucccauccgguucuucaguugaacagccugacccug

SEQ ID NO: 171365 - RNA, 81 nt, Homo sapiens
guccuccguuuagucuccuccucggcgggagcccucgcgacgcgcccggcccggagcccccagcgcagcggccgcgguaag

SEQ ID NO: 171366 - RNA, 47 nt, Homo sapiens
cuggcauucccagagccucgcaaagcacccccgccucccggcccccg

SEQ ID NO: 171367 - RNA, 80 nt, Homo sapiens
caggcaccccgugcuaggauucguuuaugagcaggcaggauucgagaaccagguagggcccgugcggcagccgaggcguc

SEQ ID NO: 171368 - RNA, 69 nt, Homo sapiens
ggcugaccuucuccaguccucagagaaaucuuguucccaaguaaggaaagugacagcuucuuaauguga

SEQ ID NO: 171369 - RNA, 41 nt, Homo sapiens
ucgcaggccaacgggcccaauugccuggggcgaggccgugg

SEQ ID NO: 171370 - RNA, 43 nt, Homo sapiens
guccagcgguucgggaauugcggacgcagccaaugggaggcgg

SEQ ID NO: 171371 - RNA, 42 nt, Homo sapiens
cccccgcuucaugucugugcaggagucggcagcuggcgccag

SEQ ID NO: 171372 - RNA, 47 nt, Homo sapiens
ggaccucucaacaaagcacaccaaagcagucgcccgcagccuggccc

SEQ ID NO: 171373 - RNA, 32 nt, Homo sapiens
gagaucaguauguguaucuggcgccaagugug

SEQ ID NO: 171374 - RNA, 45 nt, Homo sapiens
gcggcggcggcucagggucugggugcagacggcaacggcccugcg

SEQ ID NO: 171375 - RNA, 53 nt, Homo sapiens
ggugugaguuuguguuuuauuuaaauaagcacgaggagcuugugagcggggcu

SEQ ID NO: 171376 - RNA, 44 nt, Homo sapiens
gccuggcagagguagggucuggaaaugagcgccugguccuugca

SEQ ID NO: 171377 - RNA, 49 nt, Homo sapiens
uuuuuaagcagagaaaccacuucccuaguccgagacccuguccuagcca

SEQ ID NO: 171378 - RNA, 45 nt, Homo sapiens
gguuaacaggccacugaccaugaagaaggaagggauccagacucg

SEQ ID NO: 171379 - RNA, 39 nt, Homo sapiens
uaggcaaaaauaauuuauuuugcucuuguuucuaacaag

SEQ ID NO: 171380 - RNA, 41 nt, Homo sapiens
auuuuuuuaauauuuuuucuuuugucucagaguaggaggcg

SEQ ID NO: 171381 - RNA, 46 nt, Homo sapiens
ggagggucucuccuccagccccugcacacucccacccaggacagcc

SEQ ID NO: 171382 - RNA, 87 nt, Homo sapiens
ccacaagcgcaugguucagucucccugaguguccggugaccucccccagggccuccuugcccagcccaguccaggcugcugugccaa

SEQ ID NO: 171383 - RNA, 42 nt, Homo sapiens
ccucagccccgaguccaagaagauccugacacccgcccucaa

SEQ ID NO: 171384 - RNA, 109 nt, Homo sapiens
ggauuggcaaagacaggggccccgaggcagagacaggccaggugugccucccaggugggucuccaggcagagggauuggcaaugacagcagcccugaggcagagacagg

SEQ ID NO: 171385 - RNA, 47 nt, Homo sapiens
uuuaaagcaaauugcaucuuuguuuacauacgggauccauagcuggg

SEQ ID NO: 171386 - RNA, 95 nt, Homo sapiens
gggcauuccaguggggcgguggcgggggcggggggugcggaggucagcccaugggcauaccugccuccccugggccuugcagccacaggccaccu

SEQ ID NO: 171387 - RNA, 45 nt, Homo sapiens
auugaagcauuucaaagcaauuguaaaaauuauaugaaccccauc

SEQ ID NO: 171388 - RNA, 47 nt, Homo sapiens
cacacacaaccuccucacagauacaggcuagugccuauaccaagccc

SEQ ID NO: 171389 - RNA, 41 nt, Homo sapiens
gauauggagcuuacaguuguaggaagguacaaacaauaaac

SEQ ID NO: 171390 - RNA, 46 nt, Homo sapiens
gggaacugggcaucaucgacagugccuucggccagagcggcaaguu

SEQ ID NO: 171391 - RNA, 48 nt, Homo sapiens
ucugggcucauuugcugcuucggcaccucccggcagacagggcccagc

SEQ ID NO: 171392 - RNA, 48 nt, Homo sapiens
gacugcuccucaggagcucagucccuccagugacugaaggcuaauaaa

SEQ ID NO: 171393 - RNA, 59 nt, Homo sapiens
aauauagaaauaugugcaagauuuugaguacagagaaagggaaagaaacuauaugaaug

SEQ ID NO: 171394 - RNA, 53 nt, Homo sapiens
guuuacugagcaccucaucaggucucagacucagcuacucaacucugccacug

SEQ ID NO: 171395 - RNA, 48 nt, Homo sapiens
ccuacguuugugccaggcacugugcauacaacaagauagacaaaguuc

SEQ ID NO: 171396 - RNA, 45 nt, Homo sapiens
cauauaggccuucugaucccauuuccuauaaaggcauccuucauu

SEQ ID NO: 171397 - RNA, 48 nt, Homo sapiens
ucuaggagguccaugggagcagggguuagggacgaaugggaauuugcc

SEQ ID NO: 171398 - RNA, 59 nt, Homo sapiens
ugcgccccguggacauuagcgaauguuugaggagugaguuauucaguagauggagagag

SEQ ID NO: 171399 - RNA, 44 nt, Homo sapiens
gccucuaggccaugaguuggacuuggcccaagcuuagggugcug

SEQ ID NO: 171400 - RNA, 66 nt, Homo sapiens
gagcaggaaaaucaaggauaauguccuuucuggaugagaggggucagcgcacagaggcuagagaga

SEQ ID NO: 171401 - RNA, 51 nt, Homo sapiens
acucacuuuacauauaucuucucauuuaauucacguaaagcuauccuuuca

SEQ ID NO: 171402 - RNA, 42 nt, Homo sapiens
cauguuaccaugguccagaaaucacccgcucaucccagaaga

SEQ ID NO: 171403 - RNA, 21 nt, Homo sapiens
ccugcuuccugccagaguccc

SEQ ID NO: 171404 - RNA, 41 nt, Homo sapiens
auagauacagaggcaucuaccuaucugcauuuacaucaagc

SEQ ID NO: 171405 - RNA, 60 nt, Homo sapiens
ucuccacuaccccucccucacuggagucuccuugcacacagagcuugauccaggcgggaa

SEQ ID NO: 171406 - RNA, 43 nt, Homo sapiens
uuucugacaggagaagcugaggcuguccagccugccuugggaa

SEQ ID NO: 171407 - RNA, 38 nt, Homo sapiens
uuuccugccugcacccaggaccccaagagccucuguga

SEQ ID NO: 171408 - RNA, 65 nt, Homo sapiens
acacacucagguggcaccuucccuggcauaauccccacagcucuggcuuuccauuuucuccuuca

SEQ ID NO: 171409 - RNA, 41 nt, Homo sapiens
guucugauaaugaugacaaacauuauuagauauauuuggau

SEQ ID NO: 171410 - RNA, 42 nt, Homo sapiens
gauuugaucuucgggguucaggcuagugauguuucuggugau

SEQ ID NO: 171411 - RNA, 59 nt, Homo sapiens
cccagcuggggccaauuagcugagcaagaaaauguuggggaacagggagugaaggagaa

SEQ ID NO: 171412 - RNA, 66 nt, Homo sapiens
auaagagacccucaaggguuuugagaauguuauaccagcaagaacacuggacugaaagggagagag

SEQ ID NO: 171413 - RNA, 56 nt, Homo sapiens
ccucuagauugcaaaggauguuaagauuaggaaauucacugcugagaaagcauacc

SEQ ID NO: 171414 - RNA, 82 nt, Homo sapiens
cuuuugugcaccuguuuuuccccagccuacuuuuuaacacuuuuggugucuacugccugaugaucuaauuuacuagucagga

SEQ ID NO: 171415 - RNA, 79 nt, Homo sapiens
uuuuggccacccucuuuguccuuauaaagguggaacuugccuaucaggaugccaguuacugaucuuuaguacuugggca

SEQ ID NO: 171416 - RNA, 77 nt, Homo sapiens
aagagucaguggcugcaauguuagggcugagggcauggagaagggcugaggcagagaagucaguagugguaaggagg

SEQ ID NO: 171417 - RNA, 55 nt, Homo sapiens
ucugaccuggcaucccuuccacucugggagaagacaugcuugcagcuugggagag

SEQ ID NO: 171418 - RNA, 46 nt, Homo sapiens
aggccaaggcacugugaugacagggaccauccuuucaggcuccauc

SEQ ID NO: 171419 - RNA, 46 nt, Homo sapiens
gacgucccagauuuccaucccaacgagagaucccucgggaccguuc

SEQ ID NO: 171420 - RNA, 42 nt, Homo sapiens
cgaaacugaagcuccacagggcauuccagagcucauugaggu

SEQ ID NO: 171421 - RNA, 65 nt, Homo sapiens
uaauucagagcuaucaaguacauucacagugcuguguaccuguccccacuauauauaccccaaac

SEQ ID NO: 171422 - RNA, 61 nt, Homo sapiens
aauagaccucuuaccugaaggaaagagacaggcagcaauugauaaaaugaccaagaaaaug

SEQ ID NO: 171423 - RNA, 74 nt, Homo sapiens
augcagacccagucagcggaaugccuugugaucggccagauugccugccagaagcuggucguggugcugaacaa

SEQ ID NO: 171424 - RNA, 36 nt, Homo sapiens
ugcaccugagccuagcccuguggccccagcuggcag

SEQ ID NO: 171425 - RNA, 41 nt, Homo sapiens
guggacaguggggcucuuagcaugagaagggcauggucagg

SEQ ID NO: 171426 - RNA, 34 nt, Homo sapiens
guuaagggguuugcucaaggccacacagcagguc

SEQ ID NO: 171427 - RNA, 36 nt, Homo sapiens
aguagucaguucacuggcauggaacaugcuauaaag

SEQ ID NO: 171428 - RNA, 48 nt, Homo sapiens
ugguuguaauaauguuggugagauuauacaccaauauccagcccugaa

SEQ ID NO: 171429 - RNA, 66 nt, Homo sapiens
cagauagucucugugggcuuggacagugagccaaagccaacaugaugaaaugaagcaagcauaaac

SEQ ID NO: 171430 - RNA, 94 nt, Homo sapiens
gcuuuggccuucuguucaauguuuuuaaaaauggcauucgagaggaguaaaagcauguuuggagguauaguuucuacccucuuugagacagcag

SEQ ID NO: 171431 - RNA, 47 nt, Homo sapiens
acagauaaccaaaauguuaauaauuuucuuacaauauaaugccagau

SEQ ID NO: 171432 - RNA, 46 nt, Homo sapiens
uggcuuggagcaagccagucacuucugucugugugagcacagaaca

SEQ ID NO: 171433 - RNA, 45 nt, Homo sapiens
auuauuggaccccuccucugggccauguaggcccuguguggagcu

SEQ ID NO: 171434 - RNA, 50 nt, Homo sapiens
uuuccauacacauccuuuacuguguugaggaaauuccuccuguuccuagu

SEQ ID NO: 171435 - RNA, 32 nt, Homo sapiens
gacuuuguccacauauauguauauuuaugcuu

SEQ ID NO: 171436 - RNA, 76 nt, Homo sapiens
aggaggaaggccugagacagugugucugugacucucugcuguuugauugugugagagucuguaugugaagaggaaa

SEQ ID NO: 171437 - RNA, 56 nt, Homo sapiens
acucuguacccauuaaacacuaccuccccauucucccuacucccagccccuggcau

SEQ ID NO: 171438 - RNA, 229 nt, Homo sapiens
cuuuuuuggggggcuauuuuuuauuuuuaaauuuauuuguuuacaaaauuaaaaaaauuauuuuauuuuauagaugggucacauucucuugcccaggcuggagugugguggcaugaucauuuagcucacugcaacaugggcucaagcaauccucccaccuuagccucuugaguagcuuagacuucagcucacugugccuggccuggggguauuuuuuuuauuaugguaa

SEQ ID NO: 171439 - RNA, 45 nt, Homo sapiens
gagggcagugccagugguuagggugaugagggagggauggaaagg

SEQ ID NO: 171440 - RNA, 43 nt, Homo sapiens
gggcuuuguaucuuggaccaaaacauuuacacuuuguucuggg

SEQ ID NO: 171441 - RNA, 47 nt, Homo sapiens
ucacacugaggcuggguuucuuuaacuucagaaauguccugaggaau

SEQ ID NO: 171442 - RNA, 56 nt, Homo sapiens
acucauuuuugucaaauuugucuugaaggagcaggcucaaguuugcuuuuauaaau

SEQ ID NO: 171443 - RNA, 46 nt, Homo sapiens
auagugcugggagaagccugcugggccucuuuuucagaaggaggga

SEQ ID NO: 171444 - RNA, 47 nt, Homo sapiens
gaggaaugaauauuuucuaggaaagauaagagucaguuauguuuggu

SEQ ID NO: 171445 - RNA, 42 nt, Homo sapiens
uuugagcuguccccuacaugugauuugguuauaagaacuguc

SEQ ID NO: 171446 - RNA, 42 nt, Homo sapiens
agaacgcuugcugucugcuggacacuguucuagacccguggc

SEQ ID NO: 171447 - RNA, 40 nt, Homo sapiens
gacucagaguaaacaaggaccuagagacaaagggagggcu

SEQ ID NO: 171448 - RNA, 45 nt, Homo sapiens
gcccuggcuaaagaaggggaguggucaggguggcuggcacuugca

SEQ ID NO: 171449 - RNA, 33 nt, Homo sapiens
gcauagaaaugugaguaccugccugggguggca

SEQ ID NO: 171450 - RNA, 42 nt, Homo sapiens
agcgggugauuuugcuuuagcuugggugacagugugggagua

SEQ ID NO: 171451 - RNA, 46 nt, Homo sapiens
auucuacucuccaguacugcuucuucgacguccucuaccaccaacu

SEQ ID NO: 171452 - RNA, 49 nt, Homo sapiens
cagaaaggcuccacgucaauacaagcauaucuguguguauguauaaauc

SEQ ID NO: 171453 - RNA, 53 nt, Homo sapiens
agcggaggcuuugagauucagcuuuucccauccagcagaaccgagcugcaagg

SEQ ID NO: 171454 - RNA, 43 nt, Homo sapiens; identical to SEQ ID NO: 93967

SEQ ID NO: 171455 - RNA, 55 nt, Homo sapiens
ucuuuucacacacaaccccaagcuccuacuugcccacaucaagcggcccuuuuga

SEQ ID NO: 171456 - RNA, 46 nt, Homo sapiens
ggaaguucuccaucagcaccucugucuucuugaucucaguugagua

SEQ ID NO: 171457 - RNA, 46 nt, Homo sapiens
uguuuugaguccuaugaucacauggcuaaugguuuugccauauccu

SEQ ID NO: 171458 - RNA, 68 nt, Homo sapiens
gcaggagugugaaugcauaaguaccacacaacagacuggcugggggacuaagcacaccagggagaaaa

SEQ ID NO: 171459 - RNA, 56 nt, Homo sapiens
ucaauguccagcauguggaccucaucaacaaacagcacacccgggaccagcucagc

SEQ ID NO: 171460 - RNA, 57 nt, Homo sapiens
aagaugacgaugggagcgauagaagacuccagggcgcggugcagguaggugaagcac

SEQ ID NO: 171461 - RNA, 46 nt, Homo sapiens
gguucugggacaacuggauauucacaugcaaaauaaugaaguugga

SEQ ID NO: 171462 - RNA, 47 nt, Homo sapiens
gccucuguuagacaagaaacgacacuggaaauacagauccaacacuc

SEQ ID NO: 171463 - RNA, 46 nt, Homo sapiens
aguauacagcaugguccggauuaucaucacucgguccagaagguca

SEQ ID NO: 171464 - RNA, 60 nt, Homo sapiens
cacuauccuuuuccuaaagcuuaucaaagggggaacagcagaaaagcgaacagccaagac

SEQ ID NO: 171465 - RNA, 45 nt, Homo sapiens
caugcgguaagagaugcuggcaggcccaggcugggccuccagcca

SEQ ID NO: 171466 - RNA, 46 nt, Homo sapiens
agaggcacaggagcugggaaagacugagucccagcuucagccuucc

SEQ ID NO: 171467 - RNA, 58 nt, Homo sapiens
ugcccaaggagguaugcagcuucccaaguggcucacucuugccuccauguccucccgu

SEQ ID NO: 171468 - RNA, 46 nt, Homo sapiens
cucugcugcccuugcugcugggcagugccuguccuaagaggggacu

SEQ ID NO: 171469 - RNA, 44 nt, Homo sapiens
uugaugggauagguguuguacuggccacgguagcgggccgacuu

SEQ ID NO: 171470 - RNA, 47 nt, Homo sapiens
gaugguggcgaugagauucaugagguugggaagauucuggcgguaga

SEQ ID NO: 171471 - RNA, 42 nt, Homo sapiens
aauacuagaauugaaagaaagaaguguuuuccaaguggguca

SEQ ID NO: 171472 - RNA, 34 nt, Homo sapiens
acacuaagaagauaaagagggugauagcggucca

SEQ ID NO: 171473 - RNA, 46 nt, Homo sapiens
gucccgcuucagcucagcucugcuccgcgugaggcgacgcugcccg

SEQ ID NO: 171474 - RNA, 56 nt, Homo sapiens
cgacugggcuaaggaaugcccagaugguugguaaaacaugacuccugggugugcau

SEQ ID NO: 171475 - RNA, 50 nt, Homo sapiens
agauggagacgaagguuuggaagccgucggccauuuauuaucacugaaau

SEQ ID NO: 171476 - RNA, 52 nt, Homo sapiens
ggaagggcugggggaguguguguggcaauaaagcuugaaggcaccgugggag

SEQ ID NO: 171477 - RNA, 61 nt, Homo sapiens
agagagcugggcugagcugcaggagaugcccaguagagggggugggaaagauggaggcuga

SEQ ID NO: 171478 - RNA, 42 nt, Homo sapiens
cuguacauguaguagagcacgugagugaagacgucgggugag

SEQ ID NO: 171479 - RNA, 46 nt, Homo sapiens
aggcacgugugugaaggugcugaccaucgagcccccaccugcagac

SEQ ID NO: 171480 - RNA, 42 nt, Homo sapiens
gcaguacaccuagguguggcugggcugaccuuucaccucuag

SEQ ID NO: 171481 - RNA, 47 nt, Homo sapiens
gggugcacguagugccuacuuugccaacaugcuggacaccaaaugga

SEQ ID NO: 171482 - RNA, 41 nt, Homo sapiens
ccccauccgccgggcucuacgcgauuacaagcaggucacgg

SEQ ID NO: 171483 - RNA, 49 nt, Homo sapiens
augguggcagcaugcagagaccugaaugaagggggagugggccauguga

SEQ ID NO: 171484 - RNA, 42 nt, Homo sapiens
gaagccagagccagugccgaggcuggaccuuuggccuuucag

SEQ ID NO: 171485 - RNA, 40 nt, Homo sapiens
aagcugcugcaggccuccugaugguguggagggcacacaa

SEQ ID NO: 171486 - RNA, 50 nt, Homo sapiens
ugugaacccacucagcguugacacuaugcacuaacucuugaguggcacgg

SEQ ID NO: 171487 - RNA, 46 nt, Homo sapiens
ccaaguccuucucagggaccucaauaguguccugcugggccccaaa

SEQ ID NO: 171488 - RNA, 42 nt, Homo sapiens
uuggccaccuuguccugguccaucugguugagcuucgggugg

SEQ ID NO: 171489 - RNA, 45 nt, Homo sapiens
guccuaagauaagccaugagagggugggucugauugugggugugc

SEQ ID NO: 171490 - RNA, 53 nt, Homo sapiens
agggccagagccaggccucucuugaugucuucaugaccauagauggaaggagc

SEQ ID NO: 171491 - RNA, 46 nt, Homo sapiens
aucugcugauccuuggagaggcuagugaucaucuucacaucuucau

SEQ ID NO: 171492 - RNA, 81 nt, Homo sapiens
caccagaucugcgaggagaauggcguccuuggagcggggcagccggccagccgccacuuugccuggacucuccuggauucg

SEQ ID NO: 171493 - RNA, 44 nt, Homo sapiens
ucugugccuaggagccccucggacucauccucaaaugguggaag

SEQ ID NO: 171494 - RNA, 39 nt, Homo sapiens
aagacggucuugcuuucccggucgccgcugucgggaagg

SEQ ID NO: 171495 - RNA, 41 nt, Homo sapiens
guuuguaagcucaacaacccgucggugugggaagcacugag

SEQ ID NO: 171496 - RNA, 42 nt, Homo sapiens
cucaucuuccugcucuggaagcuuccaucugcucgggcgaag

SEQ ID NO: 171497 - RNA, 62 nt, Homo sapiens
cugagccaagcacuguggcuagcaaggaaaggggcacugugaagcugggagggcagcaucag

SEQ ID NO: 171498 - RNA, 59 nt, Homo sapiens
gaagccuugagauccucucccuuccucccuuccugcuugccccugcaggggacccugga

SEQ ID NO: 171499 - RNA, 49 nt, Homo sapiens
agugaggcuuccaugccccucuuuuccuuuuaucagcucggagcccaag

SEQ ID NO: 171500 - RNA, 51 nt, Homo sapiens
gagggaggccccggcucuccugaugggacugagaaaggugggugugaagga

SEQ ID NO: 171501 - RNA, 40 nt, Homo sapiens
aaacugguggcaugggagggugcccaccuggccaaguggg

SEQ ID NO: 171502 - RNA, 49 nt, Homo sapiens
cuguucuucagauuuaguacuuguaaauaaacacacacauuaaggagag

SEQ ID NO: 171503 - RNA, 67 nt, Homo sapiens
uuggugcuacacagcuagaauagauauauuuagagagagagauauuuuuaagacaaagcccacaauu

SEQ ID NO: 171504 - RNA, 44 nt, Homo sapiens
gccacugaauccagacagggagaaagccagggcggaggcucuca

SEQ ID NO: 171505 - RNA, 58 nt, Homo sapiens
cauccagggaagacuuugggggaaacugagguucccaccccaccauagccaggaaaca

SEQ ID NO: 171506 - RNA, 42 nt, Homo sapiens
cguucagggaagaggcgggucucuguggcgucaucuggcuca

SEQ ID NO: 171507 - RNA, 42 nt, Homo sapiens
uuauguuuuuuaauuaaucagucacuuguaaaagcaaacaag

SEQ ID NO: 171508 - RNA, 81 nt, Homo sapiens
acgauuugaacaagaaaaugaaggcagugggaaagcaaugccaaaugguuguggagaaaguggccggagccucccuggagu

SEQ ID NO: 171509 - RNA, 49 nt, Homo sapiens
cuucaguuaacuguacaguaccccacuggggcuggagccugaggcuaga

SEQ ID NO: 171510 - RNA, 49 nt, Homo sapiens
auaugcauauauauauauguggcucuagccucaggcuccagccccagug

SEQ ID NO: 171511 - RNA, 43 nt, Homo sapiens
cuuuuaagaaugcauucucucuugcugagggcaaggguggaca

SEQ ID NO: 171512 - RNA, 94 nt, Homo sapiens
gagugcagcagaauuuuuuccccuaaacacaaaaacaguccccagaugucccacugcucuggaggggccaggacacugcugagaugccacacug

SEQ ID NO: 171513 - RNA, 42 nt, Homo sapiens
cugagcagcugagccccagcugugaucauccagcaugaugca

SEQ ID NO: 171514 - RNA, 49 nt, Homo sapiens
cugcaccugagccaguucaacagcaugagcgccuugcacgagaucuacu

SEQ ID NO: 171515 - RNA, 58 nt, Homo sapiens
cuuccuggaugagcaggccgacaagcaccagauccacgaugcugacgugcgccacacc

SEQ ID NO: 171516 - RNA, 64 nt, Homo sapiens
gcaccuggugaagaaccacgaccaccuggaccagcgugagggugaccgcggcagcaagaugguc

SEQ ID NO: 171517 - RNA, 73 nt, Homo sapiens
ccagcagccccgacagccugcgcucgcgcacgcccaugaucacgcccgaccuggagagcggcaccaagcugug

SEQ ID NO: 171518 - RNA, 48 nt, Homo sapiens
gccuacaacaucuccaacuccuccaccuucaccaagucccucagcaga

SEQ ID NO: 171519 - RNA, 41 nt, Homo sapiens
ugcuugggcaccagugccaccgaggacccgucugucaccug

SEQ ID NO: 171520 - RNA, 46 nt, Homo sapiens
ucauccugcaggacgaggacgucaccaccaagauugacaacgauug

SEQ ID NO: 171521 - RNA, 44 nt, Homo sapiens
ggcacgcuacucccugagugaggacaagcucauccggcagcaga

SEQ ID NO: 171522 - RNA, 46 nt, Homo sapiens
caccccuuuuccuccuccuucguggcuaacuuaaugaaaccaaguu

SEQ ID NO: 171523 - RNA, 42 nt, Homo sapiens
gggcuucagcuccagcaggccaguggggcugaguggcuccag

SEQ ID NO: 171524 - RNA, 73 nt, Homo sapiens
cuucuacccgccaggcaggacaggugccuccccaggggucuccaggcacagccaagguuggcauaagcuggga

SEQ ID NO: 171525 - RNA, 45 nt, Homo sapiens
gccuccauacuuggcccggauucgggguucacggacaguggccag

SEQ ID NO: 171526 - RNA, 42 nt, Homo sapiens
gacaaaguugccguuccacacgacugacagguucacuggcag

SEQ ID NO: 171527 - RNA, 45 nt, Homo sapiens
uccuccccaacacccagcugagugagaacccaggaagcucggcac

SEQ ID NO: 171528 - RNA, 42 nt, Homo sapiens
acgugcccccagcccagcccugccugcucugccuccccaacc

SEQ ID NO: 171529 - RNA, 24 nt, Homo sapiens
aaguucauggcauggauggggagg

SEQ ID NO: 171530 - RNA, 28 nt, Homo sapiens
acgggaggagcugggagcagggcgcagg

SEQ ID NO: 171531 - RNA, 95 nt, Homo sapiens
agugaaguucugcugcccccgggccaggccaaguagaggccuguguggccagcggggagcaagcauccuucacaguggagcaaggccagaggccu

SEQ ID NO: 171532 - RNA, 67 nt, Homo sapiens
cggagcagcugggggccaguguggagggggcgcugcuccaccgccaggccuaaggagagggcagggc

SEQ ID NO: 171533 - RNA, 26 nt, Homo sapiens
gccgcgcugaggggacagaggcucga

SEQ ID NO: 171534 - RNA, 46 nt, Homo sapiens
aacauaagucaguuaucuacagguacagguugaugagaggccucuc

SEQ ID NO: 171535 - RNA, 44 nt, Homo sapiens
gggcuugguccugugcuugagaaggcacgugaggauguggaaga

SEQ ID NO: 171536 - RNA, 71 nt, Homo sapiens
gugugaagaggggguccaguacugaagggggaaaaguuggaucaggauuaauucauguauuuugaugaugg

SEQ ID NO: 171537 - RNA, 44 nt, Homo sapiens
acaugacaaacgaucaggucagcgggcuugguccugugcuugag

SEQ ID NO: 171538 - RNA, 45 nt, Homo sapiens
gugacaaauguaaggcuauuugaggccagauuuuugaugggaaga

SEQ ID NO: 171539 - RNA, 41 nt, Homo sapiens
ugcaggugauggccgggaggauacucagcaggcagguggug

SEQ ID NO: 171540 - RNA, 46 nt, Homo sapiens
ugcaagggagacauccugaaaugucaucagugugaaaauugucugc

SEQ ID NO: 171541 - RNA, 45 nt, Homo sapiens
uggucugggggcaggcagccucagugugccggguggacagcagga

SEQ ID NO: 171542 - RNA, 86 nt, Homo sapiens
ggguuuuguguuggcugauccaugaggcuucuuguguugagaugagauuagaugguuagaugagauuagauguuuagaagcaggag

SEQ ID NO: 171543 - RNA, 42 nt, Homo sapiens
aagcagggaaccuaaggaaauugcgaaaggaaaaagaaucca

SEQ ID NO: 171544 - RNA, 46 nt, Homo sapiens
uuuaccugcccugucgagggcugugggaaaucauucaccagagcag

SEQ ID NO: 171545 - RNA, 53 nt, Homo sapiens
aagcagccagggguguggggaggugggauggccuggacgggggccuuaacagu

SEQ ID NO: 171546 - RNA, 50 nt, Homo sapiens
cacaguauauggugauggauuuggauuuuaguugaugucagugugucagc

SEQ ID NO: 171547 - RNA, 53 nt, Homo sapiens
aggugauuguaacuuugaaugugucuuguuuuuccucugaugccugugugcag

SEQ ID NO: 171548 - RNA, 45 nt, Homo sapiens
acagcaugaaggcgcacauggucagacagcacagccggcgccaag

SEQ ID NO: 171549 - RNA, 81 nt, Homo sapiens
ucugggagggaaccucccugcuaauaauagcucccuagggccgauggaaccccugguccugguggcccacagugauauucc

SEQ ID NO: 171550 - RNA, 46 nt, Homo sapiens
gcccaugaagaacuugagugacgacccacuggcuuugaccuccaau

SEQ ID NO: 171551 - RNA, 48 nt, Homo sapiens
gcuggcuccaaucaagguggagccggacucgccuucucgcccaggagc

SEQ ID NO: 171552 - RNA, 13 nt, Homo sapiens
cugcaggugggag

SEQ ID NO: 171553 - RNA, 40 nt, Homo sapiens
ugucaugaugcuuucaaagaggaugggccuaucgcucugg

SEQ ID NO: 171554 - RNA, 118 nt, Homo sapiens
cugcuagguuucuucaccaucaacuucuuguuuuucccuuuguaauuaacuaucuugcaguagaugcuuugagacuguauguggggcuugggggucccuaagaccaccuucacuucua

SEQ ID NO: 171555 - RNA, 26 nt, Homo sapiens
gcccaccugagacucacugucuggag

SEQ ID NO: 171556 - RNA, 46 nt, Homo sapiens
uggaaucgacuccuccuccagagagcccugguuucuuuuguuagag

SEQ ID NO: 171557 - RNA, 56 nt, Homo sapiens
uaagcuuaaaaacgugaacagcuucagaacuauaaauggguauguauaccuuucug

SEQ ID NO: 171558 - RNA, 57 nt, Homo sapiens
gaauacaugggaagcacacucuccgcuguguguugucuaggagaggugcacccugua

SEQ ID NO: 171559 - RNA, 45 nt, Homo sapiens
cguauaauaucaaacaauguaaaagccaauagaaaucucagauaa

SEQ ID NO: 171560 - RNA, 70 nt, Homo sapiens
uaaaguugauuuaacagauccuauuccauguccuuugaauauuuauagaaauuaaauggaacaaauuagg

SEQ ID NO: 171561 - RNA, 239 nt, Homo sapiens
aaacaaaaccucuagacaaucaggugaaagaagaaauaaaagcgaggcugggcgcgguggcucaugccuguaaucccagcucagcuacucaggaggcugaggcaggagaaucgcuugaacccgggaggcagagguugcagugagccaagaucgcaccauugcacugcagccugggcaacaagagcgaaacuccuucgccaaaaaaaaagaaaaaaaauaaaagcuaauuacaaauacag

SEQ ID NO: 171562 - RNA, 52 nt, Homo sapiens
agccaaaacuaaaugcaaguuugugccucagaugucuuccuaucagaacaga

SEQ ID NO: 171563 - RNA, 59 nt, Homo sapiens
aacaaaaugcagaguuuucuaggaaaacaaguaaucauucagaaauaagaauaugaaua

SEQ ID NO: 171564 - RNA, 40 nt, Homo sapiens
gggucauuugguaauguguucaggagccaaaaaauaugca

SEQ ID NO: 171565 - RNA, 45 nt, Homo sapiens
uggccuggugggccugagggacucagguggugaugaggaguggcc

SEQ ID NO: 171566 - RNA, 83 nt, Homo sapiens
cagguuaagugugugccuaccucccuguggcuggagcacuguuguggccaccccgggacccccugagccuggugucgcccugg

SEQ ID NO: 171567 - RNA, 43 nt, Homo sapiens
uuuuuauaaucuguuucacuuuaaaacaaaaaucuuugcacac

SEQ ID NO: 171568 - RNA, 71 nt, Homo sapiens
ugugccacaugugucaugaggugcccagguggguuuggauuuggaugagggcaucuuugaggaugcagggg

SEQ ID NO: 171569 - RNA, 82 nt, Homo sapiens
ccugggagagucucgccaaggaaacaggaccaggccuggggcucagagaggcaagaggaggggcagccugggcagagguggg

SEQ ID NO: 171570 - RNA, 78 nt, Homo sapiens
cugggaagggggcagggaagaggcugcgggcagcuggggguggcccugugcugguuggaagcuagcggugagcgucag

SEQ ID NO: 171571 - RNA, 34 nt, Homo sapiens
guuuccagcuucugaagagguaagaacuccccag

SEQ ID NO: 171572 - RNA, 50 nt, Homo sapiens
ucagcuggcagggcagagguacagagucaggaccagaggcuuggcaauag

SEQ ID NO: 171573 - RNA, 60 nt, Homo sapiens
gucaucuaugaaaugggaacaguagugcagaccuugacacacaggagcuucucaaacaga

SEQ ID NO: 171574 - RNA, 57 nt, Homo sapiens
gauuugcuggagagcacucuggguacacaagguugguggggguacagggcgugccag

SEQ ID NO: 171575 - RNA, 41 nt, Homo sapiens
ugaaccuagaccgugacuaaaauaaaucucugauuauucca

SEQ ID NO: 171576 - RNA, 69 nt, Homo sapiens
auaaucuagcucuuuagaaucccagagcaucccuuccaccacggccuguugaugaagcaagucacccag

SEQ ID NO: 171577 - RNA, 52 nt, Homo sapiens
cacugacauacgaugauaauuucugggguuuuuuugguaguuggauaguaaa

SEQ ID NO: 171578 - RNA, 49 nt, Homo sapiens
ggcauccaagucccuggagagaaaguccaggaagaacucccugagggag

SEQ ID NO: 171579 - RNA, 43 nt, Homo sapiens
caaggagaagccauaaagguacauaggagacaccgugucagac

SEQ ID NO: 171580 - RNA, 28 nt, Homo sapiens
acagugaugucacccuguacaucgauga

SEQ ID NO: 171581 - RNA, 47 nt, Homo sapiens
gcuggagguccucguacuugugccgcccacaaaguacagugagggaa

SEQ ID NO: 171582 - RNA, 48 nt, Homo sapiens
uguacugcucagaaguuucccuugaagggacaagugagggccggaugg

SEQ ID NO: 171583 - RNA, 32 nt, Homo sapiens
gugugugaaauggaaaggaaggccuggaagag

SEQ ID NO: 171584 - RNA, 39 nt, Homo sapiens
ucugugugaaugaggccagcucagcaggugcccguggac

SEQ ID NO: 171585 - RNA, 31 nt, Homo sapiens
caagauguguucaccguggagccacaguuug

SEQ ID NO: 171586 - RNA, 53 nt, Homo sapiens
ccagagggaagucauccaggccuugcacccagagacccucaucagcugccagu

SEQ ID NO: 171587 - RNA, 69 nt, Homo sapiens
agcgucccucagaggaucauggcccgucaccuccaccccauccagaccagcuuccaggaggcuacagcc

SEQ ID NO: 171588 - RNA, 91 nt, Homo sapiens
cacaucgaccccaagacggguguggcuguggcccgggccgugggauccgugacgguuuacuaugaggucgcugggcaccugaggaccuaca

SEQ ID NO: 171589 - RNA, 52 nt, Homo sapiens
cagaaagcauuugccagcccuuuucuggaacagcucugccaagucggugggg

SEQ ID NO: 171590 - RNA, 46 nt, Homo sapiens
ucggacuucaugccccugccuguccuacaggccaucuccccagagc

SEQ ID NO: 171591 - RNA, 42 nt, Homo sapiens
gggaagggccccaccaacaacaccugcguuguccgcacaguc

SEQ ID NO: 171592 - RNA, 51 nt, Homo sapiens
cuggagaugucuuccaugcucacaguucgguccucaacuuugccacuaaca

SEQ ID NO: 171593 - RNA, 45 nt, Homo sapiens
agaacaaauauuaaugucgcccaacucauauauaaagcugcagac

SEQ ID NO: 171594 - RNA, 55 nt, Homo sapiens
gcucacugugucugaguggcugauaauuuaaucguuuguguuuauuuaacacaca

SEQ ID NO: 171595 - RNA, 59 nt, Homo sapiens
cucaguccguggggaugacagugguccaucgcagugggguaaacauccgggugugauug

SEQ ID NO: 171596 - RNA, 52 nt, Homo sapiens
gaguaucuuggccauggagaggugcagcccgcugcaggggagggacaguaug

SEQ ID NO: 171597 - RNA, 52 nt, Homo sapiens
cacaacaccugcuguggccuuuugccgucuugccuccgccugugcccucaag

SEQ ID NO: 171598 - RNA, 46 nt, Homo sapiens
ugcugcugcuaagggccgugaggauccgcgcccccaucaugcggau

SEQ ID NO: 171599 - RNA, 42 nt, Homo sapiens
gucugggcucgugcaggcaguggaugcagagaccggcaaggu

SEQ ID NO: 171600 - RNA, 44 nt, Homo sapiens
caaccugggugacucuccugauucccaggucuguggguugaggu

SEQ ID NO: 171601 - RNA, 29 nt, Homo sapiens
aagagaaucuuacaucuuaauucugacug

SEQ ID NO: 171602 - RNA, 46 nt, Homo sapiens
gcugcccaugcagcuggugucccaggacgaugagaguggccaaaag

SEQ ID NO: 171603 - RNA, 45 nt, Homo sapiens
ucucuuggggcaagagagcuagaaggaguugggaggagcccucau

SEQ ID NO: 171604 - RNA, 53 nt, Homo sapiens
ccccucaaggugagccaggggcccugcccuuuaccaccccccugcccacuccu

SEQ ID NO: 171605 - RNA, 46 nt, Homo sapiens
ccagcaucuugacauuuccguggcaaccaaagacgggcgccuauca

SEQ ID NO: 171606 - RNA, 40 nt, Homo sapiens
uucuauuuuccuuagucuuuaagaagcccaucagccuuag

SEQ ID NO: 171607 - RNA, 37 nt, Homo sapiens
ucccagaaugggucauaccaucgcaucagggcacuaa

SEQ ID NO: 171608 - RNA, 43 nt, Homo sapiens
uguccuggcagagggaauugcuuaggcaaugguguggaaguga

SEQ ID NO: 171609 - RNA, 54 nt, Homo sapiens
auuauagagggacccuaaggugacaugacaguaggcagguaccuuagcagggag

SEQ ID NO: 171610 - RNA, 45 nt, Homo sapiens
ggcccucauggaugcugcucaguugugacuauaugaguuuaaaaa

SEQ ID NO: 171611 - RNA, 45 nt, Homo sapiens
gcuucuagguuacccaacagcacuaucuacguggucgaaccugga

SEQ ID NO: 171612 - RNA, 46 nt, Homo sapiens
uggcugucuuggcccaggacacgucgauggucacugcacugcagcu

SEQ ID NO: 171613 - RNA, 50 nt, Homo sapiens
acucuccaugccuuccgaucaguacgaguugcagcuucagaacagcaucc

SEQ ID NO: 171614 - RNA, 74 nt, Homo sapiens
accagagcuucuugggaaaccccuagaggcuggacggaaccagcaagaaccccagugcccccucuacguagaag

SEQ ID NO: 171615 - RNA, 51 nt, Homo sapiens
cauccuagcccacguugggcaaguuauuuuucugccaagugggugugaagg

SEQ ID NO: 171616 - RNA, 47 nt, Homo sapiens
agcagucaccauugcugucaaaagugcuuguggucucugcccacaga

SEQ ID NO: 171617 - RNA, 52 nt, Homo sapiens
auggugggaaccuccauucacuacaaggugcagaagaucaggcaagggaaaa

SEQ ID NO: 171618 - RNA, 32 nt, Homo sapiens
ucccaugucuuccuggccucaccagcauccca

SEQ ID NO: 171619 - RNA, 48 nt, Homo sapiens
auuuuuauguguuugguuugguuuguuugagccucagcuuacaaagaa

SEQ ID NO: 171620 - RNA, 46 nt, Homo sapiens
acaucccuccuucuuacaucucagagauggagaaggcugccaagca

SEQ ID NO: 171621 - RNA, 73 nt, Homo sapiens
auuuacgucacgugugcguguggauaaaaugcagauucccaggcaucuuggagacaaagccugggccaggggc

SEQ ID NO: 171622 - RNA, 46 nt, Homo sapiens
gagccagacccugccugcauagugcugguccuuggugcagcacauc

SEQ ID NO: 171623 - RNA, 45 nt, Homo sapiens
ccacaggccagguccugcgcugugaugccauuguggaccucaucc

SEQ ID NO: 171624 - RNA, 46 nt, Homo sapiens
gagguggagggaccagcaucagcagaggaauagagguggagaagcu

SEQ ID NO: 171625 - RNA, 48 nt, Homo sapiens
aaugccuuaaagaccucaaggaggaccagcggugccaugggagcugau

SEQ ID NO: 171626 - RNA, 44 nt, Homo sapiens
agcagacaggcaccuacagaaaaauugagugcuguuacuggaag

SEQ ID NO: 171627 - RNA, 46 nt, Homo sapiens
cccauuaaauagcaacucccuauuuucuccugcucgggccuuggcc

SEQ ID NO: 171628 - RNA, 68 nt, Homo sapiens
uuuuccuauuuuuuuuauuuuauaacaucaaaauuggacaguuuucgggccaggggaaccuuagaggu

SEQ ID NO: 171629 - RNA, 99 nt, Homo sapiens
ugcuuuaugcaccuggaggcuccuauuucuggccugaugccagaggcugaacuugggcauuagguuuucuguaucccagucuaaggccuagucuugugu

SEQ ID NO: 171630 - RNA, 59 nt, Homo sapiens
ggucaagguugaggcagaacggggugugaccacgugacagccauguguguaagccugga

SEQ ID NO: 171631 - RNA, 42 nt, Homo sapiens
gguggccggaccccaaccccuggcccugcccugugggcagca

SEQ ID NO: 171632 - RNA, 38 nt, Homo sapiens
acgcgccgacggccgggcggacggacggacggacgccg

SEQ ID NO: 171633 - RNA, 44 nt, Homo sapiens
gguggauggguggguaagugaacagaugggugggugggcgggug

SEQ ID NO: 171634 - RNA, 40 nt, Homo sapiens
ccaucagaggcuggcaccugcucauaaaauacacaaaagc

SEQ ID NO: 171635 - RNA, 53 nt, Homo sapiens
gaugcguguuuguuuuugugguagguuggggcccagcccuaucaggacagcag

SEQ ID NO: 171636 - RNA, 29 nt, Homo sapiens
ggagacagauugcggggagaauggacaug

SEQ ID NO: 171637 - RNA, 73 nt, Homo sapiens
ccagggucuuacaggagaggggaccguccugggcuggccuggaccauggugcugcucugggagccugcaggag

SEQ ID NO: 171638 - RNA, 42 nt, Homo sapiens
gggcagcugcggccacgcuggggcccagggccagggccaggc

SEQ ID NO: 171639 - RNA, 46 nt, Homo sapiens
gcaggacugcacgggcguggagugcccgccgcuggagaacugcauu

SEQ ID NO: 171640 - RNA, 55 nt, Homo sapiens
ugcagcagggcugcgccugcgagggcuaccaguacuaugacugccuacagggugg

SEQ ID NO: 171641 - RNA, 46 nt, Homo sapiens
ggacuucgggagcacugagugcuccugcccaccaggcggcggcaag

SEQ ID NO: 171642 - RNA, 45 nt, Homo sapiens
cucuccaccggcgucagggcaguggcaggcccggcagggcggcag

SEQ ID NO: 171643 - RNA, 64 nt, Homo sapiens
ccgguggagagcucaucugcuaccagcuccccgguugccacgggaacuucucagaugccgagga

SEQ ID NO: 171644 - RNA, 108 nt, Homo sapiens
gggugaccccgagcgacacuacgaagaccccuacagcuaugaccaggagguggccgagguggaagcagcaacagcccuggggggugagguccaggcgggugcagucca

SEQ ID NO: 171645 - RNA, 68 nt, Homo sapiens
ccaggggggugccuggaugguggacaguggcugacucccaccucccagagcagcuggggggcccccug

SEQ ID NO: 171646 - RNA, 79 nt, Homo sapiens
ucacucuccuagcuuuggccugcacuggggcugggggacccagggcagcagccgcugugggccuggggaggacagcugg

SEQ ID NO: 171647 - RNA, 54 nt, Homo sapiens
ccagugcaggccaaagcuaggagagugaccgaggacagugaggaggaagaagag

SEQ ID NO: 171648 - RNA, 140 nt, Homo sapiens
ugcgggacguggcuugggcauccaggaugagguucucuucaggccuugccccagcuucugcccuugccccagcuucugcccucuccuccuggauaggaagacuggguccagcuggggcuguagugggcagcccauccagc

SEQ ID NO: 171649 - RNA, 106 nt, Homo sapiens
agucuuccuauccaggaggagagggcagaagcuggggcaagggcagaagcuggggcaaggccugaagagaaccucauccuggaugcccaagccacgucccgcagca

SEQ ID NO: 171650 - RNA, 74 nt, Homo sapiens
ggugggugggauccaggcugcaucaggcagugauguggacaggauguugugggggcugggcuugacuggguccc

SEQ ID NO: 171651 - RNA, 72 nt, Homo sapiens
agggacccagucaagcccagcccccacaacauccuguccacaucacugccugaugcagccuggaucccaccc

SEQ ID NO: 171652 - RNA, 50 nt, Homo sapiens
acccgagaagugcccaggaagccgcaaguucugccccauucccacgugga

SEQ ID NO: 171653 - RNA, 43 nt, Homo sapiens
cgugggaauggggcagaacuugcggcuuccugggcacuucucg

SEQ ID NO: 171654 - RNA, 63 nt, Homo sapiens
gcaugcagacucaguagaggagggugccccuccccuugucugugggaagccagccuugcagcc

SEQ ID NO: 171655 - RNA, 54 nt, Homo sapiens
cacggccccagggcaacagcaggagcgacugcccuuguguucuagguacagucu

SEQ ID NO: 171656 - RNA, 26 nt, Homo sapiens
ccugaguagagagagugagugggaga

SEQ ID NO: 171657 - RNA, 47 nt, Homo sapiens
cagccggacagcagugggccauugacaaugacgagugccuggagauc

SEQ ID NO: 171658 - RNA, 45 nt, Homo sapiens
uucaggacagcccagaggcacugcugugucuccuacuugcaggag

SEQ ID NO: 171659 - RNA, 97 nt, Homo sapiens
gcagccaacuugggccaugaagugacccugaagauggaagcuacaaguuaaagauaauuaaacauaaaaauagaagacuagguuccuaaagauguag

SEQ ID NO: 171660 - RNA, 47 nt, Homo sapiens
gaaauagaggcagaggaccccucugcccugggagagcgcauagucug

SEQ ID NO: 171661 - RNA, 51 nt, Homo sapiens
ugcagcaaugcugugacugcuguggccugggccuccgcgugcgggccgagg

SEQ ID NO: 171662 - RNA, 45 nt, Homo sapiens
aaccugggcuaucccugcaaucaugucaugcucuccugcugugag

SEQ ID NO: 171663 - RNA, 42 nt, Homo sapiens
ccucuccguggugcagcugcgggcucuggaggucggcgaacc

SEQ ID NO: 171664 - RNA, 71 nt, Homo sapiens
aaacuagugcagguccucaucaagaccucugugugcccagcagacagcaaggauggaugaagcaggaugga

SEQ ID NO: 171665 - RNA, 74 nt, Homo sapiens
acugggcacagaggccgagcugccgaacagccugccgggcgaugaccaggaugagugccuucuccucccgggag

SEQ ID NO: 171666 - RNA, 61 nt, Homo sapiens
agcugugccagcaccuuugcaucaauacuguggguucuuaccacugugccugcuuuccugg

SEQ ID NO: 171667 - RNA, 45 nt, Homo sapiens
gggucacccuccacagccggaagccccacaggagccugcacugaa

SEQ ID NO: 171668 - RNA, 29 nt, Homo sapiens
uucuguuuuggggaugaugggcuuacccu

SEQ ID NO: 171669 - RNA, 40 nt, Homo sapiens
gggcugagugaggagcugaggaagucacuggggagaugug

SEQ ID NO: 171670 - RNA, 48 nt, Homo sapiens
aucccuggcucuaaccuacuagugagacacagaaacaaggccccuaga

SEQ ID NO: 171671 - RNA, 35 nt, Homo sapiens
ccuuugggcccagcccugugaggccccucugccug

SEQ ID NO: 171672 - RNA, 44 nt, Homo sapiens
cagccaagccuuccuuggaaaccacuggcccagaacuuucccuu

SEQ ID NO: 171673 - RNA, 64 nt, Homo sapiens
gucagggauguaaaggcccugagaaggaagccagcugugcagguucaagggcccaccaggaggu

SEQ ID NO: 171674 - RNA, 46 nt, Homo sapiens
ugcagacaucaacgagugugugacggaccugcacacgugcagccgg

SEQ ID NO: 171675 - RNA, 46 nt, Homo sapiens
cauccuugagggcauagccuggcucacaggugagugccuuguagca

SEQ ID NO: 171676 - RNA, 36 nt, Homo sapiens
cucaccugugagccaggcuaugcccucaaggauggc

SEQ ID NO: 171677 - RNA, 56 nt, Homo sapiens
guggcccuucucugaccuugugguuggggcagcgggguccacacaggcaaacagag

SEQ ID NO: 171678 - RNA, 37 nt, Homo sapiens
aaauaaauccaucucaggugcucagaacaaugguggg

SEQ ID NO: 171679 - RNA, 46 nt, Homo sapiens
agacguggaugagugugcgaugggcacgcacaccugccagccgggc

SEQ ID NO: 171680 - RNA, 46 nt, Homo sapiens
cugcgcgcgcggcuaccacgccagcgaugaugggaccaagugugug

SEQ ID NO: 171681 - RNA, 46 nt, Homo sapiens
gugugcaccgcugcggugagggccaagugugccacaaccucccugg

SEQ ID NO: 171682 - RNA, 43 nt, Homo sapiens
caggccgccugugccagcacacgugugagaacacacucggcuc

SEQ ID NO: 171683 - RNA, 42 nt, Homo sapiens
cagacgugaaugagugugaggcccagcgcugcagccaggagu

SEQ ID NO: 171684 - RNA, 44 nt, Homo sapiens
ccagugugcaugcccugagcagggcuacaccaugacggccaacg

SEQ ID NO: 171685 - RNA, 46 nt, Homo sapiens
gcgcaggcagcggaagcuacccuggauguuguggcaggucucagcc

SEQ ID NO: 171686 - RNA, 48 nt, Homo sapiens
uuccgcugccugcgcuucgaguguccucccaacuauguccaagucucc

SEQ ID NO: 171687 - RNA, 46 nt, Homo sapiens
cacuuaaccucagaacugacagaccgcuacucugccaccagccaca

SEQ ID NO: 171688 - RNA, 57 nt, Homo sapiens
ggagugccagaacucgccagcgcgcaucacgcacuaccagcucaacuuccagacggg

SEQ ID NO: 171689 - RNA, 42 nt, Homo sapiens
cagggcgauggugucccccgugaaggcuggcgcggggccaau

SEQ ID NO: 171690 - RNA, 45 nt, Homo sapiens
caaugaggagggcuacuuuggcacgcgcaggcucaaugccuacac

SEQ ID NO: 171691 - RNA, 69 nt, Homo sapiens
agcucuggaggcagggcuccgucaccaccuuccuggccaagaugcacaucuucuucaccaccuuugccc

SEQ ID NO: 171692 - RNA, 45 nt, Homo sapiens
gguuuuuacuauaacuuuguaaauuaacuuaauuuugcugacuug

SEQ ID NO: 171693 - RNA, 71 nt, Homo sapiens
caggaggaaguuccacggcagguggugcguucccacgcaggcaccaaguggaagcuugcacggugggccac

SEQ ID NO: 171694 - RNA, 48 nt, Homo sapiens
auaaaguaguacauguacauuauauaaaaaaaaguucaacuaguauga

SEQ ID NO: 171695 - RNA, 42 nt, Homo sapiens
gauguggccaagggcaacacccugauucggccugauggagag

SEQ ID NO: 171696 - RNA, 41 nt, Homo sapiens
uuggagggaucucgcuccuggaagauggugaugggauuucc

SEQ ID NO: 171697 - RNA, 31 nt, Homo sapiens
cccuaggccccuccccucuucaaggggucua

SEQ ID NO: 171698 - RNA, 45 nt, Homo sapiens
ccagccaggcuuccuggaacggcugagcgagaccucgggugggau

SEQ ID NO: 171699 - RNA, 24 nt, Homo sapiens
gcauccacaguguggcuccggaga

SEQ ID NO: 171700 - RNA, 41 nt, Homo sapiens
acuaugggguccaucuuccggcugugaaacugcggaggcac

SEQ ID NO: 171701 - RNA, 46 nt, Homo sapiens
cccacagugccauggcaguggagucauucauggcaacagcccccuu

SEQ ID NO: 171702 - RNA, 46 nt, Homo sapiens
cuauccaagcuggaggacccucauguggacaucauucgccguggag

SEQ ID NO: 171703 - RNA, 46 nt, Homo sapiens
gggagacuugcgugucuccuuuuccuaugcuggacugagcggcgau

SEQ ID NO: 171704 - RNA, 69 nt, Homo sapiens
agaagggguuaacccuagaagaaucagugaucagucaguuccagcaagaacagcccagucugggcacga

SEQ ID NO: 171705 - RNA, 51 nt, Homo sapiens
ugccaugcuuugccaccaccaccaagcacaucugugauccugaagggcggc

SEQ ID NO: 171706 - RNA, 51 nt, Homo sapiens
cuaguaaggauuuuaaauaacugccgacuucaaaaguguucuuaaaacgaa

SEQ ID NO: 171707 - RNA, 65 nt, Homo sapiens
ccccggccggcggaacccuggcacagccugagcagaugcugcgggcggcgccgcagccaccccag

SEQ ID NO: 171708 - RNA, 49 nt, Homo sapiens
gagcaggcgacucucggucccuuccgcgguggugaaaggggcgccggau

SEQ ID NO: 171709 - RNA, 37 nt, Homo sapiens
uuaggccuggcucagcccccaguugaccuugggcaac

SEQ ID NO: 171710 - RNA, 56 nt, Homo sapiens
gccccauggggcuuuggucacugauauccucgggaguugaaauugaaccggggccu

SEQ ID NO: 171711 - RNA, 44 nt, Homo sapiens
ugccaacuuggccagagcguucguuugaauuuauggguucuggg

SEQ ID NO: 171712 - RNA, 44 nt, Homo sapiens
gagaacccugauggugaguaaggaacggaacugggguccaggag

SEQ ID NO: 171713 - RNA, 53 nt, Homo sapiens
uaccuggucagaggcuucauuuggaaaccugggcagaggcugaugccaagggu

SEQ ID NO: 171714 - RNA, 32 nt, Homo sapiens
ucugcucacaucggguccuugccgacccagag

SEQ ID NO: 171715 - RNA, 100 nt, Homo sapiens
aggugucaucucugaaggaaugaauguccuugaaaucaugaccugagucuucccucauggugcugacuagccuuggggcaagagaggaugucccuuagga

SEQ ID NO: 171716 - RNA, 45 nt, Homo sapiens
ucugccacugguagaauaucaauuagaacagacuuuuaaaaaaag

SEQ ID NO: 171717 - RNA, 52 nt, Homo sapiens
ucucuaugccugcuucauucuccauggaugcccuagcugcucaccaguguag

SEQ ID NO: 171718 - RNA, 91 nt, Homo sapiens
aauuugggggacagggagcucuguaggcugccgggacuggcauuuacugacacuggcaagugcgccucugggucugggaaggaggcugcca

SEQ ID NO: 171719 - RNA, 60 nt, Homo sapiens
aaugaacuguuaaacugggaucagcagaaaugggcagugggugucucagggggagagggc

SEQ ID NO: 171720 - RNA, 52 nt, Homo sapiens
uuuggggacccugcauccaagagaggggcgugugugagugagugggagugca

SEQ ID NO: 171721 - RNA, 47 nt, Homo sapiens
guggacaaggucugugggccucaggggucccgucuuguccuccuaga

SEQ ID NO: 171722 - RNA, 35 nt, Homo sapiens
guccuggcucugcugcagaguagccuggggcaagu

SEQ ID NO: 171723 - RNA, 40 nt, Homo sapiens
ccaggaggaagucccgggggaaggggaaggggcugggccc

SEQ ID NO: 171724 - RNA, 47 nt, Homo sapiens
cugccuucgggacuuuaggaaacgggauuuaaaacaauucaucccag

SEQ ID NO: 171725 - RNA, 52 nt, Homo sapiens
ggguggcagugccgagcuugggugagucuccaccccuucgauuuaggagccg

SEQ ID NO: 171726 - RNA, 42 nt, Homo sapiens
gggccgguguccaggccccaccccagcuuggccgcuuagugg

SEQ ID NO: 171727 - RNA, 84 nt, Homo sapiens
aucccuacccucacuccucuugcucuguggggucccaccugggccauuguguugcaaaggacucacgccuccuaccuccuuugc

SEQ ID NO: 171728 - RNA, 134 nt, Homo sapiens
ggucugucucuugucccuuaaguuacuggggacccagagagaccagauucugaugaggaauccaagacuggguccacaucaaugagaaggaagccaggauugauuagcagugucugucaagggggcaagguggg

SEQ ID NO: 171729 - RNA, 44 nt, Homo sapiens
ggugggguugggucuggcucaguggccucggaucuguucagagu

SEQ ID NO: 171730 - RNA, 46 nt, Homo sapiens
uuguguauucgaggcacuuccuuguaccuuccuuguguaauucacg

SEQ ID NO: 171731 - RNA, 46 nt, Homo sapiens
cuuucggacuaauuaggagaaaaguaagcagcuguaaucagugaaa

SEQ ID NO: 171732 - RNA, 36 nt, Homo sapiens
gucccaaaugucccucccacacaccugcacacaggg

SEQ ID NO: 171733 - RNA, 29 nt, Homo sapiens
aguuuaagcuaaauugcaauggaaaguug

SEQ ID NO: 171734 - RNA, 49 nt, Homo sapiens
agagcaggcaccugugcuccagaacacagugggcaccggugaccgacag

SEQ ID NO: 171735 - RNA, 68 nt, Homo sapiens
accucacucggacucagaaauucagcucgaccagaguguggugcuagaggaaccaaacagccugggau

SEQ ID NO: 171736 - RNA, 45 nt, Homo sapiens
gaagaagaaaguacauccucgucagggggaaaaacauguuuaaaa

SEQ ID NO: 171737 - RNA, 45 nt, Homo sapiens
gagaggguaacacugaggcugaagagagaaggugacuugcccaag

SEQ ID NO: 171738 - RNA, 23 nt, Homo sapiens
cuccucuuucuccuccagcccag

SEQ ID NO: 171739 - RNA, 44 nt, Homo sapiens
cucaguagacuuccagggcacuugguacccacagcugggcugga

SEQ ID NO: 171740 - RNA, 74 nt, Homo sapiens
agacuggccacaggcugagucuggcccccucuguguuuguguuugacccagguggugguuuagaaacugaaaaa

SEQ ID NO: 171741 - RNA, 46 nt, Homo sapiens
ucgccacgcuugaguuagccuuuccuugggagcagauaaccaacag

SEQ ID NO: 171742 - RNA, 48 nt, Homo sapiens
ggggcucccuggaccacugucuccauagauucugggcuagguacaggc

SEQ ID NO: 171743 - RNA, 43 nt, Homo sapiens
gacuuuccccagagccuuggacugaggugguagaugcuggggg

SEQ ID NO: 171744 - RNA, 45 nt, Homo sapiens
ggggacucccuggaggguguccucugaggucagacugagccgcag

SEQ ID NO: 171745 - RNA, 53 nt, Homo sapiens
aagcugcagugucugaaagauuuccacaaggacauccugaagcccucaccagg

SEQ ID NO: 171746 - RNA, 62 nt, Homo sapiens
aaagguauccaggaauaaaaaguacagugaagauauuuuuuaaauguagugacugcacuugg

SEQ ID NO: 171747 - RNA, 44 nt, Homo sapiens
cucugaggcuugaagucccugguagauuugaaggugagagggag

SEQ ID NO: 171748 - RNA, 48 nt, Homo sapiens
guaugggacggaggucacuuggggccuggcacucaucaguuccacaca

SEQ ID NO: 171749 - RNA, 46 nt, Homo sapiens
ccaugcagugagguguguuccagcugugguugcagugugcccaggg

SEQ ID NO: 171750 - RNA, 48 nt, Homo sapiens
cagcuggaacacaccucacugcauggaggacaccaugcgcaagaacaa

SEQ ID NO: 171751 - RNA, 46 nt, Homo sapiens
ggagccacugucuucgggggagugggaggagggugcagaucuggag

SEQ ID NO: 171752 - RNA, 55 nt, Homo sapiens
gggaugucagcacugccaucuccccaggugcaggugaggauaccacggcccagag

SEQ ID NO: 171753 - RNA, 47 nt, Homo sapiens
cauccucuucugggcucugcuugucucgcuguugucuaggacccagg

SEQ ID NO: 171754 - RNA, 52 nt, Homo sapiens
augucagcugagcaccuauuagguaccaggcacuguucagugaucaagacag

SEQ ID NO: 171755 - RNA, 59 nt, Homo sapiens
uauugauagauucccucugacuuguuggggcaggaguagagggaggaagaccaacgaag

SEQ ID NO: 171756 - RNA, 42 nt, Homo sapiens
guccuacaaagggacuaccaccagcaauggagaaggaggcgg

SEQ ID NO: 171757 - RNA, 40 nt, Homo sapiens
cuucaguccucugcuauaugcugggaucaccuggcaccuu

SEQ ID NO: 171758 - RNA, 29 nt, Homo sapiens
uuaaaauuuaggcucuguuuucucuuaaa

SEQ ID NO: 171759 - RNA, 32 nt, Homo sapiens
ugcauauacauguguacaccacacacacacac

SEQ ID NO: 171760 - RNA, 48 nt, Homo sapiens
ugacucuaggcaaagaugugaaggaagugaagggcugagccaggugag

SEQ ID NO: 171761 - RNA, 42 nt, Homo sapiens
gacugcccagagaggugggggcaccugccugcaaucacaguu

SEQ ID NO: 171762 - RNA, 62 nt, Homo sapiens
ugggagacccauggccuucccugggucacacugcauguuccagacaggccaagaucaggugu

SEQ ID NO: 171763 - RNA, 52 nt, Homo sapiens
cagcccuccucucuuuccuugccaccucccucccccucauagguguggauug

SEQ ID NO: 171764 - RNA, 83 nt, Homo sapiens
aguauaacucguacaggcaaguguugcgccggcgggccugguggacuuuagaaaugaugaugaugauguuuaaagaaaaagag

SEQ ID NO: 171765 - RNA, 45 nt, Homo sapiens; identical to SEQ ID NO: 94403

SEQ ID NO: 171766 - RNA, 53 nt, Homo sapiens
cagcaucgcguguccagauguucccuucucagaugaggagaccagcaaccuga

SEQ ID NO: 171767 - RNA, 46 nt, Homo sapiens
cauucuuuuuuuuauuaugcuucucuugcuuggacuggauagccag

SEQ ID NO: 171768 - RNA, 21 nt, Homo sapiens
cuaaaccccguaucccacccc

SEQ ID NO: 171769 - RNA, 48 nt, Homo sapiens
augccucuugggaagccuuugagcaacugagacccccugagagguugg

SEQ ID NO: 171770 - RNA, 50 nt, Homo sapiens
ggucaagcagaggagggugaguccagggagaggaggcggccagccagcaa

SEQ ID NO: 171771 - RNA, 50 nt, Homo sapiens
ugcuauaauucgguggcaauuuagguucaaaaccccugcggcagacacau

SEQ ID NO: 171772 - RNA, 43 nt, Homo sapiens
gaugccuacccacaggguggaguuuuaucaauuaaaaaaugag

SEQ ID NO: 171773 - RNA, 65 nt, Homo sapiens
ccgagcagcaggcaaggguggccugagcgucagccgcucaccagcucucucucuuccccuccuca

SEQ ID NO: 171774 - RNA, 37 nt, Homo sapiens
gccccuaccuggcccucucacccagcugcugccucca

SEQ ID NO: 171775 - RNA, 61 nt, Homo sapiens
acuauucagagggugagcaggggccaggaggaggggcgauuucagaugcagacaagggaag

SEQ ID NO: 171776 - RNA, 46 nt, Homo sapiens
uuuaugaugguauugaggacaugauuggcuaucggcccgggcccug

SEQ ID NO: 171777 - RNA, 78 nt, Homo sapiens
ucuguguugugaguuccauuucuguggcucuggcugguggccucuucucccuggggcuugacauuuucacccgcuaaa

SEQ ID NO: 171778 - RNA, 91 nt, Homo sapiens
gcuuauaauaaacccagcuucagcgcugccugggagaggggaggaaggcugcuccagggaguuagcuugaguugaguuuugaaggauaagu

SEQ ID NO: 171779 - RNA, 47 nt, Homo sapiens
gagggccaggcagaggaaacagcccaugccaagacccagaguucagu

SEQ ID NO: 171780 - RNA, 62 nt, Homo sapiens
aggacuggcucagaacucacaccccucucugcugccauaaggaucccccccgccccgguaaa

SEQ ID NO: 171781 - RNA, 85 nt, Homo sapiens
gggauccuuauggcagcagagaggggugugaguucugagccaguccuuucccaaggagagagacccuucccucagguugaggcca

SEQ ID NO: 171782 - RNA, 60 nt, Homo sapiens
ccccaccccccgaugcccaggaccccucuccugacugcccccaucucuccgcagggaugu

SEQ ID NO: 171783 - RNA, 67 nt, Homo sapiens
ucccuuggucaucgucauccgccucugccagacugaggggccguuccuugugguaagugcuugggcc

SEQ ID NO: 171784 - RNA, 72 nt, Homo sapiens
ggaggcgcgaggccaaaggugauuguugucaguuugcugcgugaucucaggcaagucaccugcccucucuga

SEQ ID NO: 171785 - RNA, 41 nt, Homo sapiens
uaugggaggcugaggaguuuggaguuucuccuuggggaagg

SEQ ID NO: 171786 - RNA, 38 nt, Homo sapiens
acugucuucagccuccauggcucccaccuuccccaagg

SEQ ID NO: 171787 - RNA, 43 nt, Homo sapiens
agccacaccuuacaacucucgcaccgucaugaacggcgcucuc

SEQ ID NO: 171788 - RNA, 46 nt, Homo sapiens
cuuuccugcuguuuacuaacauuagauucucauaggaccagguuua

SEQ ID NO: 171789 - RNA, 74 nt, Homo sapiens
guguguguaucguguguguguguuuuguuuugauuugggggauauuuuguacaaaaagaaaacccacgggaaga

SEQ ID NO: 171790 - RNA, 45 nt, Homo sapiens
ugaauuagauguauuuuaugggaauuugguaaauuuuucuuugua

SEQ ID NO: 171791 - RNA, 73 nt, Homo sapiens
uaaacgcaggauggaauuuuccugggacucuacacccaucuuaaggugguauaccuuccaaauccugguucag

SEQ ID NO: 171792 - RNA, 61 nt, Homo sapiens
aaaggagggcugugaggagauaccucauuaaacuuggcuuagugaagaagagagaugccaa

SEQ ID NO: 171793 - RNA, 48 nt, Homo sapiens
ucuugcgaggcugaguugugagccucacuccugccagccuucuuggau

SEQ ID NO: 171794 - RNA, 36 nt, Homo sapiens
uccugccgggagagccucugcuccuucucugccugg

SEQ ID NO: 171795 - RNA, 46 nt, Homo sapiens
gccuauauccuuugguccacucaccuccccaccacuccccuagucc

SEQ ID NO: 171796 - RNA, 114 nt, Homo sapiens
ggugucggggaggggugcuuucuuuccucaucuccccacuccccacucucagccugggagacuccugccaagcccucauuaaagaugccacccugggcugcccuggcaccuagc

SEQ ID NO: 171797 - RNA, 60 nt, Homo sapiens
ugaagagcuuuguuauauccuaggucagcaccacgggcugcccuuguucugaacugggag

SEQ ID NO: 171798 - RNA, 76 nt, Homo sapiens
aaaccccugcaauagcuggguuuacagacauuuaccaccugcggacccaaaagagaaggccuaggagaguuuucua

SEQ ID NO: 171799 - RNA, 42 nt, Homo sapiens
cauacauauuucacuguuuccaaagcuaucuacucugccaaa

SEQ ID NO: 171800 - RNA, 47 nt, Homo sapiens
aaaguuauauaagacaaaggaaaacaggucacaaugcuacuccauaa

SEQ ID NO: 171801 - RNA, 47 nt, Homo sapiens
gguggcacguggggaagaggggacuuggcacgcaguggcuaccuggg

SEQ ID NO: 171802 - RNA, 80 nt, Homo sapiens
uuucacccagggagcccccgcuggggagauggaaacugaaaugaccacaaaugcccagguagccacugcgugccaagucc

SEQ ID NO: 171803 - RNA, 80 nt, Homo sapiens
gggccuggggacuuggucugccugugucuuuggucuagaauuuggucugagaaucuuauaagaagaggccuuccucaggc

SEQ ID NO: 171804 - RNA, 104 nt, Homo sapiens
aaggccacaguauuuuggguugguaggcaaauugcaacauucuggacauggccugaggaaggccucuucuuauaagauucucagaccaaauucuagaccaaaga

SEQ ID NO: 171805 - RNA, 42 nt, Homo sapiens
aggcaccugucuccaaucagagcccucucgcccagccagccc

SEQ ID NO: 171806 - RNA, 53 nt, Homo sapiens
agccagccagaucuggaaaggaagcgaggggguuguuuaaaucaauuuuuuaa

SEQ ID NO: 171807 - RNA, 36 nt, Homo sapiens
uucaagaaaauccauuccuggcucacagugccuccc

SEQ ID NO: 171808 - RNA, 43 nt, Homo sapiens
uuucuugaaacagcucuagcugcagguucuccgagguaggugc

SEQ ID NO: 171809 - RNA, 51 nt, Homo sapiens
cuccccuccauguucagggaugaggggagcagcagcagccacacucccacc

SEQ ID NO: 171810 - RNA, 43 nt, Homo sapiens
agggaucucaauuccuagcucaccaagggcugcugggaggaag

SEQ ID NO: 171811 - RNA, 38 nt, Homo sapiens
ugagaucccuguuugugaaagagggaacugaggugcag

SEQ ID NO: 171812 - RNA, 47 nt, Homo sapiens
uggauccccagcauacccccaaagacaguggggaaacacaaggggag

SEQ ID NO: 171813 - RNA, 57 nt, Homo sapiens
gcugggugggggaccaguguggcgguacccgggugauacaagagugcccugaagugg

SEQ ID NO: 171814 - RNA, 105 nt, Homo sapiens
gcaccuaacugcuccccgcagcccaccccacccaagauucagacacaagccaggaaaggacccaagagaaaauccuucaagguggccugaggucccaucccuccc

SEQ ID NO: 171815 - RNA, 47 nt, Homo sapiens
uuuucucuuggguccuuuccuggcuugugucugaaucuugggugggg

SEQ ID NO: 171816 - RNA, 77 nt, Homo sapiens
ucagacccauguggucccaggccaggcugccugggacacgguaaauaccacugugugcaaaaaucgaaguacaaaac

SEQ ID NO: 171817 - RNA, 45 nt, Homo sapiens
uuggcucucuggguuuguuuuguuuagucuugugguuuuguacuu

SEQ ID NO: 171818 - RNA, 28 nt, Homo sapiens
uucucuugugggugucacuacagacaug

SEQ ID NO: 171819 - RNA, 33 nt, Homo sapiens
uuaaacuuuuauaaaaaaaaaaucaaccaacaa

SEQ ID NO: 171820 - RNA, 42 nt, Homo sapiens
gcccuccuccuaccagcgcgcgggcggcggcggcggcggcac

SEQ ID NO: 171821 - RNA, 105 nt, Homo sapiens
gggccgggucggcgggggcggggccgggggcggggcgcgaggggcgcggccggguggagaggccggcgccuggucuugggucagcaggugggcugcuucccuccg

SEQ ID NO: 171822 - RNA, 48 nt, Homo sapiens
auaauuccagagagucauaaguucugugaaagaaaagaagccaaauga

SEQ ID NO: 171823 - RNA, 17 nt, Homo sapiens
aauggcauuccagacag

SEQ ID NO: 171824 - RNA, 56 nt, Homo sapiens
ucugaggcuuauaauuccccauuugucaaacagggaggugggagccagcauugaga

SEQ ID NO: 171825 - RNA, 23 nt, Homo sapiens
uuauuguguagguuaaguuuuaa

SEQ ID NO: 171826 - RNA, 28 nt, Homo sapiens
gaacaaucaagccaugucauuuccccaa

SEQ ID NO: 171827 - RNA, 46 nt, Homo sapiens
agaucaacagcagauguacuuugguggagccccagugcagggggag

SEQ ID NO: 171828 - RNA, 15 nt, Homo sapiens
gaauuuuaucaaaug

SEQ ID NO: 171829 - RNA, 24 nt, Homo sapiens
aguguaguguguuuccauguaauc

SEQ ID NO: 171830 - RNA, 52 nt, Homo sapiens
gaggaugaaaagaugcacagauggacagacagauguauauauagacagacag

SEQ ID NO: 171831 - RNA, 66 nt, Homo sapiens
aaagcaaaugccugugaguucccucaaccaaccucuggccuuuuggguuggacucucuuuggccug

SEQ ID NO: 171832 - RNA, 32 nt, Homo sapiens
gggagccauuggcaugguaagugugagugucc

SEQ ID NO: 171833 - RNA, 39 nt, Homo sapiens
ggcccuggggauauagcagugaaucagauguagucucua

SEQ ID NO: 171834 - RNA, 45 nt, Homo sapiens
ugggaaggugauccuggcuuccccagagacauccagcgccaagca

SEQ ID NO: 171835 - RNA, 85 nt, Homo sapiens
acauaauauaaaacuuaacaucuuaaccagcuuuagguauacaguuuaguggcauuaaguagauuuacauuguuguaccacuauc

SEQ ID NO: 171836 - RNA, 31 nt, Homo sapiens
gccucuguggagcguuuacuggggaagacgg

SEQ ID NO: 171837 - RNA, 139 nt, Homo sapiens
ggaauggagaaguauuuuacaagaacacaguaccaggaaugccaggggcacaggccuguguucugugauggcugcuugguuccacuuucuucuguggucacaaaauucacaggaacuuugggcacuguaguccugguuu

SEQ ID NO: 171838 - RNA, 52 nt, Homo sapiens
ccuuuguccugguaaacccaacccauccuaucccuucucugaagcccucacc

SEQ ID NO: 171839 - RNA, 131 nt, Homo sapiens
uguugcauacucauauaauucacucuuuacaggccugucuuccccaucagaaugucagagcaaaaaccaugucuuaccaucuaucucuguauuccugucuucuugcucagcaaggaaaggcucucuacaaa

SEQ ID NO: 171840 - RNA, 37 nt, Homo sapiens
uauuagugucacucaaagggauagagaacucaaggaa

SEQ ID NO: 171841 - RNA, 99 nt, Homo sapiens
gaugcacacuugggaaaugguuuugcauacuagagcuuagaacagugggauucucuguagccaccauaaaugguaauccugugaaauguauccuccuug

SEQ ID NO: 171842 - RNA, 42 nt, Homo sapiens
aaaagccccggguuccuuuuuauuagaugaucuucaggagga

SEQ ID NO: 171843 - RNA, 96 nt, Homo sapiens
aagcacuuaauaccacagacagcuccucuucuccaagcuuggcagaugggauagacaccaguggaggagggagcauccacgucaucagcagagacc

SEQ ID NO: 171844 - RNA, 31 nt, Homo sapiens
augggacuucagaaucagacagcaacucuag

SEQ ID NO: 171845 - RNA, 168 nt, Homo sapiens
cugcaauguuccucuaaacuuuauggagccuccuagauacaccaaggauuuggugcuaggagcuggggauggagaagaauguagaaggcaaggguaguccccagcacugugcuaugcacagugugacucaacaaacugaagccaggccgggaacugugccuaggccuu

SEQ ID NO: 171846 - RNA, 39 nt, Homo sapiens
ccucagauaaacuaauggaaaaaaguuuguuugggugca

SEQ ID NO: 171847 - RNA, 51 nt, Homo sapiens
uacauccuguuugcauauucauuuuuucuuuaucuugauauuuacugucug

SEQ ID NO: 171848 - RNA, 46 nt, Homo sapiens
ccuuuuauagauuggcccggauccucguucgccugccggcacucag

SEQ ID NO: 171849 - RNA, 54 nt, Homo sapiens
gucucauuggcaauguuucgauagacagcauaauccccuacauccucaagaugg

SEQ ID NO: 171850 - RNA, 57 nt, Homo sapiens
acaguggcauguggaagacccggucaauugcuuugucuuuugcuuuuuaaauagucc

SEQ ID NO: 171851 - RNA, 44 nt, Homo sapiens
aggguaagugggaacaguguuuccaacuucuaaauucuuguuug

SEQ ID NO: 171852 - RNA, 100 nt, Homo sapiens
ggcaauauccacgcuacacacauacuuauuagcugucuuacuuguuugggggauaguuacggcaaggagcaaaaaauucuaaggacucuagcuguuucua

SEQ ID NO: 171853 - RNA, 47 nt, Homo sapiens
uuaaacugagacucggcccuugagagccagggccuggcccagcagua

SEQ ID NO: 171854 - RNA, 53 nt, Homo sapiens
cuaaggaaggagcaggccugugguggggggggugagaggggcucugggaucug

SEQ ID NO: 171855 - RNA, 54 nt, Homo sapiens
cugaccaugaagccucaucuucucgucggccagggugcugccguuugugggguc

SEQ ID NO: 171856 - RNA, 46 nt, Homo sapiens
cgccucuggcugagcacggccgccggggacaccggucagguucagg

SEQ ID NO: 171857 - RNA, 47 nt, Homo sapiens
acacaaaauagccagagagaccgagugcaacccauacaccagaccgg

SEQ ID NO: 171858 - RNA, 46 nt, Homo sapiens
cuuccuaaugauccagugguaaacaagaauaucccuaagacuguga

SEQ ID NO: 171859 - RNA, 46 nt, Homo sapiens
uaagccacaugggcacagaaagugccgaggaggaagaugccccaaa

SEQ ID NO: 171860 - RNA, 31 nt, Homo sapiens
gguaauuuaacaaaaucacaaaguuaguggg

SEQ ID NO: 171861 - RNA, 44 nt, Homo sapiens
uacucuggugagaagagacaauacugguaaguaauagucucuaa

SEQ ID NO: 171862 - RNA, 40 nt, Homo sapiens
aaaagacaagggagaaacgcaggaguucuugagaaaaccu

SEQ ID NO: 171863 - RNA, 45 nt, Homo sapiens
gauuuggaagaauuuuugagauagugccaaaggauuagcugagag

SEQ ID NO: 171864 - RNA, 52 nt, Homo sapiens
gaugaaacugagggagacgaacauggaggcagacuguugggcaaguagagga

SEQ ID NO: 171865 - RNA, 45 nt, Homo sapiens
gaagacggcaguugccauagauaaaaauaaauuagggaagaagga

SEQ ID NO: 171866 - RNA, 47 nt, Homo sapiens
gccauaaguucaguuaaggagaaagcauguuuauguguucagugggu

SEQ ID NO: 171867 - RNA, 43 nt, Homo sapiens
cuuggaaaagauuauuuccaagcaugaggguuuugcaaccuuu

SEQ ID NO: 171868 - RNA, 43 nt, Homo sapiens
ugauggugaaaauaagcaguuaauacugcacuuauaaggaugg

SEQ ID NO: 171869 - RNA, 44 nt, Homo sapiens
agccugcuauauuuggcacaguagauguccaaugugcgguaacc

SEQ ID NO: 171870 - RNA, 45 nt, Homo sapiens
acagucuguaccacaggguucaguaauguguccaggcuggggcag

SEQ ID NO: 171871 - RNA, 46 nt, Homo sapiens
cacaauaacaauauuaauuaaauuuccaauacuugggucuuuauag

SEQ ID NO: 171872 - RNA, 60 nt, Homo sapiens
caggguuggggggcgcagaggggaaugggucacagcagugaacaaaaaggcaaggaguac

SEQ ID NO: 171873 - RNA, 33 nt, Homo sapiens
cagguaaaucagggcucgucuauuaaaagaaaa

SEQ ID NO: 171874 - RNA, 55 nt, Homo sapiens
agccagagggacaaugagacugagacagagacagagguagaagaguuugguauua

SEQ ID NO: 171875 - RNA, 75 nt, Homo sapiens
ugaugggaauguguugucuuagcucaggggugaaaacagguccaggggagccucugcauagguaagaaugcaacu

SEQ ID NO: 171876 - RNA, 43 nt, Homo sapiens
gcuguguuuucucauuugacuuuuuaccuguggaccagauauc

SEQ ID NO: 171877 - RNA, 56 nt, Homo sapiens
ugaauuuauguuaccaaacacagaauauauauucagugaacaagcaggugauaaac

SEQ ID NO: 171878 - RNA, 111 nt, Homo sapiens
uacucugugacccaucaaugcugugccuaaggaaauaaucagacaauuguguaaagguguuuaugaacgagauccaguacaguguuguuuauuauagcaaaagccuggaaa

SEQ ID NO: 171879 - RNA, 33 nt, Homo sapiens
aggauuuagugguucuuaucagugcuuccuggu

SEQ ID NO: 171880 - RNA, 46 nt, Homo sapiens
caaucacagaaugguagguguuuuuuaagguucaugaaaauagaaa

SEQ ID NO: 171881 - RNA, 46 nt, Homo sapiens
ccaagugauucagauguuuagcuaaauuugagagucacugcuaaag

SEQ ID NO: 171882 - RNA, 35 nt, Homo sapiens
uuccugggcuggaggaaaugucauugucaaauccu

SEQ ID NO: 171883 - RNA, 44 nt, Homo sapiens
uguuucucugucuuauuccgugacccauuuucucugugcaggag

SEQ ID NO: 171884 - RNA, 54 nt, Homo sapiens
acaggacauuuaucacaguuuugaccgugcuaguaagaccauugaccuaaacuu

SEQ ID NO: 171885 - RNA, 41 nt, Homo sapiens
ggaucggguggagagcguggcaagccugaagacugggaggg

SEQ ID NO: 171886 - RNA, 46 nt, Homo sapiens
guccacugauuaagggugaagggauugacucgaaugggcuggaaaa

SEQ ID NO: 171887 - RNA, 57 nt, Homo sapiens
cccauccccacucccacgccgcaaacuaaaguaacuuaguaauugggggcaccagau

SEQ ID NO: 171888 - RNA, 59 nt, Homo sapiens
ggacacuauggaaacgaauuuaggcaaccccccccuaccuugcuguugccagauauauc

SEQ ID NO: 171889 - RNA, 50 nt, Homo sapiens
uuacaagauggacagggaugauaauugggccuccaggaacaauuuaugaa

SEQ ID NO: 171890 - RNA, 46 nt, Homo sapiens
uucauuuuucaguaguaaauuuucuagauaugucuuguagaccuca

SEQ ID NO: 171891 - RNA, 66 nt, Homo sapiens
uuacccucccaccucccacuuucccugcaacaacagccgucuagccuggggggcuuguuagaguag

SEQ ID NO: 171892 - RNA, 48 nt, Homo sapiens
aaaggcuuuaugaggaauguggcauuggguugcagcuuuaagaacgga

SEQ ID NO: 171893 - RNA, 399 nt, Homo sapiens
gugguuugcuggcugcaauaggcaggagacaaggauaagaagggaauuuuaggccgggcgugguggcuuaugccuguaaucccagcacuuugggaggcugaggugggcggaucaccugagguuuggaguucaagaccagccugaucaacauggagaaacccugucucuacuaaaaauacaaaaaauuagccgggcaugguggcucacgccuguaaucccagcuacuugguaggcugaggcgggagaaucaauugaaccugggaggugaagguugcagugagccgagaucgugccauuguacuccagccugggcaacaagagcaaaacucugucucaaaaaaaaaaaaaacaaaaaaaaaccagaauuuuagacugagagaaaaaccuaagcagaagcac

SEQ ID NO: 171894 - RNA, 41 nt, Homo sapiens
aucaccuaugaauaugugaagugguuuuugcaugcugauuc

SEQ ID NO: 171895 - RNA, 65 nt, Homo sapiens
ccauguauuaugggaccuuucacccuauuuuccugucuguugacuuuuucaaagugugucuggga

SEQ ID NO: 171896 - RNA, 50 nt, Homo sapiens
uaagaaggaucagaguuaauagaaaaccaaauggaaggcuccggagguac

SEQ ID NO: 171897 - RNA, 46 nt, Homo sapiens
gcuucuacaagaacauuucagauuuucucuaacaucuuauaugaag

SEQ ID NO: 171898 - RNA, 52 nt, Homo sapiens
aagcccccagucuuuaggugcaaaaaucaucacucuuaguaguuuauucaaa

SEQ ID NO: 171899 - RNA, 95 nt, Homo sapiens
gucuuauugagagacaucuuuauaauaguaaaaaaauugcaaccugcaguugauuuuguauucacuggcuacuuauguaggaaaaacagcauauu

SEQ ID NO: 171900 - RNA, 100 nt, Homo sapiens
aagguugauaaucuuuggccuugaagugguuuugguauacauagccaaguaacuagcagauaauuuauugacuaguggagaagcagaaauuuuugugagg

SEQ ID NO: 171901 - RNA, 53 nt, Homo sapiens
augccuguauuuuaaauguugguggcaaaaaccucagcaugaacuuggaagcu

SEQ ID NO: 171902 - RNA, 45 nt, Homo sapiens
ggcauuauucaguauauaugauuuugccaacuuggauggccuuug

SEQ ID NO: 171903 - RNA, 321 nt, Homo sapiens
ucuugucugggcacgguggcucacgccuguaaucccagcuuugggaagccgagauggguggaucacgaggucaggaguucgagaccagccugaccaacauggugaaaccucaucuuuaauaaaaauacaaaaauuagcugggcaugguggcaggcaccuguaaucccagcuacucaggaggcugaggcaggagaauagcuugaacccgggaggcggagguugcaaugagccgugaucgcaccauugcacugcagccuggguggcagagcaagacuccgucuuggaaaauaaaaaaaaaauuucuuaaagaauuggagccau

SEQ ID NO: 171904 - RNA, 39 nt, Homo sapiens
ggaaaaugaaauguuggauauuauuacuaagcuggugaa

SEQ ID NO: 171905 - RNA, 52 nt, Homo sapiens
uuuuuauaauauuggaccaguguuugaccugccagaauaaaaugaugauaga

SEQ ID NO: 171906 - RNA, 37 nt, Homo sapiens
ggggcaauggaaggggugauggaagagagaggguuag

SEQ ID NO: 171907 - RNA, 54 nt, Homo sapiens
ucccuuccgucuugguugcucacuccagccaggacuaggagccuccagagggaa

SEQ ID NO: 171908 - RNA, 45 nt, Homo sapiens
gcugccuaguugacauccucacucaggaugucucugaguggcuag

SEQ ID NO: 171909 - RNA, 42 nt, Homo sapiens
gaugagcaaauauguaauuucaaaauauuuccauaauuuaug

SEQ ID NO: 171910 - RNA, 41 nt, Homo sapiens
ccaugauucacgguuugugugacauguuugacagcacugua

SEQ ID NO: 171911 - RNA, 32 nt, Homo sapiens
guugagaugugaagccaguaggggagguuuag

SEQ ID NO: 171912 - RNA, 45 nt, Homo sapiens
uugacuuguagaauugauaaucaacaauaagaauuuugccuguag

SEQ ID NO: 171913 - RNA, 59 nt, Homo sapiens
uugcagacuuuacccuuacauggccauaaaagcagugaugaaacuugcccucaaaucag

SEQ ID NO: 171914 - RNA, 42 nt, Homo sapiens
accccucuagacguggcaaagacaagaauuacgcuggcaaag

SEQ ID NO: 171915 - RNA, 62 nt, Homo sapiens
aucuuacuuccacaaaauaugugaauuugcugcuucugagaggcaaugugaaagagggagua

SEQ ID NO: 171916 - RNA, 71 nt, Homo sapiens
gaaggagcuucaggugagcacugcucauguguggaugccccugcaacaggcuucccugucuguagagccag

SEQ ID NO: 171917 - RNA, 66 nt, Homo sapiens
caugguuaacagaaaaaaauuauacaauuuugacaauauuauuuuucguaucagguugcuguuuaa

SEQ ID NO: 171918 - RNA, 65 nt, Homo sapiens
ucgcucacaggacuuggaucugaagcacaguaaacgcaagaggggauuuguguacaaaaggcaaa

SEQ ID NO: 171919 - RNA, 51 nt, Homo sapiens
uucuugucauaccaaucucuacgggaaagagagguaggagaggcugcgagg

SEQ ID NO: 171920 - RNA, 50 nt, Homo sapiens
ccaaagcaugugacgccagucccgaguccacgccacugacaggacagcuc

SEQ ID NO: 171921 - RNA, 45 nt, Homo sapiens
agagcuacagccugcaucuucauuaacuucaggcaguccagagcg

SEQ ID NO: 171922 - RNA, 69 nt, Homo sapiens
ucgcucuaccccaguaaccacgauagaaugcugacggcugugaagaaaaagccaauggcaucucuagau

SEQ ID NO: 171923 - RNA, 46 nt, Homo sapiens
aggguggcccucaggccaaugggcacauugagagcaaugguaaggc

SEQ ID NO: 171924 - RNA, 45 nt, Homo sapiens
guccugacgucacuggucugggugugcaucaucuaccagaccagg

SEQ ID NO: 171925 - RNA, 46 nt, Homo sapiens
acggagcgagcucacagccagcugagcguccugcccgcagcaggcu

SEQ ID NO: 171926 - RNA, 45 nt, Homo sapiens
guucaagggggaccgcccgcugagccucacugagcggcaccacuu

SEQ ID NO: 171927 - RNA, 77 nt, Homo sapiens
cgaaugugcugccacaggucacccaaacccucagauugccuggcagaaggauggaggcacggauuuccccgcugccc

SEQ ID NO: 171928 - RNA, 45 nt, Homo sapiens
cuggaagaaagacaaugaaguccugaccaaugcagacauggagaa

SEQ ID NO: 171929 - RNA, 45 nt, Homo sapiens
guaguccugcaacaugaaugaacuuugacaaugucaugcuaagug

SEQ ID NO: 171930 - RNA, 69 nt, Homo sapiens
uuugugacagccaccugugcccacccagaaucacugaagggucagagcauuuucucugugccaccagag

SEQ ID NO: 171931 - RNA, 57 nt, Homo sapiens
cuauucuaggcaaugugaaauauacucuccucuauaaaguggauaaucaccccuuca

SEQ ID NO: 171932 - RNA, 46 nt, Homo sapiens
gagggaaugcgaucagaucuguccaguuugaugccuuugugaagau

SEQ ID NO: 171933 - RNA, 143 nt, Homo sapiens
aggcugggaucagaguugccuggaggcaggaaccccuuuuuaugagcaggcaguccaggaaggggacaggcacuagcgauaacguuggagguuggcccacugacaucauguaacgucuggggucuggcuuaagagccaaagca

SEQ ID NO: 171934 - RNA, 45 nt, Homo sapiens
augcgauuguuuucacauucaugcagacggccugaaagaaagaaa

SEQ ID NO: 171935 - RNA, 52 nt, Homo sapiens
uugugcgguucccgggcuggggccugcacgauggcacagagucaguacgcgg

SEQ ID NO: 171936 - RNA, 69 nt, Homo sapiens
caagcaccuguguguguuguaccuaaugaucucaugagggcaggcucuguuaggcaaccucuuuauuag

SEQ ID NO: 171937 - RNA, 56 nt, Homo sapiens
cagccccgggucccugguuccugguuuuuucaguaugcagaugauaggaaggaacc

SEQ ID NO: 171938 - RNA, 42 nt, Homo sapiens
gccuggccgagcugagcagccugaguguccugcgucucagcc

SEQ ID NO: 171939 - RNA, 74 nt, Homo sapiens
uuccuacgcuucagggccugcaguugugcauuccauguggugcuggauggcuccuuucaggcucuguagucaag

SEQ ID NO: 171940 - RNA, 41 nt, Homo sapiens
uguuugggggagggcaguuacucuauuauguggguuuucag

SEQ ID NO: 171941 - RNA, 43 nt, Homo sapiens
uccauauguggcuuguacagcuuccucgggucagcagugucca

SEQ ID NO: 171942 - RNA, 79 nt, Homo sapiens
cauuucaaacuguacuaggugugggaagccuugguauuguggcccagaggcuucgaugauacucuggaguguggaguca

SEQ ID NO: 171943 - RNA, 42 nt, Homo sapiens
gccgggccuuuccuucauaaggccugucauuguugggccaua

SEQ ID NO: 171944 - RNA, 45 nt, Homo sapiens
gucugcucacaccugggagccauuuucagcuuuuauagcccaagu

SEQ ID NO: 171945 - RNA, 90 nt, Homo sapiens
auggguuccggugagggagcuaauuucauaaaauagugccgagaaaaagaaacagacuuuuguuaaaugggggcagaagcugccagugga

SEQ ID NO: 171946 - RNA, 50 nt, Homo sapiens
uuuuguuuuuguuacuaacauucucuguguuugagaagaaaucgcaagca

SEQ ID NO: 171947 - RNA, 19 nt, Homo sapiens
gcugaaaaacaacugugcu

SEQ ID NO: 171948 - RNA, 46 nt, Homo sapiens
cagacguuucagagagauuuuuagggccuuggauggaaguaaauug

SEQ ID NO: 171949 - RNA, 49 nt, Homo sapiens
guugaagccaaauuugauuaagauugaugaugaugaugauguaguacua

SEQ ID NO: 171950 - RNA, 45 nt, Homo sapiens
gggaugguaguauguuuagggagaggguaaaauaaugaggguugu

SEQ ID NO: 171951 - RNA, 46 nt, Homo sapiens
guauugcagcaucgcucacuccccuagauccgcaguguaaacuugu

SEQ ID NO: 171952 - RNA, 46 nt, Homo sapiens
aaccacuucaagucacagacuagaucuuauccuaauuuguuaucag

SEQ ID NO: 171953 - RNA, 71 nt, Homo sapiens
aagcaaguuucccugcagcccagcuuuguacccacaaacuaccaauuuguagcuacugaucuaccauuaca

SEQ ID NO: 171954 - RNA, 44 nt, Homo sapiens
gauuaauguucgugagggaccuggcacugggguuugcuaagguu

SEQ ID NO: 171955 - RNA, 41 nt, Homo sapiens
acuuaugucauuugucccuuaaaauuuuuuguggaugggga

SEQ ID NO: 171956 - RNA, 42 nt, Homo sapiens
gcaugcagcaucugcuauuuucugcuuguaauuucagugaaa

SEQ ID NO: 171957 - RNA, 39 nt, Homo sapiens
ggggagaggagaggcuaagggaggaaggggugaaggauu

SEQ ID NO: 171958 - RNA, 39 nt, Homo sapiens
uuuuacauuucuggcucugaugauaacaucuuuaaaaau

SEQ ID NO: 171959 - RNA, 42 nt, Homo sapiens
caggcaggguaauugcucuggacagguuuacaauagggaggu

SEQ ID NO: 171960 - RNA, 21 nt, Homo sapiens
augaacaaugcugcugugaac

SEQ ID NO: 171961 - RNA, 48 nt, Homo sapiens
aaacucuagcugagguuuucugcaucugauggacucauggacagagcu

SEQ ID NO: 171962 - RNA, 39 nt, Homo sapiens
auuaagggaaagaaaugccaggucaguuucuguggugag

SEQ ID NO: 171963 - RNA, 101 nt, Homo sapiens
guagggaagccuuuuguccccagugagcuggaauagucuaggcagauuacugucuugguggccuuacggggggugcuggagggggugcuauugaucuguua

SEQ ID NO: 171964 - RNA, 47 nt, Homo sapiens
uguuggugccagacgccguggaguuauuguuagaagaauuuggaaau

SEQ ID NO: 171965 - RNA, 57 nt, Homo sapiens
ccccucuggagccagcggcuaaaugcagaggcuuucuucaauugcuguugcuucuug

SEQ ID NO: 171966 - RNA, 47 nt, Homo sapiens
auuggccuguguggaggacuucauaggaguguuuuuagaauuuaaau

SEQ ID NO: 171967 - RNA, 47 nt, Homo sapiens
augaccuuuuuccauugugcuuucugagcucaaaacaggccaaauga

SEQ ID NO: 171968 - RNA, 41 nt, Homo sapiens
gucucagauacuguuguuuaguagagggauaauuagccguu

SEQ ID NO: 171969 - RNA, 95 nt, Homo sapiens
accauucuuauuaagcaaaaugaauggaucaauaaagauugcagaaaaaauuugcaguuuauugauggucuaauuucuaguugaaagucggcaau

SEQ ID NO: 171970 - RNA, 58 nt, Homo sapiens
ugcaguuucaaaggcugauggcauugucuugagacaggagggaggacggguggaggaa

SEQ ID NO: 171971 - RNA, 45 nt, Homo sapiens
cuuuggacuuuugaacauauuaucagcaguaauucucggaaccau

SEQ ID NO: 171972 - RNA, 77 nt, Homo sapiens
uguguauuggcacacaaugucccucuugccuuuaggacaugucagaacuguuccugccccgcuuuucaagggacugu

SEQ ID NO: 171973 - RNA, 42 nt, Homo sapiens
cagcugugcuggaaggcccaggugugcaggguguugugaauu

SEQ ID NO: 171974 - RNA, 49 nt, Homo sapiens
auggcuucagaagcuauuuaagaaguauuaaauacaguuuaccuuagac

SEQ ID NO: 171975 - RNA, 25 nt, Homo sapiens
gucucuuauuuagucugggguauug

SEQ ID NO: 171976 - RNA, 86 nt, Homo sapiens
uagccagcacgcgucgugcgggccaucugggggugagugagugggagucuggagcugaguguguuugcgggugggugggugggaaa

SEQ ID NO: 171977 - RNA, 39 nt, Homo sapiens
gaagggagauucugcguggagguccgggggaguaggcgu

SEQ ID NO: 171978 - RNA, 46 nt, Homo sapiens
acuauaaucccaugcaaguuaacaggaagugguguuuccucaugac

SEQ ID NO: 171979 - RNA, 51 nt, Homo sapiens
aaaugguuaucucauuggggaagaaaaggggagggggaaggcaagaaucac

SEQ ID NO: 171980 - RNA, 46 nt, Homo sapiens
uauaugcuuaauaauuaaggugguaauuaaaguguaacugcaagua

SEQ ID NO: 171981 - RNA, 46 nt, Homo sapiens
agagaccauagguggguuuuuuucuccuagauauauagcugcuuac

SEQ ID NO: 171982 - RNA, 40 nt, Homo sapiens
gucuguagugucuuauagacgcuaagugugucccgcugag

SEQ ID NO: 171983 - RNA, 93 nt, Homo sapiens
agaaauguacauuuauugacagcucuauacagucaguguacaaagcguuuuggccaaacgcaguaaacaaaauguuuugagugguuuuacagu

SEQ ID NO: 171984 - RNA, 50 nt, Homo sapiens
ccaaguugagucuggaggauagguaagaauugaaucauugcaaaggaaga

SEQ ID NO: 171985 - RNA, 45 nt, Homo sapiens
gcagaugauauucaugcugaaauaugcaaaauaccacauucaaga

SEQ ID NO: 171986 - RNA, 26 nt, Homo sapiens
aaagaagacauuauauaauagacgaa

SEQ ID NO: 171987 - RNA, 49 nt, Homo sapiens
uuuugcagaaaauaacuaaauuaagguguuauaauuuagaacacagaug

SEQ ID NO: 171988 - RNA, 50 nt, Homo sapiens
guuauuuuaauuuguuccucucaacaggccaucaacagaaagucaguuuc

SEQ ID NO: 171989 - RNA, 27 nt, Homo sapiens
agguuggauaagaguuuggguaagcug

SEQ ID NO: 171990 - RNA, 37 nt, Homo sapiens
ggcucaaugagcagccuugauagcagaagaguuggaa

SEQ ID NO: 171991 - RNA, 22 nt, Homo sapiens
caauggcuuagcauccagucua

SEQ ID NO: 171992 - RNA, 45 nt, Homo sapiens
ucuccuccucaaaguuauuuuaaagccugaucuuacaacaauaaa

SEQ ID NO: 171993 - RNA, 80 nt, Homo sapiens
aggggagaacaguacagcauaacaagauaccaucucagcuuuauuucuuaccuauucagaggauuuuaagaucaggaagc

SEQ ID NO: 171994 - RNA, 48 nt, Homo sapiens
ccuaaguguugagaaauaauuuuaacaccuuuuuuuguuagguacccu

SEQ ID NO: 171995 - RNA, 81 nt, Homo sapiens
ggagaaagcaagugagugcagaaaaagcuauuauacgauugaccuugagucuuuuguacuucauuuagaagcacaaguaca

SEQ ID NO: 171996 - RNA, 44 nt, Homo sapiens
cauuuucucugacuuaacgaugucuauaaauaaagguggcaucu

SEQ ID NO: 171997 - RNA, 25 nt, Homo sapiens
ccuuauaauaaagccagccucucua

SEQ ID NO: 171998 - RNA, 18 nt, Homo sapiens
gagcccuuuucccugcuc

SEQ ID NO: 171999 - RNA, 46 nt, Homo sapiens
gaauucgaauuacauuuuauguuuuuacuugccagaauacaagaau

SEQ ID NO: 172000 - RNA, 79 nt, Homo sapiens
uucucugaggaggugacauuugaguggagacccgaaugauguaaaugagugaaccuuguugauuuggggcaaagugaaa

SEQ ID NO: 172001 - RNA, 41 nt, Homo sapiens
aaugagaaagcagccaggagaggcuggccuggccaucagac

SEQ ID NO: 172002 - RNA, 41 nt, Homo sapiens
uuuauuuuuacugccuaaaaagcuacaaagccaguuagaua

SEQ ID NO: 172003 - RNA, 85 nt, Homo sapiens
uuuuuuuuuagaccaggaaaggaaauaaggguuggagcuggacacucacaccuuguuggcaucaugagugagcaauucugagggu

SEQ ID NO: 172004 - RNA, 46 nt, Homo sapiens
uuaagugacuuucuauaaacuuuaugaaauuaccucaucuugagcu

SEQ ID NO: 172005 - RNA, 44 nt, Homo sapiens
accaugaguacuauucuuaaccaaaccgagaauaugccucagca

SEQ ID NO: 172006 - RNA, 47 nt, Homo sapiens
ggccaccuaccucugggaucaugaaagaaaauaauguggcccaggag

SEQ ID NO: 172007 - RNA, 52 nt, Homo sapiens
uauguaccagugccuguuugugagcuguuuuagguuugugauaaguacagau

SEQ ID NO: 172008 - RNA, 112 nt, Homo sapiens
aaaugcacagucuguguuuucaugggaucuccaggugauugcugugcacguuagaguuugaaaagcccuggucuaaaguagggacagacaaacuacaguccauggccaaguc

SEQ ID NO: 172009 - RNA, 45 nt, Homo sapiens
gaaaccauccgauauuugaugcuauugguuccaauggggcuuucc

SEQ ID NO: 172010 - RNA, 35 nt, Homo sapiens
cuguaguuuuggcaguaauuauuucguguccaccu

SEQ ID NO: 172011 - RNA, 49 nt, Homo sapiens
aaaucuguaaauaccgagacacacagcuccuuaagcugcuugaaccaca

SEQ ID NO: 172012 - RNA, 24 nt, Homo sapiens
caguucuccagugccguucaggaa

SEQ ID NO: 172013 - RNA, 37 nt, Homo sapiens
uuggaaaauuuuaggguuaugggaucaaaaaucacug

SEQ ID NO: 172014 - RNA, 27 nt, Homo sapiens
uuauagccucuguaggaaugugcaugg

SEQ ID NO: 172015 - RNA, 45 nt, Homo sapiens
gcagaauuccgacaaaaagacauauuugcuauggacgacaaauca

SEQ ID NO: 172016 - RNA, 47 nt, Homo sapiens
cgauucuagucuggcauucuuuccacuaaaucuuuuggaaauacuag

SEQ ID NO: 172017 - RNA, 45 nt, Homo sapiens
ccauucauuuugaaggugucaguuauaaguagucuugccaaugag

SEQ ID NO: 172018 - RNA, 46 nt, Homo sapiens
guguugagugaagaacaagggccuugauaacaucuaugcugcuaag

SEQ ID NO: 172019 - RNA, 24 nt, Homo sapiens
cugugucauaggcaguggagaaau

SEQ ID NO: 172020 - RNA, 59 nt, Homo sapiens
agugucucuaaaauucuguuaaguaaagagguauuggaacaaguuugcuuuuuuaagac

SEQ ID NO: 172021 - RNA, 39 nt, Homo sapiens
acauuuaaacaaucaucaaugaucuuuuccuaaggaaau

SEQ ID NO: 172022 - RNA, 75 nt, Homo sapiens
gaacuaaaccucaggaugagagagaaagggccaggauucgauggacaguuagaggaacuaauugccauuucugag

SEQ ID NO: 172023 - RNA, 43 nt, Homo sapiens
uuuaaaagaggauguuuaugaugugucuuugaauguguuuugg

SEQ ID NO: 172024 - RNA, 45 nt, Homo sapiens
auucugauggaccgguccugcaauggccccgugcuggugggcagc

SEQ ID NO: 172025 - RNA, 46 nt, Homo sapiens
gaugauuggguacaaucuagcgacaaaacaaacuccaaaagaaggu

SEQ ID NO: 172026 - RNA, 65 nt, Homo sapiens
acuuuuauuuugcucucagugagccucuaguacagugcuaaacacgcagcacauaagcagaaaga

SEQ ID NO: 172027 - RNA, 51 nt, Homo sapiens
ucuggugugcauuucagcauucucucuuuacuaugacuguaacuuuuuugg

SEQ ID NO: 172028 - RNA, 47 nt, Homo sapiens
gaucuuagcuggaggaagaggaaaaggugucuucaauagugguuuga

SEQ ID NO: 172029 - RNA, 47 nt, Homo sapiens
uugacaacacuucauugaggauacaacucuuucugugucuugauggu

SEQ ID NO: 172030 - RNA, 46 nt, Homo sapiens
ucuugugagcauuacuuuguguaaauauguuuucagaaagccaucu

SEQ ID NO: 172031 - RNA, 51 nt, Homo sapiens
cacaauguaagauuggcuuacuaguauuaaacuacaugaaaagagcaagau

SEQ ID NO: 172032 - RNA, 37 nt, Homo sapiens
auuuaucauuaucaucuaccauuuacuugauauguau

SEQ ID NO: 172033 - RNA, 308 nt, Homo sapiens
cacuagcggcagccauggauaucaaaagggagacuaucgaaaagcaagacaagacacaggccuugggucaaaacaaacuaucaaaacauaaauaaaaacauggugugcauuuguagcaggcgaauccuaucaaggauccagagguacucauuuuacacauaaaagcauuaguccaucagaagguggcagggcaguacuaaaugucuuuagaauuugggcagcuuuugaaggcaucuaacccuuuuuaacuuuguacugucucaucaaccaucucaucaaccaugagcacauuuuacuuauuucugaau

SEQ ID NO: 172034 - RNA, 59 nt, Homo sapiens
ugcugugcugauauaagccucagccugcuaaugaggcccaaaguugagcagcuccagac

SEQ ID NO: 172035 - RNA, 12 nt, Homo sapiens
uuguggcaaagc

SEQ ID NO: 172036 - RNA, 41 nt, Homo sapiens
caagccaggugggaccauaguccaccacggccaagcaagaa

SEQ ID NO: 172037 - RNA, 79 nt, Homo sapiens
uagccuuaauaaggauaauacuaauagcaguaauaguagggacuaccaccuacugagcauuuaacuaugugccagaugu

SEQ ID NO: 172038 - RNA, 69 nt, Homo sapiens
uuaaaauaauaaauagaauguaaaucguacacauuauaauuccuaagcuauaucaaacauauaauuacu

SEQ ID NO: 172039 - RNA, 94 nt, Homo sapiens
cauuuucagagaauacauuaaaaaauguauguauuauauauuauguauauauguauuauauauuaaaauuauaaauaaacuauaauagaaauaa

SEQ ID NO: 172040 - RNA, 45 nt, Homo sapiens
caaaacuaauuuucuaauauagcgauuucuggcucugguuuuggg

SEQ ID NO: 172041 - RNA, 69 nt, Homo sapiens
cuaguaguacuucuuuucuagcauaugcuaaaguucaguugcaggcuccuuaagaaguuaagugagccc

SEQ ID NO: 172042 - RNA, 44 nt, Homo sapiens
caggcauacaauaaacauucuaguccuaaagggacaaauuagaa

SEQ ID NO: 172043 - RNA, 42 nt, Homo sapiens
aguuaaaaauguugaccaaaucagagauaaaagcccagaaag

SEQ ID NO: 172044 - RNA, 46 nt, Homo sapiens
uuuaauuugacauuuauuggguuacacuugacauuuccaagugcaa

SEQ ID NO: 172045 - RNA, 48 nt, Homo sapiens
uauccaaguguuaaaagauuaaguauucuucagaagaaguuagcacca

SEQ ID NO: 172046 - RNA, 56 nt, Homo sapiens
ggugguaucccagagccuuggugauugaacauaccaaggccacuggugagucucag

SEQ ID NO: 172047 - RNA, 46 nt, Homo sapiens
aaucugccacgacagcaaaaguaaacuaaaacagguagauccccag

SEQ ID NO: 172048 - RNA, 121 nt, Homo sapiens
ggaagucagaagagaaguuuagagagguauagcagaaaucaaagacauuugaagccugagaaggauuugauguaccauuguuggcuucaagaugagggccuugugucaaggaacuggauac

SEQ ID NO: 172049 - RNA, 46 nt, Homo sapiens
uugaauuuuuggcuaucacgauuaaugcugcuaugaacacuuaugu

SEQ ID NO: 172050 - RNA, 47 nt, Homo sapiens
uauuaaagauguuucuucaacaguaaccagauguguaacauagaagc

SEQ ID NO: 172051 - RNA, 46 nt, Homo sapiens
uguauauuauguacuuuuccuggaaaacaugucaguauucaauaga

SEQ ID NO: 172052 - RNA, 47 nt, Homo sapiens
ugugugcacaucacugagauuaccuggagagagcaaagcaagaagaa

SEQ ID NO: 172053 - RNA, 45 nt, Homo sapiens
gaauaguuuugaucuaaggggaaauuuauagcauuagaagaggau

SEQ ID NO: 172054 - RNA, 59 nt, Homo sapiens
agaguucaaagauucuuuguagcagacacugcaaaugaagcucucgaggcugcuaagag

SEQ ID NO: 172055 - RNA, 47 nt, Homo sapiens
accugcaggaauaccagagcaagaaacugaugucugacaacggagug

SEQ ID NO: 172056 - RNA, 39 nt, Homo sapiens
auguaauagaguccuuaacaguuuuuaaaauaacuuaug

SEQ ID NO: 172057 - RNA, 50 nt, Homo sapiens
ugcuugaacuggcuuauuugucuauuuauuuguacauaauauauggcuca

SEQ ID NO: 172058 - RNA, 53 nt, Homo sapiens
uacaguugaggauuaaaggcacagagugguugaaugcacagcuauuaaguagu

SEQ ID NO: 172059 - RNA, 60 nt, Homo sapiens
aggccugcuuugaguuuccaguuuuuacuuccagcuuuuacuuccagcuuuuuggucuug

SEQ ID NO: 172060 - RNA, 43 nt, Homo sapiens
cugcuuuggagaaaauauaaaacaaguacuugaagguuuugga

SEQ ID NO: 172061 - RNA, 62 nt, Homo sapiens
uaaaagugaaaucacuucugaggguucuaaugaaagaaaaaaaggaguaauagcaguaguug

SEQ ID NO: 172062 - RNA, 80 nt, Homo sapiens
ugauuuucucuguaaagacucuaucuuuaaaggagauagaagguaagagauagauagaggaaaucaaguuaaaaugaggu

SEQ ID NO: 172063 - RNA, 41 nt, Homo sapiens
uuguauauucauauucauugauucuuucagugggucaaaug

SEQ ID NO: 172064 - RNA, 41 nt, Homo sapiens
acuuuggcaucgauucaaugcugugagucauuaugccagga

SEQ ID NO: 172065 - RNA, 32 nt, Homo sapiens
guagaguacucuuucuggauauaguguggaga

SEQ ID NO: 172066 - RNA, 41 nt, Homo sapiens
uacggugagaaaugaggccagagacaagagcaaggacaaga

SEQ ID NO: 172067 - RNA, 44 nt, Homo sapiens
guuaauggagacauggcaaagcacaaggcaugguuuguguaagu

SEQ ID NO: 172068 - RNA, 48 nt, Homo sapiens
uuuuguugucucuuaggguauuuccccucucuuuggcuaguggaaguu

SEQ ID NO: 172069 - RNA, 113 nt, Homo sapiens
agacuaaggggaagaguguguuaggcagagcagacagcaagugcaaagacugagaugagaaugagcugggcaugucuagguaauuagagggggaaagugguaguagacuaggu

SEQ ID NO: 172070 - RNA, 42 nt, Homo sapiens
cauuucucuguuauuguuaauguaaauuuaaaaggugcuaau

SEQ ID NO: 172071 - RNA, 30 nt, Homo sapiens
ucaaauuguaaaauguaaagauugcucuuu

SEQ ID NO: 172072 - RNA, 51 nt, Homo sapiens
aacuaaagacaugugacuuauucaaugaaagugaaaaagaagcucuaaaac

SEQ ID NO: 172073 - RNA, 37 nt, Homo sapiens
aacuucaaauuagccucaugaagagaauuuuucccug

SEQ ID NO: 172074 - RNA, 70 nt, Homo sapiens
agaacauucuguaggacugucuugcauaccuucugucugguuuccacugauuccuucuuagccauggaga

SEQ ID NO: 172075 - RNA, 52 nt, Homo sapiens
guuauagaucagcguuuagucaccuccagguuauaugcaucgagaaccugaa

SEQ ID NO: 172076 - RNA, 29 nt, Homo sapiens
aacaugcaaaacauacacacacacacaca

SEQ ID NO: 172077 - RNA, 47 nt, Homo sapiens
uuaaacacuccaacacccagacuuagaauuaaaucaguaaagcaauc

SEQ ID NO: 172078 - RNA, 46 nt, Homo sapiens
ccuucaggcugcagaccacguauugcaacacccaaaguggccauuu

SEQ ID NO: 172079 - RNA, 54 nt, Homo sapiens
aaaggcuuaauauuuaaucauucaaaaagagaagucacaucauauagacaaucu

SEQ ID NO: 172080 - RNA, 51 nt, Homo sapiens
uuugcagagagccgacuuagcuaguuaacaggaggucaaauucucaugcag

SEQ ID NO: 172081 - RNA, 46 nt, Homo sapiens
cugaggacauauuuuggaaacaagcugacuuuggauaugccagaga

SEQ ID NO: 172082 - RNA, 42 nt, Homo sapiens
cguuacuucuccacugaucggugaguuuagugauggccagag

SEQ ID NO: 172083 - RNA, 67 nt, Homo sapiens
aaggaaaaguagccuggccaguaaagcguccgugugcuggaggagugcagccacccaucccggcggg

SEQ ID NO: 172084 - RNA, 32 nt, Homo sapiens
cuacuuguaaaauaauaauuaguaaauauaua

SEQ ID NO: 172085 - RNA, 44 nt, Homo sapiens
aaacuuaaguuacaaaauucucugaagcauuugaaacuagacgu

SEQ ID NO: 172086 - RNA, 46 nt, Homo sapiens
ucauaaaauuaauuuucuucauuuuaguaguaaaaaguagucuaau

SEQ ID NO: 172087 - RNA, 46 nt, Homo sapiens
uaguccugccauaucaacaccacuuauugaacuugagcgugacaug

SEQ ID NO: 172088 - RNA, 47 nt, Homo sapiens
cagguucacacugcucagccaccuugucuaacacagucuguccuuca

SEQ ID NO: 172089 - RNA, 46 nt, Homo sapiens
aagaauuaacuauaauaggcacuaaagcauaucccuugccugacaa

SEQ ID NO: 172090 - RNA, 54 nt, Homo sapiens
guugugcuuggaagcugcgucgagggagagcuugagggcaagaccaaccaacca

SEQ ID NO: 172091 - RNA, 47 nt, Homo sapiens
ccgggacaccgauccggggcgagcacggaggggccucggggugcaag

SEQ ID NO: 172092 - RNA, 46 nt, Homo sapiens
ucuagauccagaaacacuggaaaaaacugcccauaccaagacggag

SEQ ID NO: 172093 - RNA, 50 nt, Homo sapiens
cugguauuaugaaauguucguauuguuuguaccuuuaaaugcuguaaaga

SEQ ID NO: 172094 - RNA, 25 nt, Homo sapiens
caaccuguuguuuauuaaaaacaaa

SEQ ID NO: 172095 - RNA, 68 nt, Homo sapiens
gcagguaggccagcugcuagcccugagaguucccucaugcuaauuacuaaggcacuucuuccucuccu

SEQ ID NO: 172096 - RNA, 69 nt, Homo sapiens
auuggagaaggaacagcuucgcugugguucaugaacugaaauuccauuaauguuguuggcgagauggga

SEQ ID NO: 172097 - RNA, 37 nt, Homo sapiens
uuuuauuucugauuaugaaauaauauacuaauuauag

SEQ ID NO: 172098 - RNA, 46 nt, Homo sapiens
gaaccucaagaacaaacuggagaauaaaauggaaggaauagguuug

SEQ ID NO: 172099 - RNA, 43 nt, Homo sapiens
aaggaauaaacauaacuuaccugagcuaggguugcagcagaaa

SEQ ID NO: 172100 - RNA, 47 nt, Homo sapiens
cacccaauuaucuauggcagcaugcauguauaggccgaacuauuauc

SEQ ID NO: 172101 - RNA, 49 nt, Homo sapiens
gaaagaaaaccaccacccuccuauugugucugaaguuucacguguguuu

SEQ ID NO: 172102 - RNA, 49 nt, Homo sapiens
aaaaucauuguaaaguaucaagacaauacgaguaaaugaaaaggcuguu

SEQ ID NO: 172103 - RNA, 46 nt, Homo sapiens
aaaaguguuuaaaugucaaaugugaauuggugaugggugauggagg

SEQ ID NO: 172104 - RNA, 41 nt, Homo sapiens
auuuauuuugaggaauuggcccaugagauuacggagacuga

SEQ ID NO: 172105 - RNA, 46 nt, Homo sapiens
uccaugagacaugucuucacuguuugcagacauuguugcugcuaag

SEQ ID NO: 172106 - RNA, 43 nt, Homo sapiens
uaugugcuagagggcaaaggguuggaguucuaucuuaggaaaa

SEQ ID NO: 172107 - RNA, 46 nt, Homo sapiens
gugcugccccugggccgcaagaagggagccaagcugacuccugagg

SEQ ID NO: 172108 - RNA, 41 nt, Homo sapiens
aguuggagcgcccagcugccaacaccaagauuggcccccgc

SEQ ID NO: 172109 - RNA, 45 nt, Homo sapiens
uccuuaaagaaaaucauauauggggucacaccaucuucacgguag

SEQ ID NO: 172110 - RNA, 42 nt, Homo sapiens
uucuauccuacugaccaucuuccccuccaccuccagguacag

SEQ ID NO: 172111 - RNA, 61 nt, Homo sapiens
guaaaccuugaccuaaccaccaagcugcacaaaugcucauucuccccuugaaccaccagcu

SEQ ID NO: 172112 - RNA, 43 nt, Homo sapiens
gcccuaauccaauauaacugguguccuuauacaaaggggaaau

SEQ ID NO: 172113 - RNA, 75 nt, Homo sapiens
caguguucacccagguaacggaauugccuggggagcccugcuugacuccagggaagccggcggggggggccccca

SEQ ID NO: 172114 - RNA, 48 nt, Homo sapiens
ccaugugguagcaugugucacgaguuuuuguuuuuauguuuuucauug

SEQ ID NO: 172115 - RNA, 71 nt, Homo sapiens
aagguguuuuuuacuuaaccagauaauugguuucauuaauaauuuauucucugccuuguacuagaaauuau

SEQ ID NO: 172116 - RNA, 35 nt, Homo sapiens
aauaccaugcuucauggaauagucauagagaagaa

SEQ ID NO: 172117 - RNA, 47 nt, Homo sapiens
ccuauacaaucccuuucauauaaaucccucuuuuuggucucaccacc

SEQ ID NO: 172118 - RNA, 33 nt, Homo sapiens
auugcaagaaggucaagguggcuguaaccuaga

SEQ ID NO: 172119 - RNA, 32 nt, Homo sapiens
uaauuaugugguauacuuuaagugacagagug

SEQ ID NO: 172120 - RNA, 35 nt, Homo sapiens
auugauggcaaaaaugauuuuuaguggcuacuuac

SEQ ID NO: 172121 - RNA, 100 nt, Homo sapiens
ccuuuuucucuucuaugagaccacauuuuguuuugcuuuuacuaaagaacuggaaauugaguagugcucaauuucuuggacauuuugguuauucaagagc

SEQ ID NO: 172122 - RNA, 43 nt, Homo sapiens
ugggcacugcugagcuacuggugauaagguacagaaccauuaa

SEQ ID NO: 172123 - RNA, 61 nt, Homo sapiens
ccuuuaacauucaaauauauaauucuuuuguuaguuuuuucaauacacuuaguuacaggaa

SEQ ID NO: 172124 - RNA, 54 nt, Homo sapiens
aaaagaauauggcccauuugaacagccugaaaacccaggaugcauagguuauag

SEQ ID NO: 172125 - RNA, 36 nt, Homo sapiens
cuuugaaaagaaguaaacaguagagaauuucaacuu

SEQ ID NO: 172126 - RNA, 38 nt, Homo sapiens
agaaguugaaauucucuacuguuuacuucuuuucaaag

SEQ ID NO: 172127 - RNA, 47 nt, Homo sapiens
ugaagauaugacauuuacaagguggacaggcaugauuauugggccac

SEQ ID NO: 172128 - RNA, 44 nt, Homo sapiens
ucuaaugauguccaaagaaaauaugaagcuuccacagccaccag

SEQ ID NO: 172129 - RNA, 46 nt, Homo sapiens
acauuaacaugaguagaagguuguugauuuaagacaaguuugagau

SEQ ID NO: 172130 - RNA, 46 nt, Homo sapiens
aauauguucaggauuguuuugauaccuguauuuauaauaaaaaaug

SEQ ID NO: 172131 - RNA, 44 nt, Homo sapiens
guuuaacaaaccaugcauuuaaguuuaagugaagucaacaaaaa

SEQ ID NO: 172132 - RNA, 36 nt, Homo sapiens
cuaguauaguuuuuuuaaguagguaguucuggggaa

SEQ ID NO: 172133 - RNA, 56 nt, Homo sapiens
cuuuacugugaacuucuuaggucuaaauaauucuacugcaguguagauccaugauu

SEQ ID NO: 172134 - RNA, 48 nt, Homo sapiens
cuguuuugaaugagccauuauaugggauuuauuuuuuauuucucuuca

SEQ ID NO: 172135 - RNA, 52 nt, Homo sapiens
uauuuucagaugauuuuacaaauaaagaccaagcagugcuuucccucaggug

SEQ ID NO: 172136 - RNA, 40 nt, Homo sapiens
aaugauaggucaaaagauaagguacaaaauguaaguauuu

SEQ ID NO: 172137 - RNA, 45 nt, Homo sapiens
uauaagaaaauagcagcagaaaauuguauguauuuaagacaacuu

SEQ ID NO: 172138 - RNA, 36 nt, Homo sapiens
cuucuaaauauuguuaaucaccgaaaauguuuagau

SEQ ID NO: 172139 - RNA, 49 nt, Homo sapiens
auuuugaaggauuguugauuauaggaugaaagagcuaucauugagaaau

SEQ ID NO: 172140 - RNA, 39 nt, Homo sapiens
guauuucuuggcugccuauaaucuucuaggcucuauggu

SEQ ID NO: 172141 - RNA, 72 nt, Homo sapiens
aagacauauguagauaaguaauugcauagaggcauaauaaagacucuuuuccgagaggaguaaggaagguaa

SEQ ID NO: 172142 - RNA, 93 nt, Homo sapiens
cucucagccagaagucagcagaugcaaaauauggcauuuuacaaaauagagaaaucuuaguauuuaccugcaagugucccucaauucauagag

SEQ ID NO: 172143 - RNA, 46 nt, Homo sapiens
auaaacgucgauagguaugauuacuuaaaaaugaaggcauaaauau

SEQ ID NO: 172144 - RNA, 35 nt, Homo sapiens
guauuuaaaauccuguaaauguuagaaauuauuau

SEQ ID NO: 172145 - RNA, 45 nt, Homo sapiens
uuaaguucuuggguuuauugaguagauauuaagacaacaaauagu

SEQ ID NO: 172146 - RNA, 30 nt, Homo sapiens
ugacuugucuuuacaagucauaguguuucc

SEQ ID NO: 172147 - RNA, 33 nt, Homo sapiens
auuaaauaauuuacuugacauuuauuuuaaaau

SEQ ID NO: 172148 - RNA, 48 nt, Homo sapiens
guuaucuagaaauggaaagaauagugaguggcuugagcguauuugagc

SEQ ID NO: 172149 - RNA, 41 nt, Homo sapiens
uugggcugaguuguauuugauauguuggaauucaguucagu

SEQ ID NO: 172150 - RNA, 47 nt, Homo sapiens
gccagugaaacacacaaauggcacucagauuuguugauggcucacca

SEQ ID NO: 172151 - RNA, 44 nt, Homo sapiens
uggcuuuagugguagaaugacagaacuuagggaucccuugcagg

SEQ ID NO: 172152 - RNA, 50 nt, Homo sapiens
ugcuucuuagaaaggcagauuuauggacuuagaugaacaauuggugggag

SEQ ID NO: 172153 - RNA, 44 nt, Homo sapiens
uauagaccagugcauuauuaagaauugcucaggaaagggaaaaa

SEQ ID NO: 172154 - RNA, 56 nt, Homo sapiens
uuaaaaaccuguguauguuaaaauuuucuuuauagcuaggcuuuggcacgcuuaga

SEQ ID NO: 172155 - RNA, 42 nt, Homo sapiens
cuggaggacucuguuauuaucugacaaauuccagaugcuaca

SEQ ID NO: 172156 - RNA, 46 nt, Homo sapiens
uugaaggguuucaguuguauuuuuagauggcauaaauggcuugauu

SEQ ID NO: 172157 - RNA, 49 nt, Homo sapiens
uccaguuagaaaauaaacaacuauaauuuuguaaaauacgugugguaca

SEQ ID NO: 172158 - RNA, 35 nt, Homo sapiens
aacuacauagaauuaguuaauuugguaaggcaugg

SEQ ID NO: 172159 - RNA, 79 nt, Homo sapiens
uuucuuugucagcccccaugacaacaaauggguugccugagagcacagacagcaaagaggcaaauuugcagcaaaauga

SEQ ID NO: 172160 - RNA, 46 nt, Homo sapiens
gaaguuuccucagugagcccuuugaaaaauaaacauccagaugaag

SEQ ID NO: 172161 - RNA, 53 nt, Homo sapiens
aaacgacuuccagcgaaauuucuucaguuaugguaggagaaacagaagcauca

SEQ ID NO: 172162 - RNA, 46 nt, Homo sapiens
acccggcagcacuguacagaagaggaugaagaagaggaugaagagg

SEQ ID NO: 172163 - RNA, 47 nt, Homo sapiens
gagucuuuuaugacaucaagagaaaugaucccagaaagaaaaaauca

SEQ ID NO: 172164 - RNA, 52 nt, Homo sapiens
ccauggaaaaugaugacgaagccacagaagucaccgaugaaccaauggaaca

SEQ ID NO: 172165 - RNA, 46 nt, Homo sapiens
gagaagcagguuguaaaauaaaguacuuuauggauaauuccugaaa

SEQ ID NO: 172166 - RNA, 39 nt, Homo sapiens
uuuuuuuuaauuuaggauugaaguuuuuaaacuggaaag

SEQ ID NO: 172167 - RNA, 89 nt, Homo sapiens
aaucuuaagucuguugaaauaccagguuaaacacauuccaagagaucuguucaaacucaaauucuuuuguauacuucugaggugccuga

SEQ ID NO: 172168 - RNA, 74 nt, Homo sapiens
aaggcaucccagaaauccucggccagaagguguggcuuguuaaagcauugagauucagaguauuuuguuuugcc

SEQ ID NO: 172169 - RNA, 47 nt, Homo sapiens
aaucaguacacucuucaggauuuucuuuuauuucaacuuggagccua

SEQ ID NO: 172170 - RNA, 64 nt, Homo sapiens
cagaucuauauuacuaaaggacaucaggauucaggagaaaaggagacccaggcucauaucaggg

SEQ ID NO: 172171 - RNA, 46 nt, Homo sapiens
cgguuugguggccacugaggugucgacgugguuuuaugucagagag

SEQ ID NO: 172172 - RNA, 42 nt, Homo sapiens
uccaccuacgguucagcacuggccugugccaaugauacaggc

SEQ ID NO: 172173 - RNA, 36 nt, Homo sapiens
cgguaagcuugggcauauuucaaauuucaguaacau

SEQ ID NO: 172174 - RNA, 42 nt, Homo sapiens
uuuaauuaaagcaacagauaguucagacccauugaaacccua

SEQ ID NO: 172175 - RNA, 42 nt, Homo sapiens
uuucugaugucauggccacuuacaggaaauggaggaauggac

SEQ ID NO: 172176 - RNA, 46 nt, Homo sapiens
cugguaagacuaaauuuucuccccucccucuuaaugagguuuuaga

SEQ ID NO: 172177 - RNA, 54 nt, Homo sapiens
agaugugauagagauaaaguuaucuaacaaauugguuauauucuaagaucugcu

SEQ ID NO: 172178 - RNA, 65 nt, Homo sapiens
guaaaaaaagaaaaaaaaaagcaaccaccaccauaauauuacccaggaaaccagcuguguucugu

SEQ ID NO: 172179 - RNA, 53 nt, Homo sapiens
ugaggauucacauaagcugccaucggcccacauaaggauaaacuaaaacaaag

SEQ ID NO: 172180 - RNA, 45 nt, Homo sapiens
auaauaccaggaucuuaguaugaaaaugggguggggguacagcug

SEQ ID NO: 172181 - RNA, 35 nt, Homo sapiens
guauguguucagaagcauguccuacuuuggcccua

SEQ ID NO: 172182 - RNA, 62 nt, Homo sapiens
cccuauauuucauuugcuaaauguuuguaacuuuaagguacuggaggaaaguuuauggaaaa

SEQ ID NO: 172183 - RNA, 46 nt, Homo sapiens
ggaugaaaaucuaaaagaugauucucuuccuucaaauccaauaggu

SEQ ID NO: 172184 - RNA, 68 nt, Homo sapiens
agugaauacuacucugcuggagaauccgucauuggucacuuuuaagugccuaaacuuuuuggcuagua

SEQ ID NO: 172185 - RNA, 49 nt, Homo sapiens
cugguuuacuguagggggauuugagaaucccccuacaguaaaaauccuc

SEQ ID NO: 172186 - RNA, 50 nt, Homo sapiens
ggccaguguaauuaggaaacacuuucaaaacccacuccaucuagagacau

SEQ ID NO: 172187 - RNA, 49 nt, Homo sapiens
gaaauaaaauuauuuaagcuucuggaaguguucuguguuaucuaccauu

SEQ ID NO: 172188 - RNA, 49 nt, Homo sapiens
acuacucagacacagagacagaagacacauaugcaguacuucagauuau

SEQ ID NO: 172189 - RNA, 32 nt, Homo sapiens
ggacgcuagcuuaccaugagggcuggauuaug

SEQ ID NO: 172190 - RNA, 55 nt, Homo sapiens
cuacaaacucuguucugcuuuagagagaccacuuagagccauucugugugcauca

SEQ ID NO: 172191 - RNA, 100 nt, Homo sapiens
uaauuagcccuugguuauuuucauauucagaguugccaagggcuaaagagacgaugcuaaggaaugagaaggccuaaaagguuuuaggugauacaaauaa

SEQ ID NO: 172192 - RNA, 32 nt, Homo sapiens
caagaggaaaaauucagaggaucugaacccag

SEQ ID NO: 172193 - RNA, 50 nt, Homo sapiens
uauacugcuaguuuuucuuuaaagagggauucuaaagauagucacaaggc

SEQ ID NO: 172194 - RNA, 57 nt, Homo sapiens
cuuuauaaauucauucauuuuucaucuggagagaccaaggucuuuccauugaagcag

SEQ ID NO: 172195 - RNA, 47 nt, Homo sapiens
ucaucagaccucuguguugcccaggugguaucuucugaacacaugca

SEQ ID NO: 172196 - RNA, 48 nt, Homo sapiens
ugaaggccucucggagcauaagaggauagggagaccagaggcuuguga

SEQ ID NO: 172197 - RNA, 61 nt, Homo sapiens
uaugccuaucgagaagaacaggauuuuggaauugagauagugaaagugaaagcaauuggaa

SEQ ID NO: 172198 - RNA, 47 nt, Homo sapiens
gcaauguacaggaaagggaagcacaguuuggaacaacagcagagaua

SEQ ID NO: 172199 - RNA, 47 nt, Homo sapiens
uugaacauuugaguuuuaaauauaugcaaaguaggcaaagcaauaaa

SEQ ID NO: 172200 - RNA, 46 nt, Homo sapiens
uuuuucacccucaagaagucaguauggugcggaauuuaauucagaa

SEQ ID NO: 172201 - RNA, 46 nt, Homo sapiens
cugacuucuugagggugaaaaagcugaagagguaaugucuguccgg

SEQ ID NO: 172202 - RNA, 38 nt, Homo sapiens
aauggaaguugaagaccaggauaguaaagaagccaaaa

SEQ ID NO: 172203 - RNA, 59 nt, Homo sapiens
aagugugccagccuuugauggaaagcugagcuauuuuuucagagacauuagcccuacuc

SEQ ID NO: 172204 - RNA, 41 nt, Homo sapiens
aaaugcccuuaguuuaccagggucauuauuuucuaagagcc

SEQ ID NO: 172205 - RNA, 30 nt, Homo sapiens
caauugcuagcuuuuuaaagaggaggaaga

SEQ ID NO: 172206 - RNA, 89 nt, Homo sapiens
uuugauuuuuuuuuuucuuuuuuuguuguacaaaugaucucuagaguuggcaaaccuuuuauuuagggguaguguggauuugggaaggc

SEQ ID NO: 172207 - RNA, 44 nt, Homo sapiens
gguggggagugguggacugaagacgggagauuacuggggcaagg

SEQ ID NO: 172208 - RNA, 94 nt, Homo sapiens
uuuuuagcuauuuuuuccaugugugaaccuugagugauacuaaucauguaaaguaagaguucucuuauguauuauuuucggaagaggggugugg

SEQ ID NO: 172209 - RNA, 93 nt, Homo sapiens
agcaugaccucugggugucucuccaacucaccaguucuaaaaaggguaucagauucuauugugacuucauagugagaauuuauuauagauuau

SEQ ID NO: 172210 - RNA, 68 nt, Homo sapiens
gcaucuuuggagaucaucaccauauuuuacuuuugagagucuuuaaagaggaaggggaguggagggaa

SEQ ID NO: 172211 - RNA, 133 nt, Homo sapiens
ugugcagccgaccgccugcccacuauggacugacaaccaaggaaagucuuccccaguccaaggagcagucgugucugaccuacauugggcuuuucucagaacuuugaacgaucccaugcaaagaauucccacc

SEQ ID NO: 172212 - RNA, 36 nt, Homo sapiens
uuucuuagaauuuuuaauccagugauucagguugaa

SEQ ID NO: 172213 - RNA, 45 nt, Homo sapiens
ugauuuuagugucugagcuggcuuucuucaucaguuagagugacu

SEQ ID NO: 172214 - RNA, 45 nt, Homo sapiens
ugggaaagaccgagugaagaaagguggauccuacaugugccauag

SEQ ID NO: 172215 - RNA, 52 nt, Homo sapiens
ccuuguaguaguauuuugucacaagccacauauguuaaaucaggcaucucaa

SEQ ID NO: 172216 - RNA, 25 nt, Homo sapiens
auguaccauggccuccuuaguuugg

SEQ ID NO: 172217 - RNA, 88 nt, Homo sapiens
cccucaaguucaucaagaaaaggguggggacgcacauccgugccaagaggaagcgggaggagcugagcaagguacuggcugccaugag

SEQ ID NO: 172218 - RNA, 42 nt, Homo sapiens
gaacgugagcaagcccaggcacagccgccgccgcgggcgucu

SEQ ID NO: 172219 - RNA, 46 nt, Homo sapiens
ucuuuuuuaaacaguuaauuaugaaguguuacaaaaauucagaaua

SEQ ID NO: 172220 - RNA, 46 nt, Homo sapiens
auaaaagcaucugcaugcuuggaagggggugcacaaggccuuagaa

SEQ ID NO: 172221 - RNA, 46 nt, Homo sapiens
augguuauggcuuauacaacauaguggggaacgcaugggaauggac

SEQ ID NO: 172222 - RNA, 62 nt, Homo sapiens
ucuacuucacuuaaacaucaaauuauuuaagguggguaaagaaaaaaauacccaaacccuug

SEQ ID NO: 172223 - RNA, 38 nt, Homo sapiens
uaacugaguuauucgggaagggcaggccagggcuggcu

SEQ ID NO: 172224 - RNA, 64 nt, Homo sapiens
gaccugaaucuugcaaguuugagugcuagcauauccuuaguacuugacuacacuuuuacucucc

SEQ ID NO: 172225 - RNA, 55 nt, Homo sapiens
cuggggagcagcaguguuucaguggcugaaacaagagcccacauauuuuaggaga

SEQ ID NO: 172226 - RNA, 46 nt, Homo sapiens
guaauacugaauuugagaaguuugugaacucaacuggcuauuugac

SEQ ID NO: 172227 - RNA, 42 nt, Homo sapiens
augguccccaucccugcuggaguauuuacaaugggcacagau

SEQ ID NO: 172228 - RNA, 37 nt, Homo sapiens
cuguuauuccagaccuguuuccagugcagguacagau

SEQ ID NO: 172229 - RNA, 51 nt, Homo sapiens
agacugaagacaggaacaccaauuacaaggguucugcaguuaucugggggu

SEQ ID NO: 172230 - RNA, 41 nt, Homo sapiens
ugcuauugauggacauuuagauuguuuccagcccuuuucag

SEQ ID NO: 172231 - RNA, 45 nt, Homo sapiens
ggauccuacagagugagacacuugguucucugguuuucacuugaa

SEQ ID NO: 172232 - RNA, 47 nt, Homo sapiens
cugucuugcuuagcgccuguauguguuaggugccgggauauauaaau

SEQ ID NO: 172233 - RNA, 43 nt, Homo sapiens
ugccccccuucccuggaauccaggugucacuggggccggggag

SEQ ID NO: 172234 - RNA, 50 nt, Homo sapiens
auaaugaguuuuuguccuaagccuauuuuaaguucuaucuaaaccgccaa

SEQ ID NO: 172235 - RNA, 51 nt, Homo sapiens
caagaaaugaaagugguugcugcaaguugaaagaauuagaacuuuaaaaag

SEQ ID NO: 172236 - RNA, 48 nt, Homo sapiens
gauccucaggaguacuggcggagugagaagcauuuggaugugagaacu

SEQ ID NO: 172237 - RNA, 48 nt, Homo sapiens
uagccacaaacauagggauaaaagagugcagauauuugaggagguauu

SEQ ID NO: 172238 - RNA, 50 nt, Homo sapiens
cagccaauauaaauaaacaaguaaguauuauaguauuagagguaguaaaa

SEQ ID NO: 172239 - RNA, 28 nt, Homo sapiens
gguaggcuaaucaccaaccugaggugag

SEQ ID NO: 172240 - RNA, 39 nt, Homo sapiens
gccuuuuguguuuuuuuaacucauaagaauaccuggcac

SEQ ID NO: 172241 - RNA, 75 nt, Homo sapiens
gcccugcugggugcugcuugaccuaaaaagugaaacggugccuuuuugucuucguccuuauccucgguucugagg

SEQ ID NO: 172242 - RNA, 49 nt, Homo sapiens
uugauuuuuauuauuuuuaaagcaagcagcaagaaaaccagcaccaaag

SEQ ID NO: 172243 - RNA, 62 nt, Homo sapiens
uaaggaaccaggauagaagcuuuuaauaauagaugagcuauauucugugcuagccagcuuca

SEQ ID NO: 172244 - RNA, 96 nt, Homo sapiens
acuguggggacgaggcgagggguugcaggcaggcaggggauccaaaguaccugacucucaugcucagaaggguuucauuuaaggucagacugucag

SEQ ID NO: 172245 - RNA, 63 nt, Homo sapiens
guuguggugggcuccuaauaacaagcuagaugauaauaauaauaauaagagcuuaggggcaga

SEQ ID NO: 172246 - RNA, 77 nt, Homo sapiens
ucuguguucucaguugcugucucccucuauaaauaaguucauguuuaaugaaaugcucuuuaucucuccugcaaugu

SEQ ID NO: 172247 - RNA, 71 nt, Homo sapiens
uagguugcuuccugaggugucaugcugaucauugcugcauaauucuuccugaaagaaaacuuggcacccag

SEQ ID NO: 172248 - RNA, 48 nt, Homo sapiens
uuggcuccuuccuguuuucaucgucuaugguugacucuuuuacccucu

SEQ ID NO: 172249 - RNA, 47 nt, Homo sapiens
gaaacuguuugacuuuuuuggauaaaagcuaaauaaauuagaauaaa

SEQ ID NO: 172250 - RNA, 37 nt, Homo sapiens
acuuaagaaccuugucugaggucacauggcuggugac

SEQ ID NO: 172251 - RNA, 60 nt, Homo sapiens
uuggguccagcgugagcucuuaucuuguucuauauacgggccuugggagcugggagauga

SEQ ID NO: 172252 - RNA, 48 nt, Homo sapiens
ugaauuuuggacaauaucauuguccucguaagggaugaggagagcuga

SEQ ID NO: 172253 - RNA, 30 nt, Homo sapiens
augccauuauugcauaagauucgggcaaca

SEQ ID NO: 172254 - RNA, 48 nt, Homo sapiens
ugucuuguaguugacucgucuucucccuggaaaguggaucuuauuggu

SEQ ID NO: 172255 - RNA, 46 nt, Homo sapiens
uuacaggaggcaaaaauugugcuuauucucauuggcacugauuugg

SEQ ID NO: 172256 - RNA, 46 nt, Homo sapiens
auaugguauagggauuucacagaugugauuaauuaaggcucuugag

SEQ ID NO: 172257 - RNA, 44 nt, Homo sapiens
aaccauuuaggcuagacucaguuccaaaaacaaaucaaaacaaa

SEQ ID NO: 172258 - RNA, 58 nt, Homo sapiens
ucacuucaugguuacaaaauagcugcagugguuccaggcauccuguuugcuuucauga

SEQ ID NO: 172259 - RNA, 46 nt, Homo sapiens
uugggagacaacaagcuuucuauacugugguuuauugguugcacau

SEQ ID NO: 172260 - RNA, 44 nt, Homo sapiens
caucuugugcugcauucugaugaaaucuugacauaccacccuga

SEQ ID NO: 172261 - RNA, 311 nt, Homo sapiens
gagguaggaggacugcuugaaacuagggguuugaaaccagccugggcaacauagugagauccugucucuacaaaaaauuaaaaaguuagcgaggcauagugguacacacauguagucccagcuacuagggaggcuaaggcaggaggcucauucaagcccaagcccaggaaguagaggcugcagugagcuaugaucaugcuacuguacuccagcuugggugacagaggcagacccugucuuuaaaaaaaaaaaaagaaagaaaagaaacacuaacuuguugaagauugagaugacuccacuaggaacaaaaa

SEQ ID NO: 172262 - RNA, 35 nt, Homo sapiens
uucuaaucucucagcguugccaagaaguguccaug

SEQ ID NO: 172263 - RNA, 44 nt, Homo sapiens
ucacuauauuuacagcauguguuaauuguagugggcuagauaca

SEQ ID NO: 172264 - RNA, 18 nt, Homo sapiens
uggucauuggguggagga

SEQ ID NO: 172265 - RNA, 40 nt, Homo sapiens
cuaggagcacacagcauucauguguggggaauagggguga

SEQ ID NO: 172266 - RNA, 45 nt, Homo sapiens
cuaaagcuuuugacagaccucugaguaguaaucuguggcuuucaa

SEQ ID NO: 172267 - RNA, 89 nt, Homo sapiens
gggagaaucuuaauuggacauacagcuacccaauagaaugccugauaugaugaagaguuugaagaaaguuaaggacauacuaauggcaa

SEQ ID NO: 172268 - RNA, 52 nt, Homo sapiens
gaucuuauaauugcaccggcuagugguucucccuugaauaaacugcaagacu

SEQ ID NO: 172269 - RNA, 46 nt, Homo sapiens
caccaaggguaaaagcuaugauguagguacgugcaguguuggagaa

SEQ ID NO: 172270 - RNA, 41 nt, Homo sapiens
aacuaauccuauauagagguuuuauucguuugcuaggguug

SEQ ID NO: 172271 - RNA, 49 nt, Homo sapiens
agagcuuaaagguaaggaauaggugggucaguucagccaaguaaggcca

SEQ ID NO: 172272 - RNA, 87 nt, Homo sapiens
uaucuuguagaauccagggggaucccaugaaaguuuuuuaagcuggaaagugacaucauuaaauuugccuuauuuuuauuuuaaaga

SEQ ID NO: 172273 - RNA, 41 nt, Homo sapiens
uaguuuuuaaccaccuguacagcaaaucaugaauaggagaa

SEQ ID NO: 172274 - RNA, 45 nt, Homo sapiens
auuaccauaaacagaacagggaagcucacaggccuauaaaaauag

SEQ ID NO: 172275 - RNA, 75 nt, Homo sapiens
gggucugaggugaggccuuggguuauggaucuucacaaagagguuuagguguaggugguucagacaauaccauga

SEQ ID NO: 172276 - RNA, 46 nt, Homo sapiens
uaaacguuuaaauggaaguggucucauaaauauuuucaguuucaaa

SEQ ID NO: 172277 - RNA, 48 nt, Homo sapiens
uguggcuuauuccuuggagcuuauauucguuuugugucuuagccuaaa

SEQ ID NO: 172278 - RNA, 40 nt, Homo sapiens
guugaauuuauuaagaguuuggagggagggggccgaagga

SEQ ID NO: 172279 - RNA, 37 nt, Homo sapiens
ccagugcaaaagaaacaugagacauguuaucaaagac

SEQ ID NO: 172280 - RNA, 36 nt, Homo sapiens
gacuucgggcuuguucauuggcuuggggagauacaa

SEQ ID NO: 172281 - RNA, 57 nt, Homo sapiens
cuauuaguccaguaaauauauccagaugugcagaacagcaaguaagguuuuaugggg

SEQ ID NO: 172282 - RNA, 46 nt, Homo sapiens
uacguaaaaugauaguccguggacuguuuaguaacuguaauguggg

SEQ ID NO: 172283 - RNA, 45 nt, Homo sapiens
ugggcuguggagaggguuugguagacaugaaucaccuguuagaug

SEQ ID NO: 172284 - RNA, 41 nt, Homo sapiens
caggcaucaaauaaaauaauaaaacauccacuuuugacuac

SEQ ID NO: 172285 - RNA, 43 nt, Homo sapiens
agggugagcuuacagcaggauagaugaagggugucccagguag

SEQ ID NO: 172286 - RNA, 38 nt, Homo sapiens
cucacacguggucggggcuggaugggaaaugcugggau

SEQ ID NO: 172287 - RNA, 58 nt, Homo sapiens
uaaaauugcuucaagagagacagucugcucuuccuuuguguagugggaguuccugaua

SEQ ID NO: 172288 - RNA, 55 nt, Homo sapiens
agcacauaggaagggugccaaaucggucuuugcuggauaagagggugugauacag

SEQ ID NO: 172289 - RNA, 45 nt, Homo sapiens
aagugccgaguaagccucagucggaggcacccaugggauuuagag

SEQ ID NO: 172290 - RNA, 49 nt, Homo sapiens
aauaaaauucauaaauaauagauaccaauuuuaaaaaauuauaaaggag

SEQ ID NO: 172291 - RNA, 182 nt, Homo sapiens
agguucagguaauuacagauacccccaggcuggaaugcagugaugccaucauggcucacugcagccuugacaaccugagcucaaacgauccuccugccuuagccucccagagugcuaggauuauaggcauggacuacugcgcccagccgacagauaacuuuuuaacuuaugugaauauccag

SEQ ID NO: 172292 - RNA, 41 nt, Homo sapiens
uaaauaacacauucaaguucacaaaaccacaaaccacccaa

SEQ ID NO: 172293 - RNA, 42 nt, Homo sapiens
gaagcuuccuacuugaaaaggaaccuggcuguggcaguucug

SEQ ID NO: 172294 - RNA, 28 nt, Homo sapiens
uaaaagcaaccuuugggguuuaaauggg

SEQ ID NO: 172295 - RNA, 41 nt, Homo sapiens
uuuuagcuccugcauuugaaaaguaauaaauaccuaacagu

SEQ ID NO: 172296 - RNA, 50 nt, Homo sapiens
gaguuuuuagucucaaguacagccuugcuuccuaggcugcggugagaagu

SEQ ID NO: 172297 - RNA, 38 nt, Homo sapiens
agguggagguaaggguaggguggagaaagggcuccugg

SEQ ID NO: 172298 - RNA, 24 nt, Homo sapiens
agucacaaacaaguacuuauaccc

SEQ ID NO: 172299 - RNA, 28 nt, Homo sapiens
caugcucuggagguuucagugagagagg

SEQ ID NO: 172300 - RNA, 32 nt, Homo sapiens
gugaaauguuuguucagauaguuugcccauuu

SEQ ID NO: 172301 - RNA, 61 nt, Homo sapiens
uguauucauauugccacauguaucaguacuucauuucuuuuuauugccaaguaauauucca

SEQ ID NO: 172302 - RNA, 51 nt, Homo sapiens
auguaggaauucuauuuuugaccuucugaggaacugccagaaugccuucca

SEQ ID NO: 172303 - RNA, 43 nt, Homo sapiens
gugugucagcgucccaguucuccauguggccuucauuuugaag

SEQ ID NO: 172304 - RNA, 46 nt, Homo sapiens
aaauauuucuccugcccugaccaacccacgcagacaugugcugggu

SEQ ID NO: 172305 - RNA, 40 nt, Homo sapiens
uguaauacaaguuuguugaguauguggagucuguuguucu

SEQ ID NO: 172306 - RNA, 24 nt, Homo sapiens
acuucauuauggcuaaggcaaaua

SEQ ID NO: 172307 - RNA, 29 nt, Homo sapiens
gaucaagauguggggagaaaguaaguuag

SEQ ID NO: 172308 - RNA, 26 nt, Homo sapiens
aauagacaguggcuuaucuuuuacuu

SEQ ID NO: 172309 - RNA, 42 nt, Homo sapiens
caaaugaucuggagcuccauuuaagaaacugucacugugguc

SEQ ID NO: 172310 - RNA, 65 nt, Homo sapiens
gaaaaagaaauggagggauuuucuuaaggcacuuuaaugaagggaauugggugaagggaauucaa

SEQ ID NO: 172311 - RNA, 44 nt, Homo sapiens
uuaccucugagauuaggcaagcuguggauccuuucggugagcgc

SEQ ID NO: 172312 - RNA, 35 nt, Homo sapiens
uccuggccuccugguacaggagggaagacuggcau

SEQ ID NO: 172313 - RNA, 46 nt, Homo sapiens
uucucccagaucauuagcauuuuuagugccuuugcguccaccaggu

SEQ ID NO: 172314 - RNA, 46 nt, Homo sapiens
ggcuacuucgauguugauugggggugggcugcuugcagaggagggg

SEQ ID NO: 172315 - RNA, 28 nt, Homo sapiens
cuaagaaaagcaggcuguagugacaaag

SEQ ID NO: 172316 - RNA, 66 nt, Homo sapiens
ucacccagaaugaaaggaggugagcacucccgcaugcucagcacagccgcccucccgcacugagag

SEQ ID NO: 172317 - RNA, 49 nt, Homo sapiens
cuggucaagauguucucgaaguugucuucuccaagcccaacagagaacg

SEQ ID NO: 172318 - RNA, 93 nt, Homo sapiens
aagagguguggcuguuuuggagggacagcaacaaagagauucgcagcaagagugugagggaauuggcucaggaugcuaaagaagggcagaagg

SEQ ID NO: 172319 - RNA, 33 nt, Homo sapiens
cuacauggucuuuacuguauaaaacacagcuga

SEQ ID NO: 172320 - RNA, 47 nt, Homo sapiens
ccuucucuuaccauaaggaagguccaagucugucauuucuaaacugg

SEQ ID NO: 172321 - RNA, 45 nt, Homo sapiens
gcaagauggcgaaaggagaagagaauaaagguaacaaugaugugg

SEQ ID NO: 172322 - RNA, 32 nt, Homo sapiens
gguuauuguguuuggugagguuaucagagaag

SEQ ID NO: 172323 - RNA, 51 nt, Homo sapiens
cuagcagcaauccugggaaaagugacccuguguuggaauaaagggugaggg

SEQ ID NO: 172324 - RNA, 42 nt, Homo sapiens
gcaggaagcagcaacagcgucugcuccggaacaugggcgcgc

SEQ ID NO: 172325 - RNA, 50 nt, Homo sapiens
acuuuugaaguccucaguaagacgcugacaucugcuuaaguauuuggauu

SEQ ID NO: 172326 - RNA, 36 nt, Homo sapiens
uaucauguguguguauaucuguguguguacaugugc

SEQ ID NO: 172327 - RNA, 46 nt, Homo sapiens
guuggcucaugaauuuuugcagaauuucugcgcaggcaaccagcag

SEQ ID NO: 172328 - RNA, 53 nt, Homo sapiens
uguaucagcacuucguuccuuuauguugcugaguaauuuucuauucuauacau

SEQ ID NO: 172329 - RNA, 50 nt, Homo sapiens
aggaacacagcuuacuaucuuggguggcugcaggcaauaggacagaaagu

SEQ ID NO: 172330 - RNA, 79 nt, Homo sapiens
aagguaauuccaagucacagaauuguucacugaggccugaaugagaucauaugugaaaugucucacacauagcaugccc

SEQ ID NO: 172331 - RNA, 45 nt, Homo sapiens
auguacuugaccaugugguaacuuuuuccuggaaagcaccuguca

SEQ ID NO: 172332 - RNA, 51 nt, Homo sapiens
uaaugucagagaagugguaauaacaagauuuuccaucuauuuaaauuccca

SEQ ID NO: 172333 - RNA, 71 nt, Homo sapiens
aacugcaauuaaggcaggcauacacgucaccacuucugagggagauugggaaauggacagucccgugaccu

SEQ ID NO: 172334 - RNA, 82 nt, Homo sapiens
gauuguucuuaguauaugcagugaacaaggauauaccagauccauuccuuacaccucugauguuggguagagcaggacagaa

SEQ ID NO: 172335 - RNA, 73 nt, Homo sapiens
aauacccaguaagucauuuuucagcucuaggaagaagccuugauaauuaaaucagccugccuugucaaaaucg

SEQ ID NO: 172336 - RNA, 47 nt, Homo sapiens
ucugucauuaauauuagagcaauguuacuagugagacuccuuggaua

SEQ ID NO: 172337 - RNA, 44 nt, Homo sapiens
uacagaauuugcccgggguuacauaguuaauuacaaggcaaccu

SEQ ID NO: 172338 - RNA, 45 nt, Homo sapiens
uaacugcagggaauuuugccguuuccuguuuagcauuccuucuuc

SEQ ID NO: 172339 - RNA, 29 nt, Homo sapiens
cauaaaggccacuugaugugcaauuaaug

SEQ ID NO: 172340 - RNA, 50 nt, Homo sapiens
agaggcagggucuccauccuuacccccugauuuuucuuaauccccugggg

SEQ ID NO: 172341 - RNA, 34 nt, Homo sapiens
uguaaaauucgagguagagggggaaacaggagaa

SEQ ID NO: 172342 - RNA, 37 nt, Homo sapiens
ugcuggucugugauaggcacacaugaagcggauggau

SEQ ID NO: 172343 - RNA, 40 nt, Homo sapiens
cacuaccccugcuccccugagagccuccguggacacgcau

SEQ ID NO: 172344 - RNA, 114 nt, Homo sapiens
gaccuuucugcuguuauacaaaauugacuuuggguccugugcagagaugaugcacuuuugaaguuauuauaaaucaauaauaaagaauauuuauaauuguagaaaaagcuacua

SEQ ID NO: 172345 - RNA, 89 nt, Homo sapiens
ucuauccuccuugcugcuaacuaaacucacuaaaugaaggacuaacguuuacuaaggucuguaagaucauagagaagcuuuuuggggag

SEQ ID NO: 172346 - RNA, 92 nt, Homo sapiens
acauauuuccaaguaucaaaauuuaauuucagaaacuauuccaaaaucacaguaguucaagcuagaaugaaguguacuuuauuugaaagaag

SEQ ID NO: 172347 - RNA, 65 nt, Homo sapiens
uuugcaauaaauuauguuggccaaaaagucauaugucugcccauuuugaacagugcacuaggguu

SEQ ID NO: 172348 - RNA, 50 nt, Homo sapiens
uccuuugaugaagaaaugaaugaaugugugcaucuuugaauaaauuccua

SEQ ID NO: 172349 - RNA, 47 nt, Homo sapiens
acugagaccaacaucugauauuuguuugcauacuguagguguaaacu

SEQ ID NO: 172350 - RNA, 52 nt, Homo sapiens
ccccuguuuaucccaucccaaucugucccuggaaucuuuaauuagcagcaug

SEQ ID NO: 172351 - RNA, 33 nt, Homo sapiens
ucugggacuuuccaugguuuugaugauugacag

SEQ ID NO: 172352 - RNA, 51 nt, Homo sapiens
agucugcucccucccaucuuguuuugcaaaugccucacuugaaaucuccag

SEQ ID NO: 172353 - RNA, 53 nt, Homo sapiens
ggagucucuguuuuagagaccugcuagauuucaacaccuuuccucucggccag

SEQ ID NO: 172354 - RNA, 51 nt, Homo sapiens
auuuguguugcagguguauuuuuuagcaacuuguuuugucuuuggucuacc

SEQ ID NO: 172355 - RNA, 35 nt, Homo sapiens
aucccuuuaaauauuuuuaauaccuccuuuaugca

SEQ ID NO: 172356 - RNA, 76 nt, Homo sapiens
ccgcuucccccaacguacacuuuugaaguucauugucacguguugcaccagguugggauuugggacaaugagugag

SEQ ID NO: 172357 - RNA, 45 nt, Homo sapiens
ugacuugucagagccccuuggccccaagcuucucuuucucuggag

SEQ ID NO: 172358 - RNA, 47 nt, Homo sapiens
aaagagaugagggcggaaagggcaauuugauuugccucugcuggaaa

SEQ ID NO: 172359 - RNA, 46 nt, Homo sapiens
ugugaggaagaucagccuugguuugacagggcagucacccugagga

SEQ ID NO: 172360 - RNA, 60 nt, Homo sapiens
gaugccucuugggaacugccaggcagaggauuggucagucuuccucuggagguucaggga

SEQ ID NO: 172361 - RNA, 37 nt, Homo sapiens
acagaggcuucugagauggcucuguguuguccaucac

SEQ ID NO: 172362 - RNA, 43 nt, Homo sapiens
uccuuaauagcaguagccuguuugaauaaucagaggcaagcug

SEQ ID NO: 172363 - RNA, 84 nt, Homo sapiens
cuuucugggaacaaagcagacuuucuguuaucuuuuuuuaauuauuauuauugugauauaauugacauauaaucauaggcacag

SEQ ID NO: 172364 - RNA, 37 nt, Homo sapiens
gccucaaugacauggaggaugacaaggcuaagcauag

SEQ ID NO: 172365 - RNA, 51 nt, Homo sapiens
aaaaguacucagguagcuacacaauuauauuauaaaugcucagagcuggug

SEQ ID NO: 172366 - RNA, 45 nt, Homo sapiens
caacagugacagugaacaccagugacuugggaaauaaaaagaaag

SEQ ID NO: 172367 - RNA, 45 nt, Homo sapiens
ccauccuccgcuuccuucagcuccugugugaaaaccacaaccgag

SEQ ID NO: 172368 - RNA, 34 nt, Homo sapiens
uggaucggagggaaggagaaggcauucucauaag

SEQ ID NO: 172369 - RNA, 44 nt, Homo sapiens
ugaaggaagaggagucauucaggguggaggccucgagagcaaca

SEQ ID NO: 172370 - RNA, 45 nt, Homo sapiens
uaagaugaccuaauugauggacuguagcauggucauuaugccaag

SEQ ID NO: 172371 - RNA, 54 nt, Homo sapiens
agcaucuagaaaggucuguaggacuugaauagacacagccugagagauuggggg

SEQ ID NO: 172372 - RNA, 24 nt, Homo sapiens
cagagcccuagggggaaccgagga

SEQ ID NO: 172373 - RNA, 45 nt, Homo sapiens
ggccacauagaaaagaggggauagguaagagggccuggccaaaua

SEQ ID NO: 172374 - RNA, 45 nt, Homo sapiens
aguucuuugguuucgugggccccauaggccagagcagaacagugg

SEQ ID NO: 172375 - RNA, 24 nt, Homo sapiens
cugagaggaaagcuccacaggaau

SEQ ID NO: 172376 - RNA, 50 nt, Homo sapiens
cguguagcgaccauaagaguaggagcuaguuuugaagccccgggauucau

SEQ ID NO: 172377 - RNA, 52 nt, Homo sapiens
uaaggaauucaccguucagaucacuaggauuagcucauaccauuaggggugg

SEQ ID NO: 172378 - RNA, 31 nt, Homo sapiens
cucaucccugccaagggcucucucccaagag

SEQ ID NO: 172379 - RNA, 43 nt, Homo sapiens
ugcaaaguucauaagcaggcaguuaacaaaagcagaaauccag

SEQ ID NO: 172380 - RNA, 54 nt, Homo sapiens
gaucauacgguggacaguagcugagcugagauuugaauuuacaucuaaguccag

SEQ ID NO: 172381 - RNA, 46 nt, Homo sapiens
ggucccugcagaagagacggaacaggauaaagagcacacaugugag

SEQ ID NO: 172382 - RNA, 40 nt, Homo sapiens
ucaggaagccguccaaagagguaaauuaaucccgagggga

SEQ ID NO: 172383 - RNA, 23 nt, Homo sapiens
aucauuucaggauuauucauaau

SEQ ID NO: 172384 - RNA, 40 nt, Homo sapiens
uaaauaucgugcuauuccuuaaacuuucaccccucagcuu

SEQ ID NO: 172385 - RNA, 43 nt, Homo sapiens
cagccaacacauaugaaacaccuguuugccaggugcggcauua

SEQ ID NO: 172386 - RNA, 40 nt, Homo sapiens
gaaucugaguaaccaagaccuuccuguaacaugaaagcag

SEQ ID NO: 172387 - RNA, 35 nt, Homo sapiens
aaaguuucagagguuucuucaaguugaagagaaag

SEQ ID NO: 172388 - RNA, 25 nt, Homo sapiens
uucaauaaggguugagcagaccaag

SEQ ID NO: 172389 - RNA, 53 nt, Homo sapiens
cauuuuccuaguuaugguagguaauuuuuuuuuucucuaaccaacuacucaag

SEQ ID NO: 172390 - RNA, 46 nt, Homo sapiens
ggauaaaugcauacugcuggccaaucagugucaucuccuggguaaa

SEQ ID NO: 172391 - RNA, 45 nt, Homo sapiens
aaaguuuguaaaugcauauauaaaaauauuuaauaaaugaugcag

SEQ ID NO: 172392 - RNA, 42 nt, Homo sapiens
gcgaguaggcagugguggauuuggcuaccagaaaaccaagaa

SEQ ID NO: 172393 - RNA, 46 nt, Homo sapiens
ugccuacucgcuuuuucugcuugccuucauugcuguugacguucag

SEQ ID NO: 172394 - RNA, 47 nt, Homo sapiens
gaaauugauucaaaagaacuacuuuuuucauaagucagcucaggaag

SEQ ID NO: 172395 - RNA, 114 nt, Homo sapiens
acuggauuguucaguaugacccuccggaugacccuaaggaauaauauucaucguguggguagaacagccagagaccuaaaugggagaaggcaugccuugcucauuuugcaccca

SEQ ID NO: 172396 - RNA, 47 nt, Homo sapiens
uaggucucuggcuguucuacccacacgaugaauauuauuccuuaggg

SEQ ID NO: 172397 - RNA, 42 nt, Homo sapiens
aggauuucucugaaaaaggagccauuguauguugguguugau

SEQ ID NO: 172398 - RNA, 67 nt, Homo sapiens
agcaaaaacugaaaacaaaggggaaucugaagaagaaagugccaagucuccuaaagaaacagaaaau

SEQ ID NO: 172399 - RNA, 49 nt, Homo sapiens
caagaagcaguggaaaauauaaaaguuaaaaaaucuccccagaaaucca

SEQ ID NO: 172400 - RNA, 39 nt, Homo sapiens
aagaaacaacgggagguggaaagguuaaaaaaucaaaac

SEQ ID NO: 172401 - RNA, 41 nt, Homo sapiens
uucuugcguaggaguuucaucagcaggugagacauccuguc

SEQ ID NO: 172402 - RNA, 44 nt, Homo sapiens
gacaggaugucucaccugcugaugaaacuccuacgcaagaagau

SEQ ID NO: 172403 - RNA, 42 nt, Homo sapiens
uguacccugcccacauguaccaaguguacaagucaagacggg

SEQ ID NO: 172404 - RNA, 41 nt, Homo sapiens
ccaagaaaaguuuucucgcuuugagguuggcgaggggaugc

SEQ ID NO: 172405 - RNA, 45 nt, Homo sapiens
accuacaaauugccgcaccggcucaucgagaaaaagagacgugac

SEQ ID NO: 172406 - RNA, 61 nt, Homo sapiens
cuuugguuggggaaauggaaaaaaaaaaaauaguauuucgggaggaacaaaaaagccugga

SEQ ID NO: 172407 - RNA, 45 nt, Homo sapiens
gacgcagguucacgaugggagaaaggaucggcgcaauuaagcaag

SEQ ID NO: 172408 - RNA, 58 nt, Homo sapiens
gaaugcugcaagauuguugcauuguguauacugagauaaucugaggcauggagagcag

SEQ ID NO: 172409 - RNA, 53 nt, Homo sapiens
gcacaugugugccugcguguugguauaggacuuuaaagcuccuuuuggcauag

SEQ ID NO: 172410 - RNA, 45 nt, Homo sapiens
gugcacaaagcugaguaaaaagcugcccccuucaaacagaacuag

SEQ ID NO: 172411 - RNA, 46 nt, Homo sapiens
ccaagcuuagcuucucaaaggccuaaccaagccuuggcaccgccag

SEQ ID NO: 172412 - RNA, 48 nt, Homo sapiens
aagguguaaaauuguaaauauuuuuaucuaugaguaaauguuaaguag

SEQ ID NO: 172413 - RNA, 46 nt, Homo sapiens
uugucucagugauuagccaugguaacuguuaggaauuagacugaaa

SEQ ID NO: 172414 - RNA, 29 nt, Homo sapiens
guaguuguuuguuagaccugugucuuaca

SEQ ID NO: 172415 - RNA, 45 nt, Homo sapiens
aaguguuuaaggaagcaucacugacagaucauguggcccucagau

SEQ ID NO: 172416 - RNA, 48 nt, Homo sapiens
caguuuggacugacagcccucaggcaauuucugcaaaaacagggacua

SEQ ID NO: 172417 - RNA, 42 nt, Homo sapiens
gcucaugcaggccuaaguagguggcgugagucucuguaaguu

SEQ ID NO: 172418 - RNA, 42 nt, Homo sapiens
aagccugggaagcaucacauaagugaguucucauaaucauga

SEQ ID NO: 172419 - RNA, 58 nt, Homo sapiens
auuugcacgugaaagaugugaggguacaggaacuguguggguugggguggucagaaaa

SEQ ID NO: 172420 - RNA, 44 nt, Homo sapiens
uuuuuuugcuguucuccaaaucucagaaggcacugaagccagau

SEQ ID NO: 172421 - RNA, 43 nt, Homo sapiens
ugccaguguuauuuaaugacgcugaaacuuagucaagagagac

SEQ ID NO: 172422 - RNA, 71 nt, Homo sapiens
guagugcagggaucacagggugaguuuggucucuacucuauagccuuuauguagauacuuuuccuaccguu

SEQ ID NO: 172423 - RNA, 26 nt, Homo sapiens
uuucaguccccuuuuacugcuggguc

SEQ ID NO: 172424 - RNA, 141 nt, Homo sapiens
aagcucuguuucucugugaggaaacacaugaaaggagcucuguaguauuauuagcacauguagcuugcaugugagguaccuccucaguuccugaaaguuaaggacagcacagaugaaaaucccagcagcguucaugaugag

SEQ ID NO: 172425 - RNA, 25 nt, Homo sapiens
cauuagagggugcuguuuuguuuug

SEQ ID NO: 172426 - RNA, 50 nt, Homo sapiens
uguuuguucccaagagggaauauaucuucuagaaguguauguaagagugg

SEQ ID NO: 172427 - RNA, 40 nt, Homo sapiens
aaauaaugcugcuaugagcauugguggucagauauuuaag

SEQ ID NO: 172428 - RNA, 54 nt, Homo sapiens
acacugguguuuacuuuggaugaaauguucugccaaacagucuaaaguuaacau

SEQ ID NO: 172429 - RNA, 42 nt, Homo sapiens
uguaaacuagauuuauuacuauggggaaagugguuggaagaa

SEQ ID NO: 172430 - RNA, 48 nt, Homo sapiens
aaaaauuaaaccaaagaaauuuacuuuggaguucuuaguucuuugaaa

SEQ ID NO: 172431 - RNA, 42 nt, Homo sapiens
cauaagagugaauuucagcuucugguggaucaggcuagaaaa

SEQ ID NO: 172432 - RNA, 46 nt, Homo sapiens
auguuuccauauuuguauuugaggaagggagaagauaaaaagaagg

SEQ ID NO: 172433 - RNA, 41 nt, Homo sapiens
ucuuggaaguuagaaugguaucauuuguauauauuuaagaa

SEQ ID NO: 172434 - RNA, 146 nt, Homo sapiens
auaaugaugaucuugaggucaggguuaauuauauucaaagguguuaaaaugguaguaaauaaagauuagaguuaguauaguaucguaagauaagguagaauugguugggagagaucuuagaaucuuaaaggggcucuacugggaaa

SEQ ID NO: 172435 - RNA, 69 nt, Homo sapiens
agugucaaaauuuuguuuuaaccauuuguaguaugguucucccuaaaaauuuuauaggauuuaugacau

SEQ ID NO: 172436 - RNA, 137 nt, Homo sapiens
auuuagacaaugccauaguucaacugaagcacaauuuuuucccuacacccaguaaauucccuaugccuuaguauuaugcuaaggaaaauggaagaaaccaagugauaacaaguacauuguugauuuuuguaugaaaa

SEQ ID NO: 172437 - RNA, 101 nt, Homo sapiens
cuauagacaagaauuauuuuccauugcucucaguuaucuacaacauacagaguuauaccauagcucaaaggcagugaauggcuggaaucuugggagaguag

SEQ ID NO: 172438 - RNA, 100 nt, Homo sapiens
aaaagauaauuuucaaaaacaacuaacaucauucucauauggauguaaaaugaacauguguuuuuauuaaagauuuaaacucauuaguagagagaagacu

SEQ ID NO: 172439 - RNA, 26 nt, Homo sapiens
ccagaacugagauuuuaaacucugca

SEQ ID NO: 172440 - RNA, 46 nt, Homo sapiens
aaaggaccaaacagaaaaggaaauagaugaaauccacaguaaauau

SEQ ID NO: 172441 - RNA, 56 nt, Homo sapiens
cauaaagugaaaugucauuguagccaguacugagaucacuaccagcgucccaaaag

SEQ ID NO: 172442 - RNA, 46 nt, Homo sapiens
uaugauaagccagccuuccucucagccugccuuccaauccccagau

SEQ ID NO: 172443 - RNA, 45 nt, Homo sapiens
caaaaggaagccgcugcccaaaacuguauauaauuugcucucuga

SEQ ID NO: 172444 - RNA, 52 nt, Homo sapiens
agaugagaugguaguuuggagaagcagugaguggcauaaagaucaaggguug

SEQ ID NO: 172445 - RNA, 46 nt, Homo sapiens
aaggaaucaucugcugcaguuugcuuuagagucaccagccaaaucu

SEQ ID NO: 172446 - RNA, 37 nt, Homo sapiens
uaacagucauuauucacacauggaaaauuuacuagag

SEQ ID NO: 172447 - RNA, 49 nt, Homo sapiens
agaguagagguacuagaaauuuaagcuuaugaugauauaccuuagauga

SEQ ID NO: 172448 - RNA, 40 nt, Homo sapiens
aaaauaaaaaguaaaagucuccuucuuaccauguuccugg

SEQ ID NO: 172449 - RNA, 389 nt, Homo sapiens
guagaauaauuuaguucuuuugucuuuuuuuggagaugaggucuugcuguguugcccaggcuauucacagcugccaucauagugaacuacagccugaaacuccuggguucaagagauccuucugccucagccuccugaguagcuggaacuauaggcaugcgccaccaagccugggcuuuuaaaaaaauuuuaaaaagaauuuugagacaggaucuugccauguugcucaggcuagucuucaacuccuagcccugagugaucuugcuuugggccucucaaaauguugaguuaauaggcgugagccaccauacccagccaaaaauuuuuuuagagaugggaauggaaugaucuugaauaguguuggugccaccuauguuguggcaucauuu

SEQ ID NO: 172450 - RNA, 47 nt, Homo sapiens
gguuacuuuaaaauacuguaguuuucuuugugccuaaguauaaacau

SEQ ID NO: 172451 - RNA, 46 nt, Homo sapiens
ugaugugugaugacauccucauugauguuaaugaauggugcuauac

SEQ ID NO: 172452 - RNA, 50 nt, Homo sapiens
aacauacucuagugcguacuauaggcaaaagcuaauggaaacauagguag

SEQ ID NO: 172453 - RNA, 45 nt, Homo sapiens
agaucaccuggacugugaagacggucagggacagaaucccagcua

SEQ ID NO: 172454 - RNA, 43 nt, Homo sapiens
aguuggugucgagguuauuguaauaagggugggguagggaaau

SEQ ID NO: 172455 - RNA, 40 nt, Homo sapiens
cccugggcguugcccugcaggggagugagcagcuguaaga

SEQ ID NO: 172456 - RNA, 43 nt, Homo sapiens
gcgagacaagcccgaccugcuacaggcacucgugggggugggg

SEQ ID NO: 172457 - RNA, 48 nt, Homo sapiens
ggaccgggcccuugcuacuggcucgagucucacaugagcgaaaccacu

SEQ ID NO: 172458 - RNA, 41 nt, Homo sapiens
ggcgcgggcguccucccacccuccccuuccuucgggggagu

SEQ ID NO: 172459 - RNA, 49 nt, Homo sapiens
uggcuggaugcaggcgggagggaggcccgcccugcggcaaccggagggg

SEQ ID NO: 172460 - RNA, 93 nt, Homo sapiens
gaggcugugcuucggcgcuccggcuccucagagagccucggcuagguaggggagcggaacucuggugggaggggaggugcgguacacuggggg

SEQ ID NO: 172461 - RNA, 48 nt, Homo sapiens
ccacguuuaccuuucccuugaggagaggccucuugcugcccuccgcuc

SEQ ID NO: 172462 - RNA, 46 nt, Homo sapiens
gauagccucguugaauguguaggguucgagccuggaguugagccag

SEQ ID NO: 172463 - RNA, 59 nt, Homo sapiens
cuucaaaggcagaaaaauauucccuuuaugaauucucuuucccucugcguguaagucgg

SEQ ID NO: 172464 - RNA, 94 nt, Homo sapiens
uuggacagauguuacauagcuauacuugugauuggggaggauccagcugaguggagugugcugagcuuuuuaggagaguguguacucccuauuu

SEQ ID NO: 172465 - RNA, 48 nt, Homo sapiens
uucucaggaucauuaguucucuucuguagccaaaaauucuggccuguu

SEQ ID NO: 172466 - RNA, 48 nt, Homo sapiens
auucauaaucuccuacccauuuauggauauuggcaucuggaaacugga

SEQ ID NO: 172467 - RNA, 42 nt, Homo sapiens
uuuggaaccuuuugugcucuugauauuaucauuuuuuagagg

SEQ ID NO: 172468 - RNA, 66 nt, Homo sapiens
uuucauggcaguaugaaguaaugagaagcauugccuuagccauguuaguuacauguauacuuuugg

SEQ ID NO: 172469 - RNA, 44 nt, Homo sapiens
uuugccaaccacauacuauuaaccccaaauuugauacauuucag

SEQ ID NO: 172470 - RNA, 123 nt, Homo sapiens
guuugaacaguuuuccaagagcacauuuguugcuuggguugagguaccaccuauauugcaauguuacuaaacuagccuuaaaguuuucccuucugucuauacugcaugcaacaauaaagggaa

SEQ ID NO: 172471 - RNA, 44 nt, Homo sapiens
guguuacuacuuaacauuauauuguuauuuaauggucuuggcag

SEQ ID NO: 172472 - RNA, 45 nt, Homo sapiens
ggggaaauuuuauuuuuuaucauuuuuauugucuuucaaugguga

SEQ ID NO: 172473 - RNA, 44 nt, Homo sapiens
aaaugcuauuuuuuccuagacaaauuuaguguuauuuguggcaa

SEQ ID NO: 172474 - RNA, 30 nt, Homo sapiens
gagacuuuuagucgcuaccuagcaaccuag

SEQ ID NO: 172475 - RNA, 57 nt, Homo sapiens
guuuuucgaaugucuuuuuucuuuucccauuaggugguaguaagggaaggaguaggu

SEQ ID NO: 172476 - RNA, 45 nt, Homo sapiens
uguuucagucuuucccuguugauacugcuugcccucugagcccau

SEQ ID NO: 172477 - RNA, 41 nt, Homo sapiens
uauauuaauaguaguuacuucauguuuguugaaugaaugaa

SEQ ID NO: 172478 - RNA, 46 nt, Homo sapiens
gguacagcuacggugauuuuacuugagauauuugacuuugagaugg

SEQ ID NO: 172479 - RNA, 29 nt, Homo sapiens
auuuaagaagaaauucagccuauauguaa

SEQ ID NO: 172480 - RNA, 42 nt, Homo sapiens
aaaauguucaguauuuuaucugaaauuuaauaauggauauug

SEQ ID NO: 172481 - RNA, 88 nt, Homo sapiens
uuaaaagaaaaaggacccuuugagaaaauggcuuguucuuauguaucuuaauauauacuguguucacuuuauguuuugucagacacug

SEQ ID NO: 172482 - RNA, 46 nt, Homo sapiens
ggauugcaucauuucugggagaauggccaagguccacagccucaau

SEQ ID NO: 172483 - RNA, 63 nt, Homo sapiens
uacuacuggaagauacaggcugugucuguuucugaauccaagaacuuacuaguguuccugugg

SEQ ID NO: 172484 - RNA, 51 nt, Homo sapiens
cccuuggaaaaugagauaauucuaauuugaaggaagaggaaaaauuagcca

SEQ ID NO: 172485 - RNA, 41 nt, Homo sapiens
uucaucagaagaaugaaacagucauguuaaacuagacacaa

SEQ ID NO: 172486 - RNA, 42 nt, Homo sapiens
aggauuccucauguccauaacauguuggaugaggcucugcag

SEQ ID NO: 172487 - RNA, 64 nt, Homo sapiens
cgucaugagcauugcaaucccucugggagucaccacaucagauacauccuacucagauauggcu

SEQ ID NO: 172488 - RNA, 63 nt, Homo sapiens
gugcuacuuucuagguaguagguacauuaucagucuguguggagacagccuucuuauggauag

SEQ ID NO: 172489 - RNA, 45 nt, Homo sapiens
ugcaaaguaggaauucauuuucauuuguuuuaauggguggagaaa

SEQ ID NO: 172490 - RNA, 44 nt, Homo sapiens
ccucuuccuauguacuucccauuguucuagaguaaaggggccga

SEQ ID NO: 172491 - RNA, 124 nt, Homo sapiens
gaccuucaaaaucagugguaccaaacuuuuuuuucagcuaagagcagcuuuaggaauucagaguuuguccaaaggcccaaucccuaaaauuauacucucaauucuugaagaauguaaaugccaa

SEQ ID NO: 172492 - RNA, 110 nt, Homo sapiens; identical to SEQ ID NO: 95509

SEQ ID NO: 172493 - RNA, 98 nt, Homo sapiens
gcaaagcaaagcaacuguaccagauuucuggguugaaugacaucccugauuaauaagugguuuucuuccuuaaaacagaauauuauuaaagagcaugu

SEQ ID NO: 172494 - RNA, 44 nt, Homo sapiens
aaaugaaaagcaguguuugggcuuauucccauauaaaaaggaga

SEQ ID NO: 172495 - RNA, 26 nt, Homo sapiens
guuuuguuuuguuugcaugcaaaagg

SEQ ID NO: 172496 - RNA, 47 nt, Homo sapiens
guagauugucuaacuguauagauagauagcauuaacauuugugagaa

SEQ ID NO: 172497 - RNA, 45 nt, Homo sapiens
uuuauuaauguuucaucaugccuauuucgcuguucugggcacuuu

SEQ ID NO: 172498 - RNA, 39 nt, Homo sapiens
gauggcaacuauaugcaauacgcauuuauuuuugugugu

SEQ ID NO: 172499 - RNA, 50 nt, Homo sapiens
aagccuguaauuacauuugcauaaagugguuggcugcuaaagagauguaa

SEQ ID NO: 172500 - RNA, 48 nt, Homo sapiens
uccauggccaucuuugauuucaugcaacuuuccuuuuuccuguccccc

SEQ ID NO: 172501 - RNA, 47 nt, Homo sapiens
ucucuaaguuagaguuauaccaaucaucggaguuucuaauuugugaa

SEQ ID NO: 172502 - RNA, 43 nt, Homo sapiens
uuuucuuuaaaggacugaaugucauucucauuucuguagugga

SEQ ID NO: 172503 - RNA, 46 nt, Homo sapiens
gccauuguuuuuaccuguacuuucuucaggguauccugucuuggua

SEQ ID NO: 172504 - RNA, 46 nt, Homo sapiens; identical to SEQ ID NO: 95521

SEQ ID NO: 172505 - RNA, 52 nt, Homo sapiens
uuacacacaaauccacauuuaauaacacuccuacuguuauuuauaggcuuag

SEQ ID NO: 172506 - RNA, 48 nt, Homo sapiens; identical to SEQ ID NO: 95523

SEQ ID NO: 172507 - RNA, 46 nt, Homo sapiens; identical to SEQ ID NO: 95524

SEQ ID NO: 172508 - RNA, 46 nt, Homo sapiens; identical to SEQ ID NO: 95525

SEQ ID NO: 172509 - RNA, 58 nt, Homo sapiens; identical to SEQ ID NO: 95526

SEQ ID NO: 172510 - RNA, 87 nt, Homo sapiens; identical to SEQ ID NO: 95527

SEQ ID NO: 172511 - RNA, 48 nt, Homo sapiens
auccagguguuugaagggccacuuuuguucuacuugcaaaaaucagcu

SEQ ID NO: 172512 - RNA, 46 nt, Homo sapiens
cuuguuuuccuccuugggauaggcauuucgagagggaucccggaag

SEQ ID NO: 172513 - RNA, 77 nt, Homo sapiens
uauccuccuuuacguguguguguguguguguguguguguguauaaauauauauauaugaggaaaacaugccucucaa

SEQ ID NO: 172514 - RNA, 48 nt, Homo sapiens
gaguuauaaauuuuaugcucagaauuacuaguuuaaaacuccuccagu

SEQ ID NO: 172515 - RNA, 47 nt, Homo sapiens
cacagaauuuagaugagaauacaacugagggcugggaaaaucggaua

SEQ ID NO: 172516 - RNA, 94 nt, Homo sapiens
cguuucuggggaggcaauuucacuagauguagcaugucucuuagaaaaauugagcuuucaucacauuuuaaaauuucucaucauugaucuaaau

SEQ ID NO: 172517 - RNA, 51 nt, Homo sapiens
uucuugcuguuguuuaauguuauugcucugguuuuauucaguuacagcugg

SEQ ID NO: 172518 - RNA, 47 nt, Homo sapiens
uuauaauagaguaucgugggaaagucauguuacgacagcaauuugag

SEQ ID NO: 172519 - RNA, 45 nt, Homo sapiens
auuguucaauguauaaaauggugacaccuccuuuccaagccaagc

SEQ ID NO: 172520 - RNA, 35 nt, Homo sapiens; identical to SEQ ID NO: 95537

SEQ ID NO: 172521 - RNA, 63 nt, Homo sapiens
guagauaauagucgugauauuucaucgugggaggugaaaaacaaaaguaauggugcuuuuaua

SEQ ID NO: 172522 - RNA, 375 nt, Homo sapiens
cuauaagaugugaaagcggcugggcgcaguggcucaugccuguaaucccagcacuucggaaggcugaggugggcagauaacaaggucaggaguucgagaccagccuggccaacauggugaaaccccgucucuacuaaaaaaaaauagaaaacuuagccaggcauuguggcgugugccuguauucccagguacucaggaggcugagacaggagaauugcuugaacccgggaggcagagguugccgugagccgagaucacgccacuccacuccagccugagcgacagagcaagacuguaucucaaaaaaaagaugugaaaguagagauuuuacccugauuucuaacaucucaagguuucuccacauauuuaagaaag

SEQ ID NO: 172523 - RNA, 32 nt, Homo sapiens
gaggucaccauagcauuugauuaugaguauag

SEQ ID NO: 172524 - RNA, 46 nt, Homo sapiens
uaaaguggacugugccugucacaagggaaaccggaauuguccuaua

SEQ ID NO: 172525 - RNA, 31 nt, Homo sapiens
uguggguuuauuguguucauacauuucuuuc

SEQ ID NO: 172526 - RNA, 42 nt, Homo sapiens
auccagaagaaaaaccagaagaagagaaagaagagguuauag

SEQ ID NO: 172527 - RNA, 49 nt, Homo sapiens
acucguccucauuugaagcuuccuucuacaccaguacuaucucuuucua

SEQ ID NO: 172528 - RNA, 46 nt, Homo sapiens
cggccgaagagucgaauuucucgguacaggaccaguucagcccaaa

SEQ ID NO: 172529 - RNA, 46 nt, Homo sapiens
uaccaggucuuauccauuccccguuaauuugcaccacccccaaaca

SEQ ID NO: 172530 - RNA, 40 nt, Homo sapiens
gccacucugcccaugugaguuuauaaugaguuaguuguuc

SEQ ID NO: 172531 - RNA, 72 nt, Homo sapiens
ugagguagagucuguucccuggaacacccuuuucucuuauccucagaucuggauucaggcugccuuccucag

SEQ ID NO: 172532 - RNA, 51 nt, Homo sapiens
aggcaggucuucccugacuccuccaaacuuaaaagcuuuucucuuucccca

SEQ ID NO: 172533 - RNA, 47 nt, Homo sapiens
ggcaugaaagaugagccaaaguggugugggauauggaggggaggagg

SEQ ID NO: 172534 - RNA, 98 nt, Homo sapiens
ggaaucacucauugguuuguucggggaaacgcucguagaauuccuaaagagaaauuugaccauuucuaaggauguuaacuguugaagcaucuuaucaa

SEQ ID NO: 172535 - RNA, 49 nt, Homo sapiens
uucuuuaagcuuuuuuaacuugguucugcuuuuauacuuguaucuauag

SEQ ID NO: 172536 - RNA, 56 nt, Homo sapiens
cuaauaggcucacuguuucauaucucacuaaagagguaagggccuggccuuguaag

SEQ ID NO: 172537 - RNA, 54 nt, Homo sapiens
cucuuucgccauaauagcgagaccuuuaaaauauuuauccaucuuugagccucc

SEQ ID NO: 172538 - RNA, 39 nt, Homo sapiens
uagaagaagggaugacucaaacaucaucuguaccccaag

SEQ ID NO: 172539 - RNA, 47 nt, Homo sapiens
uguuucaggucugcauaaaaaauuuaaguaugaguauuucugauaca

SEQ ID NO: 172540 - RNA, 30 nt, Homo sapiens
uaaacuagaugucaaugaaaaaucaucugu

SEQ ID NO: 172541 - RNA, 93 nt, Homo sapiens
ugguguguguguuaaugcauguguauaguuaagguugggaacaggagauugcauagcaguucacauccugacuagcaaaggauuauaggaaaa

SEQ ID NO: 172542 - RNA, 126 nt, Homo sapiens
accagccuuuuuuguuauuguugagcuucugcccuagucuaacagugagaaacacucacaggacacaccuugcccuuaaaaagcaauguaggaaaauauuugauuuuaaaaaucaagcagcaguca

SEQ ID NO: 172543 - RNA, 104 nt, Homo sapiens
aaugcgcaaguuauauugcuacaaaauuagcauaaauucugaggaauuacuuuuauuuguuggcucucuuuuguuuuuuucaagaauaccaaagagacauuaag

SEQ ID NO: 172544 - RNA, 60 nt, Homo sapiens
ugaauaauguauauaaaguucucaauauaguaucaggcccauaagaguaauuauuauacg

SEQ ID NO: 172545 - RNA, 46 nt, Homo sapiens
aaagcugaaacuuuauagaaauaaaaguuauuaucaaaguagggca

SEQ ID NO: 172546 - RNA, 370 nt, Homo sapiens
cugaaaaacuuagaauuaauaauaagaguuuaggccaggcgugguggcucacgccuguaaucccagcacuuugggaggccgagauggguggaucacaaggucaggagaucgagaccauccuugcuaacacagugaaaccccaucucuacuaaaaauacaaaaaauuagcugugcgugguggugggcacuuguagucccgcuacucggggggcugaggcaggaaaauagcaugaacccaggaggcggagguugcagugagcugagaucgcgccacugcacuccugccugggcaauagagugagacucugucucaaaaaauauauauauauacuaauaauaauaauaagaguuuauuaauaucacuggauag

SEQ ID NO: 172547 - RNA, 64 nt, Homo sapiens
acuggauaaaaaauaaguauguaaacuuuuuaaauguuaauaacauuuagauaacaaagggaga

SEQ ID NO: 172548 - RNA, 31 nt, Homo sapiens
aaaugaauaaaacuguauuuuuauucugaga

SEQ ID NO: 172549 - RNA, 46 nt, Homo sapiens
ggcucaaagaguccccagcuggccacaccuggcucaucucacccag

SEQ ID NO: 172550 - RNA, 46 nt, Homo sapiens
gauacagccucauguuuucaccagucacaucucuuacuacugcuag

SEQ ID NO: 172551 - RNA, 44 nt, Homo sapiens
ucaucuauugcauguuacuuugauuuguaauuaaaauggacacu

SEQ ID NO: 172552 - RNA, 67 nt, Homo sapiens
ccugaguguguggggagggcuggggaucugagucaguggggugaugggcuggagggcggccacucag

SEQ ID NO: 172553 - RNA, 44 nt, Homo sapiens
ggauaucaguagagugguuuucucacaaacccuacugcugugga

SEQ ID NO: 172554 - RNA, 47 nt, Homo sapiens
aaacugaaaaagguuuuauuccacuaguauauuagagauuuucuugg

SEQ ID NO: 172555 - RNA, 42 nt, Homo sapiens
aguggagauggacaucagacccucgugagaaacucagaccag

SEQ ID NO: 172556 - RNA, 83 nt, Homo sapiens
uauuuuauuucagaaacacuucugaaauuuauugggcacauuuaagcauaaauuuaagcauaugccaaauucugugcuggaug

SEQ ID NO: 172557 - RNA, 36 nt, Homo sapiens
ucugcugucaggaaagaaugagcaagcauuagggag

SEQ ID NO: 172558 - RNA, 46 nt, Homo sapiens
gguaucccugcuggaguaccgaaaacggaaacaagaagcuaaggaa

SEQ ID NO: 172559 - RNA, 45 nt, Homo sapiens
ccaucagauuccagaggcacuucuucaucucacugcagaccucaa

SEQ ID NO: 172560 - RNA, 47 nt, Homo sapiens
ggguggcccaaaagggagagcccucucccacaugggagaguaacauc

SEQ ID NO: 172561 - RNA, 47 nt, Homo sapiens
cuagguuccagcccacuuaugcucauuugggcuaccacauuuguaag

SEQ ID NO: 172562 - RNA, 42 nt, Homo sapiens
aaaggagcaacaguuuacagcccuuccagauacagcuaccag

SEQ ID NO: 172563 - RNA, 25 nt, Homo sapiens
agacauuuuacugccuuugguuucc

SEQ ID NO: 172564 - RNA, 42 nt, Homo sapiens
cucucacgguucuucagaaucaucccucucuuccacguccua

SEQ ID NO: 172565 - RNA, 46 nt, Homo sapiens
aguuccaccuccuuuccucagaacucuaggucgucauugccaucag

SEQ ID NO: 172566 - RNA, 44 nt, Homo sapiens
cccauagcugcuuccuuccagcugccucuggaaccuaggccgag

SEQ ID NO: 172567 - RNA, 63 nt, Homo sapiens
agaaacaagacuuguggucacaauuggccucuggccuuggagaaagcuguaaaucuugucuga

SEQ ID NO: 172568 - RNA, 59 nt, Homo sapiens
ucuuuuuaaauuuaaaaaaaaaaaaaaaaaaaguuuucaaaggaaaaaaaguuaaaaga

SEQ ID NO: 172569 - RNA, 42 nt, Homo sapiens
augcuucgaauuuuauuuuuucuacucccaauuaaucaggag

SEQ ID NO: 172570 - RNA, 46 nt, Homo sapiens
agaguuaccaagccacccacaccccuaacacuguucuggaugagag

SEQ ID NO: 172571 - RNA, 49 nt, Homo sapiens
cuugcauccccuucuuuucuacccuguccuacaacuaucauaugcacag

SEQ ID NO: 172572 - RNA, 43 nt, Homo sapiens
cagaguacuuuucuuuuuguuguuucccccacaaacccaucag

SEQ ID NO: 172573 - RNA, 45 nt, Homo sapiens; identical to SEQ ID NO: 95616

SEQ ID NO: 172574 - RNA, 48 nt, Homo sapiens
gggugaaaaaauaaaaguuggggaaugauuacaguaaaaagauaacgg

SEQ ID NO: 172575 - RNA, 46 nt, Homo sapiens
cagcgcugggaccagagcacugcggggaggcuuugcccgggaggag

SEQ ID NO: 172576 - RNA, 46 nt, Homo sapiens
ucccugagagcaggaauugcauuuuauagaccuaagauccuuggag

SEQ ID NO: 172577 - RNA, 46 nt, Homo sapiens
ggagacugguguuggaggacuagcagaggggcugaauuuagggagc

SEQ ID NO: 172578 - RNA, 41 nt, Homo sapiens
aggaacgaaagaccggggccggugagcagcggggcccgcga

SEQ ID NO: 172579 - RNA, 41 nt, Homo sapiens
ugacaguggagcuggagcagcccacuugccugguuaaggca

SEQ ID NO: 172580 - RNA, 48 nt, Homo sapiens
uaaaacugcccaaguuuuggaaacgauuuacuuuuuauauaaauugag

SEQ ID NO: 172581 - RNA, 51 nt, Homo sapiens
accauccaugagucauacccuuguucaaagauagggagguugcagucaccu

SEQ ID NO: 172582 - RNA, 53 nt, Homo sapiens
guagaguaugacauggacgaggaggacuacaucuggcuggauaucaugaauga

SEQ ID NO: 172583 - RNA, 47 nt, Homo sapiens
agucccaucccgcaggagaucuuugaguaccuaauggaccgacugga

SEQ ID NO: 172584 - RNA, 42 nt, Homo sapiens
ugaagcggcagucacggaauggggucccauugcuacgucgcc

SEQ ID NO: 172585 - RNA, 39 nt, Homo sapiens
agagggcuuagacucuuuccuccuuuaagcuagcccuca

SEQ ID NO: 172586 - RNA, 46 nt, Homo sapiens
cgugagcaggguggugcugugcuccgccaggcccggcgccaggcag

SEQ ID NO: 172587 - RNA, 45 nt, Homo sapiens
cacagccuggcuggagaugaggccacacaccacacugaagauggu

SEQ ID NO: 172588 - RNA, 49 nt, Homo sapiens
ucuuacaguugggaaaacugaggcccagagacacuacgacccagcuaaa

SEQ ID NO: 172589 - RNA, 34 nt, Homo sapiens
ggggccccuaccggucgugaggugagugggcauc

SEQ ID NO: 172590 - RNA, 29 nt, Homo sapiens
ccuuaagggucgugguccuugucugggcg

SEQ ID NO: 172591 - RNA, 30 nt, Homo sapiens
cacugggguuccguggacucccacuuccaa

SEQ ID NO: 172592 - RNA, 47 nt, Homo sapiens
ucagaugcaacacauauaugcugcuauauauaugcagcaauuuccag

SEQ ID NO: 172593 - RNA, 46 nt, Homo sapiens
gccccaggcugugcccguggauguccauauguggcacauugcccaa

SEQ ID NO: 172594 - RNA, 46 nt, Homo sapiens; identical to SEQ ID NO: 95658

SEQ ID NO: 172595 - RNA, 46 nt, Homo sapiens
ugcgugggagggcuugggggcagccugcuccccuucccucccugaa

SEQ ID NO: 172596 - RNA, 46 nt, Homo sapiens
auacagcucuagauaagaauauccaccagucggugagugagcagau

SEQ ID NO: 172597 - RNA, 49 nt, Homo sapiens
uggaggugaugaccgaguggugagggagccagacauuggaggugugggg

SEQ ID NO: 172598 - RNA, 23 nt, Homo sapiens
cuuccaccaaucaauuaccagua

SEQ ID NO: 172599 - RNA, 44 nt, Homo sapiens
gccaaggaggcccuggagggcaaggaaggcagcauggagaauga

SEQ ID NO: 172600 - RNA, 100 nt, Homo sapiens
ggucaugugaccaucucuggagccaggggauggaugagugacuaggggagggucauccacguccuugguccagcaguggucacagaacccauagggaaug

SEQ ID NO: 172601 - RNA, 25 nt, Homo sapiens
uggagcuuaaaaucacaggcugggg

SEQ ID NO: 172602 - RNA, 47 nt, Homo sapiens
uagggccuaaacuguccccagcuuuucacuucuggaugacagugggu

SEQ ID NO: 172603 - RNA, 45 nt, Homo sapiens
cccaggcugcuggaaaccugauuucggagaggccggggagucggg

SEQ ID NO: 172604 - RNA, 31 nt, Homo sapiens
ggaggguguaggguacgucugguauaugagg

SEQ ID NO: 172605 - RNA, 38 nt, Homo sapiens
ccuucagcugggccugacuggaagggcgugggcauuug

SEQ ID NO: 172606 - RNA, 41 nt, Homo sapiens
gcagaagaagcggacucccaccaagaaagaaaaggaccagg

SEQ ID NO: 172607 - RNA, 46 nt, Homo sapiens
aagaaucaggggcugacggggcaagcaccuccccucgcaaucagaa

SEQ ID NO: 172608 - RNA, 57 nt, Homo sapiens
gaaugaucaaagcaauuugggauugguaugggaaggcuucccacgguaggugggaug

SEQ ID NO: 172609 - RNA, 30 nt, Homo sapiens
gggcccgggcagcggcuguggcugacaaga

SEQ ID NO: 172610 - RNA, 46 nt, Homo sapiens
cagcgaggagguccgcacacuugaggaguuacugaagcccccagaa

SEQ ID NO: 172611 - RNA, 42 nt, Homo sapiens
cuuggagcuccccccaaacaugggaagcccaagaagcagaaa

SEQ ID NO: 172612 - RNA, 46 nt, Homo sapiens
ggccagggacaccccuguugagcuccuggcaccacugcccccuuau

SEQ ID NO: 172613 - RNA, 46 nt, Homo sapiens
guggugccaggagcucaacaggggugucccuggcccuggugccugg

SEQ ID NO: 172614 - RNA, 45 nt, Homo sapiens
ccuccucagacgccuccaccugacccccucccaggcugcccagcu

SEQ ID NO: 172615 - RNA, 48 nt, Homo sapiens
aagcacuaaguacucagggacccaggcuguugauacccagccagauga

SEQ ID NO: 172616 - RNA, 45 nt, Homo sapiens
uuggggcuuguuguucucagcuggcagcagaaaucgcuggcccag

SEQ ID NO: 172617 - RNA, 42 nt, Homo sapiens
ccagcgauuucugcugccagcugagaacaacaagccccaaag

SEQ ID NO: 172618 - RNA, 46 nt, Homo sapiens
ccccaagcacagggcagagcuguaguaccaugugcaccuguaguug

SEQ ID NO: 172619 - RNA, 58 nt, Homo sapiens
aucauauguuucagugaggucaguacuauggccccugcauccagagagggacacauaa

SEQ ID NO: 172620 - RNA, 41 nt, Homo sapiens
gcccugaaacuggaacacauugauggggucaaucucgugag

SEQ ID NO: 172621 - RNA, 45 nt, Homo sapiens
caauguguuccaguuucagggcagccuggaucuuccccucagaag

SEQ ID NO: 172622 - RNA, 44 nt, Homo sapiens
gcgacuagcugucuggggacagcuggagaggaguacaagcccag

SEQ ID NO: 172623 - RNA, 40 nt, Homo sapiens
gcccuagggacuggcucagcucuggcagcacugagaacaa

SEQ ID NO: 172624 - RNA, 48 nt, Homo sapiens
ccacagggucuaccagugacagguaugggccggggaugugggaaggga

SEQ ID NO: 172625 - RNA, 42 nt, Homo sapiens
ggggcgcaaauagggucagugggccgcuuggcggugucguug

SEQ ID NO: 172626 - RNA, 24 nt, Homo sapiens
ggcagcgacuuucagcaccgggag

SEQ ID NO: 172627 - RNA, 46 nt, Homo sapiens
cuacagcaagaagcuccuagacucuugguucaccagcacacaggag

SEQ ID NO: 172628 - RNA, 45 nt, Homo sapiens
acagcuaugaaacaaauuucagcuguuugaaguugaacuuugagg

SEQ ID NO: 172629 - RNA, 49 nt, Homo sapiens
ugagguggggcccuucuuccaccagcucaccugcagacacuggccugac

SEQ ID NO: 172630 - RNA, 46 nt, Homo sapiens
gccgggaagcgcucaccuuucgcgugauccuuuuugagaaggagga

SEQ ID NO: 172631 - RNA, 44 nt, Homo sapiens
agaauuagggagaagagaucagauuccaaguacugaaggagagg

SEQ ID NO: 172632 - RNA, 49 nt, Homo sapiens
guacuuggaaucugaucucuucucccuaauucugcggauccggccccua

SEQ ID NO: 172633 - RNA, 50 nt, Homo sapiens
gauagagggcguggagaggcuucacugaaggagucaggccccacgcgaga

SEQ ID NO: 172634 - RNA, 45 nt, Homo sapiens
agacccgccugguagaggugcuggagggugugugcagcaagucag

SEQ ID NO: 172635 - RNA, 44 nt, Homo sapiens
gguccggggccuccugcugccugaggcaggggcaggguggaggg

SEQ ID NO: 172636 - RNA, 46 nt, Homo sapiens
ggccacacuggccacaggccucacccccguagccggcuuggcaguc

SEQ ID NO: 172637 - RNA, 44 nt, Homo sapiens
uacgggggugaggccuguggccaguguggccuuggcuacuuuga

SEQ ID NO: 172638 - RNA, 45 nt, Homo sapiens
agaaguguagcccuggcuaucagcaggugggcuccaagugucucg

SEQ ID NO: 172639 - RNA, 63 nt, Homo sapiens
ucagaguccugcuagggccccccacccagcacccugacuccaucuuguccaucucucaacacu

SEQ ID NO: 172640 - RNA, 52 nt, Homo sapiens
ccccucccuccccucaagauguggaugagugugagacagagguguguccggg

SEQ ID NO: 172641 - RNA, 67 nt, Homo sapiens
gccccuuccccagguagcaguggcagcuccaggcccugccccaucccuacugccacccagcccccug

SEQ ID NO: 172642 - RNA, 48 nt, Homo sapiens
ucuucaccuggcggggacuggcaggcuucacaaugugugaauuucaaa

SEQ ID NO: 172643 - RNA, 73 nt, Homo sapiens
gcugcaugcugccaguuccuguucuguguucaccacauccccacaccccauugccacuuauuuauucaucuca

SEQ ID NO: 172644 - RNA, 62 nt, Homo sapiens
guuguguacuguccaggucuucacauuugucaccucauuuaauucucauguuaagccugagu

SEQ ID NO: 172645 - RNA, 41 nt, Homo sapiens
gccguaagcagcaaggggaagggcagguuguagagcaccag

SEQ ID NO: 172646 - RNA, 45 nt, Homo sapiens
cccacccuguccuuccagcacuggccucuugacaguaccugagug

SEQ ID NO: 172647 - RNA, 41 nt, Homo sapiens
ucccugcagcaugaaggccaagagggacaguggccaccuag

SEQ ID NO: 172648 - RNA, 36 nt, Homo sapiens
gggcgucucagcgcaccccuacucccaacccuggag

SEQ ID NO: 172649 - RNA, 42 nt, Homo sapiens
caggugaggagcuggcccagggagggggcgauggcgggaccc

SEQ ID NO: 172650 - RNA, 47 nt, Homo sapiens
uccuacuuucagaggggcguuguugagcugguaagaagcaaacagag

SEQ ID NO: 172651 - RNA, 47 nt, Homo sapiens
uuucauuugugugugaauuuuuaauauaaaugcggagacguaaagca

SEQ ID NO: 172652 - RNA, 46 nt, Homo sapiens
guuaacuuucuuuacacaaguaaaccauuuccacuaccaaagguuu

SEQ ID NO: 172653 - RNA, 45 nt, Homo sapiens
cagugggcacuagaugaugucgaagaagagcucauggccaaagac

SEQ ID NO: 172654 - RNA, 46 nt, Homo sapiens
gaugcaggagcagaugacgggagcagccauggccaugcccgcagac

SEQ ID NO: 172655 - RNA, 46 nt, Homo sapiens
uucggagcauuuacucucugauucugggccaagauaaugguaagaa

SEQ ID NO: 172656 - RNA, 87 nt, Homo sapiens
uugugcuuuggaugaauauagcccauccaaggugacuucuuuacaaacacugaacaacuuugggugguagggaagugggaacugcau

SEQ ID NO: 172657 - RNA, 348 nt, Homo sapiens
ccuucuuguaaguauggaacacacccaguggcucacgccuguaaucccagcacuuugggaggcugaggugggcggaucacuugaggucaggaguucgagaccagcuuggccaacauggugagaccccaucucuaauaaaaauauaaaaauuagccaggcaugguggugugugccuguagucccagcuacucaggagguugaggcaggagaaucucuugaacccagguggcagagguugcagugagccaagauugcgccacugcacuccagccuggguaacagggugagacuccgucucaaaaaaaaaaaaaguauggaacacaccaacacuugugauuuccucuaggg

SEQ ID NO: 172658 - RNA, 54 nt, Homo sapiens
uuuuauggagguugaguaggaaaccuaagcuaaaggaagccucagugauauagu

SEQ ID NO: 172659 - RNA, 55 nt, Homo sapiens
uacaugagucuagcaaaaggaaagaaugugucaccucuuuucuaucacaauuggg

SEQ ID NO: 172660 - RNA, 46 nt, Homo sapiens
cccauuuccacugacccuccguuuuaagccuauguuacagcaagga

SEQ ID NO: 172661 - RNA, 40 nt, Homo sapiens
guaaucuuagaccuuagaaaucaucugauacagggaucua

SEQ ID NO: 172662 - RNA, 46 nt, Homo sapiens
ucuuucuugacacgaaaauauuauuucaacaacccagaggauggau

SEQ ID NO: 172663 - RNA, 48 nt, Homo sapiens
aauucgaagcagaguccucagggaaaauggaaaauacauucccaaaca

SEQ ID NO: 172664 - RNA, 47 nt, Homo sapiens
gagaaagugucuuccuagcuuauuaucaaauaagaaaaagcugagug

SEQ ID NO: 172665 - RNA, 57 nt, Homo sapiens
uaauaguugauuuaagaucaccuaguaauuucauuuauuuauucaauaaauguuuac

SEQ ID NO: 172666 - RNA, 55 nt, Homo sapiens
uagaaguucaagaaauauuuguucaaugaaagaauaaaucuacccuuguacagaa

SEQ ID NO: 172667 - RNA, 71 nt, Homo sapiens
cguaggcaugauccgccacuacguguccauccugcugcagagcgacaagaagcucacccaggaacaaguau

SEQ ID NO: 172668 - RNA, 45 nt, Homo sapiens
ucuuugucugaguauuggugcuauagaugaugaaaagcaucacca

SEQ ID NO: 172669 - RNA, 41 nt, Homo sapiens
agguuggcaaauucaucauaguaaagugcagaggccugagg

SEQ ID NO: 172670 - RNA, 56 nt, Homo sapiens
uggcaaggaacuuaauggaugcuccauuaagaaaauaaauauaaugagcugaauug

SEQ ID NO: 172671 - RNA, 46 nt, Homo sapiens
uuccguuaugcugucucuccacacaaagucucaguaaccggaaaua

SEQ ID NO: 172672 - RNA, 45 nt, Homo sapiens
uuucugauuuuugcugaaauagcaguaacaguaugagguguuaua

SEQ ID NO: 172673 - RNA, 45 nt, Homo sapiens
acaaguccacaauguagaauagagaagaccucaauguccagcucu

SEQ ID NO: 172674 - RNA, 69 nt, Homo sapiens
auguuauuuauaacagaaaauaaaaucaacaggauuuggcaaucagaugugggaaaaagacgguggaga

SEQ ID NO: 172675 - RNA, 46 nt, Homo sapiens
aacaaguaauuauaauaaaaugagauuaaguuuuaucacgaacgga

SEQ ID NO: 172676 - RNA, 57 nt, Homo sapiens
gauggguagggggacaaaggaagaagacgacucagggagagcaggccccaaggaaga

SEQ ID NO: 172677 - RNA, 46 nt, Homo sapiens
gcaguagcacaauaaaaucaagcuaaaaggaagaccacugucagau

SEQ ID NO: 172678 - RNA, 52 nt, Homo sapiens
ucaccaggacugggcuaaccgggaguacauugagauaaucaccagcagcauc

SEQ ID NO: 172679 - RNA, 43 nt, Homo sapiens
cguucggucagcgggccagcaaggggaggcggggaggagggag

SEQ ID NO: 172680 - RNA, 44 nt, Homo sapiens
uccuccuucaggucccaccuucucccucccgcccugacccucag

SEQ ID NO: 172681 - RNA, 68 nt, Homo sapiens
cauccucgcuccgugguucuucuccuaaguggucucccugccuccuuuguacucugcauccauuccgg

SEQ ID NO: 172682 - RNA, 48 nt, Homo sapiens
uaguuggacccguugucaaccacucccgucuuguccauuccuuccugu

SEQ ID NO: 172683 - RNA, 60 nt, Homo sapiens
cuugaaggagauaggcaggcaagaugaguaagauuuggacauaauaagaugaaaguugag

SEQ ID NO: 172684 - RNA, 46 nt, Homo sapiens
ugucguucaagacuugcaacacuaaacgagaaauugacagcccuug

SEQ ID NO: 172685 - RNA, 45 nt, Homo sapiens
gaacagugccgugcugcugcugggaaguugcuuuacacaacacag

SEQ ID NO: 172686 - RNA, 46 nt, Homo sapiens
accguuggaaacgacguuaggcauuuuaccuuuucaguaacauuuu

SEQ ID NO: 172687 - RNA, 50 nt, Homo sapiens
aggagcuagagauggguucacuuauugcacagaaauguaauacauggcgu

SEQ ID NO: 172688 - RNA, 23 nt, Homo sapiens
ggagacucagcuuauuguaaagg

SEQ ID NO: 172689 - RNA, 42 nt, Homo sapiens
guggaccuccugugccgccuggagcucuaccgggcugcccag

SEQ ID NO: 172690 - RNA, 35 nt, Homo sapiens
gaagcaccuuugggguuucccaaguugauguaaaa

SEQ ID NO: 172691 - RNA, 46 nt, Homo sapiens
ggaggaaggugacuuguuggaggucacacagcugguuggguggaag

SEQ ID NO: 172692 - RNA, 23 nt, Homo sapiens
uggggccaggcccuuagggguca

SEQ ID NO: 172693 - RNA, 29 nt, Homo sapiens
gaugcuggccacuuagaccugagucagcc

SEQ ID NO: 172694 - RNA, 49 nt, Homo sapiens
gaagcucagcagggcuaguccaggcuccuucuccuuuaagaaccagggg

SEQ ID NO: 172695 - RNA, 48 nt, Homo sapiens
cuacugugaagauuuaucucaagaaguaacaugugaccugggccuuga

SEQ ID NO: 172696 - RNA, 46 nt, Homo sapiens
ggagugggcuuucugaggguacaggcucuucuuccaacaccccaga

SEQ ID NO: 172697 - RNA, 44 nt, Homo sapiens
agccuugaugccuccuccuccaugaguguggcacccugggcagg

SEQ ID NO: 172698 - RNA, 47 nt, Homo sapiens
gggaguaugugaugauaaucacccccagcagauuccauuaccucagc

SEQ ID NO: 172699 - RNA, 66 nt, Homo sapiens
uguuccgaaucaggcagccuuuggaggcggccccgcccacaccagggcccaagaaauguggggaga

SEQ ID NO: 172700 - RNA, 48 nt, Homo sapiens
cuagagaagccauuucuuccaaagaggcguuggcaggacgcagagggg

SEQ ID NO: 172701 - RNA, 45 nt, Homo sapiens
uccaacggggcugcacguuuacaauaaccuggggagcacugaaaa

SEQ ID NO: 172702 - RNA, 47 nt, Homo sapiens
uaucauucugacccucagcuucagcugcaaauucagaguuuguggag

SEQ ID NO: 172703 - RNA, 42 nt, Homo sapiens
cugggaugcucugcugcgcuugguuuugcccgaguggcagcc

SEQ ID NO: 172704 - RNA, 42 nt, Homo sapiens
acuguacaaaugaggaggguacaugacauagucgguggugaa

SEQ ID NO: 172705 - RNA, 39 nt, Homo sapiens
gagccggccaggcaucaccuccugagucuucuggcuggg

SEQ ID NO: 172706 - RNA, 48 nt, Homo sapiens
agcaagaaaaagaaggaagaggaggaagaugaggaagaugaagaggau

SEQ ID NO: 172707 - RNA, 36 nt, Homo sapiens
uaagucucauacacucuucuuuuccucuuuggggca

SEQ ID NO: 172708 - RNA, 39 nt, Homo sapiens
acaggacccaccucauggcagugaugugaggaccugaga

SEQ ID NO: 172709 - RNA, 46 nt, Homo sapiens
aaaguguuaagggggagcguggcagaaggaugaggcagcagccacg

SEQ ID NO: 172710 - RNA, 25 nt, Homo sapiens
guuguuggguggcagccagagcccu

SEQ ID NO: 172711 - RNA, 31 nt, Homo sapiens
gcauauuaaccuguuucuuugcaccaacuaa

SEQ ID NO: 172712 - RNA, 45 nt, Homo sapiens
aaucugucccguacuugagucccacuuugggcacccagcccuugc

SEQ ID NO: 172713 - RNA, 51 nt, Homo sapiens
acauuucuaaaagcgugggcuucagaauucaaagugcagcuuugcaaguua

SEQ ID NO: 172714 - RNA, 24 nt, Homo sapiens
caugguaaaauggagggccuuucc

SEQ ID NO: 172715 - RNA, 45 nt, Homo sapiens
aaagggcggucuauauaaugaugauacuguucccaccuuuagaac

SEQ ID NO: 172716 - RNA, 82 nt, Homo sapiens
ugcgcaaguggauguugaugguaguacaaaaagcaggggcccagccccagcuguuggcuacaugaguauuuagaggaaguaa

SEQ ID NO: 172717 - RNA, 51 nt, Homo sapiens
gaggagaagccagcaggcaccacuuuucugcucccuuucuccagaggcaga

SEQ ID NO: 172718 - RNA, 48 nt, Homo sapiens
ugaggauaucaaugcuugcacgcugaccacguccccgaggcugccugu

SEQ ID NO: 172719 - RNA, 52 nt, Homo sapiens
cugguagcugacugugugaagaaaguaaaggaagagaggccucuuuuucccc

SEQ ID NO: 172720 - RNA, 57 nt, Homo sapiens
aacagaagggaggcuuucuaucacaaguggcucucggugccaggggauaucuuuuua

SEQ ID NO: 172721 - RNA, 48 nt, Homo sapiens
caaaggacaaccuggcaauugugacccaguggugcgagggcagcagcc

SEQ ID NO: 172722 - RNA, 96 nt, Homo sapiens
uucagauuacaauaaagcaaaaaucacagagucccuuggugccuauacuacuuuggaugacacuggaauuaucuuuagagauaaaugugcaaagau

SEQ ID NO: 172723 - RNA, 46 nt, Homo sapiens
uuucucuguuagguuuuuaaugccucuggcuuuaggacuuugggaa

SEQ ID NO: 172724 - RNA, 47 nt, Homo sapiens
aaagcuggaaaucuccugaaguaacuucucuuuguccugcccuagga

SEQ ID NO: 172725 - RNA, 43 nt, Homo sapiens
uucuagaaacuuuaagcuggaaaggaccuuagagauugaaaug

SEQ ID NO: 172726 - RNA, 49 nt, Homo sapiens
ucggauugggucaggcucuuuuggaacuguuuauaaggguaaauggcac

SEQ ID NO: 172727 - RNA, 46 nt, Homo sapiens
uuaccauaacauuaaggaaaauauucugcuacauaggaauauaauu

SEQ ID NO: 172728 - RNA, 63 nt, Homo sapiens
cugucagacagcagacuaccaaaaaugaaauaguugcuaaguuaaauuuauauuucuugucac

SEQ ID NO: 172729 - RNA, 45 nt, Homo sapiens
cuuuggacuagaauaacaaccugagugcuucucccagggcguggu

SEQ ID NO: 172730 - RNA, 39 nt, Homo sapiens
ggugguaaugucagucaauuaauggggugagguugauac

SEQ ID NO: 172731 - RNA, 53 nt, Homo sapiens
uuaaaauuguuugaauauaaaaucuugaaagauucuuguuucuuucaggagac

SEQ ID NO: 172732 - RNA, 46 nt, Homo sapiens
uacuguugaugcagaugaugugcgauuggcaauccagugccgcgcu

SEQ ID NO: 172733 - RNA, 44 nt, Homo sapiens
gcaagacggcuucucccaagagcaugccgaaagaugcacagaug

SEQ ID NO: 172734 - RNA, 48 nt, Homo sapiens
aauaacaaaucugauguaccccuuacccacuuucaacacuuagcuaac

SEQ ID NO: 172735 - RNA, 37 nt, Homo sapiens
gaaaagauuauuuuuguauauuucauaggcccaggac

SEQ ID NO: 172736 - RNA, 41 nt, Homo sapiens
cuacaauaguucagcaguuuggcuaucagcgccgggcauca

SEQ ID NO: 172737 - RNA, 51 nt, Homo sapiens
uacaauuauuuguguuucuuaccagguuuaagaauuguuuaagcugcauca

SEQ ID NO: 172738 - RNA, 69 nt, Homo sapiens
cauauucgaggguuuccuaaaaagccugauauuccuuugcaaccucuuuauuuuuuuaaaagauaagau

SEQ ID NO: 172739 - RNA, 33 nt, Homo sapiens
aggauauacuuaaaggggcuaacuuugaaaaua

SEQ ID NO: 172740 - RNA, 23 nt, Homo sapiens
cauauuugcucagcagaaacuuu

SEQ ID NO: 172741 - RNA, 41 nt, Homo sapiens
guuuaauaaguguauuuuauaaacuauuuauuuguauugac

SEQ ID NO: 172742 - RNA, 49 nt, Homo sapiens
ucauucuugcugauaauuuucucccuuuguugauguugaagcugauagu

SEQ ID NO: 172743 - RNA, 54 nt, Homo sapiens
uucugagucgaguuuugaaacaccugugaguaagugcucaucgggugaggagga

SEQ ID NO: 172744 - RNA, 34 nt, Homo sapiens
uguauccuugagaugugaacggguucuagggggu

SEQ ID NO: 172745 - RNA, 41 nt, Homo sapiens
gggccccgaaaagggucagcuggccgggcuuuggggcgcgu

SEQ ID NO: 172746 - RNA, 46 nt, Homo sapiens
uccuucuuucccccucucacagcaucacagaaccacaggaauagag

SEQ ID NO: 172747 - RNA, 49 nt, Homo sapiens
auaggucaucgaccaguccaccccugguaacagggcacugugggcugca

SEQ ID NO: 172748 - RNA, 32 nt, Homo sapiens
cagaggagcccccaguccagcugggagugagg

SEQ ID NO: 172749 - RNA, 55 nt, Homo sapiens
caaacaaaugaaaccuaggagaggggguuggguaggacauagaaauaagggaggg

SEQ ID NO: 172750 - RNA, 29 nt, Homo sapiens
uaaaccccaguuuucucaucucuauaaug

SEQ ID NO: 172751 - RNA, 53 nt, Homo sapiens
uaggugcuucaguccagcucaggcacuuguagguaccccagccuugcuuccag

SEQ ID NO: 172752 - RNA, 41 nt, Homo sapiens
gcucacugcgccuguuuaugagcaggcuguggauggugggc

SEQ ID NO: 172753 - RNA, 45 nt, Homo sapiens
cggucaaguuccuuaucucggaccagccccaucccauugaccccc

SEQ ID NO: 172754 - RNA, 24 nt, Homo sapiens
ucagcuauaaaaugggggugcugg

SEQ ID NO: 172755 - RNA, 42 nt, Homo sapiens
ccucuuugaaagcauccagaaggauuccgcuucagcccccag

SEQ ID NO: 172756 - RNA, 59 nt, Homo sapiens
gacgaaaacgagguggggccagcaggcgcucggcagggcgggcucgcucuuaacacgug

SEQ ID NO: 172757 - RNA, 63 nt, Homo sapiens
aaaaucaugaaaaauuaagucuaucuuaaacucugcagcuuucaagcucaucuguuaugcaua

SEQ ID NO: 172758 - RNA, 57 nt, Homo sapiens
aguauccaauugagcuucaugggauugguaaauauggcaacgacucuuaccgaauuu

SEQ ID NO: 172759 - RNA, 86 nt, Homo sapiens
auuaggggaagaagucagugaagcagaaagcccaguucuugaccucaaggacaugacuucugucuuguuagcacagcacaaaagag

SEQ ID NO: 172760 - RNA, 42 nt, Homo sapiens
cuggaugacauccaacagaccuuuuagaauaaagagguagau

SEQ ID NO: 172761 - RNA, 58 nt, Homo sapiens
auugcuuuaagcuaaaccauagacuccauaaaguguuuacuuuuccuuuucagaagau

SEQ ID NO: 172762 - RNA, 45 nt, Homo sapiens
cuuagcuucucugugccucaauguccuuaucuguaaaguggagau

SEQ ID NO: 172763 - RNA, 45 nt, Homo sapiens
aacgagaaguaugaggauaccuuuuuagaaucugaagaaaucgga

SEQ ID NO: 172764 - RNA, 42 nt, Homo sapiens
uaucuucacaaaaauggagagacuucucuuaagccagaagau

SEQ ID NO: 172765 - RNA, 46 nt, Homo sapiens
gaagacagcaggaagauuugauguguacuuuaucagguaagcauau

SEQ ID NO: 172766 - RNA, 45 nt, Homo sapiens
uggugcuacugcaggaacagaaugccguaagucugucccaugugg

SEQ ID NO: 172767 - RNA, 46 nt, Homo sapiens
auggaauuggaaagagugggagaagaugaggaacaaaugaugauaa

SEQ ID NO: 172768 - RNA, 34 nt, Homo sapiens
aauacucccauagcacaagacugguccacacuga

SEQ ID NO: 172769 - RNA, 90 nt, Homo sapiens
cuccaccagaaugaaaucuugaacuugaagcaggaacuggcaagcauggaagaaaaaaucgcguaucaguccuaugaacgggcccgggac

SEQ ID NO: 172770 - RNA, 88 nt, Homo sapiens
gcagagucacagagaacuuugacccuaguuauccaucaaaaguaggacugcuuucucauuagccuguucagucacuucaauaacagga

SEQ ID NO: 172771 - RNA, 47 nt, Homo sapiens
aaaugaaguccaagcuuucuaaaguauuucaccuauuuauuuauaau

SEQ ID NO: 172772 - RNA, 44 nt, Homo sapiens
gaacauuaucagagggacuauuccuuaauaaugcagaccuuaca

SEQ ID NO: 172773 - RNA, 45 nt, Homo sapiens
uugggagugauuucaaacuuucagucuagcccaaaauaugguagu

SEQ ID NO: 172774 - RNA, 56 nt, Homo sapiens
uuugaagacguaguccucuugggcuucuaacauguaccucuuguuuuuacacuaga

SEQ ID NO: 172775 - RNA, 42 nt, Homo sapiens
uagagacaguauauacagcaggcauuuacaccaacuuuauca

SEQ ID NO: 172776 - RNA, 49 nt, Homo sapiens
aucucauucaacagagaauagauaucuaucacucuucuguagagaccuc

SEQ ID NO: 172777 - RNA, 30 nt, Homo sapiens
uagauuucacaauacucagaugauacccau

SEQ ID NO: 172778 - RNA, 37 nt, Homo sapiens
uagaaccaggucacagaauuugagagagcagcagagg

SEQ ID NO: 172779 - RNA, 45 nt, Homo sapiens
uucgaagaugccaggcaugcauaacaaauaggaauuugauuuaga

SEQ ID NO: 172780 - RNA, 23 nt, Homo sapiens
guguuugggauucaaaguauuuu

SEQ ID NO: 172781 - RNA, 25 nt, Homo sapiens
aagggaccuguuccuuacuagacua

SEQ ID NO: 172782 - RNA, 47 nt, Homo sapiens
ggacauugaaccuguuugguguaaaggaaacuaauaguggggaaaaa

SEQ ID NO: 172783 - RNA, 41 nt, Homo sapiens
cauaccauacuaacauuauauauuaaauauguaugauugga

SEQ ID NO: 172784 - RNA, 49 nt, Homo sapiens
uugugcugaugaggaaacugagauugggauuaaaaagguugcccaaugu

SEQ ID NO: 172785 - RNA, 51 nt, Homo sapiens
uauugagcugaauugauaacuguggaaguggaauggacaauagaagaacag

SEQ ID NO: 172786 - RNA, 47 nt, Homo sapiens
cucacaccagacacaaaagcuaccuucaaauaaaucauaggccuaac

SEQ ID NO: 172787 - RNA, 46 nt, Homo sapiens
cacucuuuucaacagaugguccuagaacaauuggagauucauacgc

SEQ ID NO: 172788 - RNA, 43 nt, Homo sapiens
auugggguuuugccaguuguuugaggaaaggaggccaaggaag

SEQ ID NO: 172789 - RNA, 48 nt, Homo sapiens
cuuucaacugcacaguguacuuucaacuauaaggguucagguauggaa

SEQ ID NO: 172790 - RNA, 24 nt, Homo sapiens
cuuugucuuuuuaucuugcuggaa

SEQ ID NO: 172791 - RNA, 378 nt, Homo sapiens
aguucaaguaccuaaaaggcagaaucugucaguugccuuccaacuuuccuuuggccaagauucagagaacagaauaaaacccucacaaacgcagaucuaccaacuggaaucguuccucacuaucugacuggcaagauauacagggggcacgcaauuuuaauuccaagagcagagaacucaagcucaguaggauccuuguugaacaccagcucccucuagcguucucuuaggccucucgccgcguucagggccugggaguuuucuugcaucacuuuccuccuucccucuugccgccuccccgccccccaaaccuucuccggauuauaggcguucacccauuuaccucugcggugagguacuccaggauggcugcgcugu

SEQ ID NO: 172792 - RNA, 38 nt, Homo sapiens
acacgggauuguaaauucuguugcuaaguuguguggau

SEQ ID NO: 172793 - RNA, 47 nt, Homo sapiens
uuauucuuugguaaaaguauccagucuauguagcauacucagccaga

SEQ ID NO: 172794 - RNA, 58 nt, Homo sapiens
caguauugauacauuaucacagagaccauacuuuaucagguuuccacagguuuuuucc

SEQ ID NO: 172795 - RNA, 25 nt, Homo sapiens
auuuaagucuucacuuuucagagcu

SEQ ID NO: 172796 - RNA, 47 nt, Homo sapiens
gguaguuuuacuagugucaugugacaaaacgaugcuuauagauggga

SEQ ID NO: 172797 - RNA, 27 nt, Homo sapiens
gagcugaggagaagauuaagaguguug

SEQ ID NO: 172798 - RNA, 50 nt, Homo sapiens
ugcccaacugucaaccuugacaaauuguggacuuuggucagugaacagac

SEQ ID NO: 172799 - RNA, 46 nt, Homo sapiens
cucacagcaaacuaucucuaggacccaugaaaucaagaaacaagug

SEQ ID NO: 172800 - RNA, 44 nt, Homo sapiens
aaaaggauuauuaaaguaagcgaucuccugagauuguuagauau

SEQ ID NO: 172801 - RNA, 45 nt, Homo sapiens
gaagaaguggaggagccaguacucaaggcugaggcagaaaaaaca

SEQ ID NO: 172802 - RNA, 78 nt, Homo sapiens
agcuugaggcuaggcuuuagagaacauucacaguauucuuuuggggcaguaucaguauauuggagacccauacugcau

SEQ ID NO: 172803 - RNA, 47 nt, Homo sapiens
ggacagugccuuugagcaacuugauaucaaagcaggaaacucagacu

SEQ ID NO: 172804 - RNA, 78 nt, Homo sapiens
ugcaccuugauacuuaaggugaccaguagucaguacaaagagacugagugucagagcuuuuucuccacuugacauaga

SEQ ID NO: 172805 - RNA, 60 nt, Homo sapiens
gaggaagaggaugaugauggcugugaccuuuuugcugacucugagaaggaggagaaagau

SEQ ID NO: 172806 - RNA, 54 nt, Homo sapiens
gaacuccuucggacggugggccuuuucccucaauucuguuauuuuaggaggcuu

SEQ ID NO: 172807 - RNA, 45 nt, Homo sapiens
aaguuuuaaucauacuuucuuccagcugaccuuagucaauuacau

SEQ ID NO: 172808 - RNA, 42 nt, Homo sapiens
aaucuucgggagggaagaauuuuuuauucuaugaauuuugug

SEQ ID NO: 172809 - RNA, 55 nt, Homo sapiens
ggcaaaguccaauccacugcugauaucuuuggugaugaagaaggagaucuguuca

SEQ ID NO: 172810 - RNA, 66 nt, Homo sapiens
aagaaaaagccguagcaucgccagaagccacggugagucagacagaugaaaauaaagcaagagcag

SEQ ID NO: 172811 - RNA, 45 nt, Homo sapiens
cuucucaaagugcgaguaacuuaaaaggugcgucucugcugccug

SEQ ID NO: 172812 - RNA, 57 nt, Homo sapiens
aagacauuuaauguaauauauuaauuuaaagaugaaucucuucaaaaugguuaggaa

SEQ ID NO: 172813 - RNA, 45 nt, Homo sapiens
ggcaccugcugugagaaccugugcgggaagcacccgcagccaugc

SEQ ID NO: 172814 - RNA, 78 nt, Homo sapiens
agagcacuguuugggugcaguccgagagcacuguuugggugcagcccaggagcacuguuugggugcaguccgggagca

SEQ ID NO: 172815 - RNA, 98 nt, Homo sapiens
cugucugggugcaguccgggagcacuguuuguguacagucagggagcacuguuugggugcagucugagaucacuguuugggugcaguccgggagcacu

SEQ ID NO: 172816 - RNA, 69 nt, Homo sapiens
guuugggugcaguccgggagcacuguuugggugcaguccaggagcacuguuugggugcaguccaggagc

SEQ ID NO: 172817 - RNA, 42 nt, Homo sapiens
ggagucauuaaaauuugggagaacugauguggcugagucaga

SEQ ID NO: 172818 - RNA, 74 nt, Homo sapiens
guucuuagcuuguuugaugaggaagaggauaaaauggaagaucaaaacauuauccaggcuccacagaaagaagu

SEQ ID NO: 172819 - RNA, 46 nt, Homo sapiens
aagccggaaacaccucagguuagaaauccucuuuaaggauuuucag

SEQ ID NO: 172820 - RNA, 48 nt, Homo sapiens
auucagacuugucugcauuaaggaggaaacagcaaccagggcuaccgc

SEQ ID NO: 172821 - RNA, 45 nt, Homo sapiens
uuaaaaccaaagaaccauccacucggaucgggaagauacaaguaa

SEQ ID NO: 172822 - RNA, 46 nt, Homo sapiens
gugaguuuugaucuuccagcucaggcagacaccuuacacagugcaa

SEQ ID NO: 172823 - RNA, 45 nt, Homo sapiens
ggcuggcugcucaggaguccagcgagacugaggacaugagcgucc

SEQ ID NO: 172824 - RNA, 43 nt, Homo sapiens
cugccgcugcaccuugggaaggugguccugugccuggagugga

SEQ ID NO: 172825 - RNA, 45 nt, Homo sapiens
ggcacuggaucucagucuguggagagaacaaaacccaaggcaaag

SEQ ID NO: 172826 - RNA, 46 nt, Homo sapiens
aaagagccccauguuuccugcucuaggugaggccagcagugaugau

SEQ ID NO: 172827 - RNA, 445 nt, Homo sapiens
uugaguuucacgaaccuggugaaauaauuuaucagaaaauagagaauccgcaguauuaucaaaguggauuguaguaauucacacucagaucuauaugagaaauacuaucucauauuaaucauacuucucaucucuuacagguuagcaaauauugucauuuaaauugcaaauccaacaauaacuuaaugugucagcauccucgucugcagacaagagcuuccucuaguuaaauagaaaaucaugacagaauauuagugcauauauuaguguacaacuaagacucuguguaaaaauuugcugagucaauacauacuagaaaauuuuaaauuguacuuuuugaacacuguaguuacagaagaaaaagcaaguauuuccuagaauuacauaacaguuuguuuuaagaauggcaaauuaccugaauauccaaacacuggaggacugagau

SEQ ID NO: 172828 - RNA, 46 nt, Homo sapiens
ccaacauuuugauagcacguguccuuaggcuucugcgacgaaucau

SEQ ID NO: 172829 - RNA, 51 nt, Homo sapiens
cauuccuucacugggagguugugauucuguuuuuacaauuucauucuggac

SEQ ID NO: 172830 - RNA, 61 nt, Homo sapiens
uaccgacuggggcugggcgccgccacugccuucaccuccucuuucaaccucagugauuggc

SEQ ID NO: 172831 - RNA, 27 nt, Homo sapiens
aagcgaaaaaaucagugaauaaaccau

SEQ ID NO: 172832 - RNA, 46 nt, Homo sapiens
aaauauauuuauagucgaacaauucauauauuugaaguggagccau

SEQ ID NO: 172833 - RNA, 48 nt, Homo sapiens
auuacuaggguugagucucuggggauuacauggggaaguuaggagaac

SEQ ID NO: 172834 - RNA, 44 nt, Homo sapiens; identical to SEQ ID NO: 96128

SEQ ID NO: 172835 - RNA, 63 nt, Homo sapiens
cguagguggccccaggugggacugcuggagguggcacaggggugggugcacagguggccagga

SEQ ID NO: 172836 - RNA, 32 nt, Homo sapiens
gacagagaaugaugagcagaacguggaggaug

SEQ ID NO: 172837 - RNA, 32 nt, Homo sapiens
cacacagccagucaacgagccucuggccccuu

SEQ ID NO: 172838 - RNA, 46 nt, Homo sapiens
ccugacucauucugaaggagccccauuccugggaaauauucccuag

SEQ ID NO: 172839 - RNA, 42 nt, Homo sapiens
uuguuucaauugcaucucccagauaaugugaaaaugguccag

SEQ ID NO: 172840 - RNA, 52 nt, Homo sapiens
gcgagugcgggaagccggugccggccuuccggggugggaggagaggcagccc

SEQ ID NO: 172841 - RNA, 52 nt, Homo sapiens
aggugggguucggggggccaccgaaucgcugucacgccggcagguagcaggg

SEQ ID NO: 172842 - RNA, 66 nt, Homo sapiens
uccugguguccagggcaaagggcugagccgggcaguagggccuagucggggccuggcucgccggga

SEQ ID NO: 172843 - RNA, 41 nt, Homo sapiens
gcuccgccccgugcucgcaggcggggguuuccauggugaug

SEQ ID NO: 172844 - RNA, 44 nt, Homo sapiens
ggugccugauaugagagcgggaguguagagacucggaggccgag

SEQ ID NO: 172845 - RNA, 331 nt, Homo sapiens
uuaguccggcccccuggcggggagcuggcgacugccggagggcucugaaagugagaacaggccuggcgcagugggaggcccagccgggaggaucucuugagcccaggaguucccgacaagccugggcaacauagacugucucuacugaaaaguaaagaaaaaaaaauuagccacgugugguggcgcgcgccuguugucccagcuacucgggaggcugaggcgggagggucgcuugcucugaggucgaggcugcagugacagugauugugccacugcauuccagccgggcgacggaaaugagaccuugucucaaaagaaguaauaauaguaa

SEQ ID NO: 172846 - RNA, 40 nt, Homo sapiens
ggacguaccuugguuuguacauuugaccauggacacacgu

SEQ ID NO: 172847 - RNA, 74 nt, Homo sapiens
gggaagggaagaggcgcucguaggucugcguccgucuccgagcgaccggggcggcggaaagggaccuggggggg

SEQ ID NO: 172848 - RNA, 90 nt, Homo sapiens
gguugagaacaaaaacaugcaccuggaguuuccccggagcccucugcgugguugagcuucgguggaauuucggggcucuuggcugccagc

SEQ ID NO: 172849 - RNA, 41 nt, Homo sapiens
aggaugcuguccacucuccaggucaggacuguccccccgua

SEQ ID NO: 172850 - RNA, 53 nt, Homo sapiens
gugcucucauuccagcacugacccuggcgcugaccccucucucucucccaggu

SEQ ID NO: 172851 - RNA, 42 nt, Homo sapiens
ccccaggcuggugcaagcucacucucuguacccaccccagac

SEQ ID NO: 172852 - RNA, 68 nt, Homo sapiens
gugccagccgcugccauauacauaaagacaagccagcaacagaggcaucauucugcgucucgugggga

SEQ ID NO: 172853 - RNA, 43 nt, Homo sapiens
aaggaugaucaaggaaagcuguccuggagcugaggcccagggg

SEQ ID NO: 172854 - RNA, 36 nt, Homo sapiens
ccccauuuacuuguccuuagggaggcugagucuuug

SEQ ID NO: 172855 - RNA, 52 nt, Homo sapiens
ccccaucgaacccucaauuuauucauuugcuuguaucaaauaaaccauggau

SEQ ID NO: 172856 - RNA, 32 nt, Homo sapiens
gcuuauguguagugugccuuuguucauuucac

SEQ ID NO: 172857 - RNA, 45 nt, Homo sapiens
auaugguagaacuuggucaagucaaacaguauaaacaggagauug

SEQ ID NO: 172858 - RNA, 42 nt, Homo sapiens
ucuacaucuggauacaaagaaccaaauucuucaagaggaguu

SEQ ID NO: 172859 - RNA, 46 nt, Homo sapiens
uugaaaaagauaaugccaaguuaaaaguuacagucaaaaagcaaau

SEQ ID NO: 172860 - RNA, 47 nt, Homo sapiens
gcacaggaucgacauacagaagcugucagaugugcugagaagaugca

SEQ ID NO: 172861 - RNA, 46 nt, Homo sapiens
guuguugugagacaacuucaacaagaacuagcugauacccuaaaaa

SEQ ID NO: 172862 - RNA, 53 nt, Homo sapiens
gugaauguaaucacuuaaaagaaagacaguaucaauaugaaaaugaaaaggca

SEQ ID NO: 172863 - RNA, 70 nt, Homo sapiens
gugcaaaaacuucaagcugagagugaaaagcaaagucuucugcuagaagaaagaaauaaggaguuaauca

SEQ ID NO: 172864 - RNA, 124 nt, Homo sapiens
uggguuuagaacggguacaaaaggaccuaagccaaacacagugucaaaugaaggaaauggaacaaaaguaucaaaaugaacaaguuaaagugaauaaauacauuggaaagcaggagucuguaga

SEQ ID NO: 172865 - RNA, 47 nt, Homo sapiens
acaaugagauucuuucucaacaacuauuuaaaacugaaaguaaacuc

SEQ ID NO: 172866 - RNA, 45 nt, Homo sapiens
agacaucaaaaagagaacuagaacuugcuuuccagagagcaagag

SEQ ID NO: 172867 - RNA, 58 nt, Homo sapiens
cugacagcugagaaugcaaugcuaaauucuaaacuggagaaugaaaagcaaagcaagg

SEQ ID NO: 172868 - RNA, 88 nt, Homo sapiens
uugcuaugcuaagacuagaaauagacacaauaaaaaaucaaaaccaggaaaaagaaaagaaauguuuugaggaccuuaaaauuguaaa

SEQ ID NO: 172869 - RNA, 56 nt, Homo sapiens
uagucaugaagaagaaaaagaccuaucgcauaaaaauagcauguugcaggaagaaa

SEQ ID NO: 172870 - RNA, 48 nt, Homo sapiens
acaagauggaauucugaccaaucaccuuuccaaacaaaaggagauuga

SEQ ID NO: 172871 - RNA, 46 nt, Homo sapiens
cagcuugaacugagucuccaaacacuggagauggaauugaggacug

SEQ ID NO: 172872 - RNA, 85 nt, Homo sapiens
uucaaguauauauguccuuuggaaaagacugaagugagaaauuaaaaaucagagaacuagaaaggaaaaauauucaagaacauag

SEQ ID NO: 172873 - RNA, 71 nt, Homo sapiens
uuaauguacuacaaagggagcuaucugaaacaaaagaaauaaaaucacaguuagagcaucaaaaaguugaa

SEQ ID NO: 172874 - RNA, 57 nt, Homo sapiens
uuaaaaaaaaucacugugaacuacuuacaguaaaaauuaaaaaaauggaagacaagg

SEQ ID NO: 172875 - RNA, 26 nt, Homo sapiens
gguauuuuuuuuuuuuaggccuacua

SEQ ID NO: 172876 - RNA, 27 nt, Homo sapiens
uuuuuucugaaaauagaaugauguagu

SEQ ID NO: 172877 - RNA, 46 nt, Homo sapiens
gaaggaaguaaagagcacugaaaaagaaaaacggaccucgaaagaa

SEQ ID NO: 172878 - RNA, 43 nt, Homo sapiens
aagaagagcaagaaagggaagggagugaaaauaaccagccaca

SEQ ID NO: 172879 - RNA, 41 nt, Homo sapiens
gccuaccauugaaaugaaagauucuguuccaaauaaagcag

SEQ ID NO: 172880 - RNA, 47 nt, Homo sapiens
guuuuuuucuccaguauacuucugucauguugcuguccuaaccaaaa

SEQ ID NO: 172881 - RNA, 56 nt, Homo sapiens
ugagaauuuuccacagaaguauguugauccuuuagcuggggcugcagacggaaaag

SEQ ID NO: 172882 - RNA, 38 nt, Homo sapiens
gggaguggggauugcaaaaaaaagaauauacuggaaaa

SEQ ID NO: 172883 - RNA, 50 nt, Homo sapiens
caaaugguacuaucugaaaaaaauucauuuacuuaauuaucaucccuaaa

SEQ ID NO: 172884 - RNA, 46 nt, Homo sapiens
gucauccagaaguaguaacucuccugguggacagaaaaugccagcu

SEQ ID NO: 172885 - RNA, 45 nt, Homo sapiens
aaaacuaaugaaauuuuaugucacaaacaugaguuccugauggaa

SEQ ID NO: 172886 - RNA, 46 nt, Homo sapiens
gcgaaagugcagcagauccuuuugcucaggaagaauggcuugaacg

SEQ ID NO: 172887 - RNA, 46 nt, Homo sapiens
aguacauuuuaaauucugaauuacaguaggucugguucgugguuag

SEQ ID NO: 172888 - RNA, 101 nt, Homo sapiens
uauauaauuccuauucuaugagaauuuguuuuauaccuuugugaauugaagagaacauacaugucuuguguguuuuguuuuuauuguuuaggagaaaacug

SEQ ID NO: 172889 - RNA, 59 nt, Homo sapiens
gcaugcaguuuuauuucaaaaagaaguaaaagaauuaaaucucaguuuugaaauuauua

SEQ ID NO: 172890 - RNA, 46 nt, Homo sapiens
uugaauauaaugcauuggcaaggagcuagaagaacacuaucagaaa

SEQ ID NO: 172891 - RNA, 53 nt, Homo sapiens
aagcaggacuagaacagcacagagaggcccauuuggggcaaagugugggcaug

SEQ ID NO: 172892 - RNA, 47 nt, Homo sapiens
ccucaauuauuaauuauuuuauauuaacauguugaaaugacaauauu

SEQ ID NO: 172893 - RNA, 45 nt, Homo sapiens
agcuaacgcagaaggugaauggaagaacauuacuuuaaaggcauu

SEQ ID NO: 172894 - RNA, 53 nt, Homo sapiens
aauugaauggauauauaucuucuuuuaaaaauuuacacaaacauuaucacaug

SEQ ID NO: 172895 - RNA, 36 nt, Homo sapiens
agaaauugcugaguuacuauuagcuuagugaucagu

SEQ ID NO: 172896 - RNA, 46 nt, Homo sapiens
guuugaggugauauuucacugugguuuuaauuugcauuucccugau

SEQ ID NO: 172897 - RNA, 69 nt, Homo sapiens
gcugggaaaaaucugccuuucuuugccggaaauucaguguuucugaacauagaaaaagaagaaauacag

SEQ ID NO: 172898 - RNA, 37 nt, Homo sapiens
aacuuugacccagaauauagucaggggagggccuggu

SEQ ID NO: 172899 - RNA, 48 nt, Homo sapiens
uuuaucggucaacagauauuaaaauauaauaacuguuuugggggugca

SEQ ID NO: 172900 - RNA, 59 nt, Homo sapiens
uuaggucacucaguaaaugccaagcuuaguauguuuccuuaaauguauggagccacuuc

SEQ ID NO: 172901 - RNA, 44 nt, Homo sapiens
ucaguccaggaacuucccaccaccagcccuugacugucccauua

SEQ ID NO: 172902 - RNA, 47 nt, Homo sapiens
cccuugacucgucuucucugaaccucagccucgugcauugccuggaa

SEQ ID NO: 172903 - RNA, 51 nt, Homo sapiens
uuguuugugcagaaagagaaggaaagagaaaauauuaggagaccucuguag

SEQ ID NO: 172904 - RNA, 47 nt, Homo sapiens
ucuguggcucacugagcuuuggauuccaggucccuuucccagcacuu

SEQ ID NO: 172905 - RNA, 45 nt, Homo sapiens
cucuaaauucucuacuugauugaaacacugucuuccuucugugac

SEQ ID NO: 172906 - RNA, 42 nt, Homo sapiens
cuucuagaauguuauaucaugaaguucguuacucaccccccu

SEQ ID NO: 172907 - RNA, 50 nt, Homo sapiens
ccuguuguuacuaacaucaucgucuaauccagugcccucauuuuauaggu

SEQ ID NO: 172908 - RNA, 71 nt, Homo sapiens
aacuacgaggaugaccacuucaaauccucccauuccaaucaaacaaaucacaagcccuccccagaccaggu

SEQ ID NO: 172909 - RNA, 44 nt, Homo sapiens
agcaauauuuaggaccgccaaguuggagacaguaaauaauugau

SEQ ID NO: 172910 - RNA, 46 nt, Homo sapiens
ugaagcgggagaaggaucgucugguacagcagcuuaagcagcaggu

SEQ ID NO: 172911 - RNA, 29 nt, Homo sapiens
ccauguaaaacuuaaucagguaaguccga

SEQ ID NO: 172912 - RNA, 41 nt, Homo sapiens
auucacucacccccaaagcaugugccuguuaucacaugauu

SEQ ID NO: 172913 - RNA, 25 nt, Homo sapiens
cacaaauuaaacaaagucaggauua

SEQ ID NO: 172914 - RNA, 35 nt, Homo sapiens
gaacuuacuuggauauauguauaaucugaggcaga

SEQ ID NO: 172915 - RNA, 49 nt, Homo sapiens
ccacaucuucuuuguuacuacugcuggaggaagaaaaugcaaucuauua

SEQ ID NO: 172916 - RNA, 64 nt, Homo sapiens
caguggcaaaacagagggcuuauaugucucaaaaagugaaugugcaaaauuguaggcccacugu

SEQ ID NO: 172917 - RNA, 357 nt, Homo sapiens
cauuaugagaaugugauuuaagauuucaaaccuaggccgagcgcggugguucacgccuguaaucccagcacuuugggaggccgaggcgggcggaucacuugaggucaggagaucgagaccauccuggcuaacacggugaaaccccgucucuacuaaaaauacaaaaaauuagcugggcgugguggcgggcgccuguagucccagcuacucgggaggcugaggcaggagaauggcgugaaccugggaggcggagcuugcagugagccgagaucgcaccacugcacuccagccugggcgacagagcgagacucugucucaaacaaaaaaaaaaagauuucaaaucuaucugacacagag

SEQ ID NO: 172918 - RNA, 48 nt, Homo sapiens
ugaaauggagcuugucugucugcuacaagacugggcacaacccuggcu

SEQ ID NO: 172919 - RNA, 91 nt, Homo sapiens
cgguauuagauacaaggaugugguuucuuuugugucaaguauagaaagaaagaccaacuuuauuagcaaagcugagagagaauugaugaac

SEQ ID NO: 172920 - RNA, 42 nt, Homo sapiens
gaaucagccaggaccaaugcugaaaaacaggucugcuauuuu

SEQ ID NO: 172921 - RNA, 86 nt, Homo sapiens
uuuucuaggacagucuccguaagaaggaugacaggauugaagagcuggaagaagcacuaagagaaaguguacagauaacugcagag

SEQ ID NO: 172922 - RNA, 52 nt, Homo sapiens
aauaagaagguagcaaaucugaagcacaaggaacagguggaaaaaaagaaga

SEQ ID NO: 172923 - RNA, 50 nt, Homo sapiens
cuugaaggagguggaaaaugagaagaaugacaaagauaagaagauagcug

SEQ ID NO: 172924 - RNA, 32 nt, Homo sapiens
cuuaagacacuagagauugcuuuggagcagaa

SEQ ID NO: 172925 - RNA, 46 nt, Homo sapiens
aauugaacgcuuaaaggagcagagggacagagaugagcgagagaag

SEQ ID NO: 172926 - RNA, 48 nt, Homo sapiens
uugaaaaucuucaagagcagcuuagagacaaggaaaagcagaugagca

SEQ ID NO: 172927 - RNA, 56 nt, Homo sapiens
uauuucuaaaugcugucagaguuucuugcucauuuuucaguuuauauuuuugugau

SEQ ID NO: 172928 - RNA, 46 nt, Homo sapiens
ggaagggaacauucagaacauuugggugccugaggcuucucuagag

SEQ ID NO: 172929 - RNA, 27 nt, Homo sapiens
agugaaggacaagaaacuucuggaggu

SEQ ID NO: 172930 - RNA, 40 nt, Homo sapiens
uuuagaugaucugcauuuucuuacuuuuauuaagcuaaac

SEQ ID NO: 172931 - RNA, 25 nt, Homo sapiens
uccuagguacaagaauauaugcagu

SEQ ID NO: 172932 - RNA, 46 nt, Homo sapiens
aguguaucggagccauucuaaauuuaugaaaaauaagguaauggca

SEQ ID NO: 172933 - RNA, 61 nt, Homo sapiens
ugggcuucgagaccuggaagaggaaauucagaugcugaaaucgaauggugcuuugaguacu

SEQ ID NO: 172934 - RNA, 50 nt, Homo sapiens
agaacuagaaaaggcuuuacuauuaauauuggaaauuuuuuucaccagaa

SEQ ID NO: 172935 - RNA, 58 nt, Homo sapiens
uugguagugagggugcuaauuugucaaaagcugccuuugucuguguuuaggguagggg

SEQ ID NO: 172936 - RNA, 37 nt, Homo sapiens
aacuguaagauauggagcaaauuaccuaugccucagu

SEQ ID NO: 172937 - RNA, 58 nt, Homo sapiens
acuugggcucuaguuggagucgaauggggagccaugacaggguuuucagcagaggacu

SEQ ID NO: 172938 - RNA, 51 nt, Homo sapiens
uucugaaugggaguuuguuuugagcaauggguuuuaaaacgucuuuguaga

SEQ ID NO: 172939 - RNA, 56 nt, Homo sapiens
gagagaacaagacgacuggcagaggcagagaugcacguucaucaccuagaaagccu

SEQ ID NO: 172940 - RNA, 55 nt, Homo sapiens
ucuggaaauguugcagagcaaaggacuuucugccaaggcuaccgaggaagaccau

SEQ ID NO: 172941 - RNA, 46 nt, Homo sapiens
cacaugcagaugacaauccaggcucuccaggaugaauugcggaucc

SEQ ID NO: 172942 - RNA, 49 nt, Homo sapiens
aaacugaaguuaaauuacugacauuuugcauauuaucucaaucauuuuu

SEQ ID NO: 172943 - RNA, 36 nt, Homo sapiens
ggugcacauccaugagauuuucaaagaaauauuugg

SEQ ID NO: 172944 - RNA, 42 nt, Homo sapiens
aauacuguucaggagcagcuuuuacugcugucagcagagugg

SEQ ID NO: 172945 - RNA, 56 nt, Homo sapiens
ugaguucuucaaugaauagcaucaagaccuucuggagcccagagcugaagaaggaa

SEQ ID NO: 172946 - RNA, 97 nt, Homo sapiens
agagauaacacaaucauggaucugcagacacagcugaaggaaguauuaagagaaaaugaucucuugcggaaggauguggaaguaaaggagagcaaau

SEQ ID NO: 172947 - RNA, 61 nt, Homo sapiens
agagcaucaccucccuccugugaguauggcauccacuguaccucacucccuucgucaggcg

SEQ ID NO: 172948 - RNA, 45 nt, Homo sapiens
cacguuccccucgcuugggucaccgucgaaccaacaguacgggag

SEQ ID NO: 172949 - RNA, 50 nt, Homo sapiens
guuguuguuguuguugauuuucugcucacaccuuuccugaccuugcaacc

SEQ ID NO: 172950 - RNA, 65 nt, Homo sapiens
ugaacuaguugccagcauauccuuacugaguaugggggauguccagguggucauuagcugauagu

SEQ ID NO: 172951 - RNA, 39 nt, Homo sapiens
caaguugaauacccaggaaauaaagaggugcuuguugag

SEQ ID NO: 172952 - RNA, 26 nt, Homo sapiens
guuuuuggccugaauaacuggaagaa

SEQ ID NO: 172953 - RNA, 23 nt, Homo sapiens
gugaggguaucucugaccaaggu

SEQ ID NO: 172954 - RNA, 46 nt, Homo sapiens
uaaugagcagauuauugucuuccagcaaauacuucuacuuuauaga

SEQ ID NO: 172955 - RNA, 49 nt, Homo sapiens
guaaaaugcugaagaugauucuuuucuuuucgaugaaauggugagauaa

SEQ ID NO: 172956 - RNA, 47 nt, Homo sapiens
cgggcugggcugggcagggcaacgcgcccccggggaggggcggagcu

SEQ ID NO: 172957 - RNA, 43 nt, Homo sapiens
auugcugggguccucggcgaugcccgugugcgcagccccgcga

SEQ ID NO: 172958 - RNA, 41 nt, Homo sapiens
gaccccagcaauggacgucgugucuguggugaucccgccag

SEQ ID NO: 172959 - RNA, 36 nt, Homo sapiens
gggagcuguuuauuuagccuccgacagcuaagcgaa

SEQ ID NO: 172960 - RNA, 55 nt, Homo sapiens
ccaccccugcuuuaaaaugauuuauuuauucucugcuuguauuucuuguggagag

SEQ ID NO: 172961 - RNA, 73 nt, Homo sapiens
ccuuaagggcccugcuucccuuaguaaguaaguaaguuggucuacggcccuaaauaugcaaaugagagcugaa

SEQ ID NO: 172962 - RNA, 50 nt, Homo sapiens
acuugaaaacuagccccccacccccuucucuuuauguucaguuucuucua

SEQ ID NO: 172963 - RNA, 116 nt, Homo sapiens
aaacgugaugccuggccagugacugucauauaaaccuuucuuauuugagcuaggcuugaacagacgugaccuagaagaaacugaacauaaagagaaggggguggggggcuaguuuu

SEQ ID NO: 172964 - RNA, 48 nt, Homo sapiens
aagucauucaacaacuuugucuagagcagguguaagaugaguagggug

SEQ ID NO: 172965 - RNA, 50 nt, Homo sapiens
uguggaaggaaaucguagguccaugugaccccagcaguccagcagugguu

SEQ ID NO: 172966 - RNA, 45 nt, Homo sapiens
aaaaaaaauuaaguucccugcggacauguaacuuugccaucaguu

SEQ ID NO: 172967 - RNA, 46 nt, Homo sapiens
ugcuuaaagcacuaaugaccuaucauaagaaagaguugcaccccag

SEQ ID NO: 172968 - RNA, 70 nt, Homo sapiens
cucaagaauccgaaccacaggacaaaaaccaccuacugggcucucuccuacccugcccuccucccuuuuu

SEQ ID NO: 172969 - RNA, 51 nt, Homo sapiens
cuucagaccaugcuuuccuguuuaucuauacucaguaaugaggaugagggc

SEQ ID NO: 172970 - RNA, 45 nt, Homo sapiens
ucauggagaugcacaguugcccaggugcagagaacuuccuugcca

SEQ ID NO: 172971 - RNA, 46 nt, Homo sapiens
aacagccaagccgcccaagcucagccuccugccaugacguccagca

SEQ ID NO: 172972 - RNA, 93 nt, Homo sapiens
uagguuacaauuucaggaagagggaaaacuucacgggaugaugaauggcaagccacagaaugagaagaggaugaacugggaagccaugcaaga

SEQ ID NO: 172973 - RNA, 50 nt, Homo sapiens
aaagagguuuucuugugcauugggcacgguuaaaguaggaguaggaaaag

SEQ ID NO: 172974 - RNA, 629 nt, Homo sapiens
ggagaagguggguuuccaaaccauuggacacugccacauucuuuagccuuuuuuuuuuuuuuugagauggagucucacucuauuacucaggcuggagugcagugguacgauccuaccuaacugcaaccccugccuccuggguucaagcgauucuccugucucagccuccagaguagcugggauuguaggugugcaccaccaugcccaguuaauuuuuguauuuuaguagagacaggguuuugccguguuggccaggcuggucucaagaacuccugaccucaggugauccgcccgccuuggccucccaaagugcugggauuacagacgugagccaccacgcccggcuuuuuuuuuuuuuuaaaggaagggucucuucuuuuucugucacccaggcuggauacagcggcacaaucacgucucacugcagccuccaacuccuccugccucagccucccaaguagcuugggacuagacguaugcacuuccacacccaguuaauuuuuuacuuuuuuauauagacagaaucuccauauguugcuuagucaugaacugcugggcucaggcaauccugccaugucagccucccaaagugcugggauuacaggugugagccaccaugcucagccuag

SEQ ID NO: 172975 - RNA, 51 nt, Homo sapiens
uggguccaggugaaaaacuuuucugaacacagcaugcuacuucucuuauua

SEQ ID NO: 172976 - RNA, 43 nt, Homo sapiens
cugggaagaguggggagaagcggugggaauccuugagccaauu

SEQ ID NO: 172977 - RNA, 45 nt, Homo sapiens
ucccauguagaagcgacaagaaaaugcagcugaggcagggugcaa

SEQ ID NO: 172978 - RNA, 41 nt, Homo sapiens
gcauacaaaaguccaugcccucccacguucacacugaagug

SEQ ID NO: 172979 - RNA, 45 nt, Homo sapiens
ccaguugggguaauaacacugcccggcacauauuugcugaccaaa

SEQ ID NO: 172980 - RNA, 54 nt, Homo sapiens
gaaaaaccuuuguuauaauuugaauaaagaucuucucuguuaaggccucaaacu

SEQ ID NO: 172981 - RNA, 46 nt, Homo sapiens
uugcacccccagcagacccuccacccuccuggcaacaucccagagu

SEQ ID NO: 172982 - RNA, 46 nt, Homo sapiens
cgacgacccacuaaaagcaaaggcagcaaaucuagucgaagcaguu

SEQ ID NO: 172983 - RNA, 46 nt, Homo sapiens
cuuugacuuagauucuggcuaggaaggcucuuugagcucagcugau

SEQ ID NO: 172984 - RNA, 45 nt, Homo sapiens
ucuucagaugugccagagagugcccacaaaacuacugccucagag

SEQ ID NO: 172985 - RNA, 90 nt, Homo sapiens
ucuguugcagcagacggugcccagaaagaggguaaaaauaagucagaagaugcaaagucuguucauuuugaauccagcaccucagagucc

SEQ ID NO: 172986 - RNA, 49 nt, Homo sapiens
gauuagcaaauuaauaaaucuguuccguuauuauuugucagaggaaagg

SEQ ID NO: 172987 - RNA, 45 nt, Homo sapiens
gcucgcuggguagaguaccugcuggaaguucaguacccacuggca

SEQ ID NO: 172988 - RNA, 52 nt, Homo sapiens
aagcaaauuuuugguuuuguuguagauuccacaguuguacaguuuggggguu

SEQ ID NO: 172989 - RNA, 29 nt, Homo sapiens
ccugggcaaguuucuaccccagucagcac

SEQ ID NO: 172990 - RNA, 46 nt, Homo sapiens
acuguuccuagugguaaauugguuggugguaagcaaguacuugugg

SEQ ID NO: 172991 - RNA, 63 nt, Homo sapiens
agcaugccucugucucacuggagaccucacuagucauagagagcacugucacaccaggcaucc

SEQ ID NO: 172992 - RNA, 63 nt, Homo sapiens
ccugcuguacagcagacacuaauucauagucagccucaaccagcuuugcuucccaaccagccc

SEQ ID NO: 172993 - RNA, 73 nt, Homo sapiens
aucagugauagcuucuacuccuauucuuccccaagcagcaggaccuacuucuacaccuuuauuaccccaagua

SEQ ID NO: 172994 - RNA, 45 nt, Homo sapiens
ccaccaggcugagaaauauaacuagacacuccugcuccaggagag

SEQ ID NO: 172995 - RNA, 46 nt, Homo sapiens
aucugagaucguuguuucuaguacagcacuguauccuucaguaaca

SEQ ID NO: 172996 - RNA, 55 nt, Homo sapiens
gcugaugaaaugcucagugaggaugucaguguggaaccagagggugaucagggau

SEQ ID NO: 172997 - RNA, 64 nt, Homo sapiens
ugacuuuauucuagcaauagagagagagucguuuguggaucaagugcgagaaauuauugaaaaa

SEQ ID NO: 172998 - RNA, 99 nt, Homo sapiens
ucaaauaaaggagaccgaguaguagaaugucaauuagagacucauaauaggaaaaugguuacauucaaauuugaccuagauggugacaaccccgaggag

SEQ ID NO: 172999 - RNA, 46 nt, Homo sapiens
acauucaaaauucuuaauuuugggcgugaaguuuuuucaugucgag

SEQ ID NO: 173000 - RNA, 50 nt, Homo sapiens
gacagguucaagugucccagccaggagggaguuuagcacaagcccccacu

SEQ ID NO: 173001 - RNA, 59 nt, Homo sapiens
acugugggaaaguacccagguguagccaguacuucugucggcaugggaggggauaggac

SEQ ID NO: 173002 - RNA, 43 nt, Homo sapiens
cguggcuucuguuugcauccauucuacaguccuauccccuccc

SEQ ID NO: 173003 - RNA, 80 nt, Homo sapiens
uguagaauggaugcaaacagaagccacguuggaagagggagcaauauuugaaucuccuggguacugugguggcagucgag

SEQ ID NO: 173004 - RNA, 46 nt, Homo sapiens
gucacagggcuucccaccucgacugccaccacaguacccaggagau

SEQ ID NO: 173005 - RNA, 48 nt, Homo sapiens
ggugaguuagagcagguugggggucaauaaauuagcaaaacagcaaga

SEQ ID NO: 173006 - RNA, 46 nt, Homo sapiens
gcugccauugugaugggaagggaugagaaaccugucugagccguag

SEQ ID NO: 173007 - RNA, 46 nt, Homo sapiens
agacaggguacugagggagcaagggaguagggagcggcugucccac

SEQ ID NO: 173008 - RNA, 39 nt, Homo sapiens
ccacaaugacuuuuaucaaaaguaucaaaaaaucuguua

SEQ ID NO: 173009 - RNA, 46 nt, Homo sapiens
acuuccacaauuauuuuaaacuacccuacuuugcaccauaacauuu

SEQ ID NO: 173010 - RNA, 46 nt, Homo sapiens
acaaugagagcagaagcaacuguguauuugaauuucauguucacac

SEQ ID NO: 173011 - RNA, 96 nt, Homo sapiens
cuaagauuagauucuggauuggguccgggaucuccccucucuaguauuucugcaccuaucaguacagaugcuacacguuugaaauuucacccuguc

SEQ ID NO: 173012 - RNA, 51 nt, Homo sapiens
acucaucaguacugucaaguccuaugaaacagauaccugaacagaagccag

SEQ ID NO: 173013 - RNA, 82 nt, Homo sapiens
caccugguggcagcccaacuaacuggacaccagaggccguaguuauguuggguacuacagccaguagaguaacuggagaguc

SEQ ID NO: 173014 - RNA, 67 nt, Homo sapiens
gccaccagguggaagaagacuuuggccaacaguccucagcagggguuggaaguggugaguuugggcu

SEQ ID NO: 173015 - RNA, 45 nt, Homo sapiens
cucuuacgccgcugggaaauggcuacuuucggugggcagguggga

SEQ ID NO: 173016 - RNA, 46 nt, Homo sapiens; identical to SEQ ID NO: 96420

SEQ ID NO: 173017 - RNA, 48 nt, Homo sapiens
uggaaauuaugugcauaguaaaaauccauuaaauacauccagggccaa

SEQ ID NO: 173018 - RNA, 44 nt, Homo sapiens
aucuaaagcaaagagcccacagauugauuucauuggcccuggau

SEQ ID NO: 173019 - RNA, 52 nt, Homo sapiens
cugcuuuuccaaauaaagaauauaguuaacuuucugaacuagcaaccccaga

SEQ ID NO: 173020 - RNA, 52 nt, Homo sapiens
uauuuuuuccuuagguuucaaccuaaggugggacuguagcucuaaugaaugc

SEQ ID NO: 173021 - RNA, 46 nt, Homo sapiens
cacaacuggauauaggaaauauuuuguacuuuuacaaaguaaucaa

SEQ ID NO: 173022 - RNA, 47 nt, Homo sapiens
agaagagcaagaauuccacaaaguuuagauuaaaagcuuucugagaa

SEQ ID NO: 173023 - RNA, 46 nt, Homo sapiens
uacaggcacagucccagggcauauaccuucuacuguccaagcacag

SEQ ID NO: 173024 - RNA, 75 nt, Homo sapiens
ggauccucugucuucacagaaucucgagugagcagccaacagacaguuucauaugguucccaacaugaacaggca

SEQ ID NO: 173025 - RNA, 50 nt, Homo sapiens
aaaaaagcaggaagagagcagucucaaacagcagguagaacaauccagug

SEQ ID NO: 173026 - RNA, 65 nt, Homo sapiens
gacagaguaucauuaauuaagaggaaacgagagcagcggcaguugguacgggaggagcaagaaaa

SEQ ID NO: 173027 - RNA, 46 nt, Homo sapiens
uuuuuuuuuuaaacuucuuuguauugcuuuuauaauggguguuaga

SEQ ID NO: 173028 - RNA, 48 nt, Homo sapiens
auacaaagauaaugaagcuauugaguuuucuuuugauuuagagagaga

SEQ ID NO: 173029 - RNA, 47 nt, Homo sapiens
agaugauggagaaaaaauagccauaaaauuauggcuacguauugaag

SEQ ID NO: 173030 - RNA, 49 nt, Homo sapiens
uauggaauuuucuauacaaaacucuuggcuguagguugaaaaagcagca

SEQ ID NO: 173031 - RNA, 66 nt, Homo sapiens
gcaugguccuacacaggcuugcucauacaguuaaguuagagguaggcugcacuuuugcagcacaca

SEQ ID NO: 173032 - RNA, 34 nt, Homo sapiens
uguauucauugugcacagcacaccguaggcacuc

SEQ ID NO: 173033 - RNA, 47 nt, Homo sapiens
aaaugugacaacaucuuuaucaccggcccuacuggcucagucaagau

SEQ ID NO: 173034 - RNA, 45 nt, Homo sapiens
uagggccggugauaaagauguugucacauuuaagaucgcggugaa

SEQ ID NO: 173035 - RNA, 54 nt, Homo sapiens
auaucaaugaaaaaaacuuuguagaucuggcuuccaauggagauuauauagcuu

SEQ ID NO: 173036 - RNA, 28 nt, Homo sapiens
ugcuaacuuuuaaguuugauacagucaa

SEQ ID NO: 173037 - RNA, 59 nt, Homo sapiens
acaauagcaaaggaugggauugcuacuuuaaaaauacuaaaauaugaggguaaagagag

SEQ ID NO: 173038 - RNA, 53 nt, Homo sapiens
uuugaauauugcacauauauaauacuagagaaauuuaaauguuaauaagacuu

SEQ ID NO: 173039 - RNA, 74 nt, Homo sapiens
gaacacaucauaaugucacugccuccacuucccagacuccaauagggaauagcagcuuuauucuacccaggucc

SEQ ID NO: 173040 - RNA, 37 nt, Homo sapiens
accauauguauaaaaauaaaaaggcuaaaaagaaaca

SEQ ID NO: 173041 - RNA, 46 nt, Homo sapiens
acacugaaaccaccguggaagucgccuggugugaacugcagguaaa

SEQ ID NO: 173042 - RNA, 46 nt, Homo sapiens
ccugcaguucacaccaggcgacuuccacggugguuucaguguccag

SEQ ID NO: 173043 - RNA, 45 nt, Homo sapiens
agcgccaaggagccacaggaggaacggagccagcagcaggaugau

SEQ ID NO: 173044 - RNA, 42 nt, Homo sapiens
uucccugccccagcccagcauccccgcggcugucccgcagag

SEQ ID NO: 173045 - RNA, 26 nt, Homo sapiens
acuaccaccacugagcaccgcuucuu

SEQ ID NO: 173046 - RNA, 50 nt, Homo sapiens
guccugccggucacagcgucggcggccgcggcucccaguuucucccccac

SEQ ID NO: 173047 - RNA, 41 nt, Homo sapiens
agcgguccgccugucccucguugcggcuugucggugcugag

SEQ ID NO: 173048 - RNA, 42 nt, Homo sapiens
ggcgccuucugucaccgaagaugggggugcggaguggccgag

SEQ ID NO: 173049 - RNA, 27 nt, Homo sapiens
accaagggaccuggggguuuggagcag

SEQ ID NO: 173050 - RNA, 29 nt, Homo sapiens
ggcaucuacaagucugaccuggacaggau

SEQ ID NO: 173051 - RNA, 25 nt, Homo sapiens
gugaugagcaggguuuuauaugaga

SEQ ID NO: 173052 - RNA, 32 nt, Homo sapiens
uucaggauugggugugauaacugggguugcua

SEQ ID NO: 173053 - RNA, 83 nt, Homo sapiens
acugguuuaagguuauguggcuaguaaauguugccgcuaaaaacaaacacugccucauaggccagugcucuuucuuucguacu

SEQ ID NO: 173054 - RNA, 86 nt, Homo sapiens
cugucccuggagaggaucuugaccaggcagguguuugucccgccauuaggcaagguucugaaaucccugggugccuggcccaguac

SEQ ID NO: 173055 - RNA, 42 nt, Homo sapiens
ggcuggcauggggaggaggaagugguggcggccgcaggccag

SEQ ID NO: 173056 - RNA, 46 nt, Homo sapiens
guccuucccagggaggaccagccacauuccagugcagcagccagag

SEQ ID NO: 173057 - RNA, 44 nt, Homo sapiens
ggagagcaugacuccugccuuuuccauauccaggcacaugugga

SEQ ID NO: 173058 - RNA, 48 nt, Homo sapiens
gcagagggaggaaggagugguuuuggcugaagcugagggacgggagcu

SEQ ID NO: 173059 - RNA, 67 nt, Homo sapiens
gcagcguggccacucuccugugcauccagaucuagagaugauuauaaggaagagcuggagggcagaa

SEQ ID NO: 173060 - RNA, 48 nt, Homo sapiens
ggucuuguccaacucccacaggcugcugcuuugcucccugguuugcag

SEQ ID NO: 173061 - RNA, 46 nt, Homo sapiens
ggaggaagagggugccuucuggccccucagagacccccaccuacag

SEQ ID NO: 173062 - RNA, 44 nt, Homo sapiens
gcuucaauguccucacccuuaaaaugagaggguuccaacagaua

SEQ ID NO: 173063 - RNA, 52 nt, Homo sapiens
aagacaggguuuugauguggguggagcaaagguguauggcagggaguggugu

SEQ ID NO: 173064 - RNA, 52 nt, Homo sapiens
ccaaacugucuuucuugggccacuaucuuaaaucccauaagauauuccagga

SEQ ID NO: 173065 - RNA, 28 nt, Homo sapiens
gcugagccuuagagauguccauccagcc

SEQ ID NO: 173066 - RNA, 47 nt, Homo sapiens
uccgacucccaaauccaaaaccucaaacuuggaaauuuuuaggaaga

SEQ ID NO: 173067 - RNA, 40 nt, Homo sapiens
gcgggaggguggggggcaaagagcaacacugugaaacaaa

SEQ ID NO: 173068 - RNA, 43 nt, Homo sapiens
ggaggucauuggagaggggauaggggaacagggguagcuggug

SEQ ID NO: 173069 - RNA, 51 nt, Homo sapiens
caaaugagagauaauaaggaaauggucugggggugugugugugugugugaa

SEQ ID NO: 173070 - RNA, 58 nt, Homo sapiens
aucagaccucgcagaucuagcagcuggcagcccuccagaucagauaauguaccuuauu

SEQ ID NO: 173071 - RNA, 49 nt, Homo sapiens
uuugcaucuuacccuacaaauugccuacaacaggcucuuugaaagaugg

SEQ ID NO: 173072 - RNA, 105 nt, Homo sapiens
gacugacccucccagacuuaccacuucagccgaaguaagggagaacuagacaacucucuuugucucaugcuacaaagugccccaggaggccuuucauacacaauu

SEQ ID NO: 173073 - RNA, 42 nt, Homo sapiens
cuuuucaagagaaacaagaaauugaggguuuuaugugaaauu

SEQ ID NO: 173074 - RNA, 82 nt, Homo sapiens
uaucugacuucagaacccaugcuccuagucaccucaggucugcccccuaaaaggguuugcuuuagggguucaguuuccuggg

SEQ ID NO: 173075 - RNA, 54 nt, Homo sapiens
uucaaucucagagcuuccuucucuuuuacagauuaaauaaacagaagcucagaa

SEQ ID NO: 173076 - RNA, 24 nt, Homo sapiens
aagguuaucuauuuacccagccuc

SEQ ID NO: 173077 - RNA, 45 nt, Homo sapiens
aggguugucuugugcauccagcaucucagaaauggucuccugaga

SEQ ID NO: 173078 - RNA, 49 nt, Homo sapiens
cuugccaccaaauacacauucuucaaucacuuuuuuccuccaugauguu

SEQ ID NO: 173079 - RNA, 42 nt, Homo sapiens
uuuauauguuaaccacuauacaaaaaugcgaguggaagaggu

SEQ ID NO: 173080 - RNA, 51 nt, Homo sapiens
ugggggcacagcucucccaacuaauauuucauggaaauggugacauuuugg

SEQ ID NO: 173081 - RNA, 61 nt, Homo sapiens
cauucccaccuccacacucuuggauaccaacaggaaccaggguaguaaaacugcaccuccc

SEQ ID NO: 173082 - RNA, 51 nt, Homo sapiens
gggaucuugugcacaaauuaaaaacagagagaaaggcaguugcuuugugac

SEQ ID NO: 173083 - RNA, 57 nt, Homo sapiens
gcgacgggagaggcguggggaggagagcccggcgcggaacacacgcgcggaggagga

SEQ ID NO: 173084 - RNA, 46 nt, Homo sapiens
aaugacaaaacgcuaugaggcauuggagcgucgacguauccuggaa

SEQ ID NO: 173085 - RNA, 42 nt, Homo sapiens
gagaaaaagcuguccaauauguaccaagagcagugcauuucc

SEQ ID NO: 173086 - RNA, 46 nt, Homo sapiens
gacacucucuuauaucuaguguuucugcugagaccugaaaaauggg

SEQ ID NO: 173087 - RNA, 55 nt, Homo sapiens
agagaagucauggaugcuugaaaaagauaauuugaugucaaagauuaagcaauau

SEQ ID NO: 173088 - RNA, 101 nt, Homo sapiens
gcucagcugggagagcagaccaaacuuucucgagaacaaauugaagggcucaucgaggacagacggauucaccuugaggaaauacaaguucagcaccagag

SEQ ID NO: 173089 - RNA, 40 nt, Homo sapiens
aucuacucuuguauagccuaaccccauuuauaagacauua

SEQ ID NO: 173090 - RNA, 47 nt, Homo sapiens
cagguaaagaauguauuuuggcagaccaagauggcuuuuauccacag

SEQ ID NO: 173091 - RNA, 36 nt, Homo sapiens
gagagaaaagaaaguucugagcauuaccaaagagac

SEQ ID NO: 173092 - RNA, 45 nt, Homo sapiens
ucugaacuccucugcgugggaaauacugauauuucaauagcacac

SEQ ID NO: 173093 - RNA, 46 nt, Homo sapiens
agacaagaaaaagauucagaaucucuuggcucuugugggaacagau

SEQ ID NO: 173094 - RNA, 41 nt, Homo sapiens
uggauccaguagaccugcugugaguuggacgugggccacaa

SEQ ID NO: 173095 - RNA, 49 nt, Homo sapiens
aggaaguggacucugagauggagauuugccuucacgguaguuacuggag

SEQ ID NO: 173096 - RNA, 79 nt, Homo sapiens
ucuaagugauaugcaggucugccucuuccaggaacgggaacauguuuuacgccucuacucagaaaaugaccgacugaga

SEQ ID NO: 173097 - RNA, 81 nt, Homo sapiens
ucgucuggccaaacuccauccuucuaaggagcuccuggaauauuaucaaaagaagauggcugagugugaggcagaaaauga

SEQ ID NO: 173098 - RNA, 85 nt, Homo sapiens
aacgugguguugccgucaguggucccaccaagaggaggggaauggcagauucacuggagucaacccccuugccuucccccgaaga

SEQ ID NO: 173099 - RNA, 43 nt, Homo sapiens
aucgagacuuguauagccuuagucuaagcauaggaacuggaaa

SEQ ID NO: 173100 - RNA, 46 nt, Homo sapiens
aaagacagcaugaacuuuaccccaacacacaccccugucugcagaa

SEQ ID NO: 173101 - RNA, 63 nt, Homo sapiens
gaggagaggacgugagccugaaugugguguccguggaggggcuggggaccggaggaggaaagc

SEQ ID NO: 173102 - RNA, 36 nt, Homo sapiens
ggaggcgggagugacaccuccgcccgggccgcggag

SEQ ID NO: 173103 - RNA, 32 nt, Homo sapiens
ccuccaccuccaccuccaccgcugaccccaag

SEQ ID NO: 173104 - RNA, 105 nt, Homo sapiens
ggucccucugcccugcuagucccuccugcaggcuguguaugaagcguucugauauggaggguuggugcgccuggguugacagccauuggucaggugccugcagag

SEQ ID NO: 173105 - RNA, 43 nt, Homo sapiens
caaagcugcuugcacaacugcuaaguguacggaauuccaggaa

SEQ ID NO: 173106 - RNA, 51 nt, Homo sapiens
gguuagccguucucgcugccuaggcuucaugcagguuucccaugaccgcca

SEQ ID NO: 173107 - RNA, 57 nt, Homo sapiens
ucucaaaaucaacuuguguacuuugucuucucuccuaaaauucccuuuagacuugag

SEQ ID NO: 173108 - RNA, 46 nt, Homo sapiens
accuuggauuuugcugugguuguugcuuuguucuuauuuuuggcug

SEQ ID NO: 173109 - RNA, 42 nt, Homo sapiens
acgcaaccuuaaagggugcugucgccaccaagugcagguggg

SEQ ID NO: 173110 - RNA, 48 nt, Homo sapiens
cacgauuauauuuguuguuaucaaauguaguauuauuaaaaucaauag

SEQ ID NO: 173111 - RNA, 46 nt, Homo sapiens
gcuuaaguauguggguuccccuuccucaccucaaaaauaccaggag

SEQ ID NO: 173112 - RNA, 44 nt, Homo sapiens
ccgacugguucgaaugugagaaccucuacucagcagaugaccag

SEQ ID NO: 173113 - RNA, 45 nt, Homo sapiens
gguccucacagacccacacacgcccuacgaggaggagcagcggca

SEQ ID NO: 173114 - RNA, 42 nt, Homo sapiens
ggguggugggucagugaagaucugggcagaccuugugugggg

SEQ ID NO: 173115 - RNA, 64 nt, Homo sapiens
auuugaaaagaggcucugaagccaguguuugaagaauuuguuccugaaguaccuccugggggua

SEQ ID NO: 173116 - RNA, 48 nt, Homo sapiens
agcugacugaagaaugccgaguuugacugugaaauagaaauguuaaaa

SEQ ID NO: 173117 - RNA, 49 nt, Homo sapiens
ccaguucuucugaaagugugacaguguccagccgguucugcagcacuag

SEQ ID NO: 173118 - RNA, 37 nt, Homo sapiens
gagacucagcaaggugguaaaagauacaaccagguac

SEQ ID NO: 173119 - RNA, 97 nt, Homo sapiens
aagaguucaacauagagaaaggucggcuugugcaaacccaaagacuaaagauuauggaauauuaugagaagaaagagaaacagauugagcagcagaa

SEQ ID NO: 173120 - RNA, 35 nt, Homo sapiens
ugaaaaugaaucacaauaaauuuucuguuuuauau

SEQ ID NO: 173121 - RNA, 46 nt, Homo sapiens
ccuagcauugcucucgccauggcucucagcgaugcugacgugcaaa

SEQ ID NO: 173122 - RNA, 36 nt, Homo sapiens
gaacuuccgaacgucgcaaucagauuugggcgggcu

SEQ ID NO: 173123 - RNA, 63 nt, Homo sapiens
agacuguaauaggaaaaauacaggucuaggaaaaaaauaauuuuuuuccuuugaugcuggcca

SEQ ID NO: 173124 - RNA, 40 nt, Homo sapiens
caggaaggaagaggagccagaaugacccacagugaucagu

SEQ ID NO: 173125 - RNA, 108 nt, Homo sapiens
auaccaccugucaagggcauaguuaccauguggauagaaagaugaguccacugauuaucuucaaaucccauguauucucucuagcacguugcuucugacagaaagaau

SEQ ID NO: 173126 - RNA, 46 nt, Homo sapiens
ugaauguuacgaucuuguuuucaaaaccuggagucaaaccaauuaa

SEQ ID NO: 173127 - RNA, 46 nt, Homo sapiens
accagaaccuacgcaccuacgugaggagcuuagccagaaauguaag

SEQ ID NO: 173128 - RNA, 44 nt, Homo sapiens
ccaggucggggacagcauggaccguagcaucccuccgggccugg

SEQ ID NO: 173129 - RNA, 47 nt, Homo sapiens
acauauuuccuuucauacauuaugcuccgugauuaccuauacaagaa

SEQ ID NO: 173130 - RNA, 41 nt, Homo sapiens
uggaccaacauagaaugguguuuuuauccaauuuuccaaau

SEQ ID NO: 173131 - RNA, 43 nt, Homo sapiens
aaccgcagcagccacucccgcuugggaagaauagaggcaggua

SEQ ID NO: 173132 - RNA, 42 nt, Homo sapiens
cugggccacgagcugccagugcuggcuccccagugggagggc

SEQ ID NO: 173133 - RNA, 30 nt, Homo sapiens
cugccauccaccaugccccacccagaagcc

SEQ ID NO: 173134 - RNA, 32 nt, Homo sapiens
gauggagcugaagcacaggacagagacaagca

SEQ ID NO: 173135 - RNA, 41 nt, Homo sapiens
agccccggagaggagaaaacccgcgggccuggccgggugca

SEQ ID NO: 173136 - RNA, 47 nt, Homo sapiens
uagucgaccguguccgcgcgccugggagacgcugccucggcccggac

SEQ ID NO: 173137 - RNA, 40 nt, Homo sapiens
aggggcaguagcccaagaaagagcugaguuaaaugagcau

SEQ ID NO: 173138 - RNA, 40 nt, Homo sapiens
uggguagagacuaacugucuagcagacaccacugcagaua

SEQ ID NO: 173139 - RNA, 43 nt, Homo sapiens
ccgcacgucuccgguggcauuuucuguaucuucguggggaggu

SEQ ID NO: 173140 - RNA, 41 nt, Homo sapiens
agccgcuuaagcuccuccugcuuggccugucuccgagcugc

SEQ ID NO: 173141 - RNA, 46 nt, Homo sapiens
ucacagacaaaaccugcuccaccuucucugugcugauugguggcug

SEQ ID NO: 173142 - RNA, 85 nt, Homo sapiens
cgguauuugagauugacugacaguccccauuuauuugaaaacuugucggaucauauagggaauugcaggagagauguggcaugca

SEQ ID NO: 173143 - RNA, 34 nt, Homo sapiens
aagaacuaacccuaguuucccaaagaguuuguga

SEQ ID NO: 173144 - RNA, 50 nt, Homo sapiens
uuccagggaugcaagaauccugcaaaucugacguguaaacugcuucccca

SEQ ID NO: 173145 - RNA, 50 nt, Homo sapiens
ccccuuccuuuuccuucucggggaaucgaccucgggaaggggugugggca

SEQ ID NO: 173146 - RNA, 48 nt, Homo sapiens
ggucacuccgacgucugaggaccugggccuuggacccggacucguuau

SEQ ID NO: 173147 - RNA, 46 nt, Homo sapiens
cgggcgccggccguggaccuucuggaggaggcggccgaccuccugg

SEQ ID NO: 173148 - RNA, 46 nt, Homo sapiens
gugcucccuguguguuguggggauccaggcccuggcagaaauggau

SEQ ID NO: 173149 - RNA, 47 nt, Homo sapiens
ucuccuaaauaccuacucuuuuccccuucccuacuauugcccuccag

SEQ ID NO: 173150 - RNA, 46 nt, Homo sapiens
auaacugggagugagggagauugaaccgcaaggaaccaucacagaa

SEQ ID NO: 173151 - RNA, 52 nt, Homo sapiens
guuuccgucacauagcucagaguuguccuucuaacccgucugcugaaugcug

SEQ ID NO: 173152 - RNA, 45 nt, Homo sapiens
accacagccucucugcuccucacguccguggccacagaagcagag

SEQ ID NO: 173153 - RNA, 40 nt, Homo sapiens
cucuguuacgcucagugccucugcccacucuuuccccgcc

SEQ ID NO: 173154 - RNA, 49 nt, Homo sapiens
acuggcgauuaaaaugugguggucucagugggagagguggcugaggaca

SEQ ID NO: 173155 - RNA, 28 nt, Homo sapiens
gcugggcaaucaaaggcuagagaaggag

SEQ ID NO: 173156 - RNA, 25 nt, Homo sapiens
ggaugggacuggggaagccagcagg

SEQ ID NO: 173157 - RNA, 44 nt, Homo sapiens
ccaagcgggccuuugugcauugguaugugggagaggggauggaa

SEQ ID NO: 173158 - RNA, 41 nt, Homo sapiens
uggcacagcauaaauaaagagacacagccaaggggaaggua

SEQ ID NO: 173159 - RNA, 58 nt, Homo sapiens
cagcuauucauacaagagaugugagaagcaccauaaaaggcguugugaggaguugugg

SEQ ID NO: 173160 - RNA, 42 nt, Homo sapiens
uuuaauucuugcaauccauggaugcauaaauucacuggggga

SEQ ID NO: 173161 - RNA, 27 nt, Homo sapiens
uagaaacccuauuagccagaaaggaaa

SEQ ID NO: 173162 - RNA, 47 nt, Homo sapiens
aucacuccacacuacuucuaagaguaaaaauuguagaaauuacccug

SEQ ID NO: 173163 - RNA, 42 nt, Homo sapiens
agggaacuguuacagggaaccugaaaauaggaauucccccaa

SEQ ID NO: 173164 - RNA, 46 nt, Homo sapiens
aaguuugaaguacaaguaacagugccaaagauaaucaccaucuugg

SEQ ID NO: 173165 - RNA, 57 nt, Homo sapiens
ggaaggaguaugaaaugaaacuucacacugaggcccagauccaagaagaaggaacag

SEQ ID NO: 173166 - RNA, 46 nt, Homo sapiens
auaucccuucuacagaugugaauguuaaaaguuuaauuuaaguuaa

SEQ ID NO: 173167 - RNA, 54 nt, Homo sapiens
augaacugaauaguaaucaagcauuuauuuauagucccauauugucaaaucaug

SEQ ID NO: 173168 - RNA, 28 nt, Homo sapiens
gcauguugaagagccucacacggagacc

SEQ ID NO: 173169 - RNA, 47 nt, Homo sapiens
uugguggugguaaaguaaguaacuuccugcauaugcaauaugcaaca

SEQ ID NO: 173170 - RNA, 44 nt, Homo sapiens
cuucugccugucugaagaugcuggacuugguaucucuuccacug

SEQ ID NO: 173171 - RNA, 44 nt, Homo sapiens
gagaggccuucacacucaaggccacgguccuaaacuaccuuccc

SEQ ID NO: 173172 - RNA, 89 nt, Homo sapiens
agugugcagcuggaagccucucccgccuuccuagcugucccaguggagaaggaacaagcgccucacugcaucugugcaaacgggcggca

SEQ ID NO: 173173 - RNA, 48 nt, Homo sapiens
gagucucaagagcugugugggacugaggugccuucaguuccugaacac

SEQ ID NO: 173174 - RNA, 42 nt, Homo sapiens
uucauuuguauauaauucaccaauacuaaaauuguaguaaau

SEQ ID NO: 173175 - RNA, 42 nt, Homo sapiens
guacuggauuaucuaaaugaaacacagcagcuuacuccagag

SEQ ID NO: 173176 - RNA, 25 nt, Homo sapiens
ccucagaaacccaaggcaccagugg

SEQ ID NO: 173177 - RNA, 45 nt, Homo sapiens
uggaguagccaaagcucagaauccccagugaauacccuucugggg

SEQ ID NO: 173178 - RNA, 47 nt, Homo sapiens
uacccuuagggcuccucagccagaucuuuggcuagaaccauggucaa

SEQ ID NO: 173179 - RNA, 45 nt, Homo sapiens
uaaagauaacugcuggaaaacuuauaaacauaggggugcaacaau

SEQ ID NO: 173180 - RNA, 24 nt, Homo sapiens
uuuaauucaguggcauaugcgcua

SEQ ID NO: 173181 - RNA, 42 nt, Homo sapiens
auuaccugaggagggacaaggaaaauggagcuaugggguggg

SEQ ID NO: 173182 - RNA, 96 nt, Homo sapiens
uuuccccacagaaaugugggcaagaagacacuucccugagccagcagaagggacaggugcagcagcauuccacacccagcgcagaggacagcagag

SEQ ID NO: 173183 - RNA, 42 nt, Homo sapiens
uuuuguguccaguggagccauguuacucuucaguggcccagg

SEQ ID NO: 173184 - RNA, 42 nt, Homo sapiens
aguaagacgaaaggauuccccacggacuacugaguaagggag

SEQ ID NO: 173185 - RNA, 48 nt, Homo sapiens
auuccccggccaaaccuccuuggcuaucacuucccucgauggccuuug

SEQ ID NO: 173186 - RNA, 59 nt, Homo sapiens
aagucccauucaggugaguuuguacacaacaucaagaagcgagccucuccucaauuagg

SEQ ID NO: 173187 - RNA, 47 nt, Homo sapiens
ggccauaaguuccaccacacuauugguggcucucgccgggcagcuug

SEQ ID NO: 173188 - RNA, 41 nt, Homo sapiens
uccacaagcacagggagaugcgugggcugacaucugcaggc

SEQ ID NO: 173189 - RNA, 49 nt, Homo sapiens
acuuacggcaagccuguccaucaugguguuaaccagcuaaaguuugcuc

SEQ ID NO: 173190 - RNA, 45 nt, Homo sapiens
cagcucucugcucuccacagggcuccccgccccacccggccugau

SEQ ID NO: 173191 - RNA, 46 nt, Homo sapiens
gcaaggcaagcuuuggggacaagcuggauccacacucauguuagua

SEQ ID NO: 173192 - RNA, 44 nt, Homo sapiens
gcaaggauggauaguuuucuucaggcccacaaaucacaggcaua

SEQ ID NO: 173193 - RNA, 43 nt, Homo sapiens
auuguuacucugguucuuuguuuuaaaauaaaaauucugaaug

SEQ ID NO: 173194 - RNA, 63 nt, Homo sapiens
augcacauagcuaucaagugugcuuuagcuugaaaaggugaccuugcaacuucaugucaacuu

SEQ ID NO: 173195 - RNA, 61 nt, Homo sapiens
uauguugcucagucucccuuucccuucuuggugcuuacacaucucagacccuuuagccaaa

SEQ ID NO: 173196 - RNA, 51 nt, Homo sapiens
ucaccaagguccaaacuccauuuauaaaaauacugcaaaaccaggaguuga

SEQ ID NO: 173197 - RNA, 66 nt, Homo sapiens
cucuuggggucccuugaugggggcuguugggaaguggaaggcauucuuuuaaggggauaagaagca

SEQ ID NO: 173198 - RNA, 54 nt, Homo sapiens
ccaugcucuuaucucgcacuuucuuuccuauuccccuugccugaaucuggagug

SEQ ID NO: 173199 - RNA, 105 nt, Homo sapiens
ccaaguuagacaguuggggaaagaacuuccuaaaucuuaagguugaaggcagagggcucaaccccacuccagauucaggcaaggggaauaggaaagaaagugcga

SEQ ID NO: 173200 - RNA, 76 nt, Homo sapiens
uauguacauaaauaacauugccucugcugaguggaauuugcauucguuacuucaaaauucagacucaucuaccuuu

SEQ ID NO: 173201 - RNA, 110 nt, Homo sapiens
aacucauaccuuuaaaggaauuccccaaagaauguuuauagcaaacuuggaauuuguaaccucagcucugggagaggauuuuuuucugagcgauuauuaucuaaagugug

SEQ ID NO: 173202 - RNA, 52 nt, Homo sapiens
gguagagauucauuauuuuuccacuuuguucuuuaggagauuuuagguguug

SEQ ID NO: 173203 - RNA, 45 nt, Homo sapiens
agaaggaguuauuucauccagugaggggaacaggcuuucuagaaa

SEQ ID NO: 173204 - RNA, 82 nt, Homo sapiens
guacuugaaaucuaggauuauuaacuaauaugggcauuguaguuaaugaugguugauggguucuaauuuuggauggagucca

SEQ ID NO: 173205 - RNA, 117 nt, Homo sapiens
aagaauuuagggagaaauguuguucauuauuggaggguaaaugauguggugccugaggucuguacguuaccucuuaacaauuucuguccuucagauggaaacucuuuaacuucucgu

SEQ ID NO: 173206 - RNA, 79 nt, Homo sapiens
uuuccaucugaaggacagaaauuguuaagagguaacguacagaccucaggcaccacaucauuuacccuccaauaaugaa

SEQ ID NO: 173207 - RNA, 72 nt, Homo sapiens
gagauuagagggagguguuuaaagagagguuauagaguagaagauuugaugcuggagagguuaaggugcaau

SEQ ID NO: 173208 - RNA, 80 nt, Homo sapiens
aaaccagaggauaaaauaaauaaaacucaaguuaauuugccacguagagcuguauggaagugaggaaggugcucuuacau

SEQ ID NO: 173209 - RNA, 61 nt, Homo sapiens
gugcaguucccccaaccucagacuuaccaggaagcagauacauaugaguguggaagccgga

SEQ ID NO: 173210 - RNA, 40 nt, Homo sapiens
auguaucugcuuccugguaagucugagguugggggaacug

SEQ ID NO: 173211 - RNA, 74 nt, Homo sapiens
uauccccuagugcggcaauaucagaacccaagggaggaaaagcuggcaaaguugucaugugccaagcggccaau

SEQ ID NO: 173212 - RNA, 40 nt, Homo sapiens
acgcacuccaugagcaccccaaggcugcgguuuguuggau

SEQ ID NO: 173213 - RNA, 63 nt, Homo sapiens
uucagaagcguccuggguucauccugaugaggucucucccuuguugagggagagguggcuuuc

SEQ ID NO: 173214 - RNA, 53 nt, Homo sapiens
gccaccucucccucaacaagggagagaccucaucaggaugaacccaggacgcu

SEQ ID NO: 173215 - RNA, 45 nt, Homo sapiens
ucaaaaguccugccacgggucucagggacuuugaagaagguaaaa

SEQ ID NO: 173216 - RNA, 122 nt, Homo sapiens
gcacuauuuaggagccuacguuuuuauuaucuucaccggcuuccucauuaccuucuuggcuuuuaccuucuucaaagucccugagacccguggcaggacuuuugaggauaucacacgggccu

SEQ ID NO: 173217 - RNA, 30 nt, Homo sapiens
aacucaccuuaucuuaaaaccagccuaugu

SEQ ID NO: 173218 - RNA, 46 nt, Homo sapiens
aagagcaauccgacuaggaaguuggagguccaguuggagcagccgg

SEQ ID NO: 173219 - RNA, 48 nt, Homo sapiens
gcgauggcaguggccggcugcuccaacuggaccuccaacuuccuaguc

SEQ ID NO: 173220 - RNA, 49 nt, Homo sapiens
cuuggucuuuguagccuucuuugaaauuggaccaggccccauucccugg

SEQ ID NO: 173221 - RNA, 45 nt, Homo sapiens
caaagaaacagucaugagcguggaacaaaaagccaucccuccaag

SEQ ID NO: 173222 - RNA, 49 nt, Homo sapiens
gaaagggcaggaagaaggacucugcauaugauaggccuuggagggaugg

SEQ ID NO: 173223 - RNA, 42 nt, Homo sapiens
gagauaaauuuaauguuggauguagucuucacucuucaagca

SEQ ID NO: 173224 - RNA, 45 nt, Homo sapiens
acagugaagauaguauuaaccacacccgcgccgaugguggcauag

SEQ ID NO: 173225 - RNA, 33 nt, Homo sapiens
gaaucuucaaggaugcagguguucaagagccca

SEQ ID NO: 173226 - RNA, 45 nt, Homo sapiens
cagcuaccgacagcccaucaucauuuccauugugcuccagcucuc

SEQ ID NO: 173227 - RNA, 47 nt, Homo sapiens
agcgguuguggggcacccaggauguaucccaagacauccaggagaug

SEQ ID NO: 173228 - RNA, 42 nt, Homo sapiens
ucuuuucuguuaaugagcaaaaaucugggacuuucagggcaa

SEQ ID NO: 173229 - RNA, 80 nt, Homo sapiens
uccugcuauccuacaaagugcagcccuuccauuuugcccugaaagucccagauuuuugcucauuaacagaaaagaagagg

SEQ ID NO: 173230 - RNA, 47 nt, Homo sapiens
aggaaaagaaacacaauuuguuuauuuuuucacaugguaaaagaaug

SEQ ID NO: 173231 - RNA, 38 nt, Homo sapiens
aucuggcacauguucaauuacauauggaaguuuuagau

SEQ ID NO: 173232 - RNA, 46 nt, Homo sapiens
uauucuucagugcuuuaccuauguuaacuuuuuuaaugacccauga

SEQ ID NO: 173233 - RNA, 86 nt, Homo sapiens
uggagagaucucgccuacugcccugcggggugccuuuggcacucucaaccagcugggcaucguuguuggaauucugguggcccagg

SEQ ID NO: 173234 - RNA, 45 nt, Homo sapiens
ccagcugguugagagugccaaaggcaccccgcagggcaguaggcg

SEQ ID NO: 173235 - RNA, 45 nt, Homo sapiens
ccugugcagaguccgcagaagaggccaauaaccaagcgacccagg

SEQ ID NO: 173236 - RNA, 69 nt, Homo sapiens
gcaauucaaugcugauugucaaccuguuggcugucacugguggcugcuuuaugggacuguguaaaguag

SEQ ID NO: 173237 - RNA, 27 nt, Homo sapiens
aaaaaaaaaagggaugauaugagccug

SEQ ID NO: 173238 - RNA, 59 nt, Homo sapiens
ggcucuaccagccacauugaggacaaguguggagaguuagggcagggaggugaugaugc

SEQ ID NO: 173239 - RNA, 49 nt, Homo sapiens
aucggcuccuuuuccgucggacucuucgucaaccgcuuuggcagguauu

SEQ ID NO: 173240 - RNA, 43 nt, Homo sapiens
uuuauuuugcagaucauaaaggaauuuaucaauaaaacuuuga

SEQ ID NO: 173241 - RNA, 202 nt, Homo sapiens
gccacaauaauuagaauuuagaauagggaaguuauuccuuuaaguaggguuucaggaauucagaauuuaaggccaggcaugguggcaucugccuggagucccagcuacuccugaggcugaggcuuaaagaucacuugaguccaggaguuaaacaccauccugagcaacacaguuagugagggucccuccccaaacuagggga

SEQ ID NO: 173242 - RNA, 200 nt, Homo sapiens
aaaauccccuaguuuggggagggacccucacuaacuguguugcucaggaugguguuuaacuccuggacucaagugaucuuuaagccucagccucaggaguagcugggacuccaggcagaugccaccaugccuggccuuaaauucugaauuccugaaacccuacuuaaaggaauaacuucccuauucuaaauucuaauuau

SEQ ID NO: 173243 - RNA, 97 nt, Homo sapiens
aggucaccccagcucugauauuugccaucacaguugcuacaaucggcucuuuccaauuuggcuacaacacuggggucaucaaugcuccugagaaggu

SEQ ID NO: 173244 - RNA, 70 nt, Homo sapiens
aaagaauuccaguuguccuuccuauuaggguuaaaaucgugagugcaggacauacuaaaauauugagugu

SEQ ID NO: 173245 - RNA, 82 nt, Homo sapiens
gguaaccauaugccacugaggacgagaugguugaguguuuagaggaucgggcugcuugguuguauggauuacaagugugggu

SEQ ID NO: 173246 - RNA, 42 nt, Homo sapiens
ccuuguucuauuuucuccuaagucaccaagcuaucuuaaggc

SEQ ID NO: 173247 - RNA, 95 nt, Homo sapiens
gagaaaacuugcugcugagaaggacauuuugaagguuuuguuggcugaaaaagcuguuucuggaaucaccccuagaucuuucuugaagacuugaa

SEQ ID NO: 173248 - RNA, 67 nt, Homo sapiens
cuucacccacccugccaccuccaguacugaaaggguugcaagcuacaaaugaaugggcauuaggaau

SEQ ID NO: 173249 - RNA, 54 nt, Homo sapiens
ccgagaaaacuagauuacuguugcuuccuuugcuuuaacgaggauauuguuaaa

SEQ ID NO: 173250 - RNA, 47 nt, Homo sapiens
cgucugcacuugcuuacgcagccuuuuacaaaagcaagacgccagca

SEQ ID NO: 173251 - RNA, 45 nt, Homo sapiens
guuccuuucugugcacgucagaagaugacaggcaagaaaacaaag

SEQ ID NO: 173252 - RNA, 41 nt, Homo sapiens
aaaagaaaaagaacaagaaagggaguuguaaaaaaaaaaaa

SEQ ID NO: 173253 - RNA, 47 nt, Homo sapiens
gaauggaauuggaagaagcaaaaauuuuggcuaggagggguggggac

SEQ ID NO: 173254 - RNA, 38 nt, Homo sapiens
uggggucgaggaaagcaauagaaagacgagauuuaaaa

SEQ ID NO: 173255 - RNA, 52 nt, Homo sapiens
aagaucagggagaagauaaaaggaaaggaaauugcgagaguauaaugaggcc

SEQ ID NO: 173256 - RNA, 45 nt, Homo sapiens
ugagaucaguggcuuguggauuguguauuuaguuaggccugaaga

SEQ ID NO: 173257 - RNA, 78 nt, Homo sapiens
aaagaugaaaagaauuuugugagaaauagauuuggaaagauaauuccaggcagagagaugcuacuaccaaagaaggaa

SEQ ID NO: 173258 - RNA, 943 nt, Homo sapiens
uugaccauccagguaaaucgcgagcccaacgauguggggagggcagaccccauucugggcggccgcuaaccagcugcgcuugggcccaagguuggauggaugcagacccgcuugggcuguucccccaacucgccacgcagccugcaguggaguuggcugcacagugaagucaggggaacuuugcugaguucucugggcccugaguguccccccaggagcgugguuggagccagucaggaagccuguugcacuguggggagcccugcccugcccugccacaacugugauccuggagaaauccucccaucuucccuucccacguuggggccuuuagggcccuccacacacaccucugcccacugugcccucccgugcuuuggggcaaaguccucagagaggccagugugggaggcgguagguaaacuagugcugguggcuugaagcuccgggccagguaaacgggcagaugcggcagggagacaccugccacugcuagaagauuccacccuggcuggcuggcauggucagccuuuucccaaggacuugugggaagaaggccugcaaagccgcagucuaaccaguuagucccagaaagagagagaagcagaggcccagccuacccaccucccaggaagagcugaucagaaaaccccuguguuccggcaucucaggggcacagagcuugggcaguggcacagcccgagaacagcaaggacagggucauccuguggucugcagggcugcagagggcacuguugcuaccaaacauacacugccguaguccuagucuaccugugcuaggguucucgguguccccagcacccagcugugcugaccccagagcagagaggguucccugcuguccgcugcacgagggcaucugccugucuugccuuugucuccaacccugcagaugccuuugauaaugauuugaugcacagga

SEQ ID NO: 173259 - RNA, 46 nt, Homo sapiens
ugaagagaaauuggagagggagucaauuccuaggauagcagagaga

SEQ ID NO: 173260 - RNA, 28 nt, Homo sapiens
acacggaggaaaggaaaaggguuucacc

SEQ ID NO: 173261 - RNA, 45 nt, Homo sapiens
gucguguggaugugauggacccugcccuuuggcugccuuucccag

SEQ ID NO: 173262 - RNA, 59 nt, Homo sapiens
gucucugaggcucuacaugcugggcugcccuucacaaauggggaagugaagagggugag

SEQ ID NO: 173263 - RNA, 39 nt, Homo sapiens
gcugggggcuguaucuggagggcugacuggaagggggcu

SEQ ID NO: 173264 - RNA, 45 nt, Homo sapiens
ggccucccgggagcagccgcaaguguucaccagggucacccacag

SEQ ID NO: 173265 - RNA, 53 nt, Homo sapiens
agccacgauacagcuaugccacucucaucaccuaugccaucaacuccucucca

SEQ ID NO: 173266 - RNA, 45 nt, Homo sapiens
cgcuggaucugugauaacuuccccuauuacaagaaugcuggcauu

SEQ ID NO: 173267 - RNA, 35 nt, Homo sapiens
auugagaaggaaggggaaggcaaaagagggaaaua

SEQ ID NO: 173268 - RNA, 34 nt, Homo sapiens
aaaucccuaaaaaguagcauuaaaugcuacacac

SEQ ID NO: 173269 - RNA, 45 nt, Homo sapiens; identical to SEQ ID NO: 96897

SEQ ID NO: 173270 - RNA, 45 nt, Homo sapiens
ucauagcagagccaaaccuuuaguguuggugguaggaggaugggg

SEQ ID NO: 173271 - RNA, 35 nt, Homo sapiens
cucccaugauguuggagggcacuuagugggguuga

SEQ ID NO: 173272 - RNA, 49 nt, Homo sapiens
uccagucaggguguguccuauacaaaacuucccaucaguucuccucaau

SEQ ID NO: 173273 - RNA, 42 nt, Homo sapiens
gcaaggcaguccauucagggaauucuggaggcagccuucagu

SEQ ID NO: 173274 - RNA, 32 nt, Homo sapiens
uccgaaugcaaaggggccgcuucgccaagucu

SEQ ID NO: 173275 - RNA, 77 nt, Homo sapiens
ccauucugcuaggucacagauauaaccaagcaauuuucuuguuguuucaggcuguccucuggagucaccaaggagag

SEQ ID NO: 173276 - RNA, 52 nt, Homo sapiens
accauugcuccuaguauaauagauuaauuuucuuuacuuaaguuucuugggu

SEQ ID NO: 173277 - RNA, 44 nt, Homo sapiens
augugccagauagcuaaccccaugcucaguucuggucucaguga

SEQ ID NO: 173278 - RNA, 37 nt, Homo sapiens
aggcguugcuuugcgcuucguguuccuugggauacag

SEQ ID NO: 173279 - RNA, 80 nt, Homo sapiens
auucucaguauccacugucuauguacaauaaaggauguuuauaagcaaauuuugugugacuuaccucauuccacaccaaa

SEQ ID NO: 173280 - RNA, 46 nt, Homo sapiens
auuacuacauggaaaauggaggaggugguagguuucuucuacugga

SEQ ID NO: 173281 - RNA, 43 nt, Homo sapiens
ucucuguuaguuaauugcaguggggauguauucacugcacuga

SEQ ID NO: 173282 - RNA, 57 nt, Homo sapiens
cugccaccccuuaggcuccaaaguccggaggugcagaaagccaggaccaagagacag

SEQ ID NO: 173283 - RNA, 43 nt, Homo sapiens
ggggcucccggaguuaagauggcguccucagcggagggggacg

SEQ ID NO: 173284 - RNA, 42 nt, Homo sapiens
ccuuguuucugacccaguuauuuuugacauuguaauuagcaa

SEQ ID NO: 173285 - RNA, 46 nt, Homo sapiens
ucaucaaaauuaaaagcuuuugugcaccaaaggauacuaucaagaa

SEQ ID NO: 173286 - RNA, 54 nt, Homo sapiens
aagcaguaacagagagggcaggagagaaagaucagaaggaaucggacgccugag

SEQ ID NO: 173287 - RNA, 37 nt, Homo sapiens
guaaaaaccaggcuaaauucucucuucuugcauccag

SEQ ID NO: 173288 - RNA, 56 nt, Homo sapiens
cgcugcauguacaugcugaucuggggcaaguuugugcuguacaaauaugucaccug

SEQ ID NO: 173289 - RNA, 45 nt, Homo sapiens
uugacgggccugggcuucaauggcuuugaagaaaagggcaaggca

SEQ ID NO: 173290 - RNA, 85 nt, Homo sapiens
caacaugaagguguggcucuuugaaacaaacccccgcuucacuggcaccauugccucauucaacaucaacaccaacgccugggug

SEQ ID NO: 173291 - RNA, 39 nt, Homo sapiens
gcaucagccucagucacugcugcugaaccaaguggcucg

SEQ ID NO: 173292 - RNA, 63 nt, Homo sapiens
ugaggacccagaggcagguggcgggaugcaaggaccagucaguuugagggucgccccacccac

SEQ ID NO: 173293 - RNA, 44 nt, Homo sapiens
gcccucuggcacggccugcacucaggauaccuggucugcuucca

SEQ ID NO: 173294 - RNA, 48 nt, Homo sapiens
gagagccccacccugagcaagcuggccgccauuacuguccuccagccc

SEQ ID NO: 173295 - RNA, 55 nt, Homo sapiens
auucauauugccuuauauucacaaagcaauggugccaaggaaagagaaguuaaag

SEQ ID NO: 173296 - RNA, 46 nt, Homo sapiens
gauucccccaugcacauugccuuaucucuccccaucuagccaggaa

SEQ ID NO: 173297 - RNA, 75 nt, Homo sapiens
gcauuccugacugcucucuuucacaguucuucuccaucaucaggguucucuccuuuagcacaugggaaucuggga

SEQ ID NO: 173298 - RNA, 38 nt, Homo sapiens
uacaccacuggauacuuuaggaaccccaaaacaaccag

SEQ ID NO: 173299 - RNA, 48 nt, Homo sapiens
cugagcuuguguaaaaguugaacuagaagggggaaaaaagaguucaga

SEQ ID NO: 173300 - RNA, 90 nt, Homo sapiens
agaacauucuucuguguauggauauaaaccuguagcaagccagcucgguucaggggacuauccaucagcaucagcaaacucugagcaaag

SEQ ID NO: 173301 - RNA, 44 nt, Homo sapiens
ccagggucccguccauucuucaacaauauagacuugugcuuguc

SEQ ID NO: 173302 - RNA, 46 nt, Homo sapiens
gcuuagguacugcacccuucacacgaggguucgggcccguaaggcu

SEQ ID NO: 173303 - RNA, 77 nt, Homo sapiens
gaacacagauucgcgcacaccguaggccacggcgccggcccccagcaacagcuucagggccgugcccaugccccggg

SEQ ID NO: 173304 - RNA, 45 nt, Homo sapiens
accaaugcuauugaucuggccuuacaguggggagucauggcucag

SEQ ID NO: 173305 - RNA, 45 nt, Homo sapiens
uucauccuguagguucagcacaagguugucagcugugagauagau

SEQ ID NO: 173306 - RNA, 46 nt, Homo sapiens
gugggagaaauggagggugugugaagagcacagcugggccucgaga

SEQ ID NO: 173307 - RNA, 68 nt, Homo sapiens
agugccccauucuuuuguaauuuaaauggcugcaucccccccaccucucccugacccuguauauagcc

SEQ ID NO: 173308 - RNA, 57 nt, Homo sapiens
cagcccugacccuguggaagcauuucgcgauggacagacucacaaccugaaccuagg

SEQ ID NO: 173309 - RNA, 46 nt, Homo sapiens
guacagcucuucugccuggguguccucccugcccugcccugugucc

SEQ ID NO: 173310 - RNA, 45 nt, Homo sapiens
gacacaaggaggauguguaugagaaccugcacacuaagaacaaga

SEQ ID NO: 173311 - RNA, 45 nt, Homo sapiens
uggccaucgcccaguucauugaaaccacuaagaagaagcuggagg

SEQ ID NO: 173312 - RNA, 74 nt, Homo sapiens
cuguccuguggggucaaauaggucuccggcccaaacagagaucauugagagcacgaugugaaguguucaccugu

SEQ ID NO: 173313 - RNA, 45 nt, Homo sapiens
cuuacugcauguguugucacauaugugcaaugccaugcuccugag

SEQ ID NO: 173314 - RNA, 42 nt, Homo sapiens
cugcguggccacgggcagcacgaauugcagcaucuuacccau

SEQ ID NO: 173315 - RNA, 43 nt, Homo sapiens
ugcucagcgcucaaggccgccgguugggucgaggcggacgcca

SEQ ID NO: 173316 - RNA, 46 nt, Homo sapiens
gguucagcggagguaaauggaaaacucacgaauaaagagccacguc

SEQ ID NO: 173317 - RNA, 46 nt, Homo sapiens
cuggggaguugugaggauguuuuuguuugguugguuuugguuggga

SEQ ID NO: 173318 - RNA, 55 nt, Homo sapiens
cugguccaagauucugugcgcuuucuguccccauccucgccaccuccccaccucu

SEQ ID NO: 173319 - RNA, 60 nt, Homo sapiens
gcacaccacaucgggccuuggccuucugucugucccucccucccccacucucuguccagc

SEQ ID NO: 173320 - RNA, 43 nt, Homo sapiens
accaaagagcuggugacgaagaacuucguucucgugcagaggg

SEQ ID NO: 173321 - RNA, 63 nt, Homo sapiens
uucagggcagcaaucucaggaaagguucaugccaggccaggggaggaaagucuuggccauagg

SEQ ID NO: 173322 - RNA, 43 nt, Homo sapiens
gcccagcugccagcgcuagacguucucgcuccaggggccccag

SEQ ID NO: 173323 - RNA, 81 nt, Homo sapiens
acggugggggcccagguggggaggccguuuuguagccugcuggcgaggaagccacgguggcaaugaccguggaaaggguag

SEQ ID NO: 173324 - RNA, 88 nt, Homo sapiens
ccggugggaaaggguagggcgccccuugagggcccugggaaggggaggggugugaacauggguaggacccuugagaaguggaagagga

SEQ ID NO: 173325 - RNA, 41 nt, Homo sapiens
cccugguggguagggccucagagaccccagggagggagaca

SEQ ID NO: 173326 - RNA, 81 nt, Homo sapiens
ggggcccagaguuuccgugaugcugcugcugcugcugcugcugcugcugcugcugcugcugcugcuguugcuguugcuggu

SEQ ID NO: 173327 - RNA, 48 nt, Homo sapiens
gggaaggggccuggaugggcauugcuguuggcuaagaggcggccauag

SEQ ID NO: 173328 - RNA, 45 nt, Homo sapiens
ggguagcugggcaaugccugggaagcugggaagggggaggcagag

SEQ ID NO: 173329 - RNA, 44 nt, Homo sapiens
cuacuagaggaugaauaaggaaaccucauggggggcgcuggagc

SEQ ID NO: 173330 - RNA, 44 nt, Homo sapiens
agggggagaggcugaugcauuguugaggggucucagggcaggug

SEQ ID NO: 173331 - RNA, 100 nt, Homo sapiens
gggcuccaugggagcaugauauccagugggugucacagaaggaugggguucaaagcuagccucuggcugucgaggggugcugucuggcgguugaggggaa

SEQ ID NO: 173332 - RNA, 35 nt, Homo sapiens
aaggaguggcagacgaggaaaggaguuaggggugg

SEQ ID NO: 173333 - RNA, 389 nt, Homo sapiens
cuggccacauacuaagcacauucaccuucauuaccuugcuuuauuuuauuuauuuauuuauuuauuuauuuauugagacggagucucacucugucacccaggcuggagugccgugccgcgaucucggcucggcucacugcaagcuccaccucccggguucacgccauucuccugccucagccuccugaguagcugggacuacaggcgcccgccaccacgcccggcuaauuuuuuuguauuuuuacuagagacgggguuucaccguguuagccaggauggucucaaucgccugaccucgugauccgcccgccucagccucccaaagugcugggauuacaggcgugagccacugcgcacugccauuaccuuacuuuaaaaagaaaaugauu

SEQ ID NO: 173334 - RNA, 62 nt, Homo sapiens
aagguaccuacccuagucaaaauaagcccaugcacaaagggagaucuuugagcucaaagcag

SEQ ID NO: 173335 - RNA, 57 nt, Homo sapiens
cauccucccagaaccccuuucuucccaacucccccuucuguguuccuguuuuccucc

SEQ ID NO: 173336 - RNA, 59 nt, Homo sapiens
gccacaaucccucuuuccaccuaccacaccccuuucccguuucccacuucccgucuauu

SEQ ID NO: 173337 - RNA, 44 nt, Homo sapiens
cguuuuccuccgccaaccccggccucgauguuccuccucuuuug

SEQ ID NO: 173338 - RNA, 57 nt, Homo sapiens
gugucuguauuucauguggcuguagaucccaagaugacuggggugggaggucuugcu

SEQ ID NO: 173339 - RNA, 44 nt, Homo sapiens
gcuggcccaggagaauggcuggggggucauggugagucaucgcu

SEQ ID NO: 173340 - RNA, 47 nt, Homo sapiens
auggggugcugacucaggcaccagguggggguguccuaagaagaacc

SEQ ID NO: 173341 - RNA, 44 nt, Homo sapiens
uggggcgagggcagaugaagggcccaggagcuuuggggcagcga

SEQ ID NO: 173342 - RNA, 48 nt, Homo sapiens
aacuuccggguaucucaaauuccccuuucagccaggugggcacacucg

SEQ ID NO: 173343 - RNA, 44 nt, Homo sapiens
ggaggaagaaagggagccggcguucaaggcuaugacagucugcu

SEQ ID NO: 173344 - RNA, 42 nt, Homo sapiens
uaaaggaagauacaguuuggaugaggccacaggaaggagcag

SEQ ID NO: 173345 - RNA, 69 nt, Homo sapiens
auggcccacacaggcucauaggccaggacgaccuugcuccaguccuucacguuaucugcagggcagaga

SEQ ID NO: 173346 - RNA, 37 nt, Homo sapiens
gcgcgccccggggccaccuuccuccaggagacccaaa

SEQ ID NO: 173347 - RNA, 85 nt, Homo sapiens
ucggccggcaccuuggccgcguucagagugccgaugagcucccccagacucugcuuccgcccguucaucuuccaguuucccccaa

SEQ ID NO: 173348 - RNA, 50 nt, Homo sapiens
uuuccugcccauaaagugagccccugcauggauuugagguuagaaggaga

SEQ ID NO: 173349 - RNA, 42 nt, Homo sapiens
gggcucagaaggcccugcucucucccauccaagugaccagau

SEQ ID NO: 173350 - RNA, 44 nt, Homo sapiens
guaucccccaguuccauaccuguaaguaguggacucucucaaga

SEQ ID NO: 173351 - RNA, 34 nt, Homo sapiens
ccaggaaccguagagacagacaggaacccaggaa

SEQ ID NO: 173352 - RNA, 71 nt, Homo sapiens
uuccagccaagagugcucagagaccauguggcagcccgagggaaggagggaauggagaguggagcccagcg

SEQ ID NO: 173353 - RNA, 57 nt, Homo sapiens
cugaaggacggugauggagcugaggagugggaacugaagcagaugcuggagcugggg

SEQ ID NO: 173354 - RNA, 67 nt, Homo sapiens
guauggcugaugaaguuggaggucaggugaugaugcuggggccuggauauuggggagaacagguggg

SEQ ID NO: 173355 - RNA, 46 nt, Homo sapiens
gccccagggauuuggggguggggcucagcccccuggacaggcugca

SEQ ID NO: 173356 - RNA, 86 nt, Homo sapiens
ugacaucagaagcauccagaaauggaaagagggggaacuagggagaaggaggagaguuugagcagaagagaaagagggggcaaagu

SEQ ID NO: 173357 - RNA, 45 nt, Homo sapiens
ggaggaaggauggucccaguuuuagugcgugaugcugagcuucag

SEQ ID NO: 173358 - RNA, 46 nt, Homo sapiens
cuccggagcccaguacacccuaguugccauggcaauggccagccag

SEQ ID NO: 173359 - RNA, 40 nt, Homo sapiens
caccuccacccaggcccagcuggugggcucaggaugaaag

SEQ ID NO: 173360 - RNA, 40 nt, Homo sapiens
cucccuggaggggaaggagggacgucccaaggaagggucu

SEQ ID NO: 173361 - RNA, 47 nt, Homo sapiens
gggacagcuggggucuccaguagauagaccacggugcaggcugaggg

SEQ ID NO: 173362 - RNA, 55 nt, Homo sapiens
ucaggagcccuggaaaggagaaggaauaagacggcaggaggaagagagagagagg

SEQ ID NO: 173363 - RNA, 54 nt, Homo sapiens
cagaugugcauggcugggagucugggucuguccuuaguuccuuaguguacccag

SEQ ID NO: 173364 - RNA, 48 nt, Homo sapiens
agcauuuauuuuuauuuguguuguauaguucuacuauggagaguagcc

SEQ ID NO: 173365 - RNA, 47 nt, Homo sapiens
ucacuuggcucaggugccggaugugcucacugacauucuacuccaag

SEQ ID NO: 173366 - RNA, 46 nt, Homo sapiens
gucacauugguacuaaacuaggcauuuccugucauuagggggcugg

SEQ ID NO: 173367 - RNA, 46 nt, Homo sapiens
ccuucaagugccacaacugucaucgggcguacacggaugcagccuc

SEQ ID NO: 173368 - RNA, 41 nt, Homo sapiens
acccuccaccccaguguuccuuugaccugaccccguauaag

SEQ ID NO: 173369 - RNA, 43 nt, Homo sapiens
augcaaaaggaaaaguuucagugucgggcggauguguaccggc

SEQ ID NO: 173370 - RNA, 46 nt, Homo sapiens
guuuugcuucgagauggcugcggggauguauuuggaacauuaucug

SEQ ID NO: 173371 - RNA, 48 nt, Homo sapiens
gagaaggucacaauuaugaagcgguucuguggcaggaaauauuggagg

SEQ ID NO: 173372 - RNA, 49 nt, Homo sapiens
auggguguagacgagggaggggugcgguguggggguuagagacgugucu

SEQ ID NO: 173373 - RNA, 110 nt, Homo sapiens
gaggaaaaugacuaauauaugguaaauuggagcaugauauuguugauaacagagaucaauuagugauaacauuccaggacagagauaagaaccugauuuuagggaguuac

SEQ ID NO: 173374 - RNA, 45 nt, Homo sapiens
uuggaagaacgaacaggaauuuaauaggccaagagggauggggug

SEQ ID NO: 173375 - RNA, 472 nt, Homo sapiens
gaccagaagguuauaagcgggagagugacuugauuagguuugcauuuuuuauuuuuguguuuguuuuuguuuuuguuuuuuugagucagugucuugcucugucauccaggcuggagugcauuggcgugaucucggcucacugaaauguccaccucccagguucaagggauuuuugugccccagccucccaaguagcugggauuacaggcaugugcaccaagccuggcuaaguuuuuguauuuuugguagagacagaguuucaccauguugcccaggcuggucuugaacuccucagcucagcugaugcgcccaccugggccucccaaagugcugggauuacaggcaugagccaccgugccuggccagguuugcauuuuuuaaaaaggacauucuggcuacuauauggaaguagauuggaaguguuauguguauaauagaggauaccaggagacuauuuguaauuugaggacaa

SEQ ID NO: 173376 - RNA, 46 nt, Homo sapiens
ucguuccaaagggaaaaacucggaugaagaagcccccaagacugcc

SEQ ID NO: 173377 - RNA, 34 nt, Homo sapiens
uucucuguuucagguuuugcccacgcugcuccca

SEQ ID NO: 173378 - RNA, 47 nt, Homo sapiens
uccaaaacuuuguaaaucaugcaucuuuucuccauaaaacaucuuuc

SEQ ID NO: 173379 - RNA, 28 nt, Homo sapiens
uuuuccccuuggacccauuuugcucaug

SEQ ID NO: 173380 - RNA, 61 nt, Homo sapiens
aaaugaaccugucugugugaagucuggccaaagaacaaauagaacuguagugggcuuccag

SEQ ID NO: 173381 - RNA, 40 nt, Homo sapiens
acaggaaggaagauggagggaaggggaagaaagggcuuca

SEQ ID NO: 173382 - RNA, 47 nt, Homo sapiens
uggcgcagcuucugagggccugggguugcagagcaguuagugagcag

SEQ ID NO: 173383 - RNA, 52 nt, Homo sapiens
cagggagcaguggcccgagccgccccaugcccagcauauucacacagugcug

SEQ ID NO: 173384 - RNA, 52 nt, Homo sapiens
gacugcucuucuucucgauuucuucuuguucugccuucucgguuugcagccc

SEQ ID NO: 173385 - RNA, 63 nt, Homo sapiens
gacuuuucucucugucugcccccccuuccuacugguucaugcuucucccccauucccacccuc

SEQ ID NO: 173386 - RNA, 41 nt, Homo sapiens
gggaugaggaggagagcacagcccucagcaucaacgaggag

SEQ ID NO: 173387 - RNA, 35 nt, Homo sapiens
aguacuagccuuguauuucaguagaauauauuugg

SEQ ID NO: 173388 - RNA, 52 nt, Homo sapiens
agaccgguaggcgccuccccugggcauggggccuuccagggggacacagcgg

SEQ ID NO: 173389 - RNA, 41 nt, Homo sapiens
ccaugcaugugugcgcggguguaugugcgcucagggucucu

SEQ ID NO: 173390 - RNA, 60 nt, Homo sapiens
ugucauguaccaucaauaaaguacccugugcucaaccaguuacuuguccugucuuauucu

SEQ ID NO: 173391 - RNA, 91 nt, Homo sapiens
guguggugggggacugaguguggcagggacuccccagcagugagggucucucucuuccucuugugcucuugcuggggcuggugguccaggg

SEQ ID NO: 173392 - RNA, 68 nt, Homo sapiens; identical to SEQ ID NO: 154081

SEQ ID NO: 173393 - RNA, 63 nt, Homo sapiens
uguugggcagcccuggagccuucaguugcagccaugccuuaagccaggccagccuggcaggga

SEQ ID NO: 173394 - RNA, 61 nt, Homo sapiens
caaagcuugugcccagacuguggguggcagugccccacauggccgcuucuccuggaagggc

SEQ ID NO: 173395 - RNA, 59 nt, Homo sapiens
uaggggguuaaaauacagcuuccccucuucccacccgccccagucucugucccuuuugu

SEQ ID NO: 173396 - RNA, 44 nt, Homo sapiens
aggcccccagcuacagaaaggucagcagcuauauuuaaccucag

SEQ ID NO: 173397 - RNA, 48 nt, Homo sapiens
cggugacauuuacagccuggccuuuggggucgggucaacgcuaggcug

SEQ ID NO: 173398 - RNA, 47 nt, Homo sapiens
ccucuuguguccccuccccgcagaggugugguggcuguggcauggug

SEQ ID NO: 173399 - RNA, 42 nt, Homo sapiens
accccuaggugggggacgcuuucuuuccuuucgcgcucugcg

SEQ ID NO: 173400 - RNA, 50 nt, Homo sapiens
ccaggcuguggcgcccugugcagcuccgcccuugcggcgccaucugcccg

SEQ ID NO: 173401 - RNA, 41 nt, Homo sapiens
aauaaaauccaagcuguacaggagaggcccuucugcggcag

SEQ ID NO: 173402 - RNA, 46 nt, Homo sapiens
gaagccagaggcugguaccuagaaccuagaaaaggcaggaaaacgu

SEQ ID NO: 173403 - RNA, 47 nt, Homo sapiens
caggccugaaaacaguuacuucugauuaaaaagaaacaaggccaugg

SEQ ID NO: 173404 - RNA, 29 nt, Homo sapiens
acacacaguaggccaggucucgcugcugc

SEQ ID NO: 173405 - RNA, 42 nt, Homo sapiens
uuccuccacccccagcucggggucugacaggcggcugaugau

SEQ ID NO: 173406 - RNA, 28 nt, Homo sapiens
augaggaguccagggguccaccagauug

SEQ ID NO: 173407 - RNA, 38 nt, Homo sapiens
uucugccucugugucaucugcuguugccccaaccagcc

SEQ ID NO: 173408 - RNA, 46 nt, Homo sapiens
aggacagcaggcgaccuucucgguggcccgcucccacagcagcugg

SEQ ID NO: 173409 - RNA, 46 nt, Homo sapiens
gguuuauuuuuacagacagucuguccugugaccauguuuccuguag

SEQ ID NO: 173410 - RNA, 42 nt, Homo sapiens
cuauaugacugaaggguucggacuccuggaaguggccugugg

SEQ ID NO: 173411 - RNA, 51 nt, Homo sapiens
gcugccagcacagcauuacgcaucauguaauucuaagagagagaagcauag

SEQ ID NO: 173412 - RNA, 76 nt, Homo sapiens
gcacaugcuggacaucaggauagcugggacacguucugcuaguucugucaggaaugcugcaaagcccuuugucccu

SEQ ID NO: 173413 - RNA, 47 nt, Homo sapiens
ccuguuccuacucucucacuccaguuaccacaauuucucuccagcaa

SEQ ID NO: 173414 - RNA, 45 nt, Homo sapiens
gcuguagauaguaucaaagugcugcagcauagccaggggccccug

SEQ ID NO: 173415 - RNA, 45 nt, Homo sapiens
caauucauucccuuuccaaccucgaagccauaugggcccccugau

SEQ ID NO: 173416 - RNA, 48 nt, Homo sapiens
cuaucgaaacuucccaugucgguuaaaguguuuguagagauagcggau

SEQ ID NO: 173417 - RNA, 45 nt, Homo sapiens
ugcauugcgccauuuuccgucccgcagaaucgggagcuuggggcg

SEQ ID NO: 173418 - RNA, 231 nt, Homo sapiens
aaaaguugcaguuauuuaaaaauauauauuucaaucugagaaagcugauuuaaaagaaaaagaaaaaaguauauauauauauaaauguauauauauguauauauauauauaaauguauauauauguauauauauauauaaauguauauauauguauauauacauauguguauauauaguguguguguguguguguguguguguauguauauaugccugagccauugugcug

SEQ ID NO: 173419 - RNA, 46 nt, Homo sapiens
aguaaaaaaguagacuggacacaggaaucaggaagucccagacgga

SEQ ID NO: 173420 - RNA, 40 nt, Homo sapiens
ggugggugagaaagaaaguagaagggcuaauacccccaaa

SEQ ID NO: 173421 - RNA, 30 nt, Homo sapiens
gucucugaagccccaggaacaucagugcaa

SEQ ID NO: 173422 - RNA, 46 nt, Homo sapiens
aagaaugaggaauaagauuacacauggaucuaacuggggacagcgg

SEQ ID NO: 173423 - RNA, 41 nt, Homo sapiens
caacauccaaggugaggccaggacaugguuaucccagggaa

SEQ ID NO: 173424 - RNA, 41 nt, Homo sapiens
caaauguagguccccucguccuguauagugaggccgggcag

SEQ ID NO: 173425 - RNA, 62 nt, Homo sapiens
acuuacucucaguucagaggaaaauacacacguacacauauacacacaugaggagucggggg

SEQ ID NO: 173426 - RNA, 46 nt, Homo sapiens
ugcccucgaggaugugcugagcuggagagggcaaguacuggguuua

SEQ ID NO: 173427 - RNA, 46 nt, Homo sapiens
ugcuuuucauuuucuuaccugcaguucgcacaguccccugggggcu

SEQ ID NO: 173428 - RNA, 64 nt, Homo sapiens
aaacagcuaggaucuuggauggcaacuuuuacccuuugaugacuccacagcuugagggcggggg

SEQ ID NO: 173429 - RNA, 47 nt, Homo sapiens
caucuugcucuaagugaaagugaaagaaaagucggcagcagagggaa

SEQ ID NO: 173430 - RNA, 45 nt, Homo sapiens
ugcuggccaagacucaucggaucuccuucugcagacaaaggagaa

SEQ ID NO: 173431 - RNA, 38 nt, Homo sapiens
aggggugucaggagcacgccagcuaaggggagagaagg

SEQ ID NO: 173432 - RNA, 67 nt, Homo sapiens
augcauucucucuagcgguggggauuaaggagaaaacucacguggccaguggguagagagaguccgg

SEQ ID NO: 173433 - RNA, 36 nt, Homo sapiens
ggugggaauggaaagggaagcacgucccuagaggug

SEQ ID NO: 173434 - RNA, 45 nt, Homo sapiens
ccugguccucucccuaccuccuuaguguaggcacuguuuucagau

SEQ ID NO: 173435 - RNA, 57 nt, Homo sapiens
ggagccauaaggcugagaaauggcauuacugcacauuuuugguggaauugggaauag

SEQ ID NO: 173436 - RNA, 60 nt, Homo sapiens
cugaugucugagcaccauuugggaggauaccuaggaguaugucagggagucaggguggaa

SEQ ID NO: 173437 - RNA, 45 nt, Homo sapiens
ggugcugcagccugguugaguaauuaguauacaaacaauagagag

SEQ ID NO: 173438 - RNA, 45 nt, Homo sapiens
ggaauccagagaaaggggcguagccucgagagcauuccugggagg

SEQ ID NO: 173439 - RNA, 45 nt, Homo sapiens
ccacaggcuccuuguucuucuggaggccuuuaugaaaugaaaaug

SEQ ID NO: 173440 - RNA, 45 nt, Homo sapiens
ggucucuaagggcaguggccggacagcuggccccacucaccuccc

SEQ ID NO: 173441 - RNA, 44 nt, Homo sapiens
aaagaauuuuuuugucuuuaaauagauacaaaugucuaucaacu

SEQ ID NO: 173442 - RNA, 43 nt, Homo sapiens
uuaaugcuucauucaauauugacauuuguaguugagcgggggg

SEQ ID NO: 173443 - RNA, 71 nt, Homo sapiens
ggcaugaucuucaguaugaucuugugcugugcuauccgcaggaaccgcgagauggucuagagucagcuuac

SEQ ID NO: 173444 - RNA, 31 nt, Homo sapiens
agggggacugaggaguucacauugauucagc

SEQ ID NO: 173445 - RNA, 47 nt, Homo sapiens
aaguccaggaguuuuacaaggacaccuacaacaagcugaaaaccaag

SEQ ID NO: 173446 - RNA, 33 nt, Homo sapiens
caugagaucucuuggguuugggaguugggggau

SEQ ID NO: 173447 - RNA, 47 nt, Homo sapiens
uggaagaggaggcuguauuuuaaggaaagggaacuucuucccugaga

SEQ ID NO: 173448 - RNA, 44 nt, Homo sapiens
gguuugccaguaaccccacgugacuugaccucacgacggaugug

SEQ ID NO: 173449 - RNA, 43 nt, Homo sapiens
cucgggagggcgggaaccaagacgaaaccagucggggcagagg

SEQ ID NO: 173450 - RNA, 50 nt, Homo sapiens
ugcaucauuuccuuaauucaaaaagcuuuguccuggggaucugcagugcu

SEQ ID NO: 173451 - RNA, 46 nt, Homo sapiens
uggcuccgauucgacucucagaccaagagcaucuucgagcaagaaa

SEQ ID NO: 173452 - RNA, 45 nt, Homo sapiens
ucugcuguccacccaacaugcccacacucacugccauaucguaag

SEQ ID NO: 173453 - RNA, 28 nt, Homo sapiens
aguuuggggcacucuuggguucucaugu

SEQ ID NO: 173454 - RNA, 35 nt, Homo sapiens
agccguucucucuccuuucuuaccucuuccugccu

SEQ ID NO: 173455 - RNA, 44 nt, Homo sapiens
gugcccugcugcagguugugggagccucucacgggcccacugag

SEQ ID NO: 173456 - RNA, 35 nt, Homo sapiens
uuuaaaaaauuguuuuucuagaguucggggagguu

SEQ ID NO: 173457 - RNA, 36 nt, Homo sapiens
uuaaauugcuacugugguguuauuuucccuaagcua

SEQ ID NO: 173458 - RNA, 45 nt, Homo sapiens
agucaguugcuuaaaaucucugagccugauucauccauaaaauga

SEQ ID NO: 173459 - RNA, 45 nt, Homo sapiens
uuuuucacagauugagguugucuaaguguucacauucauccauau

SEQ ID NO: 173460 - RNA, 62 nt, Homo sapiens
gugggccuauucugaaaacuaaauaguucuggagaagugcuuagggugggguuguggaacau

SEQ ID NO: 173461 - RNA, 46 nt, Homo sapiens
uaaucaggcaguuuuauuaauuaugaauuuauuaauucaaaaccua

SEQ ID NO: 173462 - RNA, 79 nt, Homo sapiens
uuugcaacugggaaggaaauucagaagacaaaaaaaaaaaaaaaugcaggggaauagggggcgggggcuagucuuuaua

SEQ ID NO: 173463 - RNA, 43 nt, Homo sapiens
ccuuggauugacaaaggcgccuuuucuucuaaagaacacaaac

SEQ ID NO: 173464 - RNA, 58 nt, Homo sapiens
guuuugucugcuuuuguuuguuuguuuguuuuuguuuuccuguucuguucaauuuuau

SEQ ID NO: 173465 - RNA, 32 nt, Homo sapiens
aaauaaaauugccugucagagaaacccuaagg

SEQ ID NO: 173466 - RNA, 52 nt, Homo sapiens
gucucaaaagguccuuucaagcucagucuaugaacccaacaccccuacacau

SEQ ID NO: 173467 - RNA, 48 nt, Homo sapiens
agaaaccauauccccuagaccuaggggaggcuggugcgaaacacagag

SEQ ID NO: 173468 - RNA, 28 nt, Homo sapiens
aaaagagggaaagguuuggcuauacuga

SEQ ID NO: 173469 - RNA, 37 nt, Homo sapiens
uuuccuucagaccucccugcccgccugcccacccccc

SEQ ID NO: 173470 - RNA, 48 nt, Homo sapiens
ggccacagccaaaccagcaaaucagucuguucuuccaccaccuccaga

SEQ ID NO: 173471 - RNA, 44 nt, Homo sapiens
uuuccucuccccucccagguacagucucucccggcugguguguu

SEQ ID NO: 173472 - RNA, 46 nt, Homo sapiens
aauuugcagagacugacuucccccagugcaucagucaccauaacac

SEQ ID NO: 173473 - RNA, 40 nt, Homo sapiens
ccugcaucuguauccagcgccaggucccgccagucccagc

SEQ ID NO: 173474 - RNA, 45 nt, Homo sapiens
uuccagugguguugccugaauaccaaggucuucuaagccaggcag

SEQ ID NO: 173475 - RNA, 34 nt, Homo sapiens
guagagaagaugagaaaguagugcuuagggaaca

SEQ ID NO: 173476 - RNA, 49 nt, Homo sapiens
gucuuugaaauaagcccauuugagcccuggauaacaagggauaaagugg

SEQ ID NO: 173477 - RNA, 46 nt, Homo sapiens
ugggaggaacaaucugugagccacagcaaagauguacuucaccagg

SEQ ID NO: 173478 - RNA, 41 nt, Homo sapiens
aaggaaggaaggaaggaaggagaaaggaggaaggccacacu

SEQ ID NO: 173479 - RNA, 45 nt, Homo sapiens
acguccaccuuucccaugaggcaugagggcaugaugaagcuggcg

SEQ ID NO: 173480 - RNA, 59 nt, Homo sapiens
acacuaagaaaaauacaacuuuggggguuugauuggaauauguuuguggaagaguagag

SEQ ID NO: 173481 - RNA, 45 nt, Homo sapiens
aagauucugaggaugauucugauuuuugugagagugaggauaaug

SEQ ID NO: 173482 - RNA, 42 nt, Homo sapiens
ucuggaaggcagugauggugauagugcuaaugacacugaacc

SEQ ID NO: 173483 - RNA, 46 nt, Homo sapiens
aguauuccagcuagugcagugccuuguacaaaguaagugcuuggua

SEQ ID NO: 173484 - RNA, 46 nt, Homo sapiens
gcacggccaggcuguccagguccacugacggcagcccccagccccc

SEQ ID NO: 173485 - RNA, 47 nt, Homo sapiens
ggugaugaucuuguguggaacugagaugaccucuccaugacuggucc

SEQ ID NO: 173486 - RNA, 77 nt, Homo sapiens
gacuacuuuguuaaaaaugacauuagaugacuuaagaugauuaagacacaagaugacuuaauaugaggacaguuuuu

SEQ ID NO: 173487 - RNA, 38 nt, Homo sapiens
agcgguuugggauaggguauuauuagugggcauggaau

SEQ ID NO: 173488 - RNA, 45 nt, Homo sapiens
gugcggccugugagguggguaguuccugacauucgucgggggugg

SEQ ID NO: 173489 - RNA, 45 nt, Homo sapiens
uggaacauaauuacuuuguuaguaucucagaacugauuggugaaa

SEQ ID NO: 173490 - RNA, 45 nt, Homo sapiens
guauugaaauggaaaaagucaugcaggaauugggaaaaucacuga

SEQ ID NO: 173491 - RNA, 48 nt, Homo sapiens
uacccccuuguaugacagcauccuauuucagcuaugcuguaacaaaga

SEQ ID NO: 173492 - RNA, 65 nt, Homo sapiens
uacuuuaagaaagacuauauuuuauuggcuuuaaguuuuguauauuuauauaauguuuuuugcag

SEQ ID NO: 173493 - RNA, 45 nt, Homo sapiens
ugguuuuacuaguagauaaucgaauuaauucauauagugguauua

SEQ ID NO: 173494 - RNA, 37 nt, Homo sapiens
gugcagacagggugcccgacgugccuacucagugcag

SEQ ID NO: 173495 - RNA, 44 nt, Homo sapiens
auuuucucacauuuucuuccccagaucuuugacauguagaucac

SEQ ID NO: 173496 - RNA, 50 nt, Homo sapiens
uauuucucuucauggauccacaauuuaaaucauccagauuuuguggcuuu

SEQ ID NO: 173497 - RNA, 44 nt, Homo sapiens
cauuuuuuuaaacuaauggauuuuugcaucuccgaucugguuag

SEQ ID NO: 173498 - RNA, 45 nt, Homo sapiens
uagaucgcagauucagguguggcucuaugagcaagugaauaugca

SEQ ID NO: 173499 - RNA, 46 nt, Homo sapiens
aaaggagauaauauuacucugcuacaaagugucuccaacuagaaau

SEQ ID NO: 173500 - RNA, 43 nt, Homo sapiens
auggcaaaaauguuguauuggcuaugauggugacaugauauag

SEQ ID NO: 173501 - RNA, 63 nt, Homo sapiens
ccaagacaagaaacuacauaacugagagagaggagagagagagagaucugagguacaugauau

SEQ ID NO: 173502 - RNA, 50 nt, Homo sapiens
agugccuuacugacuguagccauuacaguauccaaugucuuuugacaggu

SEQ ID NO: 173503 - RNA, 46 nt, Homo sapiens
cuuuugaugauucuggauucuaaacaacccagaauggucauuucag

SEQ ID NO: 173504 - RNA, 60 nt, Homo sapiens
ucuauugguguggacucagagcaauuuacaagagcuguucaugcagccauccauuugugc

SEQ ID NO: 173505 - RNA, 48 nt, Homo sapiens
agccaaaaggauuccucuuuguuuaucucugagacaguccaaccuuga

SEQ ID NO: 173506 - RNA, 46 nt, Homo sapiens
aggggaaggaucaaaauuuggcaggcugggggaacaacucggcccc

SEQ ID NO: 173507 - RNA, 46 nt, Homo sapiens
cggcagccccacacccaucaucacacaaggccccaaggaugggaaa

SEQ ID NO: 173508 - RNA, 75 nt, Homo sapiens
uugugaguuagcaugacccuaaaauucuaggggauuucuggugggacaauggguggugaauucugaaguuuugga

SEQ ID NO: 173509 - RNA, 47 nt, Homo sapiens
ggcaggauaagaaaaauaggucagauaaguaugggaugauaguugaa

SEQ ID NO: 173510 - RNA, 36 nt, Homo sapiens
caggcuguuuggagauccucaucuuggagcuuuuuc

SEQ ID NO: 173511 - RNA, 77 nt, Homo sapiens
ucccaguuagacccugguauccucaucaugauggaaaaaauacauugaaccaagggauccucccuccccuucaaggc

SEQ ID NO: 173512 - RNA, 45 nt, Homo sapiens
ucugcuugggagcccauucgcaugaggaauacagaagcaguguga

SEQ ID NO: 173513 - RNA, 46 nt, Homo sapiens
uauaauauauuauuuuacugcuuaaauuccaaguccugaaguagau

SEQ ID NO: 173514 - RNA, 49 nt, Homo sapiens
uuguucaguuugguuuuuuuuuuuuuuugcgcugcuaagaagcuaaagu

SEQ ID NO: 173515 - RNA, 51 nt, Homo sapiens
aauuauuuuauacacagauucugccuuguuucauaguaugaggguugaaga

SEQ ID NO: 173516 - RNA, 46 nt, Homo sapiens
agaagcgaagaguaacccagacugggggcaggaagggagggggcaa

SEQ ID NO: 173517 - RNA, 50 nt, Homo sapiens
uaugggccauaaccaaaacucacaugaaacggaggcagauggagaccaag

SEQ ID NO: 173518 - RNA, 46 nt, Homo sapiens
gaaggaguacaaaacaaucucucaacaugauugaaccauuugggau

SEQ ID NO: 173519 - RNA, 52 nt, Homo sapiens
auuuauggcaugauuagauugcaaagcaaugaacucaagaaggaauugaaau

SEQ ID NO: 173520 - RNA, 46 nt, Homo sapiens
ggaccaagccagcaccccuacagacgugcgggauaucgaccuguga

SEQ ID NO: 173521 - RNA, 36 nt, Homo sapiens
cuuuugggcuuggcaaaauagaaaccucuggguggg

SEQ ID NO: 173522 - RNA, 41 nt, Homo sapiens
auucguagagacagaaaguagaauagagguucccaggaguc

SEQ ID NO: 173523 - RNA, 43 nt, Homo sapiens
cgcuuuuuaaacgaggacuccagaacacagacugaaaaccucc

SEQ ID NO: 173524 - RNA, 32 nt, Homo sapiens
cagguuugcucugcguucaugaugggagggga

SEQ ID NO: 173525 - RNA, 40 nt, Homo sapiens
ggugauggcuuugcuucuguucaccaauagggggagagag

SEQ ID NO: 173526 - RNA, 44 nt, Homo sapiens
cagcagcuugcggcccuugcucuuccagaagccauuuuaggcug

SEQ ID NO: 173527 - RNA, 45 nt, Homo sapiens
uggcagugguucugcaguguguggggagcguauuugugugugaaa

SEQ ID NO: 173528 - RNA, 42 nt, Homo sapiens
ccgguggcacacagagcaaugaaggucugagcaugcuugcgg

SEQ ID NO: 173529 - RNA, 39 nt, Homo sapiens
uucugccugauauguaaaaggggaguuugagcagcagag

SEQ ID NO: 173530 - RNA, 87 nt, Homo sapiens
ugcaaagaggggugugcaaaccaccgaaggugggccuuggagccgcuauuccaugcgguacagcugcaauauggucgucuuauaugu

SEQ ID NO: 173531 - RNA, 31 nt, Homo sapiens
auaugccuucuaucaccacugccagagcaaa

SEQ ID NO: 173532 - RNA, 44 nt, Homo sapiens
aaucuaucgaaacaaaaaaaauuaauuuuuuuuugugggagggg

SEQ ID NO: 173533 - RNA, 62 nt, Homo sapiens
uugugggccgcagccggacacucccgccgcggcgcucaccccuucaaguuuccucccgggau

SEQ ID NO: 173534 - RNA, 29 nt, Homo sapiens
uacgugggcacacggcucgcugggcaaag

SEQ ID NO: 173535 - RNA, 45 nt, Homo sapiens
ggagcgcuaccuuccgcagugcuccuacuucaagugcgugcagaa

SEQ ID NO: 173536 - RNA, 78 nt, Homo sapiens
uuccccugaccuccuuccuuuggcuaaauaggggguuuucgggggagaggugagggcagagagagaagguggagcaga

SEQ ID NO: 173537 - RNA, 41 nt, Homo sapiens
uccccugcucgcucuucuccgcucugaagcggugacgcaag

SEQ ID NO: 173538 - RNA, 44 nt, Homo sapiens
gagagcuaacugcccagccagcuugcgucaccgcuucagagcgg

SEQ ID NO: 173539 - RNA, 45 nt, Homo sapiens
ugaaguugggucgggccagcugcuguucuccuuaauaacgagagg

SEQ ID NO: 173540 - RNA, 86 nt, Homo sapiens
uccugauaacuucgaagcuguuucgaaagccccgauuaaagggaccagaacaacgucccuucugccccccccugcagagugugugc

SEQ ID NO: 173541 - RNA, 55 nt, Homo sapiens
gcuaggaacuggcugugugaccuuagucagguuacccagccucucugauucuuag

SEQ ID NO: 173542 - RNA, 158 nt, Homo sapiens
uuggagggagaaagaaggaagagagagaacuccgggaugacaugcagcuauggaugcucgcgugggugugcauauacgugugugugcgugcgugugucuccccacaggacuggaccaguagcaggcugguggaaagcaugagcagcuccauucaggaa

SEQ ID NO: 173543 - RNA, 46 nt, Homo sapiens
gcuuccuucggccuucuuccucuucugcucugaguaucgcccaaaa

SEQ ID NO: 173544 - RNA, 44 nt, Homo sapiens
caaaagccucugugguccuauuccucccuaacccaaggcccaau

SEQ ID NO: 173545 - RNA, 45 nt, Homo sapiens
guuuuuuuuuuccuguggaauaacuugagugguccuuaaccccac

SEQ ID NO: 173546 - RNA, 45 nt, Homo sapiens
caagagaggucagacuggcucuuguuaccggagccacgggaagaa

SEQ ID NO: 173547 - RNA, 48 nt, Homo sapiens
caguggcaggggacccacaggggugaggacccacgguccuccccgcca

SEQ ID NO: 173548 - RNA, 46 nt, Homo sapiens
ccucucuaguucggaugcugcucacuuucccccuugcuucuggaag

SEQ ID NO: 173549 - RNA, 54 nt, Homo sapiens
gaauugcaucacagcuggacuugcguagcuuuuucugauaaaacucccugaggu

SEQ ID NO: 173550 - RNA, 56 nt, Homo sapiens
cuugccguaggaaguggacgcuggaagcccgaggagccgcuucgugucuucccaaa

SEQ ID NO: 173551 - RNA, 58 nt, Homo sapiens
gcggccacgggaggggagagccggggucggcuccgcgagcgcaggguggcgcuugucu

SEQ ID NO: 173552 - RNA, 37 nt, Homo sapiens
gccacggcggucgauuagcaccgaaacagagugaugg

SEQ ID NO: 173553 - RNA, 42 nt, Homo sapiens
guggcagaugucagcucccaugauggcgucuccugcucggcc

SEQ ID NO: 173554 - RNA, 35 nt, Homo sapiens
aagaggcugaggggauuuugggacacaaccuggcc

SEQ ID NO: 173555 - RNA, 42 nt, Homo sapiens
cacauggccagguugaggugagaggccagucgaagggccugu

SEQ ID NO: 173556 - RNA, 46 nt, Homo sapiens
cuccuuucuccaugcgcugaauggcccucuccagaccauaaggcag

SEQ ID NO: 173557 - RNA, 37 nt, Homo sapiens
cggagcucccgcuggucaaagagcuuguccuuguagu

SEQ ID NO: 173558 - RNA, 46 nt, Homo sapiens
uccacgauagcacccucauugggcuuagcauagccuucaccgcgag

SEQ ID NO: 173559 - RNA, 42 nt, Homo sapiens
auuggggggaaucuuuggaggacugccugcugaaccguaggc

SEQ ID NO: 173560 - RNA, 44 nt, Homo sapiens
cuaccuuuucccaggucaaaggagaauuuguccuugcgauccag

SEQ ID NO: 173561 - RNA, 43 nt, Homo sapiens
cuguuuggggcugauguccacucccuccaugggcagcggcgcc

SEQ ID NO: 173562 - RNA, 39 nt, Homo sapiens
uuuuuuuuuuugguucuugccuccuucuggcugccugcc

SEQ ID NO: 173563 - RNA, 48 nt, Homo sapiens
ugcgcggggagcggggagugaguggacagcgcugccccgcugcagaga

SEQ ID NO: 173564 - RNA, 81 nt, Homo sapiens
aagcgaccucgauuuccccagauccgagaagccccggccaggcagcgaugccucgcucagcgccugcagaugcugcgagca

SEQ ID NO: 173565 - RNA, 86 nt, Homo sapiens
auucagaauguucccacaggccccaacaauaagcccaaacuacuguggugaucucaaagugcggggagauguaguccagaccaaga

SEQ ID NO: 173566 - RNA, 56 nt, Homo sapiens
augggaagcauguaauguuuggaaaaaucacugauggacuucuagugaugagaaag

SEQ ID NO: 173567 - RNA, 50 nt, Homo sapiens
auuuaggguggagauuuuguuaauggagaugguacuggagucgccaguau

SEQ ID NO: 173568 - RNA, 45 nt, Homo sapiens
cuuugaugucagcaauggcagucaggaaguuggccgcacaaagau

SEQ ID NO: 173569 - RNA, 44 nt, Homo sapiens
uuagcagggcuugaaguugccaccaccauggcucugacccggaa

SEQ ID NO: 173570 - RNA, 50 nt, Homo sapiens
uuaagaaggcuggggaaaaagauggaaaauacaauccaggaaagagaccu

SEQ ID NO: 173571 - RNA, 45 nt, Homo sapiens
aauuaauguguguauugagcacauuaagcacuguaagaccuggga

SEQ ID NO: 173572 - RNA, 91 nt, Homo sapiens
cuggagagcugaacggguuccccaggagaaaguccauugcugcuaccgccgcugccaccaaccccgggaaucagcugacagcaaccgccag

SEQ ID NO: 173573 - RNA, 45 nt, Homo sapiens
gcagaucuccauguugagggcccaguccucgcucugcagggagcc

SEQ ID NO: 173574 - RNA, 42 nt, Homo sapiens
ucaccagcacacucuccacgaaguccuggcuggccaccagca

SEQ ID NO: 173575 - RNA, 182 nt, Homo sapiens
uccugauugugucucugaguugaacacggucuagugggaggaaaacaggaucagugagggcuccugggaacaucaagagcccaggaagucaggggccagccuggugaugucucuggggaugaguccugccucccuucccuugguucccgguacggcaguucucucacccucuggggugugug

SEQ ID NO: 173576 - RNA, 46 nt, Homo sapiens
acacuagcacugcuaaaagaugggaaaacacaagauuauguuguug

SEQ ID NO: 173577 - RNA, 2201 nt, Homo sapiens
gguucuucugacauucuuaauuacagguaacuuuuaacaaaagaagagauugauuuuaauucauauauaguugauauuuuuacaaaagauuuuuguauuguaacauuuauuuuaugaaauuaaggcauuuuggcugagauguggaaaguuucucaaaggaaaagcauguuuuuuugaaguguguaauauuagcgugauuuuacggcaaaaucagauuuacagauuaaacugauuuaauagguaaaacugagucucaccguacuccugacuauaaaaguuuucagcuuaacguauacuauugacacuaauuuuguauuaaucuggaaacuuaaaauggcaauccaguguugacuauuccccaauuuaagccagauugcucaaaugaauucugacuuaagugauucucuuugauaaaauaaaaauuaaaagcagacucuugcaaagaaaguuauauuuuaaaauacuagauuuuuaacauggauauuucuguuuuacuuauagaggcugaugaauagaaaaagguuucuaugccuagcuuacauugcuugcuaugaagaacaguuuuaguuugaaaacaaucuaaaauccaacuuccauuucuuuguccacuucuucagacaaauaauuuaucuaauuccacaaaucagagcauaucaucuugucuuuuuugccuuuucuugauuugcaaaaguaacagguaaaauugugcacuuaccauuccagagucauggugccuuucaggaaguagaagguucucucacguuuuucuuucucccccauuucccucccgucuuuucucugacucuccuagacaugccgaaaucauuccuauguuguagaaauugguuucauuuccuuaauauuaacauaaaauauuaauauuuauuaaauaaaguuauauauuuugaaguaauuuuaagccuuaaacaaauugcagccggguggggcacuuguguaaucucagaagauuacagacuuugagaggcugaggugggagaaucaguugaggccaggaguuugagaccaauuugggcaacauauagugagaugagaccucgucucuacaaaaaacuaguagaaacaacccccugcagacuaguacaacgaauccucauugacccuuugcccauauuacccaauuuuaaacauuuuauauuuguuuuaucauugucuuuauagauacuaugaaguauuuugggaaccauuugaguggaaauugugaauacagugucccuuuacuccuaaagacuuccauauauauuuucuaagaacaagaacauuuucuuacguagcgacaguacaauuauugaaacaggaauuauuguguaauuuaccgcucuuauuucaaguuuucucauugucccaauaauuguccuucauaccaaaaaugcagcacauuuaguuauuacgucuuuaguuaccauuguuauucuuugguucuuaagacugauguuuuugaagaguacaaacuguuuauuuuggagaacaucucccaguuuggguuugucuuaaauuuccucaagauuagauucagauuaucgauuuuugacgggcauauuauggaagugaugcaucauaucgggaggugugugaugguuucucucauuuccggugacaacugagcacuguguuaaccaaauguuaauccauaauuaaugauaaaaaggaaaauaggucuggugcaguggcucauaccuauaaucccagcacuuugggaugccaaagcaggaggauugcuugagccuaagaguucaagacaagccugggcaauguagugagaugucaucacuacaaaaaauguaaaaauuaacugagcaugguggcacacgccuguaguccaagcuacucgggaggcugaggugggaggaucgcuugagcccaggaacuggagguugcagugagcugugaucacaccacugcacaucagccugggccacagagugagacccugucucaaaaagaaaggaaaauaaaauugaucuaaaacauucaguaggacacaauaagguuuaaggcuauuaaccaucaauaucaauauaagcauuauaccucuucccugacaccagcauuuuaaagaaauuuuauucuauguuacaggaagaaaacaaagauagauuuuugugcaguuuaguauacuaguacuaaaucauaaagaauaaaaugcuuuuuuuuuuuuuuaaguggaaauuuaauggagccac

SEQ ID NO: 173578 - RNA, 41 nt, Homo sapiens
gcccaccaucucacagucaauugccaccaucuuccguggca

SEQ ID NO: 173579 - RNA, 45 nt, Homo sapiens
accaagacacugcagcuuucuuguccaggggcuguccugacccau

SEQ ID NO: 173580 - RNA, 49 nt, Homo sapiens
cgguauuucuccaucuggcucuccucuaccuccaggcaggcucacccga

SEQ ID NO: 173581 - RNA, 58 nt, Homo sapiens
gauccggaagaaauauccggacaggguccccgugaguguagaggagcggaggggaugg

SEQ ID NO: 173582 - RNA, 49 nt, Homo sapiens
ccgcccccgcgggcccuuccccucccauccccuccgcuccucuacacuc

SEQ ID NO: 173583 - RNA, 61 nt, Homo sapiens
agccgccgucuucagugacucagcaacccacacacggucucagcagcugagaccgugugug

SEQ ID NO: 173584 - RNA, 42 nt, Homo sapiens
aucaacacgaggaggcuggcuguccccacacaagccccggag

SEQ ID NO: 173585 - RNA, 45 nt, Homo sapiens
auuguagagaaggcuccaaaagccagggugccugaucuggacaag

SEQ ID NO: 173586 - RNA, 42 nt, Homo sapiens
ggaggaagggucagggaaggcaaagagcauuaccaguaaggu

SEQ ID NO: 173587 - RNA, 63 nt, Homo sapiens
uuggggguaggggaggggugugugugcgcgacauggggaaagaggguggcucccaccgcaagg

SEQ ID NO: 173588 - RNA, 69 nt, Homo sapiens
ucacaugcucaauugauauuuuuugcugcuuccucggcccagggagaaagcaugucaggacagagcugu

SEQ ID NO: 173589 - RNA, 52 nt, Homo sapiens
ggaguggggagcaggaauugcacucagacaugacauuucaauucaucucugc

SEQ ID NO: 173590 - RNA, 47 nt, Homo sapiens
cucagcuugcuggaaaaauuuguugacauuuucuuuuuguaguuguu

SEQ ID NO: 173591 - RNA, 46 nt, Homo sapiens
aaucuugguuagucuuccacuuuauugcuuggauguuucuuuggug

SEQ ID NO: 173592 - RNA, 42 nt, Homo sapiens
cuucagccucuccaacugcuggggcaggucgugggcgaggag

SEQ ID NO: 173593 - RNA, 56 nt, Homo sapiens
caugcuuucagcaaacgugauauauguuguauaagccaaacacuaaggaggaguau

SEQ ID NO: 173594 - RNA, 42 nt, Homo sapiens
uguaagucuacuuguuauuuuuagcacauuugucaggggcag

SEQ ID NO: 173595 - RNA, 202 nt, Homo sapiens
ccuuaagaguaccguguauacugcuccagugaugggugcaccaaaaucucagaaaucaccacuaaagaacuuauucauguaacuaaucaccaccgguuucccaaaaaccuauggaaaucaauaauacacauuuuaaaaaauaagauaaaaauuuccucuaaagaaaaaauaaaaaucacuuaaaucauuugucuccaggaga

SEQ ID NO: 173596 - RNA, 46 nt, Homo sapiens; identical to SEQ ID NO: 97365

SEQ ID NO: 173597 - RNA, 44 nt, Homo sapiens
agacgcaguaagaguggaaagauaaaaggcaucagacucaucac

SEQ ID NO: 173598 - RNA, 31 nt, Homo sapiens
cuugaggaaauuaaccuucauuuaucuguuu

SEQ ID NO: 173599 - RNA, 106 nt, Homo sapiens
cuggcccggaaccagaagggagaugcacacggccgccaggagcgcagggcgcagcgcgcucaccugggagcgccggcaagggaggcggccagcgcuggggacccgg

SEQ ID NO: 173600 - RNA, 42 nt, Homo sapiens
gucauucuucguuuuauaaucauuaagaaucuucgcaaugua

SEQ ID NO: 173601 - RNA, 42 nt, Homo sapiens
ucauacagggcagaccacuuguccuucaggauguccaggcau

SEQ ID NO: 173602 - RNA, 41 nt, Homo sapiens
ggauaguagcagggugugaggaauuucaccugggugcauug

SEQ ID NO: 173603 - RNA, 44 nt, Homo sapiens
gaagagcagaggggaaggaggugaggaggaaggaagaggugagg

SEQ ID NO: 173604 - RNA, 26 nt, Homo sapiens
agacgacucuagaagcauuaacccaa

SEQ ID NO: 173605 - RNA, 62 nt, Homo sapiens
ucugauggaaacuuguuuuacagauaugacuggauucguuugaaaacaaaaaaaaaggcagg

SEQ ID NO: 173606 - RNA, 50 nt, Homo sapiens
guuaacaauuuggcaauuuuauuggacucuguuauguuuuugaaugguga

SEQ ID NO: 173607 - RNA, 56 nt, Homo sapiens
aagacauaugaaauuaagcagagaauauguauggacaugugaacagauggaaccaa

SEQ ID NO: 173608 - RNA, 42 nt, Homo sapiens
ugcgagagaggcggucgugcagacccgggagaaagaugucaa

SEQ ID NO: 173609 - RNA, 46 nt, Homo sapiens
ggguuagcggagcaaugcgcaggaauaaggaagcgaccugcaaccg

SEQ ID NO: 173610 - RNA, 45 nt, Homo sapiens
aaccucauuuugugcccuuaaaagccacuggggaugacggaucca

SEQ ID NO: 173611 - RNA, 30 nt, Homo sapiens
uagauucuucuacucaaaacaaaagagcca

SEQ ID NO: 173612 - RNA, 43 nt, Homo sapiens
uacaucuuuaaacaguauuucauugccuguguauggaaaaacc

SEQ ID NO: 173613 - RNA, 46 nt, Homo sapiens
uguuuugugcauuuguaaaugcuguguuggguagaauagguuuucc

SEQ ID NO: 173614 - RNA, 57 nt, Homo sapiens
uaaagcguguguacguuaagauuuaggaugacuuuuuuuuucuuuuuuguaauacag

SEQ ID NO: 173615 - RNA, 55 nt, Homo sapiens
augucauuuccauuagaccuguauuacaaaaaagaaaaaaaaagucauccuaaau

SEQ ID NO: 173616 - RNA, 39 nt, Homo sapiens
uagaaggcuagugcuggauaucugguuaaacucguccga

SEQ ID NO: 173617 - RNA, 46 nt, Homo sapiens
ugggacgcuucggucggagaaucguguuccucgggugccgccaucu

SEQ ID NO: 173618 - RNA, 48 nt, Homo sapiens
cagaagaaaaugcugucuugaaauuaaggaggaaggcagcuucaagaa

SEQ ID NO: 173619 - RNA, 46 nt, Homo sapiens
cagugcguuuagaaugggcaaagcaaaggcgccugucuuuccagag

SEQ ID NO: 173620 - RNA, 45 nt, Homo sapiens
cucucaaguugaaaccuuucguauuuuccaaguggucaaucaguc

SEQ ID NO: 173621 - RNA, 56 nt, Homo sapiens
aguagaccagagcugauuuaagagaaaagucaagaaaaaguauuaaucaacuaagu

SEQ ID NO: 173622 - RNA, 48 nt, Homo sapiens
ugcucauuuuuggcaaauguuccauuuggaccauggaccauaguuccu

SEQ ID NO: 173623 - RNA, 46 nt, Homo sapiens
agcacucagucuuaguccaaagcauuugcucagcaaucacugugua

SEQ ID NO: 173624 - RNA, 68 nt, Homo sapiens
cuucuuccucuuugggauccucuuuuccaucugcuucuccugccugcuggcucaugcugucagucuga

SEQ ID NO: 173625 - RNA, 42 nt, Homo sapiens
ugaauaggaccaacgucaaugucuuuucugagcuuuccgcuc

SEQ ID NO: 173626 - RNA, 83 nt, Homo sapiens
aucuaccucacgaugcuccucuccauugccaucuggguggccuggaucacccugcucaugcuuccugacuuugaccgcaggug

SEQ ID NO: 173627 - RNA, 69 nt, Homo sapiens
caauggcuggguguuccuguuggcuuauguuagucccgaguuuuggcugcucacaaagcaacgaaaccc

SEQ ID NO: 173628 - RNA, 41 nt, Homo sapiens
caacucgugaagaagagcuaugguguggagaacagagccua

SEQ ID NO: 173629 - RNA, 42 nt, Homo sapiens
gacacgcucuaugcccccuauuccacacauuuucagcugcag

SEQ ID NO: 173630 - RNA, 55 nt, Homo sapiens
cagccuccccaaaaggaauucuccaucccacgggcccacgcuuggccgagcccuu

SEQ ID NO: 173631 - RNA, 57 nt, Homo sapiens
aaaagccucucucagcccacuggccugaaucuacacuggaagccaacuugcuggcac

SEQ ID NO: 173632 - RNA, 45 nt, Homo sapiens
accccucucuucuugcacuguccccaaacuugcugucaauuccga

SEQ ID NO: 173633 - RNA, 34 nt, Homo sapiens
gcgcggggcgaacccggagacgcgcggggagagg

SEQ ID NO: 173634 - RNA, 53 nt, Homo sapiens
ugggguucccauaguccaguccaugggccuguuuggcaggcagcuuggcccug

SEQ ID NO: 173635 - RNA, 356 nt, Homo sapiens
aagacaguaaugugucuaccucacauaguuguuaugaagauuuacugagauaagaauuuuuuuuugagacaaagucuuguucugucgcccaggcuggagugcaguggcauggucucgacucacucuaaccuccgccucccagguucaagcaauuuuaaugccucagccuccugaguagcugggguuacaggcgccugccaccacacguggcaaauuuuuguauuuucaguagagacggggucucgccacguuggccgggcuggucuugaaguccugaccucaagugaucugcucgccuuggccucccaaagugcugggauuacaggcgugagccagcaccccuggucugagauaag

SEQ ID NO: 173636 - RNA, 42 nt, Homo sapiens
uguuuugcugggaaguguuuuauuaaugauuucacuuugaca

SEQ ID NO: 173637 - RNA, 65 nt, Homo sapiens
gggggagggcacugggagauacaauacuagcaccagugaugguaaugauaauaauagaagcuaaa

SEQ ID NO: 173638 - RNA, 47 nt, Homo sapiens
aaaaagaauaauuauuccauuucauaaauagggaaauugaugcucaa

SEQ ID NO: 173639 - RNA, 42 nt, Homo sapiens
gcccagaccuaggggaguaugauccacuuacccaggcugaca

SEQ ID NO: 173640 - RNA, 46 nt, Homo sapiens
ccuggugucauaugugcgcacgucugucuuccugcugacuuugggg

SEQ ID NO: 173641 - RNA, 42 nt, Homo sapiens
cccuguccucccagagaucugcacagcaccuggagccgccac

SEQ ID NO: 173642 - RNA, 38 nt, Homo sapiens
cuggaauaugguuauuaagagaaaugagagaaaagguu

SEQ ID NO: 173643 - RNA, 53 nt, Homo sapiens
gguagacaguucuaggaaaaccuuguagaggcacuagguauauagcgcagcag

SEQ ID NO: 173644 - RNA, 34 nt, Homo sapiens
augaugauaaacuuugucaaaagcuuuacugaag

SEQ ID NO: 173645 - RNA, 41 nt, Homo sapiens
caaugggacauuugcuucacuugcuuacuugcagggaaaua

SEQ ID NO: 173646 - RNA, 23 nt, Homo sapiens
agauggugaaggcaccagauucc

SEQ ID NO: 173647 - RNA, 47 nt, Homo sapiens
aucagacauuugugcagcauggggugggcaggugagucauagcagcu

SEQ ID NO: 173648 - RNA, 59 nt, Homo sapiens
ucaccaccuuuaccuccugcauccugcguuccccuccauccuucuggaucuggccaaca

SEQ ID NO: 173649 - RNA, 45 nt, Homo sapiens
cgaagauuucucucuaggauaaaguuuguugaagcucccuacgag

SEQ ID NO: 173650 - RNA, 58 nt, Homo sapiens
uccucauuuaccaccucccugaugguugcaaaggcuugggaaggcauguuggagucuu

SEQ ID NO: 173651 - RNA, 48 nt, Homo sapiens
augguuaaguuauuuagaauuaucuccagugcuuacuucucccuucuu

SEQ ID NO: 173652 - RNA, 38 nt, Homo sapiens
uuguaccacaggaaaggggauagggccucacaacagac

SEQ ID NO: 173653 - RNA, 56 nt, Homo sapiens
uucuucacucuuuuccuuucauuuuaccaaauaauaauaauaauaguggagaaaaa

SEQ ID NO: 173654 - RNA, 78 nt, Homo sapiens
gucaucaaauuguuaaucugaaaauagcaacccagaauguaaaaaagaaaaaacuagggggaaaaaaccaggucuaca

SEQ ID NO: 173655 - RNA, 53 nt, Homo sapiens
cugaacuggggaacauggcuuggggccuccagaacaguucagguccccaagcu

SEQ ID NO: 173656 - RNA, 42 nt, Homo sapiens
gauucagggaagcucuacaccuugguccugacagacccugau

SEQ ID NO: 173657 - RNA, 47 nt, Homo sapiens
gcugggcaaagugcugacgcccacccagguuaagaauagacccacca

SEQ ID NO: 173658 - RNA, 62 nt, Homo sapiens
cucccuagauaauaacccaaagaaagucaguguuucuucuugggucccaguuuugagguuuc

SEQ ID NO: 173659 - RNA, 59 nt, Homo sapiens
cuguccugggcuuuaguggccacaaguauuguguuucuggagccauaaacaugggaggg

SEQ ID NO: 173660 - RNA, 25 nt, Homo sapiens
gaaaagaggggcagagucaggagga

SEQ ID NO: 173661 - RNA, 43 nt, Homo sapiens
aaauuucauuuacauguauuuuauuugaauaaguuuucugggu

SEQ ID NO: 173662 - RNA, 54 nt, Homo sapiens
uuggagaguguugacauucuuuauaaauguuaugagguauagaaaaagguaagg

SEQ ID NO: 173663 - RNA, 49 nt, Homo sapiens
ggaccugccucccgagguuauaaguuuccucugcugguguacuggggug

SEQ ID NO: 173664 - RNA, 43 nt, Homo sapiens
cgaaggaagaaaagaaaaagcaaaacuaagaugaggucagaag

SEQ ID NO: 173665 - RNA, 45 nt, Homo sapiens
gggcugcaggacauccugucuggcgcccuggucagagggcccccc

SEQ ID NO: 173666 - RNA, 48 nt, Homo sapiens
gaguccuuuccacucuccacagaagggaucucuuuccuuuccccagcg

SEQ ID NO: 173667 - RNA, 63 nt, Homo sapiens
ggagacccugcagcaugaaggugugguguacagguguggacaggagcaaaugaggaacaguuu

SEQ ID NO: 173668 - RNA, 61 nt, Homo sapiens
gcuguuucccaggccuguguguugagggaggaggcaggcagaaagaccuagaagcaggaga

SEQ ID NO: 173669 - RNA, 41 nt, Homo sapiens
uccccuggacacgaaggaggacaagcggaaauaagagagag

SEQ ID NO: 173670 - RNA, 23 nt, Homo sapiens
ccucagggcucaaauuuccauga

SEQ ID NO: 173671 - RNA, 33 nt, Homo sapiens
guuccccuacaacuuuggaacugcucagugcac

SEQ ID NO: 173672 - RNA, 72 nt, Homo sapiens
agauugggaaggggcuguuggagacggucagggagaaugguggaagccauugucugccucucauuccuugcu

SEQ ID NO: 173673 - RNA, 48 nt, Homo sapiens
uuagugaaagagggaagguggaaggaucauagggaugcauucaggugg

SEQ ID NO: 173674 - RNA, 44 nt, Homo sapiens
caugcaaaguaauuugauaguaaaauacuacagcaagugcuuuc

SEQ ID NO: 173675 - RNA, 46 nt, Homo sapiens
uaucaucuucugugucauugcccuccuggucuucguguuccagcuc

SEQ ID NO: 173676 - RNA, 40 nt, Homo sapiens
caugagauacucacagcacaccagugugguggccccugag

SEQ ID NO: 173677 - RNA, 51 nt, Homo sapiens
guucuccacaagagaacaaauaaccagaggagaaaauugcacaaggaaguu

SEQ ID NO: 173678 - RNA, 106 nt, Homo sapiens
uuauugugauucucacuuaauuguuguucuuucccaauauacucgguuugguggaaggacaugcucuuuugcaucccugaguagcuuuccuagacccacaagggcc

SEQ ID NO: 173679 - RNA, 85 nt, Homo sapiens
augagguucuguguuuuacaucacagcguggccacacaaaccagugcagacaugagagcccagacaccucuaauuuaucaacaua

SEQ ID NO: 173680 - RNA, 47 nt, Homo sapiens
uucuuguggggguguccaucuacacuagucauuaugcgaaucgugau

SEQ ID NO: 173681 - RNA, 41 nt, Homo sapiens
gaugaugaagcugaagcagaagcagauccagcccaggaugu

SEQ ID NO: 173682 - RNA, 36 nt, Homo sapiens
cagauucaacggcuuccuccuccccaccccccagau

SEQ ID NO: 173683 - RNA, 51 nt, Homo sapiens
ggggguggggaggaggaagccguugaaucugggagggaaguggagguugcu

SEQ ID NO: 173684 - RNA, 51 nt, Homo sapiens
uccccagggcaggggcuuggcaguagagaauccccucaguaaugguuuggg

SEQ ID NO: 173685 - RNA, 65 nt, Homo sapiens
cauuacugaggggauucucuacugccaagccccugcccuggggagaaaguaguuggcuaguacuu

SEQ ID NO: 173686 - RNA, 46 nt, Homo sapiens
gugugucacuaagaacagcuggaggccaagucugguggcugcaggg

SEQ ID NO: 173687 - RNA, 48 nt, Homo sapiens
accuacugcacugaguuaaaauagcgguacaaguucuggcaagagcag

SEQ ID NO: 173688 - RNA, 77 nt, Homo sapiens
uuuugcuuugggucagaagggcaggauggcuuccaggcuuagcguauucagcacaaagacaguaucugcucuugcca

SEQ ID NO: 173689 - RNA, 85 nt, Homo sapiens
ggccugugagccauugucccucuuuggaacagauauuuagcucuguggaauucagugacaaaaugggaggaggaaagagaguuug

SEQ ID NO: 173690 - RNA, 55 nt, Homo sapiens
uaaggucaugcugguggguuagcuaaaccaagaaggagaccuuuucacaauggaa

SEQ ID NO: 173691 - RNA, 48 nt, Homo sapiens
ggcagcucuucuggaguuucucuaaagucacuagugaacaauucggug

SEQ ID NO: 173692 - RNA, 55 nt, Homo sapiens
uuuugaggaaguuuugucuaauuaucaauauugaggaucagggcuccuaggcuca

SEQ ID NO: 173693 - RNA, 47 nt, Homo sapiens
caugccucaccugugaagugggauaggcaggguccccaagaggugau

SEQ ID NO: 173694 - RNA, 50 nt, Homo sapiens
ucuggaagcugauuaaaacacacauaaaccaaaaccaaacaacaggcccu

SEQ ID NO: 173695 - RNA, 47 nt, Homo sapiens
aagaacagagugccugcauucccaggaaaauacgaaaaucccaugag

SEQ ID NO: 173696 - RNA, 49 nt, Homo sapiens
uaaaauaaaaaagcaaaaacucuugugguaccuagucagaugguagacg

SEQ ID NO: 173697 - RNA, 47 nt, Homo sapiens
ugcggcagcagacagcucgucuaccaucugacuagguaccacaagag

SEQ ID NO: 173698 - RNA, 42 nt, Homo sapiens
uuugggaagacguuuucuuuaucgcccugagaagaucuaccc

SEQ ID NO: 173699 - RNA, 79 nt, Homo sapiens
agcuuucuccucauccauuucuuuuauaccuuuccuuuuuggggaguuguuaugccaugauuuuugguauuuauguaaa

SEQ ID NO: 173700 - RNA, 47 nt, Homo sapiens
gcaagccaccaaauuaccuaggcugagguuagagagauuggccagca

SEQ ID NO: 173701 - RNA, 46 nt, Homo sapiens
uuuuuuucugugacauuuaugucucauguaauuugcauuacucugg

SEQ ID NO: 173702 - RNA, 46 nt, Homo sapiens; identical to SEQ ID NO: 97504

SEQ ID NO: 173703 - RNA, 52 nt, Homo sapiens
auagacaaaacagcccugcugcaaagauggucaacguaccuaaaacccgaag

SEQ ID NO: 173704 - RNA, 49 nt, Homo sapiens
gcuggccauuaagagaugcaagcauuuugaacugggaggagauaagaag

SEQ ID NO: 173705 - RNA, 44 nt, Homo sapiens
caggggcuguuaaaaccacauuuucuuaaauuacuauuguauuu

SEQ ID NO: 173706 - RNA, 44 nt, Homo sapiens
caguuuuaaaguauuacuggauucagguuuauauuuacgguggu

SEQ ID NO: 173707 - RNA, 39 nt, Homo sapiens
gaauggagguaggaaagauucuucuuuuuuucucaagag

SEQ ID NO: 173708 - RNA, 49 nt, Homo sapiens
aaaaacuuuuauuauggaaaauuucaaauauauacugaaauagaaugag

SEQ ID NO: 173709 - RNA, 61 nt, Homo sapiens
uucuauucaaauauguauaucaaauauauguagauaacuagauauauucuagaaccaguca

SEQ ID NO: 173710 - RNA, 45 nt, Homo sapiens
auauuacugauuguaauaauuuuuggagggugggugaagaguuga

SEQ ID NO: 173711 - RNA, 60 nt, Homo sapiens
ugauugacaaaaugaugauaguagaaagaaaucaauuuugauugauguguuugagguugg

SEQ ID NO: 173712 - RNA, 54 nt, Homo sapiens
uuagaguuggaggucauagcaaagaaagaugagggauaguaggacagagguaua

SEQ ID NO: 173713 - RNA, 45 nt, Homo sapiens
ugcaauccugcaagaugagcauacuguagaauuauguaccauuug

SEQ ID NO: 173714 - RNA, 37 nt, Homo sapiens
guuauuaagaacaccuaauaaguagugaauuugagaa

SEQ ID NO: 173715 - RNA, 69 nt, Homo sapiens
guuuagaagaaccucagaaaaaagucuuuaaggcucgaaaaacgaugagagugagugaucgucagcaac

SEQ ID NO: 173716 - RNA, 46 nt, Homo sapiens
gauuuggacccaaccucaccuuuggaaaacauggauuacauuaaag

SEQ ID NO: 173717 - RNA, 48 nt, Homo sapiens
cuaaguguuaauguaaaaaacaagcaggaugaugauuuaaauugugaa

SEQ ID NO: 173718 - RNA, 45 nt, Homo sapiens
acaauauagaaccaaguagcaauaaagaugaugauuuucuugaaa

SEQ ID NO: 173719 - RNA, 46 nt, Homo sapiens
agacucauuggaugagaaaaauaaagcugauaauaauauugaugcu

SEQ ID NO: 173720 - RNA, 46 nt, Homo sapiens
agaggauauuucgggugaaaaagaugagucugaaguuauaucgcaa

SEQ ID NO: 173721 - RNA, 46 nt, Homo sapiens
ccuuaauaggucuagagacauuacugaauugugacauaguauuaug

SEQ ID NO: 173722 - RNA, 37 nt, Homo sapiens
cuaacuacuauuucaucucuuuccuuucuuuuagugc

SEQ ID NO: 173723 - RNA, 54 nt, Homo sapiens
aaccugaggaagaagagcaaguaauacaugaagaugaugaaagaccuucugaga

SEQ ID NO: 173724 - RNA, 40 nt, Homo sapiens
aagacauggacaauguacagucuaaacgucgucgauauau

SEQ ID NO: 173725 - RNA, 52 nt, Homo sapiens
gcgcugcagugugcuguauuugauaagacuuuggcagaauugaaaacacgag

SEQ ID NO: 173726 - RNA, 31 nt, Homo sapiens
uuauuuucugagauauauauuugagauuaac

SEQ ID NO: 173727 - RNA, 43 nt, Homo sapiens
ucaaggugucagcaguguagauucuuuuugagggcugugcugu

SEQ ID NO: 173728 - RNA, 46 nt, Homo sapiens
cagcauccacccaacccaccaguaucaccaggaaaaacuguaaaug

SEQ ID NO: 173729 - RNA, 50 nt, Homo sapiens
gaccuuaaugauaauauguuguagugaaagauuauuuuacauuuguugau

SEQ ID NO: 173730 - RNA, 94 nt, Homo sapiens
uuagauuauuuucuauaacccaauucuagcuuuaaugauugccuuugguguugugguagauuaauauugauaauuuagaguaguauugaucaac

SEQ ID NO: 173731 - RNA, 46 nt, Homo sapiens
cagugauucaaguggugucauugaucucacaauggaugaugaagag

SEQ ID NO: 173732 - RNA, 360 nt, Homo sapiens
gaaguuuuuuagauuagaauuuuaaaauuuggccaggugcagugucucacaccuguaaucccagugcuuugggaggccaaggcaggaggaucgaggcaagaggucaggaguuugagaccagcccgggcaaugcggugaaaccccgucucuauaaaaaauuuaaaaauuagcugggugugauggcaugugucuguggucccagcugcaugggaggcugaggcaggaggauagcuugagccugggagguugaggcugccgugagcuguguuuaugccacugcauuccauccugggugacagaaugaggcccugucucaaaaaaaaaaaaaaaaaaaaaaaaggauagaaucaaaucuuaaau

SEQ ID NO: 173733 - RNA, 46 nt, Homo sapiens
uaaaauggaaauaaauuauucucuuagagguaaaugugacacacaa

SEQ ID NO: 173734 - RNA, 42 nt, Homo sapiens
cuugcccauggcauguacucucacccaguuuguaucugguag

SEQ ID NO: 173735 - RNA, 41 nt, Homo sapiens
aggauauuuauggacguuuugggccuuucugugauccucag

SEQ ID NO: 173736 - RNA, 45 nt, Homo sapiens
uuaaaauuuccaccuuuuggucuuguuuuuaaucuugugcaugau

SEQ ID NO: 173737 - RNA, 23 nt, Homo sapiens
uuauguagguguuauugcauugg

SEQ ID NO: 173738 - RNA, 57 nt, Homo sapiens
agaaagccuauagauugccaaaaaauuaauucuccaaaccaccuuucacucucagaa

SEQ ID NO: 173739 - RNA, 53 nt, Homo sapiens
auguuuuauuccaguuggaaggaagguacagggagaaaucgcaauuauuuagg

SEQ ID NO: 173740 - RNA, 45 nt, Homo sapiens
gauccgugacgcggugacuuacacggagcacgccaagcgcaagac

SEQ ID NO: 173741 - RNA, 68 nt, Homo sapiens
guggcaaggggcuggguaagggaggcgccaagcgccaccggaaggugcugcgggacaauauccaaggc

SEQ ID NO: 173742 - RNA, 61 nt, Homo sapiens
gggcagcccgauuuucugcugaguaggcgcugugauuucagaaugucugggcgagguaaag

SEQ ID NO: 173743 - RNA, 28 nt, Homo sapiens
ucccgcgaccggacaugaucaccucucg

SEQ ID NO: 173744 - RNA, 47 nt, Homo sapiens
uaagguacuccaacaccgccgccagguacaccggcgccccggcgccc

SEQ ID NO: 173745 - RNA, 45 nt, Homo sapiens
gggcagcagcacggccuggauguugggcaggacgccgcccugagc

SEQ ID NO: 173746 - RNA, 52 nt, Homo sapiens
aaacaaauaagcaacuaagaucccccgaucacaaauuuccaaagaacuggag

SEQ ID NO: 173747 - RNA, 132 nt, Homo sapiens
uucuucucaaugguggcugcacuuguaucauccgccuugggucgcugaaucaaguuggguggggcacuuaaaaccccaggguuuggcaagggagcuggugggaacagcccagggggggcagguccaagggga

SEQ ID NO: 173748 - RNA, 117 nt, Homo sapiens
ggaggugcagggggagguagccuugguggggguccacgaggagggggaccaggaggcagaccuggagguggaccugggggagggccagggggucggccugguggugguccuggaggu

SEQ ID NO: 173749 - RNA, 45 nt, Homo sapiens
agguggaccaggaggaaggccuguagguggcccaggaggccguaa

SEQ ID NO: 173750 - RNA, 50 nt, Homo sapiens
gagaaggaggaacagacugcggcggagccugcugcugugaagaagcagug

SEQ ID NO: 173751 - RNA, 45 nt, Homo sapiens
cucuuuuucauagagucguagaauacguucaaagguuucacgcag

SEQ ID NO: 173752 - RNA, 44 nt, Homo sapiens
cggauuaucuguuuuggauccuucaucuuuaaaacugcagcucg

SEQ ID NO: 173753 - RNA, 31 nt, Homo sapiens
cugguguugccuccuuuggugaaccuggacc

SEQ ID NO: 173754 - RNA, 43 nt, Homo sapiens
ucgcccccuacccgcuucucguaguccugggagcacagcagaa

SEQ ID NO: 173755 - RNA, 47 nt, Homo sapiens
cucccggccucuuucacuucguaaaggccuucaacugggucucucgg

SEQ ID NO: 173756 - RNA, 47 nt, Homo sapiens
ccccuaaaggaucgcaccugcuugggucauaagaaacagaaaaaugc

SEQ ID NO: 173757 - RNA, 34 nt, Homo sapiens
uuaaauguuuaaacuuaccuuuaagggaaauaag

SEQ ID NO: 173758 - RNA, 44 nt, Homo sapiens
acaaugcuucuuuccuguauauucucuugucuggcugcaccccu

SEQ ID NO: 173759 - RNA, 47 nt, Homo sapiens
caaauaccuucauauccccucagcagagauggagagcuaaaguccaa

SEQ ID NO: 173760 - RNA, 45 nt, Homo sapiens
uucagcacccugucccuccucccuguccacagcugggucccucuu

SEQ ID NO: 173761 - RNA, 56 nt, Homo sapiens
gaaugcauccaccccuuuccccacccuugccaccuggaagaauucucucaggcgug

SEQ ID NO: 173762 - RNA, 43 nt, Homo sapiens
ggagggaagggggaggcaaugcucaauuuccuaacaaagaaau

SEQ ID NO: 173763 - RNA, 52 nt, Homo sapiens
guugcauuuuaugauuuccccucucuaaucuuugccucacagccaugcuaaa

SEQ ID NO: 173764 - RNA, 68 nt, Homo sapiens
acaggagaucuggaagcccucaaaaaggaaaccauuguguuaaaggaagguucugaauauagagucaa

SEQ ID NO: 173765 - RNA, 46 nt, Homo sapiens
agcucaauuauaagccuccaccacagaagucccugaaagagcugca

SEQ ID NO: 173766 - RNA, 55 nt, Homo sapiens
uuucaacauugagauuugagccugcauaguugcaauuuccuggagguuauugaaa

SEQ ID NO: 173767 - RNA, 45 nt, Homo sapiens
cuagauucauuaauuuucauagugccuuuuucacaugagucagcu

SEQ ID NO: 173768 - RNA, 47 nt, Homo sapiens
cugcuuauuauguauacuguguucuuauauaugagaaagcacaaaug

SEQ ID NO: 173769 - RNA, 32 nt, Homo sapiens
ucuaggcccauuauuuuuauuaaaacugaaaa

SEQ ID NO: 173770 - RNA, 45 nt, Homo sapiens
cacggcagaacgugccaguuaucaauaucacuuacgacuccacac

SEQ ID NO: 173771 - RNA, 47 nt, Homo sapiens
caaaaagaaccuacucccuguuggugucuaggaaggaaaucucagau

SEQ ID NO: 173772 - RNA, 45 nt, Homo sapiens
guuauacugagaagagaaugaagagaaauggguagggugguaggg

SEQ ID NO: 173773 - RNA, 46 nt, Homo sapiens
ugaagggcuccagaagaguuguggaguggcuuuagagugguggagg

SEQ ID NO: 173774 - RNA, 80 nt, Homo sapiens
aauagaaagguggggaggaguaagcuauguggagaugcgggggaaagcauuccagacagagcagacuagaguggccuuua

SEQ ID NO: 173775 - RNA, 59 nt, Homo sapiens
aaaauauaaacaucucucccaaaauuaacacacauacuuguuuccuuagaauauuaaaa

SEQ ID NO: 173776 - RNA, 32 nt, Homo sapiens
uuucacucccauuuucauccuacuguuuuucu

SEQ ID NO: 173777 - RNA, 46 nt, Homo sapiens
agcuccagugacagugguggcaguaucgugcgagacagccagagac

SEQ ID NO: 173778 - RNA, 87 nt, Homo sapiens
uauaggaagauuguuuguggggaauaauaauaacaauucauucuuucauucuaauacaguauugaauacauuaaaaauauuucuaag

SEQ ID NO: 173779 - RNA, 46 nt, Homo sapiens
cuuaguuuucacugcagaguucccaaauaaccaaauuuagaggaaa

SEQ ID NO: 173780 - RNA, 33 nt, Homo sapiens
ugcaaguaauuaugaauguccagucucuguggu

SEQ ID NO: 173781 - RNA, 47 nt, Homo sapiens
auccuacucuaaaaggauuccuauucucaaaacauuuauaauauauu

SEQ ID NO: 173782 - RNA, 30 nt, Homo sapiens
cucgguucuaaaggaugauauuuuagaggu

SEQ ID NO: 173783 - RNA, 25 nt, Homo sapiens
auuauugaauuucagauuugucuuu

SEQ ID NO: 173784 - RNA, 74 nt, Homo sapiens
ggauuggaugaauaagugcaugagaguauaucuaguauuucagagucacuacuucccuguccuucaccugcaua

SEQ ID NO: 173785 - RNA, 44 nt, Homo sapiens
aagcauugcaguuguugcuuuuaaauugaaaauauuuacauuua

SEQ ID NO: 173786 - RNA, 46 nt, Homo sapiens
aggacacaauugauuucuuaaauuauacugucaauggugaugaacg

SEQ ID NO: 173787 - RNA, 44 nt, Homo sapiens
cuuucacaagaguugggaccugaguagaguucugaauaaugggg

SEQ ID NO: 173788 - RNA, 45 nt, Homo sapiens
uuucuucauuaccuugcguggguacuauuucuuugccauuugugu

SEQ ID NO: 173789 - RNA, 46 nt, Homo sapiens
uccaaaaagcagcagaagcauuuucugagcuuucuaaaaggaagaa

SEQ ID NO: 173790 - RNA, 46 nt, Homo sapiens
uugagaaaccaaggcaguaucaugagcaggaagaaacaccugagau

SEQ ID NO: 173791 - RNA, 42 nt, Homo sapiens
agauaugauucuucaaguggaugacagagcugugagccugau

SEQ ID NO: 173792 - RNA, 46 nt, Homo sapiens
gcuaugaucacuguugaugauggaauaaggaaauugaaauugcuug

SEQ ID NO: 173793 - RNA, 42 nt, Homo sapiens
ugucagcagugugucagauauaucucaauaccguguugaagu

SEQ ID NO: 173794 - RNA, 54 nt, Homo sapiens
cuaccuuuucccagacggacagagaacaugguucaaaaacaagugcaaaggccc

SEQ ID NO: 173795 - RNA, 104 nt, Homo sapiens
uauauuacuuuuauaauggaauaguaaacaaaauaacaucucauaaaauugauaguugauuaugaguuugggcagaauguagaauuaugucuauaugcuuugag

SEQ ID NO: 173796 - RNA, 49 nt, Homo sapiens
gacuguuggcccuauaguugggaccaugucuguuugguucacuuuggug

SEQ ID NO: 173797 - RNA, 49 nt, Homo sapiens
uugcacaucuaucucauuucaucuuuacacuagcacugugagcucggaa

SEQ ID NO: 173798 - RNA, 46 nt, Homo sapiens
cuuuucauuaaaaccagcugcugugguuuuaaaacgcaaaccagau

SEQ ID NO: 173799 - RNA, 44 nt, Homo sapiens
cuuauucuaacagaucacuauuuuaaaacaaaagagagaccaug

SEQ ID NO: 173800 - RNA, 45 nt, Homo sapiens
uuugccacaugagccgccgugauaagugaaacugugauugccaaa

SEQ ID NO: 173801 - RNA, 42 nt, Homo sapiens
ugaaaacagaauuuguuguuauaauaacaauagguaguuaaa

SEQ ID NO: 173802 - RNA, 45 nt, Homo sapiens
aaucuccucuucuuucugaccuaaaauagcuuacuuacccaaaca

SEQ ID NO: 173803 - RNA, 42 nt, Homo sapiens
agcuggaguuaauuugggggguuauuuagacauuuuaaucag

SEQ ID NO: 173804 - RNA, 43 nt, Homo sapiens
gucuuggugagucagagcauaguacuuuuuccucugagucagu

SEQ ID NO: 173805 - RNA, 54 nt, Homo sapiens
uuaaaaauuuuaaacuaauggaugagaaggacauaccugaauccaggcauggau

SEQ ID NO: 173806 - RNA, 48 nt, Homo sapiens
cuggcaucaagcuuuucuucaucacaucuucuuuucauauauucugua

SEQ ID NO: 173807 - RNA, 42 nt, Homo sapiens
uugcuaaggagggcucucaaaggcguaauuauuauaaagggu

SEQ ID NO: 173808 - RNA, 45 nt, Homo sapiens
gaggaggaaaucuuaguuaacgcccuagagaaaccaaaucagaaa

SEQ ID NO: 173809 - RNA, 35 nt, Homo sapiens
cagaauuuucaggaauaaggaguugcagcauacag

SEQ ID NO: 173810 - RNA, 50 nt, Homo sapiens
ggaucagccccuguggacgaagggaaggaaggaaacacuguugggccaag

SEQ ID NO: 173811 - RNA, 50 nt, Homo sapiens
augagcuuugcuuagaauuguuccacuaucauugauauccuguguaugga

SEQ ID NO: 173812 - RNA, 37 nt, Homo sapiens
uuaaucuguuuuucauagccccaugucaaaaauagaa

SEQ ID NO: 173813 - RNA, 46 nt, Homo sapiens
uccauguguauguauguaaguguguaucuucauuuuuugcugucac

SEQ ID NO: 173814 - RNA, 30 nt, Homo sapiens
uagaugagcagcgguuagaaacuagucgau

SEQ ID NO: 173815 - RNA, 57 nt, Homo sapiens
uuucuuugauacaccauucaucucguuaagaugagaauguccagccagcccuagaga

SEQ ID NO: 173816 - RNA, 38 nt, Homo sapiens
aacuuagccuucauuggacuaaaguagaaacguaagaa

SEQ ID NO: 173817 - RNA, 46 nt, Homo sapiens
cagaauaagaccaaaugaaagucucuugagagucgugucucagguu

SEQ ID NO: 173818 - RNA, 24 nt, Homo sapiens
ccauuuagugaacuuaguguguau

SEQ ID NO: 173819 - RNA, 47 nt, Homo sapiens
gauucuggaaaaugaaaccuaucuagaguacaacccaaaugcucaaa

SEQ ID NO: 173820 - RNA, 68 nt, Homo sapiens
ugagagaggaagugggcagauuugaaugagauugaacgaguauaguucauguauuauauauaucauua

SEQ ID NO: 173821 - RNA, 63 nt, Homo sapiens
aauugugcacccaugacccuugguaguauuuauacaugagacuuuuacuuguagucuacaguu

SEQ ID NO: 173822 - RNA, 36 nt, Homo sapiens
guuucuugauccuuucuucucucuuucugggugcau

SEQ ID NO: 173823 - RNA, 75 nt, Homo sapiens
cuguugccuuuuacaagacuuuuguaauuccuuuaacucccugcagacauuuugaaaaucacuucuuuguaacac

SEQ ID NO: 173824 - RNA, 36 nt, Homo sapiens
cauauuuaauuuaccuuccaauuuguaaacuucuua

SEQ ID NO: 173825 - RNA, 45 nt, Homo sapiens
cuugauaaaauuggcaaaaguagaguuacaauuuuauguuaauaa

SEQ ID NO: 173826 - RNA, 46 nt, Homo sapiens
uacugaccacaguuuuuacugagccuaaauugaaauauucugaaaa

SEQ ID NO: 173827 - RNA, 33 nt, Homo sapiens
auuucacuugcaagcaaggaaaauguggacucc

SEQ ID NO: 173828 - RNA, 55 nt, Homo sapiens
ucucucuccagguagaaagaugagcauguuugacaugugcggaauagguuggcau

SEQ ID NO: 173829 - RNA, 39 nt, Homo sapiens
uaagauugcaccacaagucauucacuuuauagcagaaaa

SEQ ID NO: 173830 - RNA, 37 nt, Homo sapiens
ucgucugggcucgcggcgucuccggggaaagccgugg

SEQ ID NO: 173831 - RNA, 40 nt, Homo sapiens
aaccugaaauuacuugucuaccaaguuacacuuagaagau

SEQ ID NO: 173832 - RNA, 46 nt, Homo sapiens
auuguuuaaguggagagcucuggcccuuuuaaaacacugucuguca

SEQ ID NO: 173833 - RNA, 37 nt, Homo sapiens
uguucuuuuggaaggugguuaaugaugcuaaggucuu

SEQ ID NO: 173834 - RNA, 30 nt, Homo sapiens
uuuuggacuauaugguggacaugccaugug

SEQ ID NO: 173835 - RNA, 42 nt, Homo sapiens
uucaaaggcucuguuauaaagccaaauacccaauccgggaag

SEQ ID NO: 173836 - RNA, 30 nt, Homo sapiens
aaccacauguuagacagaggcacuagcacg

SEQ ID NO: 173837 - RNA, 41 nt, Homo sapiens
agucuuuaaagguaugggauuauuaaguugacuaaguuuau

SEQ ID NO: 173838 - RNA, 44 nt, Homo sapiens
uauaauuugugauuucucuguuuuggaaguuguauauaacagaa

SEQ ID NO: 173839 - RNA, 46 nt, Homo sapiens
guguauguguuuuguuaaauuuugcauuauucugacuaauuugcag

SEQ ID NO: 173840 - RNA, 42 nt, Homo sapiens
uuuuuaacaacagacauauauuacaugugaauauguaagcag

SEQ ID NO: 173841 - RNA, 46 nt, Homo sapiens
aacaggaaaaugauugaauacauuuuuuauguccaugugauggaau

SEQ ID NO: 173842 - RNA, 28 nt, Homo sapiens
uauuuuauguucuucaaggaacauagau

SEQ ID NO: 173843 - RNA, 47 nt, Homo sapiens
uuuuuuuuauuacuuugcaaagggguacaccacuguauguaugguag

SEQ ID NO: 173844 - RNA, 49 nt, Homo sapiens
aaagagagcuauacuuuuuuccuugaacaauccaagaacaagaugauag

SEQ ID NO: 173845 - RNA, 45 nt, Homo sapiens
caguaugaccuuaucuuaacuaaugacaucuucaguggcccucuu

SEQ ID NO: 173846 - RNA, 44 nt, Homo sapiens
gggugagauuuugacaucucuuuuuugggggaaacaauucaaag

SEQ ID NO: 173847 - RNA, 46 nt, Homo sapiens
agauauuaaauauuuuuaucugcaaaaagcauuugguaagguucuc

SEQ ID NO: 173848 - RNA, 49 nt, Homo sapiens
aggcauuaggagauaaauuugcuuaugagcaagagacagauacuaacag

SEQ ID NO: 173849 - RNA, 92 nt, Homo sapiens
gaguuccccaauuccaaacugugucggggaaugggaggaaaugagggauggaggguuggugagggcuggagggaagacugaggcacuguggg

SEQ ID NO: 173850 - RNA, 53 nt, Homo sapiens
auuagcaagauaacacauguaaaucaaaaugcagaacuaauacauuuguuuua

SEQ ID NO: 173851 - RNA, 42 nt, Homo sapiens
cagagaccagaaagagauucgugcucaguaacaaagagagag

SEQ ID NO: 173852 - RNA, 66 nt, Homo sapiens
cuuaguagaguaguuggaauaaaauuacaacugaggaaggacaagaauaaaugguaucagaggaga

SEQ ID NO: 173853 - RNA, 34 nt, Homo sapiens
aaagcacauauaauucccccagacccuacauaaa

SEQ ID NO: 173854 - RNA, 15 nt, Homo sapiens
ugaagaccagcucgc

SEQ ID NO: 173855 - RNA, 26 nt, Homo sapiens
caaauuguuaaccuacagagugauua

SEQ ID NO: 173856 - RNA, 46 nt, Homo sapiens
ucuauuuaguaaugaguugcugaauagucauuaaauccacuggaga

SEQ ID NO: 173857 - RNA, 46 nt, Homo sapiens
aucuuuaauuaacauggaguuuuuccucuuuuuguuuuaggaucag

SEQ ID NO: 173858 - RNA, 45 nt, Homo sapiens
cacuuuauguccuuuuguuaaccgaagacaauuuugucacugaca

SEQ ID NO: 173859 - RNA, 42 nt, Homo sapiens
agguuaaugcagaaauuaaacuuccuugaggaauggaaagaa

SEQ ID NO: 173860 - RNA, 66 nt, Homo sapiens
uuaauuaaaaaauugggcaguagguaacuggcauuccucucuuuaaaauuucuaccgaacuuaaug

SEQ ID NO: 173861 - RNA, 47 nt, Homo sapiens
gugguacucauuucaggcacaucugaaaugaucuuaauuacuagaag

SEQ ID NO: 173862 - RNA, 40 nt, Homo sapiens
aaauucuaagggagaaaaaaacaauauuaaaccgcccaag

SEQ ID NO: 173863 - RNA, 46 nt, Homo sapiens
auauguaguaaaaauaaucauuuuuaauuaacuaaaaccugcucag

SEQ ID NO: 173864 - RNA, 40 nt, Homo sapiens
uagccacugcaacaccagagaaauucagaaaagcagcuca

SEQ ID NO: 173865 - RNA, 34 nt, Homo sapiens
aagguugagcucugaguaaaguccaaaagugguc

SEQ ID NO: 173866 - RNA, 46 nt, Homo sapiens
caaagucauccaccaagccugccuuggccacauuggccuuguagua

SEQ ID NO: 173867 - RNA, 47 nt, Homo sapiens
aggcaggcuugguggaugacuuugagaagaaguuuaauguccugaag

SEQ ID NO: 173868 - RNA, 45 nt, Homo sapiens
aaaacuugugcugagugggugucucucucaaaggccagguuggag

SEQ ID NO: 173869 - RNA, 45 nt, Homo sapiens
auggcgacgaggcgaacugggagcuggcacggaccgggacagcga

SEQ ID NO: 173870 - RNA, 43 nt, Homo sapiens
gcaugggguucuccuuuucaccuugauccgccaugauagagaa

SEQ ID NO: 173871 - RNA, 85 nt, Homo sapiens
ugaaaagauugcuguccacugcacaguucaaggauccaaggcagaagaaauccuggagaaggaucuaaaggugcagaaguaugag

SEQ ID NO: 173872 - RNA, 44 nt, Homo sapiens
aucuacggccuggacuucucuguggugcuggguaggccagguuu

SEQ ID NO: 173873 - RNA, 51 nt, Homo sapiens
gggaucauccuuccugacaaauaaacccguuuccaucaaaaaggccaauaa

SEQ ID NO: 173874 - RNA, 42 nt, Homo sapiens
gaccuggagcaguguaaggaggcggcggcggcggaggaggag

SEQ ID NO: 173875 - RNA, 46 nt, Homo sapiens
gcaaccaucuuacuggcgucccuucagaaaucaccagaagguacua

SEQ ID NO: 173876 - RNA, 71 nt, Homo sapiens
uuuuuaaaagccaacuugaguucaguaccaucugaauacacacacaugcacauauacccacacacgcauac

SEQ ID NO: 173877 - RNA, 51 nt, Homo sapiens
ucgaguuaaucacauuguaguuuuuaaauuucuacagccuagagcucacua

SEQ ID NO: 173878 - RNA, 43 nt, Homo sapiens
gauaaauccaauuuguuauuuccuguuagugacauaucaguga

SEQ ID NO: 173879 - RNA, 42 nt, Homo sapiens
uaucuuccaaaacauccacaagagcaaguucaucagccagag

SEQ ID NO: 173880 - RNA, 48 nt, Homo sapiens
uuaaguagaaaaggaugucacaggaugucagauccugucucuguuuca

SEQ ID NO: 173881 - RNA, 76 nt, Homo sapiens
auucagugaaauaaauaagaaaagggcuucuuuccucaagucuucgagaacuaaagaaagcuuaacugugguuuga

SEQ ID NO: 173882 - RNA, 44 nt, Homo sapiens
uauauauacacauauauguauguauauauggugagagaguauaa

SEQ ID NO: 173883 - RNA, 43 nt, Homo sapiens
uguccaacacccacuacagugaucuuauuguuuggaacuguug

SEQ ID NO: 173884 - RNA, 44 nt, Homo sapiens
uaccaggagagagaaggcucuggagaccucuguaacagucgugc

SEQ ID NO: 173885 - RNA, 44 nt, Homo sapiens
cagaagaggaauuauauuuuauggucacuccucuguguuucuau

SEQ ID NO: 173886 - RNA, 36 nt, Homo sapiens
cauaacuagcaacuucauuccacuaugugcuaggag

SEQ ID NO: 173887 - RNA, 49 nt, Homo sapiens
ccaccagcaccagguaauauauucucuauguuuguagaauuccaaagau

SEQ ID NO: 173888 - RNA, 52 nt, Homo sapiens
uuguguuaaauauucacuuugagugaaacuuuaaauauguuuccucuuuuga

SEQ ID NO: 173889 - RNA, 51 nt, Homo sapiens
gaacaguuuuuuuuuucuucaauagguuucagaaccuucugugguccagaa

SEQ ID NO: 173890 - RNA, 37 nt, Homo sapiens
aaaagagacauccuccuucccccucuuuucccugccu

SEQ ID NO: 173891 - RNA, 41 nt, Homo sapiens
ugcccuuaagagucauuuccuuguuaucacaggugucaaua

SEQ ID NO: 173892 - RNA, 116 nt, Homo sapiens
aauuuuguuaaaguaguaaaaaugcaguugacuuaguaggaacauaaaauuauuuccuaauaagauaauauugcacuccuaccaaauaaacaggauuuuaguaauaucugagggau

SEQ ID NO: 173893 - RNA, 51 nt, Homo sapiens
gcaacauuugaguuaguauugacuuugucuaaaagaggcuugacuucaacu

SEQ ID NO: 173894 - RNA, 23 nt, Homo sapiens
cugaggaauucgguaacaacuga

SEQ ID NO: 173895 - RNA, 52 nt, Homo sapiens
guaauuuauguugauuuuaauaaaaucauaauuuaaaaaaugaaaugggaag

SEQ ID NO: 173896 - RNA, 33 nt, Homo sapiens
aguagauuugauuugccuggagucuuuuggagg

SEQ ID NO: 173897 - RNA, 43 nt, Homo sapiens
uagguuuuccuucaacagaaacuuauaauaauaauuguguagc

SEQ ID NO: 173898 - RNA, 45 nt, Homo sapiens
aauuaacauguuuuuuauucgagagacuacuucucuucgggaggu

SEQ ID NO: 173899 - RNA, 45 nt, Homo sapiens; identical to SEQ ID NO: 97833

SEQ ID NO: 173900 - RNA, 31 nt, Homo sapiens
uuaagaagaauaggaaauaaaguuaguuaaa

SEQ ID NO: 173901 - RNA, 54 nt, Homo sapiens
cugaucugugaagcauaaucauuaucuugucuguaauuuguaaucuuauagacu

SEQ ID NO: 173902 - RNA, 46 nt, Homo sapiens
gaugcuacugucagguuacuggaaagggagugauacuggcuuggga

SEQ ID NO: 173903 - RNA, 44 nt, Homo sapiens
ucccaucuccuccuagacuuccaaagucucucaagauccugaau

SEQ ID NO: 173904 - RNA, 44 nt, Homo sapiens
guuuugaucauaauaaaacugagaauguuuaaauaggaaaauaa

SEQ ID NO: 173905 - RNA, 35 nt, Homo sapiens
gcaaguuuuaaaaggaaagagacgcucaggggaag

SEQ ID NO: 173906 - RNA, 92 nt, Homo sapiens
ugaaaugauuuucaagagacuuuaaaaauaauguguguaucuauauagaaaaaaagaaugagcaaaaugggggggaaucuggguugaggucu

SEQ ID NO: 173907 - RNA, 49 nt, Homo sapiens
augucuggaaaaauucaaaaauagcaauuuagcggaaauaggaagagag

SEQ ID NO: 173908 - RNA, 68 nt, Homo sapiens
uacagaauaguuuuauauucacuuuacauauaugucaauagaaucuuuauuaaaucaguacaaagucu

SEQ ID NO: 173909 - RNA, 47 nt, Homo sapiens
cauuacuaaauaacugauauuuucuugccuuucuagccucaacagau

SEQ ID NO: 173910 - RNA, 47 nt, Homo sapiens
uaugauuugaauuuauacauaauucugguugaggauuuuaaccagaa

SEQ ID NO: 173911 - RNA, 44 nt, Homo sapiens
cucugccugaagaugaauuaauucagguaauuaagauuuagucc

SEQ ID NO: 173912 - RNA, 48 nt, Homo sapiens
gcuucaaacaugggcagaggacagagggcaaguggaauauccaguaag

SEQ ID NO: 173913 - RNA, 24 nt, Homo sapiens
cuucuauguuuuccuaccuuuaug

SEQ ID NO: 173914 - RNA, 46 nt, Homo sapiens
aaaaguuccugauguucuguuuacaacuauagaccucccaacagau

SEQ ID NO: 173915 - RNA, 46 nt, Homo sapiens
gauuucugcaggauggcaccguggaaggcuguuuggaacagagguu

SEQ ID NO: 173916 - RNA, 38 nt, Homo sapiens
agauauaggaugcuuugggauccuagagggcugaaagc

SEQ ID NO: 173917 - RNA, 77 nt, Homo sapiens
guaauaaacugauuuaaaauuuauuuuucagaugaaccagaaacucgagaugcauggugggcagaaaucagacaaga

SEQ ID NO: 173918 - RNA, 46 nt, Homo sapiens
aggauugauuuagugcucaguucaugccugcaauuaaaaggauaua

SEQ ID NO: 173919 - RNA, 47 nt, Homo sapiens
uaucuugccaucauuuaaaauaaugucacguuggaagugugugaaga

SEQ ID NO: 173920 - RNA, 42 nt, Homo sapiens
aaaacugaucuacuaauuugcuguuuugaacucagccuuugu

SEQ ID NO: 173921 - RNA, 47 nt, Homo sapiens
auccuuaaauaacuuuucuuugacccaggggagauaaacauuuuuau

SEQ ID NO: 173922 - RNA, 30 nt, Homo sapiens
cacguuggggguguaguuagugcacguucu

SEQ ID NO: 173923 - RNA, 49 nt, Homo sapiens
guucccucaucucauugagaaguuccaucagaguuggagauucagagga

SEQ ID NO: 173924 - RNA, 48 nt, Homo sapiens
cuuucucuuaacccacacugcuuauccucucacuuauccuccuuuggu

SEQ ID NO: 173925 - RNA, 80 nt, Homo sapiens
augcacuuguauuuguuccugccacauugguguugauagaguaaccucacacaaugauucucuacccaucucaacuugau

SEQ ID NO: 173926 - RNA, 25 nt, Homo sapiens
auuaaaaccaaauauaauaaaagac

SEQ ID NO: 173927 - RNA, 25 nt, Homo sapiens
augcugacaguaucuguguaugcac

SEQ ID NO: 173928 - RNA, 48 nt, Homo sapiens
uucuauagcuuucauuaugucugauuuggaagcuauaagcauuuacag

SEQ ID NO: 173929 - RNA, 99 nt, Homo sapiens
ugaaaaaugugugagagccuauuucuuguauugauagcuuucuaguuuuaaucuuggucauuuaaauuuuauuuaaucuuagcaaauguugacagcguu

SEQ ID NO: 173930 - RNA, 89 nt, Homo sapiens
auuucucucucucucuuuuuuuuuuuuaaauaaacuucauugcuaagggaggaucgccucauagguucuguagaaggcggguauguuuc

SEQ ID NO: 173931 - RNA, 45 nt, Homo sapiens
aagugguagugcuggaaaagaaggggggcccuuuaaagcucuuuu

SEQ ID NO: 173932 - RNA, 42 nt, Homo sapiens
uuauuauuauuauuauuuuauuuuuuuugccauaccacagau

SEQ ID NO: 173933 - RNA, 53 nt, Homo sapiens
gugcauucuuuuuguuagccauuuuauuucugcuggccauuagucauuugggu

SEQ ID NO: 173934 - RNA, 34 nt, Homo sapiens
aaugucuagaggccagggaguuuauaugaauaaa

SEQ ID NO: 173935 - RNA, 52 nt, Homo sapiens
aauuguguugaugagguaguguaguggaaagagcgcugagcaaggggcguuc

SEQ ID NO: 173936 - RNA, 46 nt, Homo sapiens
ccaaauuauacaaaugcaguuuauauuuacuuugcuuacaugagaa

SEQ ID NO: 173937 - RNA, 27 nt, Homo sapiens
cuagggaacuccaugaaauauaugggu

SEQ ID NO: 173938 - RNA, 65 nt, Homo sapiens
cuguagugguugggauacugcauagcugcccucuauuggaaaagcuuaaaggucuggauuaagag

SEQ ID NO: 173939 - RNA, 31 nt, Homo sapiens
uucuguucuaaaaguaguccugucacugugu

SEQ ID NO: 173940 - RNA, 45 nt, Homo sapiens
aacaaacaucagacuguuuuuaacaaauauuaaagauugucagac

SEQ ID NO: 173941 - RNA, 48 nt, Homo sapiens
acaaaacuguagagugcucuaaacuugucacuuaaaaaaucauguacu

SEQ ID NO: 173942 - RNA, 49 nt, Homo sapiens
uuaauuaaauuaagacuaagugaaccgagauucuucuguacuagagugg

SEQ ID NO: 173943 - RNA, 43 nt, Homo sapiens
aacuacauugucaucuuguguuuuucuaggaaccuuugaggga

SEQ ID NO: 173944 - RNA, 99 nt, Homo sapiens
aaucccauccuguagugauuuaaagagaaaguacaugggaagugaggaaguagaaagaguaugaauaggcaacuguuucaagauguauggcuaugaagg

SEQ ID NO: 173945 - RNA, 93 nt, Homo sapiens
uuauuagaagaggaggacuagaggaaggaaacugagauugugagccagugggugggagaaaaauggggaacauaaugucuuagaaggcaagag

SEQ ID NO: 173946 - RNA, 46 nt, Homo sapiens
ggccgggcgccauuugccagugauggaccgugcuagugaccugacu

SEQ ID NO: 173947 - RNA, 67 nt, Homo sapiens
caaauguuuuaugucaaguguuaauugcagaaauaaaucuuuuuuuuuuuuuuuugguagaaaacaa

SEQ ID NO: 173948 - RNA, 60 nt, Homo sapiens
auugucuuuauuuuccaugagcuacuaagucauuagagauacucugaagcauaguuaguu

SEQ ID NO: 173949 - RNA, 49 nt, Homo sapiens
uacucugugcauuaggaagaccugagugcauuucccaccauuguccuuu

SEQ ID NO: 173950 - RNA, 164 nt, Homo sapiens
auaacuugguaguaguaacuuaccuuaccuuaccuagaaaaacauuaauguaagccauauaacaugggauuuuccucaaugauuuuagugccuccuuuuguacuucacucagauacuaaauaguaguuuauucuuuaauauaaguuacauucugcuccucaaac

SEQ ID NO: 173951 - RNA, 49 nt, Homo sapiens
gaaaauagaggauacaauggaaaauagaggauaccaacuguaugcuacu

SEQ ID NO: 173952 - RNA, 50 nt, Homo sapiens
augcaguaauguuucuugaaggagugaaugggcaagugaaacaccaaaca

SEQ ID NO: 173953 - RNA, 40 nt, Homo sapiens
acaacagccaccgaaaaaaccuucaagauucuugccagua

SEQ ID NO: 173954 - RNA, 37 nt, Homo sapiens
agauauucccaacacaaugugugggcaugagcaaagc

SEQ ID NO: 173955 - RNA, 45 nt, Homo sapiens
caauacacauuccaacuauggagaaugguccuaagcuggcaagcc

SEQ ID NO: 173956 - RNA, 46 nt, Homo sapiens
gccagcuuaggaccauucuccauaguuggaauguguauugucuaca

SEQ ID NO: 173957 - RNA, 34 nt, Homo sapiens
caugggagaagaauuguucuguuucaugucaaua

SEQ ID NO: 173958 - RNA, 46 nt, Homo sapiens
cuuacuguucugcuuaacauucugauugcacuuagacaaggucaca

SEQ ID NO: 173959 - RNA, 30 nt, Homo sapiens
acagaagaagaacuggcaacuccuccacua

SEQ ID NO: 173960 - RNA, 84 nt, Homo sapiens
ccgguuugggggcacuggaaguguguguguguguguacauauauauacacacacaaauagauccauacauuuauguaucuaguu

SEQ ID NO: 173961 - RNA, 45 nt, Homo sapiens
acuugcacaugcggggcugcuguuuucauuuaacuucauguaguc

SEQ ID NO: 173962 - RNA, 46 nt, Homo sapiens
ugaagugggaacuaugaaucuuuuucuuuacuggauaaaugaagau

SEQ ID NO: 173963 - RNA, 52 nt, Homo sapiens
uugggcaaaaagagaugagccguaauuccuuuaagaaagagaaaauacacag

SEQ ID NO: 173964 - RNA, 45 nt, Homo sapiens
gccuggaaagguggaacuggggacugcaagaugggaggguaagua

SEQ ID NO: 173965 - RNA, 69 nt, Homo sapiens
caucuuucccacaaacacuguaaagccagaagcccacaaugcaaaaucaugccaauuccuccaucacaa

SEQ ID NO: 173966 - RNA, 44 nt, Homo sapiens
cguugggucucucaguuuucuuccuuaauaaacaaugaacccua

SEQ ID NO: 173967 - RNA, 42 nt, Homo sapiens
gauuuugacagguaaauuugcauuuuauuccacuagguggua

SEQ ID NO: 173968 - RNA, 41 nt, Homo sapiens
auuacuuagagguuuaucaagaccuuuuuucuacaaaugga

SEQ ID NO: 173969 - RNA, 86 nt, Homo sapiens
ugggucccauauucaacaucugcuagucuguauauucguccuacauucauuggaacugaggugcaaacugacucuuuauuuugggg

SEQ ID NO: 173970 - RNA, 27 nt, Homo sapiens
gaauauacagacuagcagauguugaau

SEQ ID NO: 173971 - RNA, 36 nt, Homo sapiens
auuauguuuuucauucuuucagguauuugacaaaga

SEQ ID NO: 173972 - RNA, 40 nt, Homo sapiens
aaugcuucagugaggaucauuuauuauugccacauuguga

SEQ ID NO: 173973 - RNA, 43 nt, Homo sapiens
uaguauuuugucacauuuaaguauaucaucuaauuagaauuga

SEQ ID NO: 173974 - RNA, 42 nt, Homo sapiens
cacauuuuauccauuuuuuuccuucaugauuuguguuuuaca

SEQ ID NO: 173975 - RNA, 76 nt, Homo sapiens
gaccccaauaaucugguuuuuggaacuguguucacggaucauaugcugacgguggagugguccucagaguuuggau

SEQ ID NO: 173976 - RNA, 48 nt, Homo sapiens
uaggaaguuguuuuuaauaugcccuguuuuucucaauauuucuugcca

SEQ ID NO: 173977 - RNA, 30 nt, Homo sapiens
gauuuuauuuugagucauauauuuuucuug

SEQ ID NO: 173978 - RNA, 56 nt, Homo sapiens
agaggcuuagugucuaaagcaacguucaacugaauaaauccauuucuuguugagau

SEQ ID NO: 173979 - RNA, 45 nt, Homo sapiens
aguaacggaugcuccgcagaguguaccggagaaggaggaucaaaa

SEQ ID NO: 173980 - RNA, 42 nt, Homo sapiens
acaagagcagacgcacaaaugucaauccccgcccgcaaacuc

SEQ ID NO: 173981 - RNA, 42 nt, Homo sapiens
gaguaaaauuagaugaggguauuuaacccacuauauuaacua

SEQ ID NO: 173982 - RNA, 42 nt, Homo sapiens
uuuuaaggguuauuuuauaguuaacuagcagaaaauguggau

SEQ ID NO: 173983 - RNA, 42 nt, Homo sapiens
aggguagguugggggaaagggggaagagaagaccaugcaugu

SEQ ID NO: 173984 - RNA, 66 nt, Homo sapiens
gaaaugaaaauaaacccuguaguauuggaauugaauguuagguagcagauuauauggagauuaaua

SEQ ID NO: 173985 - RNA, 48 nt, Homo sapiens
uaaaagucauacacacauacaacaccuaaauccguauguauauacacu

SEQ ID NO: 173986 - RNA, 47 nt, Homo sapiens
ucaccaccaaucuuacugcccaucuacuauuccaaccugcuuaacuc

SEQ ID NO: 173987 - RNA, 47 nt, Homo sapiens
ucaaaggcuacacauccugggccauuggacucucuguagcagauuug

SEQ ID NO: 173988 - RNA, 46 nt, Homo sapiens
caacauggcagccuuuuccuuagaacaccaaagauugucucuggca

SEQ ID NO: 173989 - RNA, 20 nt, Homo sapiens
augugcauuccugauuccuu

SEQ ID NO: 173990 - RNA, 64 nt, Homo sapiens
uguaugaucuguugguguacacaccauggguaagguauugcuugcacauaauuugcucugcaua

SEQ ID NO: 173991 - RNA, 71 nt, Homo sapiens
uuauggaccauugugguuucuuccagucacuuagauggaaaggagguuaaaccuagguacuuuuuagcaag

SEQ ID NO: 173992 - RNA, 49 nt, Homo sapiens
cuguauaaagucauuuuguuguuguucagagaaaucaagaucuuauuca

SEQ ID NO: 173993 - RNA, 47 nt, Homo sapiens
ugagacuucaguugguauuaauaggaguuaccuauuuaauucuccca

SEQ ID NO: 173994 - RNA, 32 nt, Homo sapiens
guucaaaugccagugcuguuuuucauuuuuga

SEQ ID NO: 173995 - RNA, 49 nt, Homo sapiens
aaagaaacacggagcugggccaucgucagaacuaagucagggaaggaga

SEQ ID NO: 173996 - RNA, 57 nt, Homo sapiens
aggcauauauuuuucaaagaagugaggaugcaguuucucacguugcaaccuauucug

SEQ ID NO: 173997 - RNA, 42 nt, Homo sapiens
ggggggaccaacugcuucacacuuucaacacugcacugaaga

SEQ ID NO: 173998 - RNA, 42 nt, Homo sapiens
uuuaaaauauuucagcugucauuuuuguacuaauuauaaaau

SEQ ID NO: 173999 - RNA, 41 nt, Homo sapiens
agaacuaaauuuagcauauugcaaaaauauuuugugcggaa

SEQ ID NO: 174000 - RNA, 45 nt, Homo sapiens
uguuaguccuuuccuaaaaugcugauguucuguucugugaauaua

SEQ ID NO: 174001 - RNA, 46 nt, Homo sapiens
auaacagagcugaacuauaucaacaucuuaaagaggaaaauggguu

SEQ ID NO: 174002 - RNA, 30 nt, Homo sapiens
ccccagaaccuccaaacaaaaaaccccuug

SEQ ID NO: 174003 - RNA, 45 nt, Homo sapiens
ugaaagauuaugaacaggaaaagucuuggcaagacucagagaggu

SEQ ID NO: 174004 - RNA, 62 nt, Homo sapiens
agaaacaucaaagagucuuggaaugucugauggcaugcaggagcaaacccccagaagaggaa

SEQ ID NO: 174005 - RNA, 68 nt, Homo sapiens
agaugaacaauaccguaucauguggaaugaauuagaaacccuugucagagcccauaucaacaacucag

SEQ ID NO: 174006 - RNA, 44 nt, Homo sapiens
uaccuauuuccacaguugguacaagaggaaagggcccuaaaagg

SEQ ID NO: 174007 - RNA, 50 nt, Homo sapiens
ugaaagaaucucugacagaagaagauguguuaaacugucaaaaaacaaua

SEQ ID NO: 174008 - RNA, 45 nt, Homo sapiens
aaucaauuagacaauuuguaauuuauaccauuucuuaagcaaaga

SEQ ID NO: 174009 - RNA, 52 nt, Homo sapiens
cuagaccccagauauaaaaucgauggaagucuugaggucccuuuggaacgag

SEQ ID NO: 174010 - RNA, 75 nt, Homo sapiens
uuuuugcacguccuuagcaguucucgauccauucuagaagauccaccuucaauuagugaaggauguggaggaaga

SEQ ID NO: 174011 - RNA, 54 nt, Homo sapiens
uuugcauuuucguuuuucauuguuucaggacucaaugaacucagugaagaaguu

SEQ ID NO: 174012 - RNA, 45 nt, Homo sapiens
aaggugauucgcaucuagguggcggcagucgagaaggcucguuua

SEQ ID NO: 174013 - RNA, 115 nt, Homo sapiens
cauuucccuaauccagccuuuuauuuccuuaccuaguaucucacaguagccuacuaaauggccugucccuaucuacucuuuacccucuagcuacaguaacuuucagaaugcuaau

SEQ ID NO: 174014 - RNA, 59 nt, Homo sapiens
ucaauucuaaaauacaaugaaaauuuuaagauguugaaggucauuuuaaaagccuuuaa

SEQ ID NO: 174015 - RNA, 46 nt, Homo sapiens
caauuaugauguggagcuacuucaucacaaagaugcacauguagau

SEQ ID NO: 174016 - RNA, 44 nt, Homo sapiens
cuuuucuccccauaucguauuuucuguuuugcuagcccacauuc

SEQ ID NO: 174017 - RNA, 46 nt, Homo sapiens
aacauuuugacuuggcuucaacuacuauuacaaauauuccaaugaa

SEQ ID NO: 174018 - RNA, 55 nt, Homo sapiens
aguugggguguaccacccucccagcacauggauguguuuaccaaccuagaagcuc

SEQ ID NO: 174019 - RNA, 42 nt, Homo sapiens
uacucauggagaaugcagaacguguuggaaauagaggacgaa

SEQ ID NO: 174020 - RNA, 43 nt, Homo sapiens
gaugcgucuugaaagcaagaggugaaaauagcuggaucguaag

SEQ ID NO: 174021 - RNA, 55 nt, Homo sapiens
gugugcacgcgcacgcgcgcuccugcucuuaggaagccugggaaggaccggugug

SEQ ID NO: 174022 - RNA, 47 nt, Homo sapiens
ucuguaacguaauuccacuuacagccagcaugccccauacugccagg

SEQ ID NO: 174023 - RNA, 55 nt, Homo sapiens
gggacaccugggguuuggcagcggaugggaguggagguugaggguacaacagaag

SEQ ID NO: 174024 - RNA, 55 nt, Homo sapiens
ccauauuccaaagaguaagagggaggagaagacagaaggguuaccucuuucugag

SEQ ID NO: 174025 - RNA, 24 nt, Homo sapiens
ucuauacugauuuuuagcugauag

SEQ ID NO: 174026 - RNA, 45 nt, Homo sapiens
caaaugggcauuaaagccauggaauuccuuugaaagguggaauaa

SEQ ID NO: 174027 - RNA, 54 nt, Homo sapiens
auaucuaacuugaaguugaaacugacagcuguagagaaggacagauuggauuau

SEQ ID NO: 174028 - RNA, 44 nt, Homo sapiens
uccuuugguuuuguuuaguaauuguuugcuacuguugaguccag

SEQ ID NO: 174029 - RNA, 39 nt, Homo sapiens
auuguucaaaaaccagcaaauccggaucuauaccugaaa

SEQ ID NO: 174030 - RNA, 41 nt, Homo sapiens
augagggagagacacacucucaacuugugggaccgguggau

SEQ ID NO: 174031 - RNA, 45 nt, Homo sapiens
caucuuccuaaggaacagacuuaaguaugcccugacaggagauga

SEQ ID NO: 174032 - RNA, 45 nt, Homo sapiens
auccacuauccugauccccuuaucaaggugaaugauaucauucag

SEQ ID NO: 174033 - RNA, 41 nt, Homo sapiens
ugacuggaagugcuaaccugggaagaauuggugugaucacc

SEQ ID NO: 174034 - RNA, 101 nt, Homo sapiens
ccugaggaaaggguacccaccucaccauuguugaagagagagacaaaagacuggcggccaaacagagcagugggugaaauggucccugggcgacauguuag

SEQ ID NO: 174035 - RNA, 41 nt, Homo sapiens
guauguaauuaaaaauaauguggcaugauuaaaaaaaaaga

SEQ ID NO: 174036 - RNA, 44 nt, Homo sapiens
ugaaaaaccaugaucauucuuuguacauaaaauaaacauuugaa

SEQ ID NO: 174037 - RNA, 46 nt, Homo sapiens
ucugcucaaaccggcacggucugauccggaaauauggccucaauau

SEQ ID NO: 174038 - RNA, 49 nt, Homo sapiens
uuauccaaaagauaccuaaauuaaaaaggagaaacaugucucagagaga

SEQ ID NO: 174039 - RNA, 48 nt, Homo sapiens
aagacaagugcagagauaaaguauuauuguuuugcagugauacuacaa

SEQ ID NO: 174040 - RNA, 45 nt, Homo sapiens
uguuguuggcauaguacugaaaaaucaguuguuaaucuuagcaaa

SEQ ID NO: 174041 - RNA, 30 nt, Homo sapiens
agggaauugugguggaaguuaccugggcag

SEQ ID NO: 174042 - RNA, 70 nt, Homo sapiens
uuccugacauucagacaacugacuuguaacugacuuauaacugacuuguaauacacugcuacuauaucaa

SEQ ID NO: 174043 - RNA, 48 nt, Homo sapiens
gaaaaaccaaagagugcuacauuaccaccacuguauccuaaaagccag

SEQ ID NO: 174044 - RNA, 45 nt, Homo sapiens
aacugauuuuggagcuaacguacccaauaugccggcacuacagag

SEQ ID NO: 174045 - RNA, 58 nt, Homo sapiens
ccagauuacagaccaccuccaaagcuauaccguuacucaccacaaagcuuuuuaccag

SEQ ID NO: 174046 - RNA, 89 nt, Homo sapiens
guacuggacacaaguguugcaaaagaaaagcuaguaagggauauuaaaacauuaguagagauaaaacagaaguuuucagaacuugcaag

SEQ ID NO: 174047 - RNA, 46 nt, Homo sapiens
auaaauauaacaaagggaacagaacuucagauagcuguagugucac

SEQ ID NO: 174048 - RNA, 58 nt, Homo sapiens
auuggcagaaaaugcaaaggcaacugcugcuuugaaaguugauguuaguggaccagua

SEQ ID NO: 174049 - RNA, 45 nt, Homo sapiens
caguacuauuccuugacuccugugagauuugcugaucguucauag

SEQ ID NO: 174050 - RNA, 61 nt, Homo sapiens
uaugaacgaucagcaaaucucacaggagucaaggaauaguacuguugugaguagugauaca

SEQ ID NO: 174051 - RNA, 54 nt, Homo sapiens
cccaaauagcaaagauauucagcucucuucccuugaaaaugguugagccacaga

SEQ ID NO: 174052 - RNA, 47 nt, Homo sapiens
aggaagugugggagcuacauucaaauuaggugacucuuugucaaacc

SEQ ID NO: 174053 - RNA, 46 nt, Homo sapiens
aaauuuaguagaauucuaacuccuaaggaguauuuacaaaggcaga

SEQ ID NO: 174054 - RNA, 46 nt, Homo sapiens
uaaagaaucauuaaauggcuugacaagccaugguaaaaaccucaaa

SEQ ID NO: 174055 - RNA, 74 nt, Homo sapiens
aaaugccuccccaaguaaaggaucaaaagaaauuauaucugaauagaguuggguuuaaaugcacugaacgugaa

SEQ ID NO: 174056 - RNA, 51 nt, Homo sapiens
agcauuucucucaccaaauuagaaaguucacccaggaagcuucauaaagau

SEQ ID NO: 174057 - RNA, 46 nt, Homo sapiens
uuauuuacauguuaauuugauuaaucuucaauacaauuuaggcaag

SEQ ID NO: 174058 - RNA, 49 nt, Homo sapiens
ugaaaguaccuuguuguuaggguuuggcuuugaaaacuaaaagcuagag

SEQ ID NO: 174059 - RNA, 46 nt, Homo sapiens
aagagaagcuucagugcagauggauuugagaugcuacaaaacccag

SEQ ID NO: 174060 - RNA, 42 nt, Homo sapiens
uuuucagaagucuuauuuuauacuugugaaacugaacacaau

SEQ ID NO: 174061 - RNA, 44 nt, Homo sapiens
gcgucucugaauaagcagaauccggagccccucgcuacccgcgg

SEQ ID NO: 174062 - RNA, 49 nt, Homo sapiens
cauuguuuccucccccaagagaaaaauugccuaagaaaugaauauauaa

SEQ ID NO: 174063 - RNA, 80 nt, Homo sapiens
gaaaaugagaccgauuagggaagaaaacccgagaagcucagaguuugggugacccuggggaugugggaagguggugaaaa

SEQ ID NO: 174064 - RNA, 42 nt, Homo sapiens
uccauucugggucuugguggcaagccaggaugauucaggcag

SEQ ID NO: 174065 - RNA, 76 nt, Homo sapiens
augugcuaaaaacuaaauaaagcaagguggaggaauaacaagacuggcgggggugcuggcugggguggcuauuuga

SEQ ID NO: 174066 - RNA, 46 nt, Homo sapiens
aaagucacaggagugaaugagauuaaguagaggaagaaggaaaaga

SEQ ID NO: 174067 - RNA, 49 nt, Homo sapiens
cagagcagacagaggaagggcacgcagugacagagcccacgaagugugg

SEQ ID NO: 174068 - RNA, 47 nt, Homo sapiens
gacggcccgaaucuccucacagcuccaggacugcugcgcugguggug

SEQ ID NO: 174069 - RNA, 45 nt, Homo sapiens
cuugugggcaccaaauuuuuuuuuuuaauuuuauuguaucuuuag

SEQ ID NO: 174070 - RNA, 45 nt, Homo sapiens
cugacaaaguaauuuuggcucuuuaccagggaugcuucauauaaa

SEQ ID NO: 174071 - RNA, 71 nt, Homo sapiens
gccaccaggcuuugaauagcaguggugcuacuuagaagcugagagguuaugaaccuuauaugcaaccauag

SEQ ID NO: 174072 - RNA, 43 nt, Homo sapiens
agugaaagaucacauuacuuuacaugaggaccacaaggcacau

SEQ ID NO: 174073 - RNA, 46 nt, Homo sapiens
cccugucucugacuuauucagugagcugaacauuucagaaauacag

SEQ ID NO: 174074 - RNA, 46 nt, Homo sapiens
aguccaacuaagacccccacaaucucuccuguuauuacugccccac

SEQ ID NO: 174075 - RNA, 45 nt, Homo sapiens
uaaugacugaaauuguuuucacccugaguuuuaccuuggugggag

SEQ ID NO: 174076 - RNA, 46 nt, Homo sapiens
gucacccaguuggaugagaugcagagacaguuagcagcugcagagg

SEQ ID NO: 174077 - RNA, 42 nt, Homo sapiens
ccccccuuccaugagugaauucauccaagggcaccggcucag

SEQ ID NO: 174078 - RNA, 30 nt, Homo sapiens
cauguaaaauacguauauugcaguaucauc

SEQ ID NO: 174079 - RNA, 29 nt, Homo sapiens
cuggugcugcuccuuuguauguguguaug

SEQ ID NO: 174080 - RNA, 50 nt, Homo sapiens
uugagggagguuaauuuucuagcuccuccuacaaauacauauuguaguaa

SEQ ID NO: 174081 - RNA, 37 nt, Homo sapiens
accauccacuuugauucgauuuuauuuaaagggugga

SEQ ID NO: 174082 - RNA, 45 nt, Homo sapiens
ccccugagggccugucuccgccggaggcugagguggcucuuggcg

SEQ ID NO: 174083 - RNA, 44 nt, Homo sapiens
agcucgccuugacggcaaucacacucucacugacuguccggcgg

SEQ ID NO: 174084 - RNA, 42 nt, Homo sapiens
uaggauuugcuauguauuuuggauaugggaucccacacagcu

SEQ ID NO: 174085 - RNA, 45 nt, Homo sapiens
gaugaccacugagaccugggcccaauguggagucuggauguugau

SEQ ID NO: 174086 - RNA, 103 nt, Homo sapiens
gccuguucucuggagagcugaucuacaucgcagcggcuguguugcugcuggugcucauugugggauucacuuucaccgucuggagacagccccagagcaacac

SEQ ID NO: 174087 - RNA, 22 nt, Homo sapiens
gcguccagcacuccggcgaguc

SEQ ID NO: 174088 - RNA, 46 nt, Homo sapiens
gugcccggguuccccguucugguucggcauaucucuacagcuaugu

SEQ ID NO: 174089 - RNA, 42 nt, Homo sapiens
aaaccugcacugguucauagcagccucuccaaauagcugacc

SEQ ID NO: 174090 - RNA, 42 nt, Homo sapiens
aggaagcauuuugauucccugcuccucugagacuccccagcu

SEQ ID NO: 174091 - RNA, 42 nt, Homo sapiens
acagggaacuguagcuucugagaauggcuguuggcucggcaa

SEQ ID NO: 174092 - RNA, 45 nt, Homo sapiens
augaucuguggcugggauaggagaggcccuggccucugcuacaug

SEQ ID NO: 174093 - RNA, 40 nt, Homo sapiens
auauguaaucccacuugacccucaacaaacccauacgaag

SEQ ID NO: 174094 - RNA, 46 nt, Homo sapiens
uuccuggcccugggggucccucugucccaagcgggggcaccgggcc

SEQ ID NO: 174095 - RNA, 46 nt, Homo sapiens
cguuuuucucuguggcuguauguggguugcuugggggugggauggg

SEQ ID NO: 174096 - RNA, 45 nt, Homo sapiens
cagguuguuggcauccacgaugacgcgguauucaggcgcggccuc

SEQ ID NO: 174097 - RNA, 45 nt, Homo sapiens
gggacuccacauacucguagaugcggugcuuggaggcguucagcu

SEQ ID NO: 174098 - RNA, 42 nt, Homo sapiens
uagccgguguggggcagcacugagguagacgagaagcccgac

SEQ ID NO: 174099 - RNA, 26 nt, Homo sapiens
gugggcugcccacccaggccuccucu

SEQ ID NO: 174100 - RNA, 45 nt, Homo sapiens
aagcacaccgccgcaccucaccuaagcaaaccacccggucacuga

SEQ ID NO: 174101 - RNA, 46 nt, Homo sapiens
gucacauaaguuuugcgacaaacccagcuccgggccacuggcaugu

SEQ ID NO: 174102 - RNA, 41 nt, Homo sapiens
cuuaauccuccuccucgucgucuccagccccagccccaccc

SEQ ID NO: 174103 - RNA, 27 nt, Homo sapiens
ggugggacccaggagacagcggaccug

SEQ ID NO: 174104 - RNA, 41 nt, Homo sapiens
ggccccccgagccccccggguccaagauccccucgcccggg

SEQ ID NO: 174105 - RNA, 28 nt, Homo sapiens
gggaccuguagggguggccuguauucag

SEQ ID NO: 174106 - RNA, 38 nt, Homo sapiens
guggacaaaggcccagugggggagagacacggccccag

SEQ ID NO: 174107 - RNA, 64 nt, Homo sapiens
uccaggcucagcguccccccaggagaugguggcagcugccccccuuguacccuuaggaaccccc

SEQ ID NO: 174108 - RNA, 46 nt, Homo sapiens
cacagaaaccaagcaccagcgacaccagccccuguccacgggccag

SEQ ID NO: 174109 - RNA, 107 nt, Homo sapiens
ccuccccaaucccuucccuuacucaauccucagaugucccagacuccagaucucagacacccgcuacuaugcaccccuccuucacuucuaaaaccccaugccucgac

SEQ ID NO: 174110 - RNA, 42 nt, Homo sapiens
cauggagccuuaugguagcuccuucaugggguggaggcaacu

SEQ ID NO: 174111 - RNA, 48 nt, Homo sapiens
cucgccuggcaggcugcacccccaccccacccugggcaggaccgggca

SEQ ID NO: 174112 - RNA, 41 nt, Homo sapiens
uuccaacagguuagggcugcgggcaggggaaacggguguug

SEQ ID NO: 174113 - RNA, 44 nt, Homo sapiens
uccaugcagcagccagccagccaggugauccuuuuaaaacacaa

SEQ ID NO: 174114 - RNA, 67 nt, Homo sapiens
ugcacccgcccuugucauugcaggccccuaucucccuuucacauggguccuccccagucagcacccc

SEQ ID NO: 174115 - RNA, 62 nt, Homo sapiens
cccugcugccccugccacaucccagugggcucugacccccugaucucaacucguggcacuaa

SEQ ID NO: 174116 - RNA, 106 nt, Homo sapiens
uagaaucagaagaaagcguuuuguuuuuugauuuuuuuuuuuuuuuuuuuaaagaacaaugucuuuggaccccuugcugagccuggacaggcgcagaaauuccugg

SEQ ID NO: 174117 - RNA, 93 nt, Homo sapiens
guucuuuaaaaaaaaaaaaaaaaaaaucaaaaaacaaaacgcuuucuucugauucuaaaaguaaugcgcguguccugacacaggaagacacag

SEQ ID NO: 174118 - RNA, 51 nt, Homo sapiens
gacauaucggcucuccaucuggccaaaaacuucuauagauaagaugggugg

SEQ ID NO: 174119 - RNA, 50 nt, Homo sapiens
gguagggaaaauggggagggaggaguuuaagcaggagaucauaaaaccag

SEQ ID NO: 174120 - RNA, 50 nt, Homo sapiens
cuacacuuccucugcuugagcaggguaugggagcugggcuaggauguuac

SEQ ID NO: 174121 - RNA, 45 nt, Homo sapiens
aaccccggcaagggcucccggcuccagucaaugguauaggccgag

SEQ ID NO: 174122 - RNA, 44 nt, Homo sapiens
gcgucggggaccuggaggaggagcgggagcgggagucugugcug

SEQ ID NO: 174123 - RNA, 39 nt, Homo sapiens
ugcccugcaccuggggcagcggggcgagaacaagaguca

SEQ ID NO: 174124 - RNA, 42 nt, Homo sapiens
guccacgagguagccagacaugcagggugcauggcaguagag

SEQ ID NO: 174125 - RNA, 48 nt, Homo sapiens
cauuaguggagugaaaggcggacacagaugagccugcagaccaugccc

SEQ ID NO: 174126 - RNA, 50 nt, Homo sapiens
aagcaggugaggcagcgggcggugggcgggcuugcugggugcccccgccg

SEQ ID NO: 174127 - RNA, 37 nt, Homo sapiens
cgaggacgggcacagucucuaagcagcucccccaccc

SEQ ID NO: 174128 - RNA, 46 nt, Homo sapiens
agggaaaggggaaaaaaaaaucagaagaaacacugggggcagaggg

SEQ ID NO: 174129 - RNA, 43 nt, Homo sapiens
ggagggaggggaaccguuuuaccugugcugaaccaagggaaga

SEQ ID NO: 174130 - RNA, 46 nt, Homo sapiens
cagcuguuugcaaacucauagcacauccuccaguuacauggcagaa

SEQ ID NO: 174131 - RNA, 51 nt, Homo sapiens
cugaaauagguuuuuauuauugcgauaacagugacuguuaaaacaaaagua

SEQ ID NO: 174132 - RNA, 70 nt, Homo sapiens
gaaggcgcgggccggggauuaggagacggaggcggacucggagccagggaaccagggguccgggcuagag

SEQ ID NO: 174133 - RNA, 46 nt, Homo sapiens
gggcugagccaggcucugugaucauccagggaaguccugugacccu

SEQ ID NO: 174134 - RNA, 67 nt, Homo sapiens
gagcuggccgcccagcccagcacauaccuggccguggcggaggaacuggcggauguuuccggaaagu

SEQ ID NO: 174135 - RNA, 45 nt, Homo sapiens
caccgagaaaccugccaucaccgagaaaccugccaccaccgagaa

SEQ ID NO: 174136 - RNA, 47 nt, Homo sapiens
ucguugggggugagaagacaggaaugguucagaugguugggguggaa

SEQ ID NO: 174137 - RNA, 48 nt, Homo sapiens
gugccacugggcaaugggccgccgcggguuggccagcauguccgccca

SEQ ID NO: 174138 - RNA, 41 nt, Homo sapiens
cucauagggacccgcaccuccccgauggcgucauugcgaga

SEQ ID NO: 174139 - RNA, 42 nt, Homo sapiens
gcucucgugaccgccucggucuccacgcugccucuugacccc

SEQ ID NO: 174140 - RNA, 46 nt, Homo sapiens
accaauuacaaugacagauacgaugagauccgccgucacuggggug

SEQ ID NO: 174141 - RNA, 342 nt, Homo sapiens
gcgcagacucagguccuggaggagaggggcugggggccuggacuccugggucugagggaggaggggcugggcacuggacuccuaggucugagggaggagggccugggggccuggacuccuggguuucagggaggagggccugggggucuggacuccuggguuucagggaggaggggcugugcuuggacuccggagucugagggaggagaggcugguggccugcacuccugggucugaaggagaagggcuugggggccuggacuccagggucugagggaggaggggcugggggucuggacuucugggucugagggaggaggggacugggguccuggacuuuug

SEQ ID NO: 174142 - RNA, 25 nt, Homo sapiens
ggucuggggagggggcaaaugugag

SEQ ID NO: 174143 - RNA, 113 nt, Homo sapiens
gagaaagugggggggcgggggcuuggaggagacagacucggggagacacggugaggaaagaaugcguggcaggcgggcuccccaggacggagagggugagggccagggggugg

SEQ ID NO: 174144 - RNA, 25 nt, Homo sapiens
gugcugaugaaggugugugcgccug

SEQ ID NO: 174145 - RNA, 45 nt, Homo sapiens
cuuagggagaaccaagaaaagaugauauauuaucugcuuuuggau

SEQ ID NO: 174146 - RNA, 39 nt, Homo sapiens
ugccccauugcuggucugugguuuuaugccuacgggugg

SEQ ID NO: 174147 - RNA, 108 nt, Homo sapiens
gcuuccaguucugcuuucuguuuggucccuccauccugauagugagcauuuggauagggagggauaucgccgaucucuuugucaccaauauuaauaugucacaggugg

SEQ ID NO: 174148 - RNA, 42 nt, Homo sapiens
cagacccagagcugagcagcucuccccgccgaggccccccca

SEQ ID NO: 174149 - RNA, 62 nt, Homo sapiens
uccccaucuaggccugggcaggaacauauauuauuuauuuaagcaauuacuuuucauguugg

SEQ ID NO: 174150 - RNA, 45 nt, Homo sapiens
cagcuuuuuucccugccagagggacaaauucccagcugacgggga

SEQ ID NO: 174151 - RNA, 32 nt, Homo sapiens
aguccaggcccaggcccuccucucucagaccc

SEQ ID NO: 174152 - RNA, 22 nt, Homo sapiens
gaggaacuggggucuggacucc

SEQ ID NO: 174153 - RNA, 41 nt, Homo sapiens
ucggccgcaucugcccggcucuccccgcuuuccccccgcgc

SEQ ID NO: 174154 - RNA, 43 nt, Homo sapiens
gcccugcaaggcagccgcuccgucugaauggaaaaggcaggca

SEQ ID NO: 174155 - RNA, 53 nt, Homo sapiens
acuccugggucugagggaggagggccugggggccuggacuccuggaucugagg

SEQ ID NO: 174156 - RNA, 55 nt, Homo sapiens
ggcccuaaauucuaguucaagaaagguagaggaggaucuuggggcccuucugcac

SEQ ID NO: 174157 - RNA, 49 nt, Homo sapiens
agccccauuguuagggaaagucccccccgcaaugagaagaccugggagg

SEQ ID NO: 174158 - RNA, 60 nt, Homo sapiens
ggccuuacaggacaucaccccagcaaccggccccgcccgccugcccgccaggccccagga

SEQ ID NO: 174159 - RNA, 35 nt, Homo sapiens
ggggaagucucagaugacgaggucccagcucaaga

SEQ ID NO: 174160 - RNA, 43 nt, Homo sapiens
ucucaaauaagccauagaggagagaggucuugaggggugggag

SEQ ID NO: 174161 - RNA, 38 nt, Homo sapiens
cuaggggugggaucccuggaauccaggcugggcuagag

SEQ ID NO: 174162 - RNA, 47 nt, Homo sapiens
cccuggaagggaugggaggagccccucagagcagcuagaagccgugg

SEQ ID NO: 174163 - RNA, 39 nt, Homo sapiens
guuugcggggagacauaagagggagggggacggcccagg

SEQ ID NO: 174164 - RNA, 45 nt, Homo sapiens
gagugggggaauggccgcccccgcaacauggcuauguacaaagag

SEQ ID NO: 174165 - RNA, 39 nt, Homo sapiens
ucaacccagcaaccucucauuaucaccagagaggaagca

SEQ ID NO: 174166 - RNA, 46 nt, Homo sapiens
uggaccucauggauccugggagaugauaacaccagggucauggugg

SEQ ID NO: 174167 - RNA, 85 nt, Homo sapiens
ugcaucccugcaaaugaugaugacacuauugggcaucaugggucuugggaggugaugacaccaaaaucaugagggauuaugggaa

SEQ ID NO: 174168 - RNA, 73 nt, Homo sapiens
ccgacacaggcgcacacaugccaggggccuggggcccagaucggcccuuggacaggagugaaagccuccuucu

SEQ ID NO: 174169 - RNA, 41 nt, Homo sapiens
ccccccgggccccagcagcagguuggagugcgaggcggcca

SEQ ID NO: 174170 - RNA, 45 nt, Homo sapiens
gagcaccugcugucgcccccgcgcagccccgcgcugccccccgac

SEQ ID NO: 174171 - RNA, 42 nt, Homo sapiens
agccucguaggacgggggcagaugcgagagguuguggaagga

SEQ ID NO: 174172 - RNA, 24 nt, Homo sapiens
caaggcucgccagucuggguuaga

SEQ ID NO: 174173 - RNA, 53 nt, Homo sapiens
cugggcaccaggggggggggugcuaagaacuugggacagaccacuuacccagc

SEQ ID NO: 174174 - RNA, 35 nt, Homo sapiens
uuuagaugacugcugugaagaaaaucagcggaaag

SEQ ID NO: 174175 - RNA, 44 nt, Homo sapiens
cauaccccagccacguggcggcgggccccuucccggcccucaga

SEQ ID NO: 174176 - RNA, 46 nt, Homo sapiens
cugggaaacggucacuggccuuuaaugagauaaccgccuuuuaggg

SEQ ID NO: 174177 - RNA, 66 nt, Homo sapiens
ucccccuggccuccgggauaccucgcucccucacugcccuccgucaccugucaccccaucucaguc

SEQ ID NO: 174178 - RNA, 45 nt, Homo sapiens
aggcaaagccaggcgcgggggcggcggcgggaggagggggcugcg

SEQ ID NO: 174179 - RNA, 41 nt, Homo sapiens
aggggcgcuccgccgagugcgugcgcuggugcagcagcagg

SEQ ID NO: 174180 - RNA, 28 nt, Homo sapiens
cagcccagcaccccaaccuagcccagca

SEQ ID NO: 174181 - RNA, 40 nt, Homo sapiens
uacccagugugccacacugaacaucggacugugcugccuu

SEQ ID NO: 174182 - RNA, 42 nt, Homo sapiens
ugggagagcuaucuggggagggggagaggaggccgagcagaa

SEQ ID NO: 174183 - RNA, 42 nt, Homo sapiens
caccaccggggcuggaaggcccacaucugcucccacgaggag

SEQ ID NO: 174184 - RNA, 42 nt, Homo sapiens
ccagccccccgcccagcugggaacccccagaacgccucccgg

SEQ ID NO: 174185 - RNA, 46 nt, Homo sapiens
ugcccccggcggugccagauucgggccuggugcagggcccgugugg

SEQ ID NO: 174186 - RNA, 44 nt, Homo sapiens
ccagcaugacugucaccaccgcgaggacgccggggccgugugug

SEQ ID NO: 174187 - RNA, 36 nt, Homo sapiens
uggaggaaaggauggaugaauggagggaaggccuag

SEQ ID NO: 174188 - RNA, 45 nt, Homo sapiens
uaugcagacagcacuucauuaucccagcaacgaagugggacaaca

SEQ ID NO: 174189 - RNA, 41 nt, Homo sapiens
gccccucgggggcuugggggaagcacaacugugaccacgag

SEQ ID NO: 174190 - RNA, 43 nt, Homo sapiens
ggggguaccuggacacacucuccccuggaggaccacccggcgc

SEQ ID NO: 174191 - RNA, 77 nt, Homo sapiens
ggcugccuggguuucugccucugucgccccgcgccccguaccugugcccuccugagaggcccaagccucccgcuccc

SEQ ID NO: 174192 - RNA, 67 nt, Homo sapiens
ugaaaagacagccaugugugccaccuuaucaauaggaagacuuggaggcguaugcgggguggagugg

SEQ ID NO: 174193 - RNA, 47 nt, Homo sapiens
gaccccuaccgcaggcaaacuaggaccaacucuuggggcuggcacca

SEQ ID NO: 174194 - RNA, 46 nt, Homo sapiens
ccgaggcgaccucugacgcuccggacacuucaccacccaccccaga

SEQ ID NO: 174195 - RNA, 46 nt, Homo sapiens
cguugaccccggagcccucacccacgcccuuacccaccuugcccaa

SEQ ID NO: 174196 - RNA, 55 nt, Homo sapiens
ccagguccuccacagccacaagcauggacccacuguccacugaggacuucaagcc

SEQ ID NO: 174197 - RNA, 52 nt, Homo sapiens
aaggauuggugggcggauggguggauggauggaaggaaggauuggugggugg

SEQ ID NO: 174198 - RNA, 39 nt, Homo sapiens
gagauaaaguuagggauaaauggaaggaauaaaagaagg

SEQ ID NO: 174199 - RNA, 61 nt, Homo sapiens
ccaaacacuagaauagacuggccugaaauccccuugcccaguagaauggacugaucuaugu

SEQ ID NO: 174200 - RNA, 96 nt, Homo sapiens
cacuggugaccccagaaaauggauauagccgaaaucugccuuuccccuuuuucauucccugugcugaaagagggaccaggguagaugcccccugcc

SEQ ID NO: 174201 - RNA, 42 nt, Homo sapiens
guggagggagcaugucccugaauuuuccuagaucccuccaaa

SEQ ID NO: 174202 - RNA, 115 nt, Homo sapiens
uggacugacugccaggcugcgugcgcccugcccuccacccagccuccuggacucggccuggaccaggggaccucgggacugcgcgugaggccccggcccuccaaauccaaaucca

SEQ ID NO: 174203 - RNA, 55 nt, Homo sapiens
ucugggcacuggagccagcuaagaggagagaggggcagagucagugcucacaggg

SEQ ID NO: 174204 - RNA, 34 nt, Homo sapiens
gcuauaaucccggcucccaacucagccccauccc

SEQ ID NO: 174205 - RNA, 47 nt, Homo sapiens
ccucccaccucuaaagcauucuuuuaaaucggugguugucaaggaua

SEQ ID NO: 174206 - RNA, 36 nt, Homo sapiens
ggcagccauccuagcugggggcguucaugggggagc

SEQ ID NO: 174207 - RNA, 44 nt, Homo sapiens
gcaaggcacuaaggaaacacucuggggagaauuauauagaggau

SEQ ID NO: 174208 - RNA, 35 nt, Homo sapiens
uaaggcauggagaggcaaagugaguugccaugguc

SEQ ID NO: 174209 - RNA, 74 nt, Homo sapiens
gaagucaggacaagccuagagaacugaaaaaagucaguauggggagugcacucuuuuaauauuaauagacagua

SEQ ID NO: 174210 - RNA, 56 nt, Homo sapiens
cucaucccuucagguuuuauccuaaaaugagcauaaugauaaggggaaucacaguu

SEQ ID NO: 174211 - RNA, 42 nt, Homo sapiens
acgcgggcccuccucgcuucagguucccaaacaagugcuggu

SEQ ID NO: 174212 - RNA, 33 nt, Homo sapiens
ccccgcggccgguggcacguccuuguggcagcg

SEQ ID NO: 174213 - RNA, 41 nt, Homo sapiens
gcagcgggugggcgcccaggagcgggacgggcacagcgccg

SEQ ID NO: 174214 - RNA, 45 nt, Homo sapiens
ugaggacgguguugucuugugggacggguuuggguccagggaagg

SEQ ID NO: 174215 - RNA, 151 nt, Homo sapiens
gggggugggcgagggagguauuuagugcuauggcccuggggguggggcuucuugugguuucgcgaggggcggggcaggggaggagacuaugucauggugggcggggugggggagggaccuauggguggugggcggggccuggaugggggcg

SEQ ID NO: 174216 - RNA, 49 nt, Homo sapiens
ugcacaccaggcuccgggacuccgcuucccacagcaccucucccaagcc

SEQ ID NO: 174217 - RNA, 95 nt, Homo sapiens
ucccuuugccgcccccuacccccccaccggcccccguaucggccuccuggcccuccguccccacuacaugccgcagggccuccccaucuucauau

SEQ ID NO: 174218 - RNA, 63 nt, Homo sapiens
guaaccucagcagagccagggggugugugugggagugagugacgcugugugggucagacuugg

SEQ ID NO: 174219 - RNA, 71 nt, Homo sapiens
gauggcagccucugggaggcucuuucccacucuggggaguaugaacggaagauuuguucuuccucccaaaa

SEQ ID NO: 174220 - RNA, 72 nt, Homo sapiens
ggucaccacccaaaaaggcccacaaaggaagggacuuaaugucuuugauggggaaggagugcucauuaacca

SEQ ID NO: 174221 - RNA, 85 nt, Homo sapiens
accagucaagagaagacgcuagcugugaacuggcuggggcugggugcugcugugggagcuaucugggcugcuucuggccaugaau

SEQ ID NO: 174222 - RNA, 63 nt, Homo sapiens
ggaggagggagagacagaacccggugggucuuucuccagcaaggcuggaggggcuuggagaga

SEQ ID NO: 174223 - RNA, 65 nt, Homo sapiens
auuuaaauuaucugaauaauucucugucucacgcggaguuggggaggucuguccgggaaucaggu

SEQ ID NO: 174224 - RNA, 44 nt, Homo sapiens
cucccaggcacgucccccuccuaggaagaggcugaggccaaguu

SEQ ID NO: 174225 - RNA, 43 nt, Homo sapiens
guuuccguguguccucgugugccacugcgcccaguccccucug

SEQ ID NO: 174226 - RNA, 44 nt, Homo sapiens
cugacgcugggcuccagcuucauucucacaggucaucauccucg

SEQ ID NO: 174227 - RNA, 46 nt, Homo sapiens
gguacucugggcuuggauauaauagccaucucucaguccacugaau

SEQ ID NO: 174228 - RNA, 42 nt, Homo sapiens
ugaacuggaccuggggcugucccugcgcagccauugcggugu

SEQ ID NO: 174229 - RNA, 59 nt, Homo sapiens
cuugugcugccgccaugucgcuagugaucccugaaaaguuccagcauauuuugcgagua

SEQ ID NO: 174230 - RNA, 57 nt, Homo sapiens
cgcaaaauaugcuggaacuuuucagggaucacuagcgacauggcggcagcacaagcg

SEQ ID NO: 174231 - RNA, 71 nt, Homo sapiens
cucaacaccaacaucgaugggcagcggaaaauagccuuugccaucacugccauuaagggugugggccgaag

SEQ ID NO: 174232 - RNA, 53 nt, Homo sapiens
agccagguccuagccaauggucuggacaacaagcuccgugaagaccuggagcg

SEQ ID NO: 174233 - RNA, 44 nt, Homo sapiens
gaaguucagcagcaaugaucccuuuuggacaaaggcaaacagac

SEQ ID NO: 174234 - RNA, 44 nt, Homo sapiens
ggugaagaaauuuggaagaggaggcaggaaagugucgcagacag

SEQ ID NO: 174235 - RNA, 42 nt, Homo sapiens
cucaguauguugggucuccucgaugcccaugagcagugugaa

SEQ ID NO: 174236 - RNA, 73 nt, Homo sapiens
augccucugggcacccaggugccauuccuuaaaggacccaguucauuacccuccacacaggcaguccagggga

SEQ ID NO: 174237 - RNA, 57 nt, Homo sapiens
aacaaguauacauuuuauuauggaaguaguggggaaaguucgagaacgaucuggagg

SEQ ID NO: 174238 - RNA, 45 nt, Homo sapiens
ggguuggagggacaaagggaagaguuugggguuuuuagcgcuuua

SEQ ID NO: 174239 - RNA, 43 nt, Homo sapiens
aagaagacuuugguucucagcuuuuugaauacuggaauggcag

SEQ ID NO: 174240 - RNA, 37 nt, Homo sapiens
gaauacauuuuuuaaaaucuacaacuuuauugaggua

SEQ ID NO: 174241 - RNA, 57 nt, Homo sapiens
ucagcauggaaaaggagaaacauuuaauuccuuuaugucuuucagacucggggucua

SEQ ID NO: 174242 - RNA, 46 nt, Homo sapiens
cagagggcacaccuuaccuagcaugagagaauucacacuggugaga

SEQ ID NO: 174243 - RNA, 45 nt, Homo sapiens
ccuucagccgugucucagcucuuauagaucaccagcgaauucaua

SEQ ID NO: 174244 - RNA, 42 nt, Homo sapiens
uaaaguuuucggccgccaaucauuucuuauugaacaucaaag

SEQ ID NO: 174245 - RNA, 65 nt, Homo sapiens
uauguuaaaauccucaccaucaaugugauguuacuuggaaaugaggcauuugggaggcaauuagg

SEQ ID NO: 174246 - RNA, 51 nt, Homo sapiens
aggugagagugaaaguggcagaauugagugcuaaagguuccaucguuucag

SEQ ID NO: 174247 - RNA, 42 nt, Homo sapiens
aaggucuguuuuaucuccagcgucacguucuguggcuccaac

SEQ ID NO: 174248 - RNA, 46 nt, Homo sapiens
aaaaacuuccuaaauuuaagaucugcauugaagacccaucccgcag

SEQ ID NO: 174249 - RNA, 46 nt, Homo sapiens
uacccaguauuagaaggcuuuucucucccucaucuuaccaggagac

SEQ ID NO: 174250 - RNA, 46 nt, Homo sapiens
ugggacuacacauuuggaccagagaaaccuaauauagauaccagaa

SEQ ID NO: 174251 - RNA, 47 nt, Homo sapiens
ugggaaacauugaaaucaaggaucuuaugguuggugaugaggcaagu

SEQ ID NO: 174252 - RNA, 43 nt, Homo sapiens
cagcggcucuucccuggguggacgauggacagccagagcagga

SEQ ID NO: 174253 - RNA, 42 nt, Homo sapiens
uguagccagugugggaaauccuuuagccaaaaagccacccuu

SEQ ID NO: 174254 - RNA, 46 nt, Homo sapiens
ccaucauguuuaauuagcaacaagguggcaauuauuuucagaaaaa

SEQ ID NO: 174255 - RNA, 46 nt, Homo sapiens
cggccccggcggggagagccgccacugucggugcucacccaggaca

SEQ ID NO: 174256 - RNA, 45 nt, Homo sapiens
augacggugucauugguggucaucauguuugaauuaaccgggggu

SEQ ID NO: 174257 - RNA, 45 nt, Homo sapiens
cccagcauggcugugggcgcgauagcgggcaggauggugggaauu

SEQ ID NO: 174258 - RNA, 45 nt, Homo sapiens
uuaucauucuuuaauccacagcaggcaaacccagccagcuuuuga

SEQ ID NO: 174259 - RNA, 42 nt, Homo sapiens
ugagucuucccagcucugugacuacaucaaugaccccaacau

SEQ ID NO: 174260 - RNA, 46 nt, Homo sapiens
ggguuagggucuaaagaagaaaagagccagugggaggagcagauau

SEQ ID NO: 174261 - RNA, 45 nt, Homo sapiens
caucauuuagcuccugaaaguccacacuuaaguagagccuuagac

SEQ ID NO: 174262 - RNA, 46 nt, Homo sapiens
uggcaaguacucacuuguucagcaccagagaguccauacuggagaa

SEQ ID NO: 174263 - RNA, 49 nt, Homo sapiens
gaaaccauacuugguuggagaauguacaaaccaucaccagcaccagaag

SEQ ID NO: 174264 - RNA, 46 nt, Homo sapiens
aagagagugggcaucugugucaccagggccuguauuuccuuaaggu

SEQ ID NO: 174265 - RNA, 41 nt, Homo sapiens
aaggacccaggccccuggcauugaggacuuaagggucaaag

SEQ ID NO: 174266 - RNA, 55 nt, Homo sapiens
guggcuucaccagugugguggcugugaagguagaagaaguggcuggauucugggu

SEQ ID NO: 174267 - RNA, 50 nt, Homo sapiens
aacacaacucuccuuucuuucucaugggaacucagagcagcagggcagga

SEQ ID NO: 174268 - RNA, 46 nt, Homo sapiens
gcuggcagacaauggaaugaggugugaaagguugccccgccuacgu

SEQ ID NO: 174269 - RNA, 55 nt, Homo sapiens
ccacaguugcuaagaguuggcacugaggacuggaacgcugaggcucagaaauaau

SEQ ID NO: 174270 - RNA, 52 nt, Homo sapiens
cacggaagaggguuacaggcaaagggaccagcguuucuaaacucuuggagac

SEQ ID NO: 174271 - RNA, 63 nt, Homo sapiens
ucaucucacaaaacaagugaaugcccaaaccacaagagaagcaaacauggggacacccuccca

SEQ ID NO: 174272 - RNA, 61 nt, Homo sapiens
agaaauggaaaucaaguggcaaaaacuuggagagauucauagaagaccugacugaugacag

SEQ ID NO: 174273 - RNA, 76 nt, Homo sapiens
ucucacaaaacaagugaaugcccaaaccacaagagaagcaaacauggggacacccucccagacuucccaagauacu

SEQ ID NO: 174274 - RNA, 76 nt, Homo sapiens
ucacaaaacaagugaaugcccaaaccacaagagaagcaaacauggggacacccucccagacuucccaagauacuuc

SEQ ID NO: 174275 - RNA, 44 nt, Homo sapiens
gcauaaauccaccugccuuagugaguacaggguucuaacuucug

SEQ ID NO: 174276 - RNA, 113 nt, Homo sapiens
agaaauggaaaucaaguggcaaaaacuuggagagauucauagaagaccugacugaugacagcauaaauccaccugccuuagugaguacaggguucuaacuucugggaugagag

SEQ ID NO: 174277 - RNA, 80 nt, Homo sapiens
ugucauuguucaucucacaaaacaagugaaugcccaaaccacaagagaagcaaacauggggacacccucccagacuuccc

SEQ ID NO: 174278 - RNA, 59 nt, Homo sapiens
caaucuugagguuguugucauacuucucaugguucacacccaugacaaacauuggggca

SEQ ID NO: 174279 - RNA, 50 nt, Homo sapiens
gaaggaagaggaggaagaugaggaagaugaagaggaugaggaggaggagg

SEQ ID NO: 174280 - RNA, 46 nt, Homo sapiens
ucguggcaccuugcgcauaaggccgcucaccucgcccucaccugag

SEQ ID NO: 174281 - RNA, 67 nt, Homo sapiens
cuuaugcgcaaggugccacgagugagccuugaacgccuggaccuggaccucacagcugacagccagc

SEQ ID NO: 174282 - RNA, 42 nt, Homo sapiens
ccuugaagacggguggcuggcugucagcugugagguccaggu

SEQ ID NO: 174283 - RNA, 44 nt, Homo sapiens
ugucgcucgcgguccagcucccgcauggcacgguucagggcccu

SEQ ID NO: 174284 - RNA, 41 nt, Homo sapiens
uuuccgcuuccgggucacgcuucucuuucugggauccccga

SEQ ID NO: 174285 - RNA, 58 nt, Homo sapiens
agguugggaaacuccaggagcgcgcgugcgcccgugccccggaacgggccagcguccg

SEQ ID NO: 174286 - RNA, 39 nt, Homo sapiens
cggugggcccacccacacaagaaaggggcaaagcuagag

SEQ ID NO: 174287 - RNA, 120 nt, Homo sapiens
cuagaguaggcuucaucccaaccaaccccaggcacagucaugguauccccaccaacuuuagagcugccccaggcacugggcagccuguuguagggugcuccaaugccaccugugaccaca

SEQ ID NO: 174288 - RNA, 40 nt, Homo sapiens
ggcaggucagauccagggcauaggagagugagcaugugag

SEQ ID NO: 174289 - RNA, 45 nt, Homo sapiens
gaagaugacugggaaaucaagaaaccacagacaacaaaggggugg

SEQ ID NO: 174290 - RNA, 42 nt, Homo sapiens; identical to SEQ ID NO: 98614

SEQ ID NO: 174291 - RNA, 47 nt, Homo sapiens
aguugaggaggucgucuggaucugagaagcugauaucacacgucuug

SEQ ID NO: 174292 - RNA, 45 nt, Homo sapiens
cuggcccagggugacccccaacuuuucuguauccacagcucccaa

SEQ ID NO: 174293 - RNA, 44 nt, Homo sapiens
agcgagaacagcuugaucauccugccgccgccgccgccgcugcc

SEQ ID NO: 174294 - RNA, 21 nt, Homo sapiens
ggggccugagaccagaguugg

SEQ ID NO: 174295 - RNA, 55 nt, Homo sapiens
guucugucucauuaucaccucaucagggaagucuguacagauagaaucccuaccc

SEQ ID NO: 174296 - RNA, 61 nt, Homo sapiens
uucucaguuggaguugcuggugccuccuccuucacccagcgucugacgcuggagugcucac

SEQ ID NO: 174297 - RNA, 27 nt, Homo sapiens
cauccugcuggucaggcaucaggacag

SEQ ID NO: 174298 - RNA, 45 nt, Homo sapiens
cuccuaggacuaugcaggaaucaccacugggccugcaggugaaag

SEQ ID NO: 174299 - RNA, 45 nt, Homo sapiens
gcugcugcccuaguagaugggcugcgccgggagccgggcggaccc

SEQ ID NO: 174300 - RNA, 95 nt, Homo sapiens
gaugcccaggcuguagguguauaggugccauccaccugguaaagagagagcuguagcgcaggaaugagguugcacauguagaagaagggaaggau

SEQ ID NO: 174301 - RNA, 45 nt, Homo sapiens
ucagguugacuuggcaccuugaagaguggaggcuuggcccccagg

SEQ ID NO: 174302 - RNA, 31 nt, Homo sapiens
augccgacgcacggauucgaggcggggagca

SEQ ID NO: 174303 - RNA, 45 nt, Homo sapiens
agggguucuucugauggggccaaaauaagaagauguacauauaug

SEQ ID NO: 174304 - RNA, 45 nt, Homo sapiens
cagcaaauucagaggcggcagggauugagaaggaaacaucauuua

SEQ ID NO: 174305 - RNA, 44 nt, Homo sapiens
caguuccauguguuugaccaaggacauucgcagaaacuggcccu

SEQ ID NO: 174306 - RNA, 48 nt, Homo sapiens
ucccuauccagucuacacucagaacuuugucuucaugagcagccagau

SEQ ID NO: 174307 - RNA, 49 nt, Homo sapiens
cccugcaaaucuguccccaucaggcucuccucccucucagccuucuccu

SEQ ID NO: 174308 - RNA, 48 nt, Homo sapiens
aggcauugcugagaaacagcgggugagguggggagugagggggaaggg

SEQ ID NO: 174309 - RNA, 76 nt, Homo sapiens
aagacccccuuugacacaaugugauggguguuugucucagaaagggagaaaaagggagauugggauucgugggugg

SEQ ID NO: 174310 - RNA, 39 nt, Homo sapiens
uaauccccugaaaaaaugucaucaugcaaagagagagau

SEQ ID NO: 174311 - RNA, 36 nt, Homo sapiens
gguauccagcucacauagaagacauugacuacgagg

SEQ ID NO: 174312 - RNA, 46 nt, Homo sapiens
aaacagaucacaaaagucuuucaucaucuccugauaaacgagagaa

SEQ ID NO: 174313 - RNA, 46 nt, Homo sapiens
agaaaagucuucccaagaacgagaaggaagacaaggaaaacauuuc

SEQ ID NO: 174314 - RNA, 45 nt, Homo sapiens
uucaaacucucaaacuuugcaaccaauaacauuggaacugagaag

SEQ ID NO: 174315 - RNA, 42 nt, Homo sapiens
cugcacugacuugccacuccuuuggggauggauccggggcug

SEQ ID NO: 174316 - RNA, 42 nt, Homo sapiens
uuuccauggaauggagaagucacuggagccagaagagagccc

SEQ ID NO: 174317 - RNA, 42 nt, Homo sapiens
cugccgcuguggugccagccuuggaaacagcacucaggggag

SEQ ID NO: 174318 - RNA, 56 nt, Homo sapiens
guugaaugaagagagucuuuuugcacaaacuucacuugaaauugugccacugauga

SEQ ID NO: 174319 - RNA, 45 nt, Homo sapiens
uauuuaauugacuuuucuaucacguuggggcacaugccaacuccc

SEQ ID NO: 174320 - RNA, 51 nt, Homo sapiens
uugguguuucuggcgugggaagaaaugcacaggcgugcauggcaugcacgu

SEQ ID NO: 174321 - RNA, 56 nt, Homo sapiens
ucagacagcugcauuguaagaguucugucaugcagucugaaaagggaagaaacagg

SEQ ID NO: 174322 - RNA, 28 nt, Homo sapiens
agaaacugaauugcccuaauuuugccaa

SEQ ID NO: 174323 - RNA, 41 nt, Homo sapiens
cacaggaggucccaggugauugaaaaguuugaggccuugga

SEQ ID NO: 174324 - RNA, 46 nt, Homo sapiens
ggggcugggaggggagagcggcgggggcagcugcuguucuucggcc

SEQ ID NO: 174325 - RNA, 41 nt, Homo sapiens
guagcugcucuccccccggacuuugcggccacaguccaugc

SEQ ID NO: 174326 - RNA, 28 nt, Homo sapiens
gagaaaguccccaccaccaaguccacac

SEQ ID NO: 174327 - RNA, 24 nt, Homo sapiens
cgggggucggggacgggggccgcu

SEQ ID NO: 174328 - RNA, 42 nt, Homo sapiens
ccuuucaguuucccuuuggggacccucccaaccccgcucugg

SEQ ID NO: 174329 - RNA, 38 nt, Homo sapiens
gcuuccagaggaggaauaugaucgagccucgagagaga

SEQ ID NO: 174330 - RNA, 42 nt, Homo sapiens
ggcugggccaguggggccaaugcccaggggcugagggcacgg

SEQ ID NO: 174331 - RNA, 38 nt, Homo sapiens
gaggucugucccacgcccgcccgccuggccaccacaga

SEQ ID NO: 174332 - RNA, 46 nt, Homo sapiens
cggcccacgagguggaguugcagcggcagaaggaggcggagaagcu

SEQ ID NO: 174333 - RNA, 45 nt, Homo sapiens
gagguggcgccugccggagcuuccuacaauccauccuuugaagac

SEQ ID NO: 174334 - RNA, 46 nt, Homo sapiens
uccucaacccuucugcaacaagggccaagcccgggccccaggacac

SEQ ID NO: 174335 - RNA, 45 nt, Homo sapiens
aaagaagagaaccaaaguccagaagaagucacugcuucucaagaa

SEQ ID NO: 174336 - RNA, 44 nt, Homo sapiens
ugagcuugugugagaucagucaaaggguauguuuuaaugaaaau

SEQ ID NO: 174337 - RNA, 43 nt, Homo sapiens
aggcaagcaaguuaagacguguguuacccgcucacuaaagcaa

SEQ ID NO: 174338 - RNA, 56 nt, Homo sapiens
guguguguguguguauucgggcacgaagugcucucccagcucccgcccugcccggc

SEQ ID NO: 174339 - RNA, 49 nt, Homo sapiens
ucacguucacuuaggcacaucacacacacacuggcacacgcaggcaucc

SEQ ID NO: 174340 - RNA, 45 nt, Homo sapiens
cuggaugguggggaccaagcuccccaacucagugcuggggcgcau

SEQ ID NO: 174341 - RNA, 48 nt, Homo sapiens
uguacgauggaggguguggacgaauccucuggcucuaaguccuuuggc

SEQ ID NO: 174342 - RNA, 53 nt, Homo sapiens
gaaggcaguuccagggcucaguccucacuggggcuccuggagaggagacagau

SEQ ID NO: 174343 - RNA, 26 nt, Homo sapiens
gcgcaugugccuauaauuguggcugg

SEQ ID NO: 174344 - RNA, 21 nt, Homo sapiens
gcccccgcccuggaauccacc

SEQ ID NO: 174345 - RNA, 128 nt, Homo sapiens
ucaagguggacgcccgagcggagaggucugggaggggucaggagagggagagacugagaaacaugagugugcuaagaggagcugaaagggaacagaaaagggauccacgaagacuuaguaggguugag

SEQ ID NO: 174346 - RNA, 41 nt, Homo sapiens
aacagugugugguggccacucagaagcagagccuggggacg

SEQ ID NO: 174347 - RNA, 106 nt, Homo sapiens
aggcuggagaaggggguuugggaggagggccuggggaugggaagagacugugguaggagccuggcagaggcugguaagacacgaaggagagggaucuuuacaagag

SEQ ID NO: 174348 - RNA, 47 nt, Homo sapiens
uccggggcugauggacuggauugauuaggugaaaaauguuuuauuuu

SEQ ID NO: 174349 - RNA, 47 nt, Homo sapiens
uaguuuuccuggguggcucugggugucuggucccuuuggcccaggga

SEQ ID NO: 174350 - RNA, 42 nt, Homo sapiens
aauuaccuacuguaaggaggggcucgaugaugucauuccugu

SEQ ID NO: 174351 - RNA, 97 nt, Homo sapiens
ccucugccccugucaaagggcaagucagagagcccgcaccugggacgcaaggcgaugggugucugugcugucgccugccuuggugcucagaugccac

SEQ ID NO: 174352 - RNA, 36 nt, Homo sapiens
uuuaagaaaaaggaaguacauucgcccuuggucugu

SEQ ID NO: 174353 - RNA, 38 nt, Homo sapiens
cacagggccaaauauaaauccuaauacuuaaaaauaug

SEQ ID NO: 174354 - RNA, 45 nt, Homo sapiens
ucuuuagaagugguggcccuggaaaugcuggcauagcugggauua

SEQ ID NO: 174355 - RNA, 67 nt, Homo sapiens
cucagcagcugggcaucucaugcguuggccucaguggucacaugguggggcucaggccuggcaagag

SEQ ID NO: 174356 - RNA, 69 nt, Homo sapiens
ccaugccuuccauuaaacugccccgccaagccuuuccuucugcucccugggaaacugguuggccuagag

SEQ ID NO: 174357 - RNA, 34 nt, Homo sapiens
ggggcaacacugagcgccaggcugccgaacagag

SEQ ID NO: 174358 - RNA, 44 nt, Homo sapiens
uugaggagcugguggguggcaggacuagguuaaagggacugagc

SEQ ID NO: 174359 - RNA, 46 nt, Homo sapiens
gggccgauucacgauugcggccaagcaccacaucuccauugcugag

SEQ ID NO: 174360 - RNA, 70 nt, Homo sapiens
ucucucucccuggcugugccccucccacaccccucgcagagcuuccuggaggggcccagagugaggcugg

SEQ ID NO: 174361 - RNA, 42 nt, Homo sapiens
gaccaaugccauggacagcccccuccucaaguacagcgccaa

SEQ ID NO: 174362 - RNA, 50 nt, Homo sapiens
guaagugcugggugcuccggccucccccuucccgaaccucagacgggggu

SEQ ID NO: 174363 - RNA, 44 nt, Homo sapiens
uuuggccauuugagucuccauuuuccagaugaagaaaguacaac

SEQ ID NO: 174364 - RNA, 82 nt, Homo sapiens
ucacccucuguucucgcuacaucccuugcccccuguccauuuauuuaagcccccauaggugcccuucacccccaaaaccagc

SEQ ID NO: 174365 - RNA, 50 nt, Homo sapiens
agucaugaggccgguuucucucucucucccacuuuugucccccagccaag

SEQ ID NO: 174366 - RNA, 167 nt, Homo sapiens
gugagacuggcugcggcacagggcggguuagggcuccaggcagggcuugagcgggacgagggggcgggcuccgaggcgggcuagaugccugggcuggaugaaguccgagucugggaagagaaccguguuguggcgggaggaggcggugauuggggugguggggcuaa

SEQ ID NO: 174367 - RNA, 62 nt, Homo sapiens
uguagaggagacaggaauccacggcuuuggaaaaaggaaggacaaaacucaccaaaccagag

SEQ ID NO: 174368 - RNA, 112 nt, Homo sapiens
cgaucccagcagcggccacgacgcggacgcgccugcggcccggggagcagcagcagccacagccacagcagccgccacugcaguuagagcggcagcagcagcgacagccaca

SEQ ID NO: 174369 - RNA, 43 nt, Homo sapiens
gaaggaagccgcccgccccccaccgccgcccccuccggcgugu

SEQ ID NO: 174370 - RNA, 54 nt, Homo sapiens
aggugugugugcugcugggcugugugggauuagaguuagcuguagggugugugu

SEQ ID NO: 174371 - RNA, 116 nt, Homo sapiens
cauguggguguguuuuggggguguugauguauguguguccgugggugucuguuuuguguugauaugugaguccagaggugugcaggucuuaucucuggagugagugugugugugug

SEQ ID NO: 174372 - RNA, 42 nt, Homo sapiens
guggccaauguggucuuuguguugcaagaagcaggaagacgg

SEQ ID NO: 174373 - RNA, 44 nt, Homo sapiens
uuggccaggggcuguccucagcagucccggcggaggaaggagag

SEQ ID NO: 174374 - RNA, 41 nt, Homo sapiens
ggggcccagcugcggcggauggcggacgaccucaacgcaca

SEQ ID NO: 174375 - RNA, 40 nt, Homo sapiens
aacgccgagugaaaccccugcccccucuccaguggcagga

SEQ ID NO: 174376 - RNA, 50 nt, Homo sapiens
gugacugccccgucucuguuguacauuugagaaagacaucccccaagggg

SEQ ID NO: 174377 - RNA, 31 nt, Homo sapiens
gacugaguauggugaugggaguggggauggu

SEQ ID NO: 174378 - RNA, 37 nt, Homo sapiens
ugggucccuggccaagaagccaggagagggacggcug

SEQ ID NO: 174379 - RNA, 46 nt, Homo sapiens
ugaagagcaaaugagccaaacgugaccacuagccuccuggagccag

SEQ ID NO: 174380 - RNA, 33 nt, Homo sapiens
cgccccaucaaucccauugcauagguuuagaga

SEQ ID NO: 174381 - RNA, 57 nt, Homo sapiens
aguccccagggccaagcgcuggggggaagacggggagucagggagggggggaaaucu

SEQ ID NO: 174382 - RNA, 60 nt, Homo sapiens
aguggggagggauggcccagccuguaagauacuguauaugcgcugcuguagauaccggaa

SEQ ID NO: 174383 - RNA, 46 nt, Homo sapiens
gauuggagaaggggacaaccaaucgggagaaagcucucugcugauu

SEQ ID NO: 174384 - RNA, 46 nt, Homo sapiens
cccugcgcucuagggcaggggcagaguuuuggaaacagugcaggcu

SEQ ID NO: 174385 - RNA, 74 nt, Homo sapiens
uguggagaagcucugugugagcggugagggguggagggaugucgcggagaggggaagggggaaacugaccaaga

SEQ ID NO: 174386 - RNA, 24 nt, Homo sapiens
caggaggaggcggcggcggcgacc

SEQ ID NO: 174387 - RNA, 79 nt, Homo sapiens
agaaaggacaggggguggggcuggcgaccccggaguuccggcggcgggccggaccuggccuccccgcccccaaaucggg

SEQ ID NO: 174388 - RNA, 56 nt, Homo sapiens
gcuugggaaacggggugauaguccccauuuaacagagaaacaaauugaggcucaga

SEQ ID NO: 174389 - RNA, 42 nt, Homo sapiens
ccccugccaggaauacacuuccuucaaggcaagaaagacuga

SEQ ID NO: 174390 - RNA, 42 nt, Homo sapiens
guccuaugaugcccaguuauagauaaggaaacugaagcccag

SEQ ID NO: 174391 - RNA, 56 nt, Homo sapiens
ggggaacauggaggcgucccaggcaaacccuaccccuccauccaugcucacccgag

SEQ ID NO: 174392 - RNA, 42 nt, Homo sapiens
gaagcuuugauuuucacgaagacuuuggcggggccugcgggc

SEQ ID NO: 174393 - RNA, 40 nt, Homo sapiens
gugggggagccuuuucaaccaagacuguuaggagugggga

SEQ ID NO: 174394 - RNA, 57 nt, Homo sapiens
cagucuugguugaaaaggcucccccaccaccaccgagaggaauggggaggagcccug

SEQ ID NO: 174395 - RNA, 51 nt, Homo sapiens
aauucaaaccgaauuaccccuuuugcauacauggacacuuacuguacagau

SEQ ID NO: 174396 - RNA, 57 nt, Homo sapiens
ccaccgcucucccucucauuccugaugagcccucucauuccuccuuuccuugcccag

SEQ ID NO: 174397 - RNA, 45 nt, Homo sapiens
ucacuucgaucccuggacaauuauggaggauucggagguagaaga

SEQ ID NO: 174398 - RNA, 42 nt, Homo sapiens; identical to SEQ ID NO: 98760

SEQ ID NO: 174399 - RNA, 102 nt, Homo sapiens
gccacagggaggagggccaggcgggagaugaaggggagacucgggaccagaggaagcacggcagggagccagggaccggagggagaggacagaagauggaca

SEQ ID NO: 174400 - RNA, 85 nt, Homo sapiens
ggaaggggggagggaggaaggagcagagacaccaaggagauaaaggaacagagacggggagauagagggacagaggaaagaaggg

SEQ ID NO: 174401 - RNA, 69 nt, Homo sapiens
gaggagauggacggauggggugggagaggauggggagauggagggaggggguguggggugggagaggau

SEQ ID NO: 174402 - RNA, 59 nt, Homo sapiens
gacaaagggacagaggggacagagcaggggagauggagggaggggguguggggugggag

SEQ ID NO: 174403 - RNA, 57 nt, Homo sapiens
caggaacaagaggagcgauggaggggugcacggauggagguagcuaaggcagguggg

SEQ ID NO: 174404 - RNA, 40 nt, Homo sapiens
aggagcagguagagggugugggguuagagggagaaaggua

SEQ ID NO: 174405 - RNA, 382 nt, Homo sapiens
gagaaggaaagaaacaggaggugguggggggguggugggugucaggcaugguggcucacaccuguaaucucagcacuuugggaagccaagguggauggaucaccugaggucaggaguucgagaccagccugaccaacaugguggaaccccgucucuacugaaaauacaaaaauuagcugggcgugguaguggacgccuguaaucucaucuacuccagaggcuggggcaggagaaucgcuugaacccaggagguggagguugcagugagccgagaucaugccauugcucuccauccuggacaacagagugagacucugucucaaaagaaacgaaagaaaagaaagagagaaagagaaacaggaagguggggagagacagagag

SEQ ID NO: 174406 - RNA, 41 nt, Homo sapiens
ggcauccugagcgcacggcgaccggcgcgccccucggccuu

SEQ ID NO: 174407 - RNA, 56 nt, Homo sapiens
uacagaagacggaguccagguccagagaugauaauccaccugucccgacucacaca

SEQ ID NO: 174408 - RNA, 57 nt, Homo sapiens
ccucugaaaagcaaauuagcucagggcuuggaauaaagcccauaagaaaugucacua

SEQ ID NO: 174409 - RNA, 48 nt, Homo sapiens
acuucccccacccugcccagguaaccacguuucaaaucacaauaaagc

SEQ ID NO: 174410 - RNA, 42 nt, Homo sapiens
gagaauguuaaagcugcccucauugagguuggugaaggugug

SEQ ID NO: 174411 - RNA, 45 nt, Homo sapiens
ucaucuucugcauggaugccgagauccgcagccgggaggaagcca

SEQ ID NO: 174412 - RNA, 30 nt, Homo sapiens
ggacaucaauuacgccgugguccccaggga

SEQ ID NO: 174413 - RNA, 28 nt, Homo sapiens
aaccgucaaauuauaggauauguaauag

SEQ ID NO: 174414 - RNA, 50 nt, Homo sapiens
caggcaucaggaaagaagucuaaggaugcccugaugugagcaggaccuga

SEQ ID NO: 174415 - RNA, 30 nt, Homo sapiens
agacaugauuugagcaucuuuacagaugag

SEQ ID NO: 174416 - RNA, 51 nt, Homo sapiens
acugucucccaccccgcuucuguuuacucauggggaaacugaggccgggag

SEQ ID NO: 174417 - RNA, 44 nt, Homo sapiens
uauggaugugauccacaguggaccucugugaucaguuacucuga

SEQ ID NO: 174418 - RNA, 54 nt, Homo sapiens
ggccccccgcccuuccucccuuucucccucccaccugggcccuagaugaggggg

SEQ ID NO: 174419 - RNA, 23 nt, Homo sapiens
agcuucacagagaggcaaacccu

SEQ ID NO: 174420 - RNA, 45 nt, Homo sapiens
aggucacguccugugaugucauuaggcugaagcauguacuuccug

SEQ ID NO: 174421 - RNA, 40 nt, Homo sapiens
aggcaggccccacuuccccuccccuaucccccacuuccca

SEQ ID NO: 174422 - RNA, 57 nt, Homo sapiens
gucccuaagaggcauugcaaaaguguggacauggagcuaaauugggucccccuucca

SEQ ID NO: 174423 - RNA, 47 nt, Homo sapiens
aaacuggggaggaggagacaagcucaacuccuccucugcuagcccaa

SEQ ID NO: 174424 - RNA, 46 nt, Homo sapiens
cucuacaugggcaaggaggcuucacugcaauaauuaguaggggugg

SEQ ID NO: 174425 - RNA, 37 nt, Homo sapiens
cccucauucuguuucuccucccuguuccuccauccca

SEQ ID NO: 174426 - RNA, 46 nt, Homo sapiens
gaaagcuguacuugccuucuggaauauuccagaaggauucuacaug

SEQ ID NO: 174427 - RNA, 57 nt, Homo sapiens
ugguagucaccagagacccccuccagcugauaaaaauaacaauaacaggacuccaga

SEQ ID NO: 174428 - RNA, 47 nt, Homo sapiens
aaauauuagggaucagggucugcgaggauugugggggcucuggggau

SEQ ID NO: 174429 - RNA, 37 nt, Homo sapiens
aaaagugcgaggagaggaggugucugcaggaguuaga

SEQ ID NO: 174430 - RNA, 42 nt, Homo sapiens
cgcuugggggcggcggcugugaagagggggccgcagggggcu

SEQ ID NO: 174431 - RNA, 33 nt, Homo sapiens; identical to SEQ ID NO: 98806

SEQ ID NO: 174432 - RNA, 42 nt, Homo sapiens
ucagaaacaaugaccgucagcccuuggacuucugcuggaaug

SEQ ID NO: 174433 - RNA, 49 nt, Homo sapiens
uacgcacacugcucaccugcgauuuggccagcgucgggggcagguuggc

SEQ ID NO: 174434 - RNA, 45 nt, Homo sapiens
ugcucggcauguugcgggcgaucucggccugaggugugcccaggu

SEQ ID NO: 174435 - RNA, 46 nt, Homo sapiens
gucugacuggccggagaucugcgcugaggccuucgagguccccgac

SEQ ID NO: 174436 - RNA, 45 nt, Homo sapiens
cuggcauggccucggguagguacaccaugcugaugaggaccugug

SEQ ID NO: 174437 - RNA, 44 nt, Homo sapiens
uuccaccugggcaucgguaaggggcuucagcacgucgcugagac

SEQ ID NO: 174438 - RNA, 48 nt, Homo sapiens
auacccaccaaguggcggaccagcaggcucaggccuguaggcguucag

SEQ ID NO: 174439 - RNA, 46 nt, Homo sapiens
uggacuugaggggugggagaaaaggaguuaaugguguaugccacug

SEQ ID NO: 174440 - RNA, 45 nt, Homo sapiens
ucacucauucugagaauauuuauggaacaccuccucuggaccaga

SEQ ID NO: 174441 - RNA, 41 nt, Homo sapiens
ggugccaggugugccagggagggugcgggugcgggccaggg

SEQ ID NO: 174442 - RNA, 46 nt, Homo sapiens
aggggcaccucguggaugcgcgggcacagcgcagugcccagcaccu

SEQ ID NO: 174443 - RNA, 41 nt, Homo sapiens
caccgccuugcccggccgggcccaggugcagaugaggcccu

SEQ ID NO: 174444 - RNA, 62 nt, Homo sapiens
gcaggauggagagagggauggguaugggaggggagggaaggagaggagacaguggguucugg

SEQ ID NO: 174445 - RNA, 30 nt, Homo sapiens
agacaguccuagggugaagcugagaggcag

SEQ ID NO: 174446 - RNA, 52 nt, Homo sapiens
ggagcccaucguggugaggcuuaaggagguccgacugcagagggacgacuuc

SEQ ID NO: 174447 - RNA, 47 nt, Homo sapiens
aucaugaacaagugggacaugcugaagaggggcgaggugaggggcug

SEQ ID NO: 174448 - RNA, 42 nt, Homo sapiens
agcgguccagcaggauguugucggguuugaugucccugcacg

SEQ ID NO: 174449 - RNA, 42 nt, Homo sapiens
auaggucuccgccguggaauccgcguagaagggcgucugccc

SEQ ID NO: 174450 - RNA, 41 nt, Homo sapiens
aggugggaauccugauuuguuccugaaagguaguuuggcug

SEQ ID NO: 174451 - RNA, 42 nt, Homo sapiens
aaagcuuugcacuuugcgaaccaacgauaggugggggugcgu

SEQ ID NO: 174452 - RNA, 50 nt, Homo sapiens
ggaguccagagcuuugggcagauggagggccuuuuauucgcgagggucgg

SEQ ID NO: 174453 - RNA, 45 nt, Homo sapiens
ccccacccccgacccucgcgaauaaaaggcccuccaucugcccaa

SEQ ID NO: 174454 - RNA, 41 nt, Homo sapiens
gcgucccaggagcggaugcgcguggcgugcgcaggcgcagu

SEQ ID NO: 174455 - RNA, 27 nt, Homo sapiens
gaagagcggggagugggggcgaaaagg

SEQ ID NO: 174456 - RNA, 52 nt, Homo sapiens
ggcggcugggggggaggcgguggcggcggcggcggcgaccgaagaggaggag

SEQ ID NO: 174457 - RNA, 59 nt, Homo sapiens
cccguccacacuuaguccccgcgccccgcgggcgccugagauugugagcuggucccggg

SEQ ID NO: 174458 - RNA, 46 nt, Homo sapiens
guucaauaguggggagguggggcucaggcccgugggauaccccggg

SEQ ID NO: 174459 - RNA, 45 nt, Homo sapiens
ccacacccgucacgauggggcugccagacacaggguuggccagga

SEQ ID NO: 174460 - RNA, 41 nt, Homo sapiens
cgccgggaaguugggcaggaggccaggggagucaggggaga

SEQ ID NO: 174461 - RNA, 46 nt, Homo sapiens
uaguaccaaguggagggggcagggccccugagucaggacccugagu

SEQ ID NO: 174462 - RNA, 59 nt, Homo sapiens
acuuccagcccccagagcccucucccugucacucccugaaacacuauuaauagcucugc

SEQ ID NO: 174463 - RNA, 47 nt, Homo sapiens
uuuguauccuaaaucuuuauuuuucuaggacauguuaugccuccauu

SEQ ID NO: 174464 - RNA, 47 nt, Homo sapiens
gacccaguuuguuuccugucucugccugucuuccaaacacugugaca

SEQ ID NO: 174465 - RNA, 117 nt, Homo sapiens
aggggcugacugcccaggguggugaaguaguaggggcagagugagaggcuuggauuaccccagcugcagagugaggagggagaggcgauggcugagcagaggcugggagggugacga

SEQ ID NO: 174466 - RNA, 52 nt, Homo sapiens
agugggagacccucucuauccccucucagagcagccccagaucacaccagag

SEQ ID NO: 174467 - RNA, 129 nt, Homo sapiens
ccugggcccgcuuuugggaagcugcaggugaaagugggagggccgggcuuuccccgacuuccauccucaccucccuucucuaaagagguaaaacuggccuggaccaagaucugcccagauagaaagcca

SEQ ID NO: 174468 - RNA, 40 nt, Homo sapiens
uuuuccugcaguguaccacuggcuggagaugcggaccaaa

SEQ ID NO: 174469 - RNA, 68 nt, Homo sapiens
gagcucugugacucugaaugcuacuuuauaaaucgacugucagcguuuucuaauuaaaggagcucugg

SEQ ID NO: 174470 - RNA, 51 nt, Homo sapiens
accgagacuccacacccccuuuucuggcaccugugacagacauuauuaauc

SEQ ID NO: 174471 - RNA, 42 nt, Homo sapiens
ugcccgaguccgcccaucccugaccaugguuuuggcucuccc

SEQ ID NO: 174472 - RNA, 80 nt, Homo sapiens
acagaucaguuggaggaagaaaaagcagagcuggagucggagaucgccgagcuccaaaaggagaaggaacgucuggaguu

SEQ ID NO: 174473 - RNA, 42 nt, Homo sapiens
uggcuugugcaacccacccucaucucuuccauggcccagucc

SEQ ID NO: 174474 - RNA, 42 nt, Homo sapiens
caaacugcaaagagucgggagauguuugcaauugguugcgug

SEQ ID NO: 174475 - RNA, 71 nt, Homo sapiens
cuucuugaaaguacccugaugaccccagcugccaaggaaacccccaguguaauaauaaaucguccucccag

SEQ ID NO: 174476 - RNA, 37 nt, Homo sapiens
uuugccucuuucucuuuuuggucggggacaggacugu

SEQ ID NO: 174477 - RNA, 41 nt, Homo sapiens
ccuuugggcuucuuccucuucuuggugguggacgggaacag

SEQ ID NO: 174478 - RNA, 42 nt, Homo sapiens
ucuucuucccugaggugagcagguugggggccaaggcugacc

SEQ ID NO: 174479 - RNA, 44 nt, Homo sapiens
ggcaaaguuagcaaggagggugagcggggagaagucagcaaggu

SEQ ID NO: 174480 - RNA, 41 nt, Homo sapiens
ugccauggugacgggguggaaguccaggaucuugggguaga

SEQ ID NO: 174481 - RNA, 72 nt, Homo sapiens
ucacacaggaaaccugucaccaucagagugugagaggaaugaagcugacauagcggugcagugccagggacu

SEQ ID NO: 174482 - RNA, 42 nt, Homo sapiens
cgauucccucggacacuuugccccgggccacugacagcagga

SEQ ID NO: 174483 - RNA, 148 nt, Homo sapiens
agggacagccucacgcgacccaggaugcugugucugaguuggggggagaggguguguucccgccgggugccuagggacagaggggaggggagggccccucugugcaccuaggcugggggugggugguuccccgcgggagcagacagca

SEQ ID NO: 174484 - RNA, 45 nt, Homo sapiens
gaaacagaacaaguaucaacaagcggaagagcuguacaaagaaau

SEQ ID NO: 174485 - RNA, 42 nt, Homo sapiens
aacggccgugggcaucccguaggggggcccggccccaccccc

SEQ ID NO: 174486 - RNA, 43 nt, Homo sapiens
accaacgguggaucuaccgcgucgaccccacccgagucaacga

SEQ ID NO: 174487 - RNA, 46 nt, Homo sapiens
cuguggcccaccuucccuggcgcaugcucaccuacaaggcccucaa

SEQ ID NO: 174488 - RNA, 68 nt, Homo sapiens
cccccucaccacuuccuacaccugggcacacucuaccacuuccuauaccugggcacacucuaccagcg

SEQ ID NO: 174489 - RNA, 355 nt, Homo sapiens
ugucuugggaacaaguaaacaaguagggccaggugcaguggcucacaccuguuaucccaaugcuuugggaggcugaggcaggaggaucacuugagcccaggaauucgugaccagccugggcaacuuggcaagacccgaucucuacaaaaaaacacagaaauuauuggggagugguggugcgugccuguagucccagcuaccugggaggcugaggugggaggaucccuugaguccaggagguugaagcugcagugagccaugauuacgccacugcacuccagccugggugacagagugagacccugucucaaaaaacaaaagaccgggugaaucacagccaauagugaguacugug

SEQ ID NO: 174490 - RNA, 44 nt, Homo sapiens
gcccacucucgcuuuggcgcuggcagcucuaugcugcccagagc

SEQ ID NO: 174491 - RNA, 46 nt, Homo sapiens
acuacuaucccaucaucuacuucaaugacuacuggaaccugcagaa

SEQ ID NO: 174492 - RNA, 42 nt, Homo sapiens
ggacuaugggccuguggaggugaucucccauuggcaccccaa

SEQ ID NO: 174493 - RNA, 42 nt, Homo sapiens
aucaccuccacaggcccauaguccucagcccucugaggcaac

SEQ ID NO: 174494 - RNA, 56 nt, Homo sapiens
agugggcuggggagccgggcaguuaaucugugguuaaccugcagugggcacuaaga

SEQ ID NO: 174495 - RNA, 76 nt, Homo sapiens
gccaggccccagagcccaagcucagccuggcuccaagcacacacacgagaauauggcuuuaguaggaacugcagga

SEQ ID NO: 174496 - RNA, 51 nt, Homo sapiens
ggcagcugucucucagggagugaggaggaucccagacaagguuaccugagc

SEQ ID NO: 174497 - RNA, 47 nt, Homo sapiens
aagcgcagacgauuucagaaaaccaagaaccugcugacaggagagac

SEQ ID NO: 174498 - RNA, 42 nt, Homo sapiens
acuccgggacauguggacuguggcaagccggcgguacagggc

SEQ ID NO: 174499 - RNA, 44 nt, Homo sapiens
aggcccuguaccgccggcuugccacaguccacaugucccggagu

SEQ ID NO: 174500 - RNA, 34 nt, Homo sapiens
acgagcacuuugcugagcucgauaucccacaggu

SEQ ID NO: 174501 - RNA, 49 nt, Homo sapiens
guucucgccgcuaguccagucgccauacacaagaucgugcuguucccag

SEQ ID NO: 174502 - RNA, 42 nt, Homo sapiens
ugaggggccggcccucggcggaaccaacugcugauggcccag

SEQ ID NO: 174503 - RNA, 45 nt, Homo sapiens
aggugaccagcaauggcagcaucgggagggacccgccagcggaga

SEQ ID NO: 174504 - RNA, 52 nt, Homo sapiens
guucugcucacccuucacgcacccugcuagcuccccaguccuguucucauuc

SEQ ID NO: 174505 - RNA, 49 nt, Homo sapiens
cccaaggugucacagccaagaacggugggaccaggacuauagcugaggu

SEQ ID NO: 174506 - RNA, 36 nt, Homo sapiens
uggcugugacaccuugggcacaucacuucaccucuc

SEQ ID NO: 174507 - RNA, 51 nt, Homo sapiens
gaaauuuagggguccaaguauggguuucaaugggucugagcugauuugggg

SEQ ID NO: 174508 - RNA, 57 nt, Homo sapiens
gacgaagagaggagacugacauguaaacaguuguaauccugaaugauuagguuggug

SEQ ID NO: 174509 - RNA, 40 nt, Homo sapiens
gcgcagugauuaauugggaguuuucuagcuguggggaagu

SEQ ID NO: 174510 - RNA, 86 nt, Homo sapiens
aguucccagcgcuggccgcucugccacucggucugcuggcgcagcucgggcuccggcucugucuccaccgcuugcuccaccuuggc

SEQ ID NO: 174511 - RNA, 43 nt, Homo sapiens
ccuggggaaggacguccuucaccuccgcuggggcugaguagga

SEQ ID NO: 174512 - RNA, 45 nt, Homo sapiens
ccggggguccguuccgaacuucgacucguacuggugccggcgccc

SEQ ID NO: 174513 - RNA, 42 nt, Homo sapiens
cgcguggcgcacggggugggagcggagcccaggccgggagca

SEQ ID NO: 174514 - RNA, 46 nt, Homo sapiens
uuuaugcacaaguccaaugggaagaccgagucuugacgcugguggg

SEQ ID NO: 174515 - RNA, 46 nt, Homo sapiens
uucauggauccaaaacaugauggcuaauuagagaagggccggaaga

SEQ ID NO: 174516 - RNA, 45 nt, Homo sapiens
aaauaugaauuuauacuuugaccaggucuugccuuuucuguggga

SEQ ID NO: 174517 - RNA, 39 nt, Homo sapiens
aagggucuggacccugagacuucugcuuacaggagggug

SEQ ID NO: 174518 - RNA, 46 nt, Homo sapiens
cuccagggccaccugcuguggaagacguuucccuggaucuagagga

SEQ ID NO: 174519 - RNA, 73 nt, Homo sapiens
gaucacuuccuacgcacgacacagauuaccaaucugcucuugaccccaaaauccugaccgcucucuccccaug

SEQ ID NO: 174520 - RNA, 45 nt, Homo sapiens
cuuccccuggccccgugacacucaggaguuaauaaaugccuugga

SEQ ID NO: 174521 - RNA, 42 nt, Homo sapiens
cagacugguuggacuuguucgucuggacgacacuggagugga

SEQ ID NO: 174522 - RNA, 36 nt, Homo sapiens
uggacaccaguagucccuggucccauggaaccagau

SEQ ID NO: 174523 - RNA, 30 nt, Homo sapiens
gccccccagaaacaugacugaagguguagg

SEQ ID NO: 174524 - RNA, 46 nt, Homo sapiens
ucaccuggaugguaacccugcacgcucaaacccauugucaccaaga

SEQ ID NO: 174525 - RNA, 56 nt, Homo sapiens
cauccacgcaguggacagucuguucaauaccaccuucgucugcacagucaccaaug

SEQ ID NO: 174526 - RNA, 28 nt, Homo sapiens
uccugguggguguaucuuuagggaugag

SEQ ID NO: 174527 - RNA, 45 nt, Homo sapiens
gccacccugagcugugacguccgcagcaacccagagcccacgggc

SEQ ID NO: 174528 - RNA, 25 nt, Homo sapiens
gagcagauggugucacggucaccug

SEQ ID NO: 174529 - RNA, 46 nt, Homo sapiens
uccacgggcucacgguggaggacgagggcaacuacacuugcgaguu

SEQ ID NO: 174530 - RNA, 57 nt, Homo sapiens
agcccgaagccuggcagcgagcggcuguccuucgucucugccaagcagagcacuggg

SEQ ID NO: 174531 - RNA, 44 nt, Homo sapiens
cgaggccagcucgggggcaccguggagcugccgugccaccugcu

SEQ ID NO: 174532 - RNA, 64 nt, Homo sapiens
gcuguaucucccuugccuccaccugacaugcagagcgucugggcagcggcccucaccccugucc

SEQ ID NO: 174533 - RNA, 76 nt, Homo sapiens
gaggauagaaggggagugaaaugccggcacagggucgggggagugaaauaccgacacagggaugaggcugaaagac

SEQ ID NO: 174534 - RNA, 74 nt, Homo sapiens
uuguaggcagaggaacgucuucugagauccaaacagaagugcgagcagcgggccccgucucuugggcuccagau

SEQ ID NO: 174535 - RNA, 54 nt, Homo sapiens
guucccggcagaaccgggggacaggagacucgaucucgugggcuucagacuuaa

SEQ ID NO: 174536 - RNA, 42 nt, Homo sapiens
ccgagcuggggaagccgagcaccuuccccgcccacccccggc

SEQ ID NO: 174537 - RNA, 42 nt, Homo sapiens
gggccuccggccgggcccaguccccucccgggcccuccaugg

SEQ ID NO: 174538 - RNA, 54 nt, Homo sapiens
gagccggagccggagccccacaggcaccuacuaaaccgcccagccgaucggccc

SEQ ID NO: 174539 - RNA, 31 nt, Homo sapiens
gcugguggaggcggggcuggugggggcggag

SEQ ID NO: 174540 - RNA, 44 nt, Homo sapiens
ccagaaagaaacgagugcagcgacaccuagaguucggggcagag

SEQ ID NO: 174541 - RNA, 40 nt, Homo sapiens
ccacccccaacaucucuugggagccagaaauagcccuaac

SEQ ID NO: 174542 - RNA, 45 nt, Homo sapiens
cccccguccuucagagcuccaggaucccaaacuaccuugccaguc

SEQ ID NO: 174543 - RNA, 43 nt, Homo sapiens
gaacacagacuuucaggccccuuggcgugaccaguuucaccag

SEQ ID NO: 174544 - RNA, 106 nt, Homo sapiens
gaggcaggagagacagagaauggagagagagagagacagagaugcagagaaacgaagacauguaaagagaugcaucuuagacaaggcagcaugaacaaacuggaaa

SEQ ID NO: 174545 - RNA, 46 nt, Homo sapiens
uguggcucuggcuuccugggaaggucugcaggagagucuguugcug

SEQ ID NO: 174546 - RNA, 42 nt, Homo sapiens
cuacuuccggcccaucgacaccaccauggacgaggaacaggu

SEQ ID NO: 174547 - RNA, 46 nt, Homo sapiens
gggcgcuugcgcggcgagacggacuaguccuguagcgcugugggaa

SEQ ID NO: 174548 - RNA, 34 nt, Homo sapiens
ucuuggcuuuuaaagacagauuucauaauuggca

SEQ ID NO: 174549 - RNA, 76 nt, Homo sapiens
aagucuggaugucaaguuuaaugcuggggacuaaagagaaaagcuucagauugaaaccuggagguggcuggggcaa

SEQ ID NO: 174550 - RNA, 81 nt, Homo sapiens
ggggggcgggggcgguccguuggugaagagggagagagagaagucacagaaggcuuccuggcagaggcaguauuucagcgg

SEQ ID NO: 174551 - RNA, 41 nt, Homo sapiens
ccggccacaaguucucuaauacaggauguuggcagguagag

SEQ ID NO: 174552 - RNA, 351 nt, Homo sapiens
ugccaguagagaaagaaagggucaggcugggcgcgguggcucacaccuguaaucccagcacuuugggaggcugaggcaggcagaucaccugaggucaggaguucaagaccagccuaaccaacaaggugaaaccccaucucuaccaaaaauauaaaaauuagccaggugugauagcacacgcuuguaaucccagcuacuugggaggcugaggugggaggaucgcuugaaccuuggaggcggagguugcagugagccaagaucacgccauugcacgccagccugggugacagcgagacucucucucgaaaaaaaaaaaaaugaacgggucaaccaggugggcgaggagcagag

SEQ ID NO: 174553 - RNA, 40 nt, Homo sapiens
guguugucuuagaaguagaugugugauggccagaauaaaa

SEQ ID NO: 174554 - RNA, 45 nt, Homo sapiens
caacucguaccccagccacagccccagucccugcccgagcacagg

SEQ ID NO: 174555 - RNA, 46 nt, Homo sapiens
agaccaaagcagccucaccagugcuccaggaagauauagacauuga

SEQ ID NO: 174556 - RNA, 61 nt, Homo sapiens
cccaggguggcagagcagaaggaacacagacugcccccuggccaggaggagaauggggaag

SEQ ID NO: 174557 - RNA, 71 nt, Homo sapiens
acccguaugcaggcuccacggaugagaacacggacagugaggaacaccaggagccuccugaucugccaguc

SEQ ID NO: 174558 - RNA, 24 nt, Homo sapiens
ccugcagauuucuuccagggcaag

SEQ ID NO: 174559 - RNA, 65 nt, Homo sapiens
cccugauggacaaccccucccuggcauucguucguccccgauggaucuacaguugcaaugagaag

SEQ ID NO: 174560 - RNA, 44 nt, Homo sapiens
gucugcgucgugagggguagagcugcuguaaccagcccgguacc

SEQ ID NO: 174561 - RNA, 38 nt, Homo sapiens
agaugagaggcaagaagacccagggagaaggccacuga

SEQ ID NO: 174562 - RNA, 73 nt, Homo sapiens
ggacaauuucauuggaagaaauagggagugugguggguagaggaccugaaggacaaucggggugagagccuga

SEQ ID NO: 174563 - RNA, 67 nt, Homo sapiens
uuauuaaaaggaggggaaugaaggcaacaggaagaaacagagaaaagaccgaggggacuuuugggag

SEQ ID NO: 174564 - RNA, 43 nt, Homo sapiens
ucggccaaucgacguucaugucucugaggcuugggccaauagu

SEQ ID NO: 174565 - RNA, 51 nt, Homo sapiens
gcucucgccgucgccucucgccugcuccguagccucgcucucgcccccagc

SEQ ID NO: 174566 - RNA, 33 nt, Homo sapiens
agcugucccaagagggcuccgcggcuccccagg

SEQ ID NO: 174567 - RNA, 91 nt, Homo sapiens
auuggggcggugagagggguuuuggugugaagacauuaggaaaucgauauccccaagggaacgguuuagagcuaaggagggguccaguugu

SEQ ID NO: 174568 - RNA, 69 nt, Homo sapiens
ucuuuguacaaagaaggauuaaguguauuuuaaaagggugucugggugucccuagaaugagcuggggaa

SEQ ID NO: 174569 - RNA, 50 nt, Homo sapiens
gccaaggugaagaugggauuugguuauuggaaggggaggaaguagggugg

SEQ ID NO: 174570 - RNA, 41 nt, Homo sapiens
aucucagaggggauuagaauugucgauuuggucuugguaca

SEQ ID NO: 174571 - RNA, 50 nt, Homo sapiens
ccccgcuucggaccuaggcccuuccaccacccuagcuccugucuccaggg

SEQ ID NO: 174572 - RNA, 46 nt, Homo sapiens
uccagcccagggccuugcugccgccaugacugaggaaucagaggag

SEQ ID NO: 174573 - RNA, 46 nt, Homo sapiens
ccaccagaggaaccugucauugguuucccugagccagccccagcag

SEQ ID NO: 174574 - RNA, 35 nt, Homo sapiens
aauaauaugugucuggauguaggaagauucaugag

SEQ ID NO: 174575 - RNA, 44 nt, Homo sapiens
cucugcugccuccgucgcccagcccaacaguuucauuucccggg

SEQ ID NO: 174576 - RNA, 45 nt, Homo sapiens
gcugaggccuggagcuccaucugccucuccucagaguguccggca

SEQ ID NO: 174577 - RNA, 42 nt, Homo sapiens
uggccccugccccuuguugggcaggagcagagagagaggaga

SEQ ID NO: 174578 - RNA, 46 nt, Homo sapiens
aggagauaagagaaacgggugagggcgccgcgcggggcuggacugg

SEQ ID NO: 174579 - RNA, 48 nt, Homo sapiens
cgggagcggcgcgggcuggaaggagagcacuccuuccugugugcccug

SEQ ID NO: 174580 - RNA, 40 nt, Homo sapiens
ggcacuaauagauuaggugaaaaagagguaaagaaggugg

SEQ ID NO: 174581 - RNA, 46 nt, Homo sapiens
cucaacagacuaucaugugcacagagcugggggagaccaucgccau

SEQ ID NO: 174582 - RNA, 44 nt, Homo sapiens
gcgggcucuugcaguuggacacggccuucgugugacgcagcuga

SEQ ID NO: 174583 - RNA, 43 nt, Homo sapiens
aaugucuaagcugagacuuaaaggaccaauaggaaucugucag

SEQ ID NO: 174584 - RNA, 58 nt, Homo sapiens
ugugcugcagauaacagagcaggagccacuaaaauaggguucugaagcaugcauagga

SEQ ID NO: 174585 - RNA, 45 nt, Homo sapiens
gagucaguaagagggcauccaagagcagagcacagggacaaggga

SEQ ID NO: 174586 - RNA, 85 nt, Homo sapiens
gguagcaggguuuccacaggugaggggaaaggcaggaggggaucccugggagaaggaguggggaucccuaggaccaugagagaag

SEQ ID NO: 174587 - RNA, 46 nt, Homo sapiens
gaacauggugaggccgccugggacauucaggggguuguuuauggua

SEQ ID NO: 174588 - RNA, 46 nt, Homo sapiens
ccugaccagugccaccugccaccugcgccagggcggagcccauugc

SEQ ID NO: 174589 - RNA, 47 nt, Homo sapiens
cucugcccacucugcgaggagcaucgggacugccacgccugcaccca

SEQ ID NO: 174590 - RNA, 45 nt, Homo sapiens
caugcagccggcggggccggggucggggugcccugaagaguccag

SEQ ID NO: 174591 - RNA, 42 nt, Homo sapiens
ccguggcccucccugcccgcugggcauacgcccgcuguccug

SEQ ID NO: 174592 - RNA, 46 nt, Homo sapiens
gauucccacgcuuccuggacacugguguuguccagucggaccgcag

SEQ ID NO: 174593 - RNA, 47 nt, Homo sapiens
gcuucaaugcuucggugggcucugcccgcugugggucagggggcccc

SEQ ID NO: 174594 - RNA, 58 nt, Homo sapiens
gcugggcuggcccacacugccgcauggcucuguguccugagaacugcaaugcccacac

SEQ ID NO: 174595 - RNA, 49 nt, Homo sapiens
accaagcuggauggcgggcagcuggucugggagacccucauggacagcc

SEQ ID NO: 174596 - RNA, 46 nt, Homo sapiens
ccgcauaugugcccgcuggccguggugccauguaucugcugggggg

SEQ ID NO: 174597 - RNA, 41 nt, Homo sapiens
gggcaagugcauguggacgcggcaguucaagaggacaggug

SEQ ID NO: 174598 - RNA, 49 nt, Homo sapiens
ccagccuugguguagugggauguggccagggagggcuaggagcacgugg

SEQ ID NO: 174599 - RNA, 19 nt, Homo sapiens
agcaacgggacagagcagg

SEQ ID NO: 174600 - RNA, 29 nt, Homo sapiens
aguuacaaauguccaagggagagccaaag

SEQ ID NO: 174601 - RNA, 46 nt, Homo sapiens
cugcugggcgugggagacccaagugggcccggcgccaacggcucag

SEQ ID NO: 174602 - RNA, 48 nt, Homo sapiens
agcaggaaccaagagacgagguucccugaucucaugggacuuagguuc

SEQ ID NO: 174603 - RNA, 71 nt, Homo sapiens
gcugggcauucaaagaagcuagacugagaacgccugagaagaaccagcuacgggaagagcuuugggaagca

SEQ ID NO: 174604 - RNA, 368 nt, Homo sapiens
ggggagugacaggauccgauguaccuauuuaagaauuuaagagggucgggugcgguggcucaugccuauaauccuagcacuuugagaggccaaggugggcugaucacaaggucaagaguucgugaccagccuggccaauauggugaaaccccaugucuacuaaaaauacaaaaauuagcugggcaugguggcacacacuuguaguccgagcuacucgggaggcugaggcagaagaaucgcuugaacccaggaggcggagguugcagugagcucagauugcgucacugcacuccaaccugggugacagagcgagacuccaccucaaaaaaaaaaaaaaaauuuaagaggucacucaguugugcugugga

SEQ ID NO: 174605 - RNA, 85 nt, Homo sapiens
gggcuggaguagggugcuggcaaugagggagucuggcucagaugugggauguguauggaagaauauaaaugaugguguggauguc

SEQ ID NO: 174606 - RNA, 93 nt, Homo sapiens
guucuugacaugagaugcccuucagacaucucuucacucagguccaacuagggauacagaaacacugaauauuucaacagcagaaauugaaug

SEQ ID NO: 174607 - RNA, 49 nt, Homo sapiens
aagcuggaacaacagaggcguguugugggggagccucagaggggacaaa

SEQ ID NO: 174608 - RNA, 45 nt, Homo sapiens
ugggcucuccugaggcgccaccccgcaccugagccaccuccuugg

SEQ ID NO: 174609 - RNA, 62 nt, Homo sapiens
agaggugguggggaccacaucagaagaagaggggggugaugaaauuaacaaauaaaaaguau

SEQ ID NO: 174610 - RNA, 43 nt, Homo sapiens
ggggcgcgguugauucgccgcggaggggcauugagggucccag

SEQ ID NO: 174611 - RNA, 37 nt, Homo sapiens
gggacuggggcacugggggcugggcucucagggggag

SEQ ID NO: 174612 - RNA, 45 nt, Homo sapiens
cccagggcccacugggcacggauucccucaagaaccugacccuga

SEQ ID NO: 174613 - RNA, 85 nt, Homo sapiens
ccagucacacacacacacacacacacacacacacacacacacacacacacacacacauccuucacuagaacacacugccccacug

SEQ ID NO: 174614 - RNA, 63 nt, Homo sapiens
ggagguggggagaagggccagguuccagaggccuuuaguaggcauagugggcaggacuagggg

SEQ ID NO: 174615 - RNA, 57 nt, Homo sapiens
uagggggcggagacagagggagaaagaucccccaggaaaagcgcaauaggagaacua

SEQ ID NO: 174616 - RNA, 85 nt, Homo sapiens
gagaucgaaaaacagaaucugagagauagaagcagagacaugagaggcauguacagacaccgagagacagacauagagugaggga

SEQ ID NO: 174617 - RNA, 41 nt, Homo sapiens
uggaucagggaggagcuggugagugagggguuuggaaggga

SEQ ID NO: 174618 - RNA, 42 nt, Homo sapiens
gagccuccacaucguagaaauaguuggucaggaacuggagua

SEQ ID NO: 174619 - RNA, 41 nt, Homo sapiens
guggcagcagcgcugcagcgacaaggacuggagcuccuuca

SEQ ID NO: 174620 - RNA, 46 nt, Homo sapiens
aggcaggcgaggccccguucggagaugcgggggcaaccggccagcg

SEQ ID NO: 174621 - RNA, 53 nt, Homo sapiens
auuggccagcaccacucccccacccugacguugagugaagacaaauggaagcc

SEQ ID NO: 174622 - RNA, 57 nt, Homo sapiens
cccugugucagucagggucccugcaagaaauggcagugcacucacauaaggacaguu

SEQ ID NO: 174623 - RNA, 50 nt, Homo sapiens
gagggcagucuuggggcaguuggcaaagugcccucagcacagaguaagcg

SEQ ID NO: 174624 - RNA, 40 nt, Homo sapiens
aguggggucuuccagggagcuuguugguguggggcccugc

SEQ ID NO: 174625 - RNA, 74 nt, Homo sapiens
ucucagaguaaaaucaauguaucguucccuuuguuaucugggugccaucuccucucccuccucaucuuucccca

SEQ ID NO: 174626 - RNA, 68 nt, Homo sapiens
ucccacagcaaacuaauccugucugaacuugaccucgacaucuuccucccaggcgugcuccuuugccu

SEQ ID NO: 174627 - RNA, 53 nt, Homo sapiens
uggaauccccaucuaccgcgucauggaccggcaaggccagaucaucaacccca

SEQ ID NO: 174628 - RNA, 47 nt, Homo sapiens
cugaccucggaggaaucccgggaguagugggaagaaaaguugcagau

SEQ ID NO: 174629 - RNA, 67 nt, Homo sapiens
agaauucguguguucuggacacuguacagaggagacgauuaauauuuguugaauuaaugaggggaaa

SEQ ID NO: 174630 - RNA, 67 nt, Homo sapiens
uuaggagaggaaaaaacccguuugcaacuucuuugugggcccugagggagacgacuugaagagagag

SEQ ID NO: 174631 - RNA, 72 nt, Homo sapiens
uuuucccaaaggggauuagggauguaaaggcuaucuucagaguguggggucccugaaggauaugaaggaagg

SEQ ID NO: 174632 - RNA, 45 nt, Homo sapiens
agugguuguuagccaagauggcgguagcgaucgcugcagcgaggg

SEQ ID NO: 174633 - RNA, 50 nt, Homo sapiens
gacuagaaaggagaagauaguuccaucuuuguaacuaucucugagaauga

SEQ ID NO: 174634 - RNA, 33 nt, Homo sapiens
acugaagcaaaccugucuauuugcauacugugg

SEQ ID NO: 174635 - RNA, 73 nt, Homo sapiens
uccaacuugagcagucagagacaugugacaagcuagcaaaggagacucagaaggaacgcccagagaguuaggg

SEQ ID NO: 174636 - RNA, 77 nt, Homo sapiens
agcuguuucagccuuacugacagccgggucaugggaggguugaucauuuggaggucaguggugacgauguugagcug

SEQ ID NO: 174637 - RNA, 59 nt, Homo sapiens
guaacugcaccaucccaggcugagaccgugagcccuuucugggaauuugggugaggcgu

SEQ ID NO: 174638 - RNA, 43 nt, Homo sapiens
gaagacccugaaccucucuucaauuuccccagguguugcagag

SEQ ID NO: 174639 - RNA, 42 nt, Homo sapiens
gucgccugcgcccuggacucugaugggacccucgugcuggau

SEQ ID NO: 174640 - RNA, 41 nt, Homo sapiens
ugccugauaggucugaguccuguugcugucagaaucugauc

SEQ ID NO: 174641 - RNA, 65 nt, Homo sapiens
acuugggggcaggggagugaugggagguuaagggagucagguggggucagcagaaccuccugggu

SEQ ID NO: 174642 - RNA, 42 nt, Homo sapiens
guuucuagaugcuccugccgccgccgcagccucauccaccaa

SEQ ID NO: 174643 - RNA, 42 nt, Homo sapiens
cgcauacgugcacacgcccagcccgacggcgaggacccccag

SEQ ID NO: 174644 - RNA, 36 nt, Homo sapiens
cucagucccagacccuuccccuggucccucccccac

SEQ ID NO: 174645 - RNA, 46 nt, Homo sapiens
cacuugcagaagaggcuacuuuccgagaaaccgcuggccccuauga

SEQ ID NO: 174646 - RNA, 84 nt, Homo sapiens
aggcccuggggggggacugucugguggggacaguauggcuggagcccagacggagugugccugguggggacagcauggcuagag

SEQ ID NO: 174647 - RNA, 47 nt, Homo sapiens
agaacacaguucagcuccucagucugguagucaaagcccuuggagau

SEQ ID NO: 174648 - RNA, 76 nt, Homo sapiens
gcugaauuuccucucuguguuauccuccuccaugaccccaugucagggcagcccauugcuccuccaguccccaggu

SEQ ID NO: 174649 - RNA, 42 nt, Homo sapiens
gccgaggagcagccugaggccccagagucugagacgagccgc

SEQ ID NO: 174650 - RNA, 38 nt, Homo sapiens
uuucuccuccaggagacggaucucucuccgaccugcca

SEQ ID NO: 174651 - RNA, 46 nt, Homo sapiens
uuaucuuuugaugucaccggaguugugcggcagugguugagccgug

SEQ ID NO: 174652 - RNA, 43 nt, Homo sapiens
aggaggggcaccauagcugauguugaagggaugaguagaaugg

SEQ ID NO: 174653 - RNA, 65 nt, Homo sapiens
ggccgccgaggugaccuggccaccauucauggcaugaaccggccuuuccugcuucucauggccac

SEQ ID NO: 174654 - RNA, 45 nt, Homo sapiens
ugagugauggcucagaacuuuggaauguugggaugcaauacuggc

SEQ ID NO: 174655 - RNA, 61 nt, Homo sapiens
gagaucagccagauuugauagcaccuuguggcucacggugaggacuugggcauuugccgug

SEQ ID NO: 174656 - RNA, 55 nt, Homo sapiens
gagugaaguaacagagggaugggggugaaggggagaagagagacagggagaugga

SEQ ID NO: 174657 - RNA, 75 nt, Homo sapiens
ugagagagacagauacagacacagaguuaggccaaggagagacaaagacagauacacaacaaggcaagaggcgaa

SEQ ID NO: 174658 - RNA, 45 nt, Homo sapiens
ggggagagacgaagugagagaggcuggcgcgguagcggguggggg

SEQ ID NO: 174659 - RNA, 101 nt, Homo sapiens
ucucuuaccugccuguauuugugccccauuuuuaaagagcagagggccugggccacaggaaagguaucagcccuuggugauaggcacauuuuuuaccaguc

SEQ ID NO: 174660 - RNA, 74 nt, Homo sapiens
ugucccgcacacagacaggaucaggucaucuugauauggagaucaguccccaaaucacugaauugucccagcag

SEQ ID NO: 174661 - RNA, 82 nt, Homo sapiens
gagccuccuugcuucuguuagguucccaucucuccuucugccucacucugggccucuucuuucuacuuguacauuuccaccu

SEQ ID NO: 174662 - RNA, 45 nt, Homo sapiens
ggcuucuuucugucucuuucugucuuucugucucucucccuaccc

SEQ ID NO: 174663 - RNA, 41 nt, Homo sapiens
acaaccccgacuucgacaaccucgacaucguggcacgggau

SEQ ID NO: 174664 - RNA, 74 nt, Homo sapiens
gacucugugcucagugccugcccgagugcacccgcauucacacccccucuccucucccucugcagaccagaggu

SEQ ID NO: 174665 - RNA, 36 nt, Homo sapiens
ucagugcccgcaccccaacccaccagccccccaagc

SEQ ID NO: 174666 - RNA, 44 nt, Homo sapiens
gagccggacaccagucccaucuaaaccccaggacaaaguggaag

SEQ ID NO: 174667 - RNA, 51 nt, Homo sapiens
aggcuuuaucaaaaauguuagaaccagaaaaucuaaaaccacauaauguca

SEQ ID NO: 174668 - RNA, 56 nt, Homo sapiens
gaaaccuagaaccuuugaaucuagacucuuuaaaccuuggacucuagagucuugga

SEQ ID NO: 174669 - RNA, 86 nt, Homo sapiens
uuccuuuuacagauggugaugcuacugcuuucaaggugaugcuacugcacagagaaggggagggaccugucugggauggagguggg

SEQ ID NO: 174670 - RNA, 47 nt, Homo sapiens
ggaguuuuccccaguggcagugcuuagcuuggauccugagagggagu

SEQ ID NO: 174671 - RNA, 42 nt, Homo sapiens
aauccuuagggucuggcuggguuggggggucagcuccuccug

SEQ ID NO: 174672 - RNA, 45 nt, Homo sapiens
acauagaggauuucgucaggcuccugggcaggaggcaaggccuuc

SEQ ID NO: 174673 - RNA, 44 nt, Homo sapiens
ggcaucuuggcgauacgucccuggcgguaguaguccccauugua

SEQ ID NO: 174674 - RNA, 42 nt, Homo sapiens
gcuucagugguccgacgacuguaggacuugcgcacgcgguac

SEQ ID NO: 174675 - RNA, 45 nt, Homo sapiens
gcagcggccacgacugcuccuagcaguacauaccaccagggccac

SEQ ID NO: 174676 - RNA, 45 nt, Homo sapiens
ggcccuggcugcuggugcaugccacgcggaugugauaaggggugu

SEQ ID NO: 174677 - RNA, 41 nt, Homo sapiens
cgccuggaugcccaucccaucguuugacagcacagccugag

SEQ ID NO: 174678 - RNA, 42 nt, Homo sapiens
uaccauuauguccauuuuguagacaagagagcugagccccgg

SEQ ID NO: 174679 - RNA, 46 nt, Homo sapiens
uuaugggcuucgcaggagaaagaggaugucuuguucagcccuaggg

SEQ ID NO: 174680 - RNA, 41 nt, Homo sapiens
cgauuccagaugugcuuuccagauguccugaccaucccccc

SEQ ID NO: 174681 - RNA, 46 nt, Homo sapiens
ccacacgcacucgagccauggaacagcucagaggaaacccaggaca

SEQ ID NO: 174682 - RNA, 42 nt, Homo sapiens
guguuggcggccacaguccugucuucgggcuccuccaggaag

SEQ ID NO: 174683 - RNA, 79 nt, Homo sapiens
accuggagcugacaccgaagggugcccgugaguccccgggcaccugugauauucccuggguugcccacgaagggacuuu

SEQ ID NO: 174684 - RNA, 143 nt, Homo sapiens
gagacucagagagcagggagagauaaaggcagagacugugaaagagagagaaacagagacccacagagauagcagagcuggaggcagagacagagagacaaagugagagccuccuccccagagauggaguggacugguggggu

SEQ ID NO: 174685 - RNA, 44 nt, Homo sapiens
ugccagauccccguagcucaucucuucaucuugguuuugccaca

SEQ ID NO: 174686 - RNA, 46 nt, Homo sapiens
ucugacuuucuuggugcauuuggccaugucaccgcaaacuaagucu

SEQ ID NO: 174687 - RNA, 44 nt, Homo sapiens
gagaacaaaggggacagaggaaaguuguuuguugauuuuggagg

SEQ ID NO: 174688 - RNA, 67 nt, Homo sapiens
ugaguuaagucuccuuuaagggcgauuccugcuuugucaggggcuacuacuauuaguaggcagaggg

SEQ ID NO: 174689 - RNA, 42 nt, Homo sapiens
agauggugauggcuggggugguuugccuuuauacugccugaa

SEQ ID NO: 174690 - RNA, 44 nt, Homo sapiens
gagaacaaagcagagagaggaaagcuguuuauugauuuuguggg

SEQ ID NO: 174691 - RNA, 67 nt, Homo sapiens
ugaguuaagucuccuuuaagggcgauuccugcuuugucaggggcuacuacuauuagcaggcagaggg

SEQ ID NO: 174692 - RNA, 42 nt, Homo sapiens
agauggugacggcuggggugguuugccuuuauacugccugaa

SEQ ID NO: 174693 - RNA, 52 nt, Homo sapiens
gaaagagaaggaugaggggagacgaagagaaaguaguacagagauggcaaga

SEQ ID NO: 174694 - RNA, 24 nt, Homo sapiens
agggagagggcgguuuagaccaag

SEQ ID NO: 174695 - RNA, 41 nt, Homo sapiens
cagggucccgggaucugggacagguggggacauugcaccag

SEQ ID NO: 174696 - RNA, 41 nt, Homo sapiens
gauccuguuaaccagguugugccagaaucacaggggaggca

SEQ ID NO: 174697 - RNA, 42 nt, Homo sapiens
gucuccaaaucuuuggaucucguggaucacugccuccaugua

SEQ ID NO: 174698 - RNA, 52 nt, Homo sapiens
gccguuuccugauugguuguggguggcuaccucuucguucugauuggccgcu

SEQ ID NO: 174699 - RNA, 49 nt, Homo sapiens
cuaggcacagagagguuaagugacuuccccaagauccuaccugcagcaa

SEQ ID NO: 174700 - RNA, 48 nt, Homo sapiens
auacgggaagagaccccaaucagauuuuucaaauuaaagccaguccug

SEQ ID NO: 174701 - RNA, 19 nt, Homo sapiens
gccaggaugugaagcucca

SEQ ID NO: 174702 - RNA, 41 nt, Homo sapiens
cuugaggccaguaggggacgagagguggaggccaugcuuac

SEQ ID NO: 174703 - RNA, 61 nt, Homo sapiens
caguggccccaagggacuagggggcugagcagggcagucuggguaaggagaguuguggcug

SEQ ID NO: 174704 - RNA, 36 nt, Homo sapiens
ugcuucugccgcagguucccugggaugcaggcgaga

SEQ ID NO: 174705 - RNA, 42 nt, Homo sapiens
gauggagcaaaaacaggugguaucucccuuuaaaccaaguau

SEQ ID NO: 174706 - RNA, 41 nt, Homo sapiens
accaccuguuuuugcuccaucauaucccaaucaacauuuug

SEQ ID NO: 174707 - RNA, 42 nt, Homo sapiens
ucaagccaagugcuucaacaggcgugcugacugugccaucug

SEQ ID NO: 174708 - RNA, 45 nt, Homo sapiens
augauaacacauuuugaaccuucugucuccuuugagggccuuuac

SEQ ID NO: 174709 - RNA, 45 nt, Homo sapiens
uauucaacauugccaaauucauacuggugggaaacccuuugaaug

SEQ ID NO: 174710 - RNA, 46 nt, Homo sapiens
gcccuggauuguuguaaguaaagaaacaagcagaugguauccaggu

SEQ ID NO: 174711 - RNA, 70 nt, Homo sapiens
agggcacugggaaauggugagaggcacugggaaauggugagaggcacuggggaauggugaagggcacugg

SEQ ID NO: 174712 - RNA, 116 nt, Homo sapiens
cacugggaaauggugaggggcacuggggaauggugaagggcacuggggaauggugaagggcacugggaaauggugaggggcacugggaaauggugaggagcacugggaaaugguga

SEQ ID NO: 174713 - RNA, 32 nt, Homo sapiens
ucaugcuuccgccgcagguucccugggaugua

SEQ ID NO: 174714 - RNA, 90 nt, Homo sapiens
caaagcugcagaggcugcagcagaggaaugaaaauguccccaguagggagguuagauauugaaccgagaaugaagcuuugcacaagaagg

SEQ ID NO: 174715 - RNA, 46 nt, Homo sapiens
cacucagcagauuccaguaccaccuggcaucgugcaggagaaagaa

SEQ ID NO: 174716 - RNA, 23 nt, Homo sapiens
uaucgacuuacauuacaucaaag

SEQ ID NO: 174717 - RNA, 38 nt, Homo sapiens
ccuacauauguaaugaaugugggaaugcuuuuauuugc

SEQ ID NO: 174718 - RNA, 42 nt, Homo sapiens
ggaaagccuuuagucguguuagagaccuuagaguacaucaga

SEQ ID NO: 174719 - RNA, 50 nt, Homo sapiens
guggcugcgggagaucucugcggauuggggcuccagccugacugacccga

SEQ ID NO: 174720 - RNA, 41 nt, Homo sapiens
uuucuuuacccaggauugguuucuucaauaaauagauaaga

SEQ ID NO: 174721 - RNA, 70 nt, Homo sapiens
cuacauuguccuggccaaggacuucgagaaagcauacaagacugucaucaagaaggacgagcaggagcau

SEQ ID NO: 174722 - RNA, 46 nt, Homo sapiens
ggcuggaccguaaaauugaauuuccacuuccugaccgccgccagaa

SEQ ID NO: 174723 - RNA, 46 nt, Homo sapiens
ggauccugcuggagcugcugaaucagauggauggauuugaucagaa

SEQ ID NO: 174724 - RNA, 47 nt, Homo sapiens
cgagauugaugccaucgccaccaagagauucgaugcucagacagggg

SEQ ID NO: 174725 - RNA, 58 nt, Homo sapiens
aggauagguggaaggaguaguagagcccagggggagcugagagauugggaggacaggg

SEQ ID NO: 174726 - RNA, 27 nt, Homo sapiens
ggacaucggaggcauggacauccagaa

SEQ ID NO: 174727 - RNA, 32 nt, Homo sapiens
guccaggaggcugcuggucagccaggucugac

SEQ ID NO: 174728 - RNA, 23 nt, Homo sapiens
gugggcuaugaggaagugaggag

SEQ ID NO: 174729 - RNA, 49 nt, Homo sapiens
ccaggaggaggugaagcgaauccaaagcaucccgcuggucaucggacaa

SEQ ID NO: 174730 - RNA, 47 nt, Homo sapiens
ggaguuccuggaggugcaggaggaauacaucaaagaugagcaaaaga

SEQ ID NO: 174731 - RNA, 47 nt, Homo sapiens
agagcuuguuuagguggccaaaagguuuccaggaucuauuuagaggg

SEQ ID NO: 174732 - RNA, 49 nt, Homo sapiens
agaacuagaggagagcggggggcaggaggaccaugagggaggcccaggc

SEQ ID NO: 174733 - RNA, 46 nt, Homo sapiens
cucugucuuucgcauccauggcaccaccuucgcgugcugcugggau

SEQ ID NO: 174734 - RNA, 46 nt, Homo sapiens
ugaccuccaccggugugacucgggguuugcuguaaugcugugagau

SEQ ID NO: 174735 - RNA, 46 nt, Homo sapiens
ccuaaucauggccugagacaucaucuccaacgcagcugcaccacuc

SEQ ID NO: 174736 - RNA, 44 nt, Homo sapiens
uaaagagaaguugacuuuauuaacagcaaagguuuggggguggg

SEQ ID NO: 174737 - RNA, 47 nt, Homo sapiens
ggucuucuucaagggauucuagaggauuuaggggaccugugugagca

SEQ ID NO: 174738 - RNA, 74 nt, Homo sapiens
gugggggggggggguccugaaaaccugcauaucagaggggucaccaagagaaucuuacggucuuacagggguug

SEQ ID NO: 174739 - RNA, 69 nt, Homo sapiens
agacaggaggccucugggggagacuuuugggaucuguggaaagguccagagggauacgugaagggggag

SEQ ID NO: 174740 - RNA, 83 nt, Homo sapiens
ucuggaaugggguaagugggagggaaaauucuuaggauccgggagggggaagucgggugagccuguugggcugugagaggcag

SEQ ID NO: 174741 - RNA, 42 nt, Homo sapiens
guggaauggacgaggaguggccuccgaggacuauuucuggag

SEQ ID NO: 174742 - RNA, 52 nt, Homo sapiens
cccaugaagggcucgaggaggcgacuccacgggagggguggguuuugcgggg

SEQ ID NO: 174743 - RNA, 45 nt, Homo sapiens
ccucagaacauuuccccagaggagcucaaaauggaguugccggag

SEQ ID NO: 174744 - RNA, 45 nt, Homo sapiens
cgaguguccuacccuuuguguuucaucuucuccagcccugugggu

SEQ ID NO: 174745 - RNA, 45 nt, Homo sapiens
ggaacaacagaugauguaugcagggaguaaaaacaggcuggugca

SEQ ID NO: 174746 - RNA, 46 nt, Homo sapiens
ccaaccacucucgcccgcacgcaggaagaacugggaaacuggggag

SEQ ID NO: 174747 - RNA, 28 nt, Homo sapiens
cgcgcccucuuauuucccucucugccuc

SEQ ID NO: 174748 - RNA, 50 nt, Homo sapiens
uuucuucccuuucccucccuuuccgugucuucuucucccuucucuccucc

SEQ ID NO: 174749 - RNA, 56 nt, Homo sapiens
cucggggccaccuggaaauuggcgagaaacucgacaucauccgucagaagugagcc

SEQ ID NO: 174750 - RNA, 43 nt, Homo sapiens
gcaggaggcugggaagaugagguccagccaggaggugagggau

SEQ ID NO: 174751 - RNA, 60 nt, Homo sapiens
cauaccccugucgccuuguaccccgauuccgacuuggagaaggaagaagaggagagugag

SEQ ID NO: 174752 - RNA, 75 nt, Homo sapiens
ccccgcccccggcgccccagggaagcccccgacaccuaccucgcucagggcccugaccguacucccgacaccaac

SEQ ID NO: 174753 - RNA, 44 nt, Homo sapiens
cccggcgccugcugcguacagcuucuccaccguggaugucuccc

SEQ ID NO: 174754 - RNA, 45 nt, Homo sapiens
gucauucugcagguccauguacucagugccggccgagaagccuag

SEQ ID NO: 174755 - RNA, 51 nt, Homo sapiens
gccacagccuuuuccccaaaccugguaucacccccucuccucccucccuaa

SEQ ID NO: 174756 - RNA, 36 nt, Homo sapiens
agcugaccuuggaagggguggcccgguacaugcaga

SEQ ID NO: 174757 - RNA, 46 nt, Homo sapiens
caaccuagagaaguaccaucuucccuacccagaggccaucuuugag

SEQ ID NO: 174758 - RNA, 46 nt, Homo sapiens
ucgucagcagugcugucgcucuucccugcagccaaccaucugucac

SEQ ID NO: 174759 - RNA, 45 nt, Homo sapiens
uuggugagagccucccagcgcguuucuucuccuguaugcagucag

SEQ ID NO: 174760 - RNA, 45 nt, Homo sapiens
cucuccaccccucgccugcucaucaacaaggagaaagcuggccag

SEQ ID NO: 174761 - RNA, 45 nt, Homo sapiens
accugccaaggacgaggccaggacaacagagagggagaaacccca

SEQ ID NO: 174762 - RNA, 47 nt, Homo sapiens
acugcccccacggggccagggcuaccccagaacuuuuaacucuucca

SEQ ID NO: 174763 - RNA, 57 nt, Homo sapiens
gacuuggaggaauuuggcagagcuagaggcccaggcauuugggguucauuucuggag

SEQ ID NO: 174764 - RNA, 42 nt, Homo sapiens
ucuggaccaauccucaguuccguuuaacgcugcuggagccug

SEQ ID NO: 174765 - RNA, 45 nt, Homo sapiens
cccuugcucuugcuucuuucagauuccagaggaggugagucuggg

SEQ ID NO: 174766 - RNA, 46 nt, Homo sapiens
ugcucaccaccauugcccgcaccaucaacgagguggagaaccagau

SEQ ID NO: 174767 - RNA, 46 nt, Homo sapiens
cugagagccaguggugagacacugaccagaguuuguccaaacaguc

SEQ ID NO: 174768 - RNA, 45 nt, Homo sapiens
guaaugucuccuucccuuaccucuccgcccucagugguagcagcu

SEQ ID NO: 174769 - RNA, 23 nt, Homo sapiens
gaaucugccugcucccagcaggu

SEQ ID NO: 174770 - RNA, 24 nt, Homo sapiens
guccucugcucuuaaagcagccca

SEQ ID NO: 174771 - RNA, 42 nt, Homo sapiens
ugauuugggggcaaugaaggggaaucauggaucagagguggg

SEQ ID NO: 174772 - RNA, 56 nt, Homo sapiens
ccaugaaacaggcuuucaaacuuccugaagcaacuucucacucuaaaguggaagag

SEQ ID NO: 174773 - RNA, 21 nt, Homo sapiens
gcagagccauaacuagccuga

SEQ ID NO: 174774 - RNA, 65 nt, Homo sapiens
ggaguucccuggacaucuuagacuucaguguucccggacuggaggccaggucugugggcacuaag

SEQ ID NO: 174775 - RNA, 47 nt, Homo sapiens
gcuggggcuggggucucucaguccuagguuuggguuccagguuccag

SEQ ID NO: 174776 - RNA, 44 nt, Homo sapiens
cccccugccccugccaggggcucugaggguuccggaauccccgu

SEQ ID NO: 174777 - RNA, 52 nt, Homo sapiens
gaugauauuuguauaaagccuugaaagaaacaagggaaugagccacaaggaa

SEQ ID NO: 174778 - RNA, 44 nt, Homo sapiens
gucagagggcagggggucucugcaguauccugggaaggagagga

SEQ ID NO: 174779 - RNA, 35 nt, Homo sapiens
agcaagauggaggguuuugagcagaggagggacau

SEQ ID NO: 174780 - RNA, 42 nt, Homo sapiens
cgggcccuucaggaggggaaggggcggcugcagcgcccccag

SEQ ID NO: 174781 - RNA, 46 nt, Homo sapiens; identical to SEQ ID NO: 99314

SEQ ID NO: 174782 - RNA, 42 nt, Homo sapiens
ggcggggccagggcggagcuuggggacagggguggagcuuga

SEQ ID NO: 174783 - RNA, 44 nt, Homo sapiens
uaaggacuugggccugaucggaucuuggagaacaggggcggggc

SEQ ID NO: 174784 - RNA, 30 nt, Homo sapiens
gccacggugggagcuggagccggggauggg

SEQ ID NO: 174785 - RNA, 46 nt, Homo sapiens
gguggcucgcccaggugguugguggaugugcucagccuaguggggg

SEQ ID NO: 174786 - RNA, 51 nt, Homo sapiens
uucagauauaagaacuugucucucugccgucccaacuggggagacaagggc

SEQ ID NO: 174787 - RNA, 107 nt, Homo sapiens
cucgaugaccuguuuggccaguucuguggagggaaugguggugucuuccggcuucugcugcuggcuggcaaaacuguaguaguuguuggggcccaggacccacccuc

SEQ ID NO: 174788 - RNA, 48 nt, Homo sapiens
cuuuguuguagcugcccuccaucagguacugcagaagccgggaagggg

SEQ ID NO: 174789 - RNA, 35 nt, Homo sapiens
gccagagcuccagaaauaaaggagcuuccaugcaa

SEQ ID NO: 174790 - RNA, 40 nt, Homo sapiens
gugugcuggcccugugcuagacagugcuggagacauaguu

SEQ ID NO: 174791 - RNA, 47 nt, Homo sapiens
gacaagugacugcccgucucugagccuugauuuccucagcugccaaa

SEQ ID NO: 174792 - RNA, 42 nt, Homo sapiens
gaugaauggauggauggauggaugguuagauggauagaugga

SEQ ID NO: 174793 - RNA, 45 nt, Homo sapiens
agaugaauggaugcauagaugaauguaucaguggauggauaguug

SEQ ID NO: 174794 - RNA, 42 nt, Homo sapiens
ccuaugggagcagccuggccgcgcagggcaaggagcuggugg

SEQ ID NO: 174795 - RNA, 74 nt, Homo sapiens
aaacccugaugggcauggcguggacagccucuccuuggccucgcgcacgaaugggcgggcccagcgcugggcag

SEQ ID NO: 174796 - RNA, 36 nt, Homo sapiens
acauccguguccgaaucgcuggagcugcugcuggag

SEQ ID NO: 174797 - RNA, 44 nt, Homo sapiens
gcugcagcggcggcuggacguggagaaguggaucgacgggcgcc

SEQ ID NO: 174798 - RNA, 23 nt, Homo sapiens
aacuagagccaaggcgagagacc

SEQ ID NO: 174799 - RNA, 86 nt, Homo sapiens
acaugcccgaugagaucaacauugaugaauuguuggaguuagagagugaagaggagagaagccggaaaauccagguaggugggggg

SEQ ID NO: 174800 - RNA, 28 nt, Homo sapiens
uuuccccaucucugucuuucucccggcu

SEQ ID NO: 174801 - RNA, 53 nt, Homo sapiens
cccuaacuccccccaccccacaaucagagaacaggaggaggcgcccaggucag

SEQ ID NO: 174802 - RNA, 50 nt, Homo sapiens
ccuccaggaccgggcccggacugcucaccccugacccucuugcacucucc

SEQ ID NO: 174803 - RNA, 44 nt, Homo sapiens
gccucugggcgggcaugggggguggugggugccagccaggggca

SEQ ID NO: 174804 - RNA, 42 nt, Homo sapiens
aggcacggggcgggcacaggcuggggcggucggggaggggca

SEQ ID NO: 174805 - RNA, 44 nt, Homo sapiens
ccgggugggcccccgcccagcgccugcuggaaugagaagcacag

SEQ ID NO: 174806 - RNA, 42 nt, Homo sapiens
ugccccaaaccagacgggagaacgaggcagucgugggcagag

SEQ ID NO: 174807 - RNA, 49 nt, Homo sapiens
uucuccuccuuucuggcaaagcagggcggagcugggacaaagccgggga

SEQ ID NO: 174808 - RNA, 45 nt, Homo sapiens
ccaaacugugcuuugaggcccggcccuucccuucgugucccaguu

SEQ ID NO: 174809 - RNA, 48 nt, Homo sapiens
ggacaucuuugucuaaacuaccucuuaccuaucaaaacuugucugugu

SEQ ID NO: 174810 - RNA, 28 nt, Homo sapiens
ucauuucaggauuuggugauguucagag

SEQ ID NO: 174811 - RNA, 48 nt, Homo sapiens
guggaaauugcuagggagaagaauaaaggaggaaggguaaggggcugg

SEQ ID NO: 174812 - RNA, 54 nt, Homo sapiens
aucuaacucggagccauuccgggccgcuggaccugggcggcucugaagcgagaa

SEQ ID NO: 174813 - RNA, 44 nt, Homo sapiens
ccaggaggacaaugacaucccguuguaccugaagggcggcaucg

SEQ ID NO: 174814 - RNA, 88 nt, Homo sapiens
uggcugggccuccuuccccaggaauuaagaccaagaagccuggggggccugagagacuugaacaagugucaauaaacgcuggccucug

SEQ ID NO: 174815 - RNA, 48 nt, Homo sapiens
ccugguuaacucguucuugaagggcggcggcggcggcggcgggggagg

SEQ ID NO: 174816 - RNA, 45 nt, Homo sapiens
uucuccacccucugucucaugauccaaaauacaggcccauagguu

SEQ ID NO: 174817 - RNA, 41 nt, Homo sapiens
aagcauauaacuggaagccucaccuagucucagguugggug

SEQ ID NO: 174818 - RNA, 50 nt, Homo sapiens
aaggauggaggcuguggcaggguggggacaguggaggggaagaguuuagu

SEQ ID NO: 174819 - RNA, 26 nt, Homo sapiens
acagcagggagcagacagaagggagc

SEQ ID NO: 174820 - RNA, 41 nt, Homo sapiens
ugccacugcucaccagugugaguccucauguggcgcuugag

SEQ ID NO: 174821 - RNA, 43 nt, Homo sapiens
auggugacacugcgucucuccugccccuuaccuccaggcacag

SEQ ID NO: 174822 - RNA, 46 nt, Homo sapiens
cgucaccgucccugcagugagcuucccagccccuagcccuguggaa

SEQ ID NO: 174823 - RNA, 50 nt, Homo sapiens
ccugcccugcguuccuggggcaaccacgaggcccgggccaaccugagacu

SEQ ID NO: 174824 - RNA, 85 nt, Homo sapiens
gagccuggcguccugugucccugcuuccuccgugcugcccacagacaggaaucucccaacgcccacaucugcacccaccccaggc

SEQ ID NO: 174825 - RNA, 16 nt, Homo sapiens
cacugcccacccucug

SEQ ID NO: 174826 - RNA, 56 nt, Homo sapiens
gcuccgccuccugacccugccccucgguuugccacgucgcugccccauuucccagg

SEQ ID NO: 174827 - RNA, 46 nt, Homo sapiens
gcaggaaggagguggaggccgggccuggagaccagcagggcgacuc

SEQ ID NO: 174828 - RNA, 45 nt, Homo sapiens
gugagauucacucccugagcccuggagagcaaacagaggaugauc

SEQ ID NO: 174829 - RNA, 53 nt, Homo sapiens
gaugggguuucaguuucagucuaggcaucagauggggacaagagguagcaggg

SEQ ID NO: 174830 - RNA, 28 nt, Homo sapiens
augagagacuggaaucaaauguucucau

SEQ ID NO: 174831 - RNA, 84 nt, Homo sapiens
uauuggcacaaggugucuggaguaagaucacacggguagaaugaagaagcugggaugacucgaugacugauuucauuuggggag

SEQ ID NO: 174832 - RNA, 51 nt, Homo sapiens
accagguuuaagaugacaaaugacagcugugaccaccuggguauuggagcc

SEQ ID NO: 174833 - RNA, 40 nt, Homo sapiens
aucuaucugucuguccaucccacaaauacccaucaugacu

SEQ ID NO: 174834 - RNA, 70 nt, Homo sapiens
ccaggcccauagccugcacuaccucgccaaccugcccaagccacacuaccuugggguagacguggcacag

SEQ ID NO: 174835 - RNA, 71 nt, Homo sapiens
uuugagggcagcggucucgggccauuuggccucucaggggcccagcugcugcuucugggccuacucucagg

SEQ ID NO: 174836 - RNA, 46 nt, Homo sapiens
gccaugugagguucugguucuuggaagucuccacugagacaaaggu

SEQ ID NO: 174837 - RNA, 46 nt, Homo sapiens
ucucagugcucuggccuucuccccugaugggaaguacauagugaca

SEQ ID NO: 174838 - RNA, 68 nt, Homo sapiens
accucugcuggccucuuccgaggcuugggaggcagaagagggcagaguccuaucagagucgccaggau

SEQ ID NO: 174839 - RNA, 41 nt, Homo sapiens
cugugcugggugcuguuccgugugcuggggacacagcagug

SEQ ID NO: 174840 - RNA, 42 nt, Homo sapiens
cugugugguggugauuuuggaccccaaggagaacaagcagca

SEQ ID NO: 174841 - RNA, 26 nt, Homo sapiens
gaugaacccguccccgaggcccccag

SEQ ID NO: 174842 - RNA, 66 nt, Homo sapiens
guuucccugaggagguuacaguugagaagacuggagggugaguugggguuaacuaagagaaggguc

SEQ ID NO: 174843 - RNA, 45 nt, Homo sapiens
ugaggcagaauugaacuuggaacagaaagauccuggagcugcauu

SEQ ID NO: 174844 - RNA, 59 nt, Homo sapiens
uggcacgugggagggacagagggagcccagugugggaaaugagggaaggggaauaagug

SEQ ID NO: 174845 - RNA, 42 nt, Homo sapiens
ggccagugggugggcguggagcuggacgaaccugagggcaag

SEQ ID NO: 174846 - RNA, 45 nt, Homo sapiens
ugggcagcuugcagcagcgugacggggccaaggcugagguuggag

SEQ ID NO: 174847 - RNA, 50 nt, Homo sapiens
gauucccaguaacacauccagaguagagaccccuguuagccagcccucga

SEQ ID NO: 174848 - RNA, 46 nt, Homo sapiens
aguccucucaagaugucgugaccccauggucacccugaagcccuua

SEQ ID NO: 174849 - RNA, 52 nt, Homo sapiens
aucccaaacccuagaguacacacgucccaaacuccccugugcccucaagucc

SEQ ID NO: 174850 - RNA, 46 nt, Homo sapiens
auccccagggaaucccaaauuugaaaauccaaucccaaguccccag

SEQ ID NO: 174851 - RNA, 23 nt, Homo sapiens
gacgcugguggacggucaguuuu

SEQ ID NO: 174852 - RNA, 54 nt, Homo sapiens
gggagggaagaagauuugggagucagccucagagcuaaagaucucagggugcug

SEQ ID NO: 174853 - RNA, 58 nt, Homo sapiens
ggggauccgaggaggcugaggguggacaugucugaggaggcucagauuggggucacag

SEQ ID NO: 174854 - RNA, 60 nt, Homo sapiens
ucucuguguggcuuguaagaugcugaagacucagauuuuagagaccaagugcguuucaga

SEQ ID NO: 174855 - RNA, 21 nt, Homo sapiens
aggcuggggcaggggacucag

SEQ ID NO: 174856 - RNA, 59 nt, Homo sapiens
cucuuuggaggccucccagcuaaccauguccucgugaaccaguaucugccuggggaggg

SEQ ID NO: 174857 - RNA, 44 nt, Homo sapiens
caucaugguaaccacacacccucggcccguguccccccacucag

SEQ ID NO: 174858 - RNA, 61 nt, Homo sapiens
cccgcccagccuccucagaaccaguuuugccaaucuccuggcacacagucugcccaaauag

SEQ ID NO: 174859 - RNA, 37 nt, Homo sapiens
acccuguaggaaacccaaggcaccgaggcacagcugg

SEQ ID NO: 174860 - RNA, 28 nt, Homo sapiens
cauagagaguaaaugugggagagggaaa

SEQ ID NO: 174861 - RNA, 2126 nt, Homo sapiens
aaagaccagcugaggcuccggcggacugcuggcagacauggccacuucccgcuuaccccagcaacacuaauguuaaagcaguucaucagaaggcaacaaguucuucuccucuacagaaggauuuuccaaacaauucagcaaguuccaaaugauucugaucgcaaauaccugaaggauugggcaagggaagaauucaaaagaaacaaaagugccaccgaagaggauacaauucggaugaugauuacucaaggcaauaugcagcucaaggaguuagaaaaaacacuugcuuuagcaaaaucuuaacuauagcauuauucugaaggauuuucaaagucuccauguguuuuguugcauuuaggauuaacaauggacaacacaaagcccagucuuacuauuuguauguacaguauuuggugauagagagcaaaggaaaacacaucaaaacaguugccuuaacacugaaaaacauacccugcauuuugaaaauguuuauggauggcucagcaguuuuuaaaagaagcaaaacccacuaacaaauggccaguucgcacaugaaaagcugcuggacacaaucauuagggaaguguaaaucaaaacuacuaugaggccgggcacaauggcucgcguuuguaaucccaguacuuuaggaggccaagguagguggaucauuugagaucaggaguuagagaccagccuggccaacauggugaaaccucaucucuacuaaaaaugcaaaaauuaaccaggugugguggugcaugccuguagccucagcuacucgggaggcugaggcaggagaaucacuugaacccaggaaguggagguugcagugagcugugauugugccuacugcacuccagccuggaugacagagugagacucugucuccaaacaacaacaacaacaacaaacaagcaaacaaaaaacuaugagauaucacuucacauucacuagaauggcuguaauuaaaaagagaaauaauaacaaguguuggugaagaugugcagaaauugcaacccucauacauuguuggugggaauguaaaauggugcagccacuucaggaaacagacugucaguuccucaaacuaaugaaacacagcugccgcgugauuuagcaauucuaccccuaggcccauaaacauuauuuggcagugaaaagaaagaaggacugauauacugauauaugcuaaacauggauaaaccuugaaaacguuaagugaaagaagccagucacaaaagaucacgugaugauuccauucauaugaaguguccagaauaggcagaaagauuagugguugccuaggcuggcuguagguggaauggauuaacuguuaauggguguaggguuucuuuucagggugaugaaaauauccugcaguuagcuugugguguuagguugcaugacucugaauauacucaaauccauugaauuguaucucaauaaagcugaaaaaaaaaaaagaccaaagacagacaagaaaguaauuuauuccaggaaagccuuuuuuuuuuuuuuuuuuuuuuuagacggaguuucgcucuuguugaccaggcuggagugugcaauggugcaaucucggcucaccccaaccucugccucccggguucaaacgauucuccugccucagccucccgaguagcuggaauuacaggcaugcaucacgaugccuggcuaauuuuguauuuuuaguagagaugggguuucuccauauuggucaggcuggucucgaacuccugaccucaggugaucugcccaccucggccucccaaagugcuaggaauauaggugugagccaccacgccaggaccuuuuuuuuuugagauggaaucucgcucuguugcccaggcuggagugcaguggcauaauccuggcugacugcaaccuccgccuccuggguucaagcaauucuccugccucagcuuuccaaguagcugagacuacaggcaggugccaccaugcucagcuaauuuuuguauuuuuaguagagacgggguuucacauguuggccaggcuagucucgaacuccugacuucaggugauccacccuccuccucagccucccaaagugcugugauuacaggcgugagccaccgugcccagcaucggaagaagcccuuugaaua

SEQ ID NO: 174862 - RNA, 42 nt, Homo sapiens
ggccguguacuuccugggccggcuggucccucgggggcgagg

SEQ ID NO: 174863 - RNA, 42 nt, Homo sapiens
ccuccgcagccccucgcccccgagggaccagccggcccagga

SEQ ID NO: 174864 - RNA, 44 nt, Homo sapiens
aaggcgacucggucucagugauacgcuguuuccgggucgcugcu

SEQ ID NO: 174865 - RNA, 67 nt, Homo sapiens
gccccaccccaaaucuucuaauggcuuuggaggagucaggcggcaucuaugugccaguuuuuccgcg

SEQ ID NO: 174866 - RNA, 52 nt, Homo sapiens
gugggguacgguagggggggcagugggauguuagggguccugggggcugugg

SEQ ID NO: 174867 - RNA, 42 nt, Homo sapiens
cacaaggagcccucuugaugauuucugugaaaucgaggcccc

SEQ ID NO: 174868 - RNA, 35 nt, Homo sapiens
gagcaucacucaagcucuuuauuaaacucaauuug

SEQ ID NO: 174869 - RNA, 46 nt, Homo sapiens
uuucccuacuaacaucccaauaaaguccucuucccuaccaggccag

SEQ ID NO: 174870 - RNA, 67 nt, Homo sapiens
cccuuuugugagacggcuggaaauucuuauuuccccuuuccaauuccaaaauuccaucccuaagaau

SEQ ID NO: 174871 - RNA, 110 nt, Homo sapiens
auuuuggaauuggaaaggggaaauaagaauuuccagccgucucacaaaagggugugaaaugaucacuucaagacucccugcugcccuaggcugggaguugggguucuggg

SEQ ID NO: 174872 - RNA, 70 nt, Homo sapiens
acuuaccgcuuccuggaggaacgacccugacccggcccccuucaccccuucagccgagcccagaccuccc

SEQ ID NO: 174873 - RNA, 42 nt, Homo sapiens
gcuccugcgcaggaagaagcccuacggggcuaucagccaugg

SEQ ID NO: 174874 - RNA, 52 nt, Homo sapiens
ugggaaucacagccuggccgcugaccucuggucucuuccccuagguacccgg

SEQ ID NO: 174875 - RNA, 45 nt, Homo sapiens
gugaaugcgucuguuccaagggguuucccuuuccacucaucggag

SEQ ID NO: 174876 - RNA, 45 nt, Homo sapiens
cuucauguccacucacccacaggugcauacccaccuucaagugau

SEQ ID NO: 174877 - RNA, 38 nt, Homo sapiens
ggccauaggagaaggaaauugaagaauaaaguccaagg

SEQ ID NO: 174878 - RNA, 46 nt, Homo sapiens
ccguggaucccgagaaggcacagcagaugcgcuuccaggugcucac

SEQ ID NO: 174879 - RNA, 47 nt, Homo sapiens
agagucugcagaauggacuggaagugcuggggagcgggugggcacag

SEQ ID NO: 174880 - RNA, 31 nt, Homo sapiens
aguggggucuccaugggguaggucagguuaa

SEQ ID NO: 174881 - RNA, 23 nt, Homo sapiens
cuggaugggcagggcacagccag

SEQ ID NO: 174882 - RNA, 46 nt, Homo sapiens
gggccauggcagacaaccaguccaagaaccugccuaaagccgacag

SEQ ID NO: 174883 - RNA, 46 nt, Homo sapiens
cuacgcuccuccagguccaucuuggcccucaggaaccccucgugcu

SEQ ID NO: 174884 - RNA, 44 nt, Homo sapiens
aucagugagcacgagggguuccugagggccaagauggaccugga

SEQ ID NO: 174885 - RNA, 52 nt, Homo sapiens
gaaaagacgagaguaucuuuggauaaaauagaaguagaagggcuaaccugcc

SEQ ID NO: 174886 - RNA, 46 nt, Homo sapiens
cagccaguagaugauuacuucguggagccuccgcaggcugaagagg

SEQ ID NO: 174887 - RNA, 35 nt, Homo sapiens
gcgcgaucuaaggcguggaggcuggggggcguggc

SEQ ID NO: 174888 - RNA, 39 nt, Homo sapiens
cuuccauccaggccccggggucggcccagguggcuggac

SEQ ID NO: 174889 - RNA, 41 nt, Homo sapiens
accaggggcucugaauagaccaguuccuaugcucgagaugg

SEQ ID NO: 174890 - RNA, 86 nt, Homo sapiens
caguggggcggguuggggggggggcgcgcucugcccucucucuaaccgcuauuccuccaucaguugggccaaucaguccgucccaa

SEQ ID NO: 174891 - RNA, 40 nt, Homo sapiens
gucaagaaggugacaugaagauuccccaauuuccagaaga

SEQ ID NO: 174892 - RNA, 47 nt, Homo sapiens
cauuaggagagccuuauuuagaaacccaaacaaugacuuggccauuu

SEQ ID NO: 174893 - RNA, 55 nt, Homo sapiens
cuccagaagaggaggggagagggcccugcgacuugaggaaggguucccggccacu

SEQ ID NO: 174894 - RNA, 66 nt, Homo sapiens
gaggagggagcuggggaaucagugcccuggggggcacgaugacuucggauucgcugacaccggggg

SEQ ID NO: 174895 - RNA, 42 nt, Homo sapiens
guccuuggcgcacucgggacaucuggcugggcggagucagau

SEQ ID NO: 174896 - RNA, 37 nt, Homo sapiens
ucgaaaguuaggguccuuuauugggggaugucagcag

SEQ ID NO: 174897 - RNA, 45 nt, Homo sapiens
cuucugguucuuccgagaggccuuccuugucccagccuacacaga

SEQ ID NO: 174898 - RNA, 46 nt, Homo sapiens
uugucuuugcaccuuuuccaggguuaacugcucuuuuuacuuuaag

SEQ ID NO: 174899 - RNA, 45 nt, Homo sapiens
cuggcugaaugucggcuuguugugaagccgggagcaccggucccc

SEQ ID NO: 174900 - RNA, 46 nt, Homo sapiens
ucucggggaugguggccaguauggaaccucgggggugaccugggaa

SEQ ID NO: 174901 - RNA, 93 nt, Homo sapiens
cuuaacugaggccguggcugcccaccacgaccccucacaccuccugcugccgucgcugccaucuugccccuagccugggggcucccuagcccc

SEQ ID NO: 174902 - RNA, 54 nt, Homo sapiens
cugacaagcgggagaaguucuacgaugggaaggugggcucccaguggcuguggg

SEQ ID NO: 174903 - RNA, 45 nt, Homo sapiens
gaucagccauccacgggcgaggccuguucuguaagcgcaacaucg

SEQ ID NO: 174904 - RNA, 48 nt, Homo sapiens
gggagucacacggcaggaguguugcuuuagagucucccuuggggcagg

SEQ ID NO: 174905 - RNA, 49 nt, Homo sapiens
gcccaagcacuuggccagaguucagcuaaggaucgggagcgggaggugg

SEQ ID NO: 174906 - RNA, 39 nt, Homo sapiens
gccccaucuccaccacccccugaagaccugggcccagac

SEQ ID NO: 174907 - RNA, 45 nt, Homo sapiens
ucccucaagaaugugcaugcugcuguggcccgagggaggcagaug

SEQ ID NO: 174908 - RNA, 46 nt, Homo sapiens
gggaagcaacugcacccaggacccugcggccugcaagcugugaguc

SEQ ID NO: 174909 - RNA, 42 nt, Homo sapiens
gggacgucgaguggucuggagauuacagccucugccccaggu

SEQ ID NO: 174910 - RNA, 42 nt, Homo sapiens
gcugccacugccagaaccugaggagcagagccggccccgcaa

SEQ ID NO: 174911 - RNA, 52 nt, Homo sapiens
aagagccuaggagagagggagccaagucaggugcucagggguuagguggcaa

SEQ ID NO: 174912 - RNA, 46 nt, Homo sapiens
aggcccuguccggucugaagaugagucgguggaagcuaagagagag

SEQ ID NO: 174913 - RNA, 58 nt, Homo sapiens
guucagccuccucaagagagccaaagugcagcuauucaagaucgaucagcagcagcag

SEQ ID NO: 174914 - RNA, 46 nt, Homo sapiens
ggugagugcccgcuccucccgugucaucaagacaccccggcgauuu

SEQ ID NO: 174915 - RNA, 50 nt, Homo sapiens
aguguccccaccaccucuaccauccccuccaccgccuccugcccaagagg

SEQ ID NO: 174916 - RNA, 37 nt, Homo sapiens
cuguagcugaggagaugaugccagcugcggaaaagga

SEQ ID NO: 174917 - RNA, 28 nt, Homo sapiens
agaagaagaagaaaaagacaaggaggga

SEQ ID NO: 174918 - RNA, 49 nt, Homo sapiens
ggucaacaugaggaaaguuggcaggaugucccccaaagaagaguuggau

SEQ ID NO: 174919 - RNA, 45 nt, Homo sapiens
ccucgccuagcagauguggcuccuacccccccaaagaccccugcc

SEQ ID NO: 174920 - RNA, 24 nt, Homo sapiens
gugacugugaggccugcccggcug

SEQ ID NO: 174921 - RNA, 32 nt, Homo sapiens
cucaggugggggcggugcucuggucacuaugc

SEQ ID NO: 174922 - RNA, 42 nt, Homo sapiens
uuggggcuucagguuggggcuuaggaggccccaugucgggag

SEQ ID NO: 174923 - RNA, 46 nt, Homo sapiens
auggacaagguugcccaugagaucaaccaugguauuggacaagcag

SEQ ID NO: 174924 - RNA, 56 nt, Homo sapiens
gaggcagacaaacugauccaucaugggguccaucacggggccaaccaggcgggaag

SEQ ID NO: 174925 - RNA, 46 nt, Homo sapiens
uggccagggaguccaccaugcugcagggcaggccggaaaugaggcu

SEQ ID NO: 174926 - RNA, 46 nt, Homo sapiens
uuggccaggggauccaccaugcugccggucagguugggaaggaggc

SEQ ID NO: 174927 - RNA, 47 nt, Homo sapiens
uuggccaggggguccaccauggucucagugagggcuggaaggagaca

SEQ ID NO: 174928 - RNA, 46 nt, Homo sapiens
ccaugggguccaccaugggguuaaugaggccuggaaggaagcagag

SEQ ID NO: 174929 - RNA, 70 nt, Homo sapiens
guccaaccugggguccacgaggccgggaaggaggcagggcaguuuggccagggaguucaccauacccuug

SEQ ID NO: 174930 - RNA, 63 nt, Homo sapiens
aacaggccgggaaggaagcagacaaagcgguccaaggguuccacacugggguccaccaggcug

SEQ ID NO: 174931 - RNA, 45 nt, Homo sapiens
aggugaacagggauggggagaugggggacagggggguugggggag

SEQ ID NO: 174932 - RNA, 33 nt, Homo sapiens
cguuagccucugggguaagcgcggacucugggg

SEQ ID NO: 174933 - RNA, 41 nt, Homo sapiens
cuagauugggguacaggaagcuggccacguuggaggcguug

SEQ ID NO: 174934 - RNA, 46 nt, Homo sapiens
ccucggauggccaggacguugagcgggaagcccagcgcaaaggcgg

SEQ ID NO: 174935 - RNA, 80 nt, Homo sapiens
agcaggaacagcuggugggagugugcugggcaucuggacacugaggggcaggggcuggaaggaagagugucuugggagcc

SEQ ID NO: 174936 - RNA, 75 nt, Homo sapiens
agccaccucagguguucccagcauuuaugcccccagcaccuaugcccaccugucucccgccaagaccccaccccc

SEQ ID NO: 174937 - RNA, 42 nt, Homo sapiens
ugccagcucaccgugcccagccuccugcauccccucgaagag

SEQ ID NO: 174938 - RNA, 57 nt, Homo sapiens
cugucccgguuaugccggaaucguugcaggugaguccaucagaaacaggagcugaca

SEQ ID NO: 174939 - RNA, 48 nt, Homo sapiens
ugacaccacgacgcucucugagagaccauccccaagcacagacgucca

SEQ ID NO: 174940 - RNA, 44 nt, Homo sapiens
augggccucuagugacagauccagagacacacaagagcaccaaa

SEQ ID NO: 174941 - RNA, 53 nt, Homo sapiens
uucuuuuucucucuccuuuucucuccgugacuccuuguuucuggacuccagau

SEQ ID NO: 174942 - RNA, 33 nt, Homo sapiens
auggacauucaggucccgacacgagccccaggu

SEQ ID NO: 174943 - RNA, 68 nt, Homo sapiens
uaaacugacuuucccaucccacagggaugggcggggagggggacuagaagaaggguucccaggcauug

SEQ ID NO: 174944 - RNA, 66 nt, Homo sapiens
gcuuugcagaugaagcaacugaggcucagagaaaggacuucacuuguuccaggucacacagcaaga

SEQ ID NO: 174945 - RNA, 60 nt, Homo sapiens
cucuuucuacuuuucucucucaucucugccuccacagcccaaccugcaaauccuguaagu

SEQ ID NO: 174946 - RNA, 39 nt, Homo sapiens
cagaggccagaugggcgacaaugguggacagaaccaggg

SEQ ID NO: 174947 - RNA, 39 nt, Homo sapiens
gcaggggggcuccgggaucugagagccuaggagagaggg

SEQ ID NO: 174948 - RNA, 60 nt, Homo sapiens
ucgcugacggggaucgggcugcgggucagggguacuccccgccucacccgcggcgcccuc

SEQ ID NO: 174949 - RNA, 45 nt, Homo sapiens
aggccugggagggguuggggcggggcggggccagggaggggcggg

SEQ ID NO: 174950 - RNA, 70 nt, Homo sapiens
gaaguaagauaauuaagggggagcagauaugggaggaggaaagugggguaccagggagaggaaaggggug

SEQ ID NO: 174951 - RNA, 51 nt, Homo sapiens
auagagggaaggagaaugacagagauaucaauacugggacucugggggagg

SEQ ID NO: 174952 - RNA, 36 nt, Homo sapiens
gaugggaucacacaacaacacaacguagcagggacg

SEQ ID NO: 174953 - RNA, 46 nt, Homo sapiens
acggggacgggccccagcacccagauccugaccccugugcccgggc

SEQ ID NO: 174954 - RNA, 46 nt, Homo sapiens
ugacgcagggcauccccuaccaggacuacuucuacacugcccaccg

SEQ ID NO: 174955 - RNA, 53 nt, Homo sapiens
gccaccagcgccgggugcugacguacaccauccccaucagcaacccacugggc

SEQ ID NO: 174956 - RNA, 45 nt, Homo sapiens
gggccccuuggaucugcugcccagugaggagcuauugacagacac

SEQ ID NO: 174957 - RNA, 91 nt, Homo sapiens
gagcagguagacagccagccagacgccuccuccagccagacagugaccccgguggcugaacccccgagcacagagcccacccagccugacg

SEQ ID NO: 174958 - RNA, 62 nt, Homo sapiens
agggaggggaagacggacaugugacagggaaagagagacagggaagagaggggacagacaga

SEQ ID NO: 174959 - RNA, 44 nt, Homo sapiens
gcgccguggccaugucacgcccaaccuuucccgagccagcagcg

SEQ ID NO: 174960 - RNA, 46 nt, Homo sapiens
gugcaucagugcuacggcucagagcugggccucaccagugaggaug

SEQ ID NO: 174961 - RNA, 49 nt, Homo sapiens
gaaaagacggccaagcugauccccaacgccauccagaucugcacggaga

SEQ ID NO: 174962 - RNA, 46 nt, Homo sapiens
gcuccucagagaaggguggggugccugggacccccagcacccagag

SEQ ID NO: 174963 - RNA, 23 nt, Homo sapiens
cugcccccaagccggcccccacc

SEQ ID NO: 174964 - RNA, 30 nt, Homo sapiens
gauggcuggguggauggguguguauucggg

SEQ ID NO: 174965 - RNA, 45 nt, Homo sapiens
uacgaucuggacagacagaauggcauauguuaaggcuuggaggua

SEQ ID NO: 174966 - RNA, 96 nt, Homo sapiens
ucugugugcacacaugcaugugucuggauaacuuuucugggaaauugccaugugacuguagcagacuagcaaugcugcaggugugugugugugugu

SEQ ID NO: 174967 - RNA, 48 nt, Homo sapiens
ccugauuuaccugggacuauguaugugucaccuggggucuuuugggac

SEQ ID NO: 174968 - RNA, 42 nt, Homo sapiens
uccugggaccaggaacccgggcucagagacugggagagggaa

SEQ ID NO: 174969 - RNA, 21 nt, Homo sapiens
gagagguagggcacggcgaua

SEQ ID NO: 174970 - RNA, 42 nt, Homo sapiens
ugcucaguguagcccaggaugcccuugagggggcccuccgau

SEQ ID NO: 174971 - RNA, 40 nt, Homo sapiens
gaaggggucauugauggcaacaauauccacuuuaccagag

SEQ ID NO: 174972 - RNA, 43 nt, Homo sapiens
ggucuuacuccuuggaggccaugugggccaugagguccaccau

SEQ ID NO: 174973 - RNA, 44 nt, Homo sapiens
uauaauacaaaauucuuccaugggagucugaugauuugggggcc

SEQ ID NO: 174974 - RNA, 46 nt, Homo sapiens
cauaagcugaaacucaaauauccuuuggccuccacacuggcugcag

SEQ ID NO: 174975 - RNA, 48 nt, Homo sapiens
cauccucaucugcaacacagauguaguagggcaggaagagcggcagcc

SEQ ID NO: 174976 - RNA, 45 nt, Homo sapiens
uuuggcacugcuggcaucauucccaaaauccaagguaaacugugg

SEQ ID NO: 174977 - RNA, 40 nt, Homo sapiens
auugcaggaacugaaaagaaagaacuaccuuucccagacc

SEQ ID NO: 174978 - RNA, 46 nt, Homo sapiens
accugagcguccugcgccucucucucuggcaccugcaggcacuggg

SEQ ID NO: 174979 - RNA, 49 nt, Homo sapiens
ccauugguagaagcgucgugagaggucacuugagcacugccaucaagcu

SEQ ID NO: 174980 - RNA, 45 nt, Homo sapiens
cuggaccgggaugaggaagucacaggguaucaucuuggugccugu

SEQ ID NO: 174981 - RNA, 36 nt, Homo sapiens
ggugguccacacggguuccagauuuggugauguauu

SEQ ID NO: 174982 - RNA, 45 nt, Homo sapiens
aaguacgcagcaaagcggugcagguacuggucauagggcagcaug

SEQ ID NO: 174983 - RNA, 45 nt, Homo sapiens
cagcagggccagcaagacgggggcguucuucuccaggggcgucgu

SEQ ID NO: 174984 - RNA, 46 nt, Homo sapiens
gccucauaccugugccagggcccaccuccucagacacggacacacc

SEQ ID NO: 174985 - RNA, 45 nt, Homo sapiens
aggccucauaccugcacacagcuucaacucuuuagacauggucag

SEQ ID NO: 174986 - RNA, 398 nt, Homo sapiens
uccucauaccagggccagauccaaccacuucagacacugacagacucaggucuucauaccuguaucagaugcuaccuccucagacauagacccagauccuaauaccuguaucagauccuacuuccucagauacagagacaugaagauccucacaccuguaccagauuccuaauuccucagacacugacacacacacagauccucauaccuguaccagauuccuaccucuucagauauugacagacucagauccucauaagggggccagauccaaccuccucagaaauugacagacugagaucuucuuacuagggccagauccuaccuccucagaaacugacagaugcagauccucuuaccagugccagauccuaccuccucagacauuaacagaccca

SEQ ID NO: 174987 - RNA, 47 nt, Homo sapiens
cagauccucauacuuguacccagccucacuuccccagacacuagaag

SEQ ID NO: 174988 - RNA, 46 nt, Homo sapiens
gcacaaugccaucuuggaugcagaccaacaccauggacugguuaca

SEQ ID NO: 174989 - RNA, 43 nt, Homo sapiens
cggccauggcgggacuagaagguacacugagugagacgcgagc

SEQ ID NO: 174990 - RNA, 55 nt, Homo sapiens
uuccucgccacccagcagcacccugggacugcggccuuucccagcuuuauugaag

SEQ ID NO: 174991 - RNA, 45 nt, Homo sapiens
ucugaaacgauggcaucagagcccuggagagccagcuggagacac

SEQ ID NO: 174992 - RNA, 47 nt, Homo sapiens
ugaguguccccaccccagggccacuuagcugacaccagccccucaga

SEQ ID NO: 174993 - RNA, 44 nt, Homo sapiens
ugugagaagagaggcuccuugccugugugcauucuuuucaggca

SEQ ID NO: 174994 - RNA, 46 nt, Homo sapiens
cucgggcuuuaacaugggccagucacaucagggcucuccguuggug

SEQ ID NO: 174995 - RNA, 46 nt, Homo sapiens
aggcaguaaggacuuuuuaguaacuuuuauuuucagaauaauuuaa

SEQ ID NO: 174996 - RNA, 46 nt, Homo sapiens
guggacgugcucuacacagcugugcuggaccuaaaccgcuggaggg

SEQ ID NO: 174997 - RNA, 363 nt, Homo sapiens
caaauagauuaagaaaauguaauggccaagugcggugacucacaccuguaauccuagcacuuugggaggccaaggcgggcagaucgccugaggucagaaguuugagaccagccugcccaauguggugaaaccccaucucuacuaaaaauacaaaaacuauccaggcaugguggugggugccuguaauuccagcuaaucaggaagcugaggcacaagaauugcuugaacccaggaggcggagguugcagagagcugagauugcacuauugcacuccagccugggcaauagagcaaaacuaucucaaaaaaaaaaaaaaagaaaaaagaaaauguauaacuucaccuaaaaaucagagacaaagu

SEQ ID NO: 174998 - RNA, 46 nt, Homo sapiens
uuggaucauaaugagcaguauuaucuuuguuacugagucuacagca

SEQ ID NO: 174999 - RNA, 53 nt, Homo sapiens
gacacagcacagauugagaauaaagaagccuaugccccccagaucaguuuaga

SEQ ID NO: 175000 - RNA, 36 nt, Homo sapiens
acacauuucugugugacuuuagguuaugguucuggg

SEQ ID NO: 175001 - RNA, 33 nt, Homo sapiens
ugaguagccagguaggaggcaaggugagguaca

SEQ ID NO: 175002 - RNA, 42 nt, Homo sapiens
augcuaauggaacuuagugcuggggcugcaaauuuuacggau

SEQ ID NO: 175003 - RNA, 42 nt, Homo sapiens
ucugaccgcugcaggcagcugccaccaugccaugccccacac

SEQ ID NO: 175004 - RNA, 47 nt, Homo sapiens
aauucccccucccgcauguauugcugcagugcccaggacaguaaaau

SEQ ID NO: 175005 - RNA, 46 nt, Homo sapiens
ccugccucauggaaaugccuuuuuuaaaacuucgauuugcagaacu

SEQ ID NO: 175006 - RNA, 50 nt, Homo sapiens
uuuuaguagaacuaggaaauacauacuuuuuggaaagaaaaagauacacc

SEQ ID NO: 175007 - RNA, 44 nt, Homo sapiens
aaagguuggcagaaaggaauaaaaaugaaacuggaggaccaagc

SEQ ID NO: 175008 - RNA, 69 nt, Homo sapiens
ggcacuagaagaacuggaagauaaauggugugacugcagaaugaugagugagacucaggaggcacgaca

SEQ ID NO: 175009 - RNA, 46 nt, Homo sapiens
aacacuuguuuugagagcuaaaggaugaacgggaggagcaucauga

SEQ ID NO: 175010 - RNA, 47 nt, Homo sapiens
ugccaggugguaaaguguacauaugcaaauaaaaugguaagaugauu

SEQ ID NO: 175011 - RNA, 64 nt, Homo sapiens
guugcucuuagaaacagagagggcauagcacuuaaggucuaucagaggaggaguagcucaaagg

SEQ ID NO: 175012 - RNA, 54 nt, Homo sapiens
aaggauagggagguggauucugguuacucucuagagggccuugacuggcagcuu

SEQ ID NO: 175013 - RNA, 60 nt, Homo sapiens
uggaaugucguggcccuguggccucugcagcuugagggaagguuaaguugaagggacagg

SEQ ID NO: 175014 - RNA, 46 nt, Homo sapiens
uguuuguagcuggaaagcuuaaacuuaauuuuguauccucagaaga

SEQ ID NO: 175015 - RNA, 44 nt, Homo sapiens
aaaaguucuaaguguauguuuguaagggcuacuuacaaaguuca

SEQ ID NO: 175016 - RNA, 54 nt, Homo sapiens
acacaaaaagucuuaagguagaaaaugacagucaucugccagucuaccauucag

SEQ ID NO: 175017 - RNA, 56 nt, Homo sapiens
caucuauuucaaagacagcugguggcuguuggaugaaaacaguuucagacgcuuac

SEQ ID NO: 175018 - RNA, 37 nt, Homo sapiens
gacauucucgaaaugccaucgaugccguggagcagau

SEQ ID NO: 175019 - RNA, 40 nt, Homo sapiens
agcuugaguucaucgcggaugcguugacuacacagcaccc

SEQ ID NO: 175020 - RNA, 48 nt, Homo sapiens
cgccggggcccggagaagggaggcgagaggccucccggagcucgacgg

SEQ ID NO: 175021 - RNA, 42 nt, Homo sapiens; identical to SEQ ID NO: 99671

SEQ ID NO: 175022 - RNA, 52 nt, Homo sapiens
ugcccccgcucauggcgccgccgccgccgcucccagcugcucgcagagaggc

SEQ ID NO: 175023 - RNA, 38 nt, Homo sapiens
cgagcgggcgugcggagcgggcgacaguggcgugggau

SEQ ID NO: 175024 - RNA, 44 nt, Homo sapiens
gaugagacccagacacaggcagaccuggcgcucuugaccccuga

SEQ ID NO: 175025 - RNA, 39 nt, Homo sapiens
cuagguccccagcucagggagccauccccagcuccaguu

SEQ ID NO: 175026 - RNA, 45 nt, Homo sapiens
cagcccauggugcgcgagcuggagcgcuggcagcaggagcaggag

SEQ ID NO: 175027 - RNA, 46 nt, Homo sapiens
cuguacaaugggugcaaccggcccaguccacacaauacccugcgag

SEQ ID NO: 175028 - RNA, 72 nt, Homo sapiens
gcagaggcccaggauagagcccugaggagcccuugcauggggcaggagaggcaggaugggccacugacccau

SEQ ID NO: 175029 - RNA, 42 nt, Homo sapiens
uggaaagaaggugucaagccuggagcuuuauggacugggagg

SEQ ID NO: 175030 - RNA, 41 nt, Homo sapiens
gggcggguuugaaagaaaugauguucaucuggguggugaag

SEQ ID NO: 175031 - RNA, 26 nt, Homo sapiens
gccagugucuguggaugugugaaggg

SEQ ID NO: 175032 - RNA, 46 nt, Homo sapiens
uguaucucucacugcacccacuuuugugcuucugacuuaagcagug

SEQ ID NO: 175033 - RNA, 42 nt, Homo sapiens
cuucgggugccgcggccaccccgccccgcggcgccuccagcc

SEQ ID NO: 175034 - RNA, 46 nt, Homo sapiens
uuuauaauacauaauuuagaagaaaaucacaaauagauuaccauag

SEQ ID NO: 175035 - RNA, 44 nt, Homo sapiens
ucuuuuugcucugcuugcugggagccacagcuuugccuccuccc

SEQ ID NO: 175036 - RNA, 42 nt, Homo sapiens
ccccaggcggccuccacuccgagcggccccgcgcggugcggc

SEQ ID NO: 175037 - RNA, 24 nt, Homo sapiens
caaggcggccgugggccccacggg

SEQ ID NO: 175038 - RNA, 45 nt, Homo sapiens
gaggaggggagaauucuuggggcugagcugggagcccggcaacuc

SEQ ID NO: 175039 - RNA, 45 nt, Homo sapiens
acaaggcacugcuggggcacagaggccagauacaaguguugauau

SEQ ID NO: 175040 - RNA, 46 nt, Homo sapiens
ccccgccaggaggccuuccgccucuguggcuccgccaucccaccug

SEQ ID NO: 175041 - RNA, 58 nt, Homo sapiens
ucuacagcccggccuggccccucaacuacccgccaggcaccaacugcagcugguacau

SEQ ID NO: 175042 - RNA, 71 nt, Homo sapiens
uuucccugggauuccugcugugugggacccuggauugggaaacauucccccagccccuucuccacccuaac

SEQ ID NO: 175043 - RNA, 48 nt, Homo sapiens
guggcuuuauaccaccggcaagcugccgagggucccguggaauugaca

SEQ ID NO: 175044 - RNA, 53 nt, Homo sapiens
uggcuuuggacaggcuucaacuugucugagccucaguuuccucaucuguaaag

SEQ ID NO: 175045 - RNA, 46 nt, Homo sapiens
gacucagcagugcgguuccugccuuagguaaguaagcacuuucucu

SEQ ID NO: 175046 - RNA, 41 nt, Homo sapiens
uuuucuuacuacagaguucuuaggauaaacguguuuauacu

SEQ ID NO: 175047 - RNA, 45 nt, Homo sapiens
aaaguuugcaagucuucucacuucguagaacuguggggguggcaa

SEQ ID NO: 175048 - RNA, 42 nt, Homo sapiens
ucugagucuguuccgucuugugguugaaaauggacugcccag

SEQ ID NO: 175049 - RNA, 43 nt, Homo sapiens
ggagcaagggacgggucuucgcugaggauuuagagcaugcagg

SEQ ID NO: 175050 - RNA, 45 nt, Homo sapiens
uuguuguguugcugguggacaggcgugagugaaauccagggggca

SEQ ID NO: 175051 - RNA, 45 nt, Homo sapiens
gcaccuggggaucugacauuggauagacuuacauucccaaguuac

SEQ ID NO: 175052 - RNA, 46 nt, Homo sapiens
auuugcucugacccaucugaaguccauauggcucuguaugaugaag

SEQ ID NO: 175053 - RNA, 45 nt, Homo sapiens
gcucugcaaaagugccgcccugacuugugcagcaaaguggcccaa

SEQ ID NO: 175054 - RNA, 46 nt, Homo sapiens
gucugugagugagcagcgaggggcccccaugagccgcucccuccag

SEQ ID NO: 175055 - RNA, 42 nt, Homo sapiens
ccagucuacuugucaguuugaguccuacauuuugauaccugu

SEQ ID NO: 175056 - RNA, 37 nt, Homo sapiens
aggugccaagcaucucucucugaucccgugauggggu

SEQ ID NO: 175057 - RNA, 46 nt, Homo sapiens
ucuucucucagugcccauucucuuugaagaaacuuucuacaaugaa

SEQ ID NO: 175058 - RNA, 49 nt, Homo sapiens
ccuuuggcacccucagaucccuuuucccugaaaaccauugaagauguga

SEQ ID NO: 175059 - RNA, 55 nt, Homo sapiens
gcauuggcuggggucggcgaggggaugugauuauauuucuaugugaaucgugaga

SEQ ID NO: 175060 - RNA, 41 nt, Homo sapiens
gaugggagcaaaugaccucccccugcuaagacuggaggccg

SEQ ID NO: 175061 - RNA, 46 nt, Homo sapiens
ugcagugugugaaggcucugguuuacuacgacguggagucgugcag

SEQ ID NO: 175062 - RNA, 41 nt, Homo sapiens
uccuccacuuccagcuucuccuccaugucagccagcucaag

SEQ ID NO: 175063 - RNA, 48 nt, Homo sapiens
aaugcauauuugguaaugguguuguuauauuuuccugacaaguaauga

SEQ ID NO: 175064 - RNA, 42 nt, Homo sapiens
uuaggggaaagacuucaagggagauuauggcaagagauagaa

SEQ ID NO: 175065 - RNA, 50 nt, Homo sapiens
ccuauugcgugacaggugcuagaaauuuauagugggauuucaggcaauua

SEQ ID NO: 175066 - RNA, 57 nt, Homo sapiens
agcagguccccuaacaauggucuugucuauuugugcuaaacuauuaauuaucaguaa

SEQ ID NO: 175067 - RNA, 25 nt, Homo sapiens
aauagcuacuguacauggucacagu

SEQ ID NO: 175068 - RNA, 46 nt, Homo sapiens
uaugcaacugaaacuccugaauuauaucuuuucuguaucccuuaau

SEQ ID NO: 175069 - RNA, 46 nt, Homo sapiens
uuuacuucaauacaacugcaaggagaaaugcuuaaaucauuuccac

SEQ ID NO: 175070 - RNA, 23 nt, Homo sapiens
aaaaauacaaaggcuaaaaacac

SEQ ID NO: 175071 - RNA, 47 nt, Homo sapiens
gaaggacccuaaccaaccacccgcacuaugaagacagcagccugaga

SEQ ID NO: 175072 - RNA, 31 nt, Homo sapiens
uucacguuuucauugaaacccucuuauuccu

SEQ ID NO: 175073 - RNA, 45 nt, Homo sapiens
acaucaaauauguuuguuuaaaucaacacucaaauccacacuggc

SEQ ID NO: 175074 - RNA, 56 nt, Homo sapiens
agguaugguauauuucagaaaucuaaugcucuccuuuaaugaacuuguuccauguu

SEQ ID NO: 175075 - RNA, 44 nt, Homo sapiens
gggcauuuucaucuuaccaucuuguagaugugugggugagauug

SEQ ID NO: 175076 - RNA, 53 nt, Homo sapiens
gggaggagcagagcuggaggaucaguaaguucugacaccagcuauccaccguu

SEQ ID NO: 175077 - RNA, 35 nt, Homo sapiens
ucacuggguuaaggaaguucuaguuuuaccuagua

SEQ ID NO: 175078 - RNA, 48 nt, Homo sapiens
ucucugugugagcagauagcccaaauugaaugcuaacaaccguauagc

SEQ ID NO: 175079 - RNA, 45 nt, Homo sapiens
agugggguggggccagacauaagggugugacucccuuugggaggg

SEQ ID NO: 175080 - RNA, 63 nt, Homo sapiens
gaugaaauugaguccccaaggaaauccgggcagagcaaugacaucaugucucuguggggaagg

SEQ ID NO: 175081 - RNA, 43 nt, Homo sapiens
uguuucccaaaacauaaucccagugaaacugcaaaaacuaagg

SEQ ID NO: 175082 - RNA, 51 nt, Homo sapiens
uacagauauguccuugauucauauguaugcuacauguaucacacaacagau

SEQ ID NO: 175083 - RNA, 58 nt, Homo sapiens
uuggcuagcaggcagcaaggccaucauaggauagcucauucaucaacugauguacaaa

SEQ ID NO: 175084 - RNA, 44 nt, Homo sapiens
uugugauugugacuauuuuagauauaagauuguaauaaaaauuu

SEQ ID NO: 175085 - RNA, 75 nt, Homo sapiens
cccucacugaaaagugaaguguucugaggaguuaacuuaggaucugauaggcugaccggcuguagcuucccaguc

SEQ ID NO: 175086 - RNA, 73 nt, Homo sapiens
uagguccgaauaaauacuggaaagaauaccacuuuaaaauucagugaaaagaaagaagaagccaaacguaaac

SEQ ID NO: 175087 - RNA, 45 nt, Homo sapiens
uucucuacaauaauaaagacacugaagacuaggauuuguuaauaa

SEQ ID NO: 175088 - RNA, 57 nt, Homo sapiens
uccaguucuuaccacagugaugaugaugaugaugaugaugaugacgacgacgacgac

SEQ ID NO: 175089 - RNA, 25 nt, Homo sapiens
gugauugcaaauggagaagauacga

SEQ ID NO: 175090 - RNA, 34 nt, Homo sapiens
uucuugcuuuccuuuuauaaacuuuggagcaggu

SEQ ID NO: 175091 - RNA, 45 nt, Homo sapiens
guacauguacuuaaauacuuaagaucaacaucuucauuuuuuauu

SEQ ID NO: 175092 - RNA, 46 nt, Homo sapiens
caggaagaauugcugggugaacuugauagguacuugaugacaaauu

SEQ ID NO: 175093 - RNA, 48 nt, Homo sapiens
ucauaaaccgcauuccaaaccaaaaacuucagauauuuuugaagcaga

SEQ ID NO: 175094 - RNA, 88 nt, Homo sapiens
aaggcuguaagagacauucauccuuggaguucuguuuggcuuaaaaauugugaccccucuguuucaauauuucccuugccccaaaaga

SEQ ID NO: 175095 - RNA, 46 nt, Homo sapiens
uuuuuuuuguuuaaaaaccaggcugcaggugauauuguugacauac

SEQ ID NO: 175096 - RNA, 46 nt, Homo sapiens
aguuccauuuuuaaauucaagaaagcuuucugaaucauacauuaau

SEQ ID NO: 175097 - RNA, 34 nt, Homo sapiens
ccugguucucagaacacuagaugaagaagaucag

SEQ ID NO: 175098 - RNA, 73 nt, Homo sapiens
gaacaaaaaaaaagugcuuccagaaaugaaacuauguacaggaaaauuuuaaagucaauacaugauuuaaaag

SEQ ID NO: 175099 - RNA, 55 nt, Homo sapiens
uucagaaguuacaaaguuucaaagucauuaugugauuuuguaguuagaaguuggg

SEQ ID NO: 175100 - RNA, 47 nt, Homo sapiens
uacugagguuaagucuggggucuuuauuuauaacaaaauuugaacag

SEQ ID NO: 175101 - RNA, 56 nt, Homo sapiens
gacuccuguguccaaaaauuaauuacguuucuaauuauuaaaauagaaaaaaaaau

SEQ ID NO: 175102 - RNA, 64 nt, Homo sapiens
cuucaucgcugcugccuauuuuuuuuuuuuaauuuccuuaaaacaaaagguacucucaaaaggc

SEQ ID NO: 175103 - RNA, 69 nt, Homo sapiens
ugagggauaugcucaaguauuuaggggugaaauacacagauguccacaacuuaauuugaaauucaucag

SEQ ID NO: 175104 - RNA, 367 nt, Homo sapiens
agagugauagaagauuuuuuuucuuaaaaaaaaaaaaaaaaaaaaaaaaaaacugggccaggcaugguggcucacaccuguaaucccagcacucugggaggccgaagcggguagaucacaaggucaggguucgagaccagccugaccaacauggugaaaccccgucucuacuaaaaauacaaaaauuagccgggugcgguggcgcgugccuauaaucucagcuacucaggaggcugaggcaggagaaucgcuugaaccugggagguggagguugcagugagccgagaucacgccacggcacuccaggcugggugaaagagugagacuccaucuccaaaaaaaaaaaaaaaaaaaaaaguucaauguu

SEQ ID NO: 175105 - RNA, 56 nt, Homo sapiens
aucguuucuuaaauuaaaaaauaaaaauuuaacucugucccagguuaacucagaug

SEQ ID NO: 175106 - RNA, 42 nt, Homo sapiens
aaggaacacuccucauggaaaauuuaaauguacuugaauuaa

SEQ ID NO: 175107 - RNA, 45 nt, Homo sapiens
uaaaaaaggaauauaccaccauucugccugaauuuugugguacau

SEQ ID NO: 175108 - RNA, 20 nt, Homo sapiens
gcauaaagcagguaucucca

SEQ ID NO: 175109 - RNA, 43 nt, Homo sapiens
cuuuggugaacgaagaaauuuauaauauuuguuuaguuaauaa

SEQ ID NO: 175110 - RNA, 44 nt, Homo sapiens
aaguacuauauuacuucaagauauguguaggcaaauaugcuaag

SEQ ID NO: 175111 - RNA, 52 nt, Homo sapiens
uagaaaaauaaugggaaucaguuacuuuaaaauaaugauggaaauagggcac

SEQ ID NO: 175112 - RNA, 43 nt, Homo sapiens
acugaugggguaaccuacuuguguucaaauaauguguuuacug

SEQ ID NO: 175113 - RNA, 46 nt, Homo sapiens
gaauaaaaauuacaggugaaaauguuuggagauauacugacaaaau

SEQ ID NO: 175114 - RNA, 65 nt, Homo sapiens
cuguuauuaaguguugcuaugugauugauacuuacugagagaucuucauucuaaaauggacuuuu

SEQ ID NO: 175115 - RNA, 88 nt, Homo sapiens
cauuuaauucuauuugucuauuuuguaauuacugccaaaucagaaacagugaaauggauugauguaguuuuagcuuggcucuuccaga

SEQ ID NO: 175116 - RNA, 41 nt, Homo sapiens
gaaguaaaaggaacagggcaagaauggccggaacgaagugg

SEQ ID NO: 175117 - RNA, 48 nt, Homo sapiens
uuuguuucuuuugcuguguuuuucaaguguugcuuguagaacaaggcu

SEQ ID NO: 175118 - RNA, 33 nt, Homo sapiens
gacucagcagcuuuaaaaccaaaauaguaagau

SEQ ID NO: 175119 - RNA, 58 nt, Homo sapiens
uuaccuuuauguuuuagccagauuccuccuacacaggcuucuaagcauuuuuuccugu

SEQ ID NO: 175120 - RNA, 50 nt, Homo sapiens
cuuaggaaauuaugaaauaauuuacuguaagaagucaggagggagucaag

SEQ ID NO: 175121 - RNA, 54 nt, Homo sapiens
gaguauauuuuccuguuuuuuuuuuuuuuucuucuacuuguauuuacucuucag

SEQ ID NO: 175122 - RNA, 47 nt, Homo sapiens
ugccuucaagucuccuuuguuggauauuaguauuaguauggucacac

SEQ ID NO: 175123 - RNA, 43 nt, Homo sapiens
aaggcaaaauaagcugccuuuuguauaagaaagcaguauggag

SEQ ID NO: 175124 - RNA, 361 nt, Homo sapiens
gaaggacaggucaaaagugaauguaaaugguuaucuaggccggcuguggugguucacaccuguaauccuagcacuuugggaggcugaggcgggcagaucaccugaggucaggaguuugaaaccacccuggcgaacauggucaaacuccauuucuacuaaaaauauuuuuuaaauuagccgggcaugguggugggcgccuguaauuccaguuacuugggaggcugaggcaggagaauugcuugaaccugggauguggagguugcagugagccgagauugcgccacugcacuccagccugggcaacaagagugaaacucugucucaaaaaaaaaaaaaaaaaaaaguuuaucuguagggguaa

SEQ ID NO: 175125 - RNA, 49 nt, Homo sapiens
uuuuuaagaaaggcacaguuguaagaauauguuugcuuguauagccgaa

SEQ ID NO: 175126 - RNA, 43 nt, Homo sapiens
ugggcaucaggggucaacuuuuaaacauuuaccauuaagugug

SEQ ID NO: 175127 - RNA, 105 nt, Homo sapiens
ucuuauauugucuaauagaagcuuuacugcuuugcuuuucacauugagaaucuacauucuaccuggaauuggcuuuguauaugggggagauugaggucagguuuc

SEQ ID NO: 175128 - RNA, 37 nt, Homo sapiens
guuauaccaguuuaccgcuugcuagcaguggacagaa

SEQ ID NO: 175129 - RNA, 39 nt, Homo sapiens
uggaauuacauuauagggagcaacucugugugccacgca

SEQ ID NO: 175130 - RNA, 78 nt, Homo sapiens
ccauuugagcagaaacuugaaauaaguggggagugagcuguguggauauauggaggauauuuuagagaagagcuuucu

SEQ ID NO: 175131 - RNA, 70 nt, Homo sapiens
agguaagaggcguguagagaaugagggaugugaguggagggauggugucuucuguaagccaucagagagg

SEQ ID NO: 175132 - RNA, 58 nt, Homo sapiens
agugugcaguaaugaacaaaauacagcaaguucuuucuuucaugguuacacucuaggg

SEQ ID NO: 175133 - RNA, 63 nt, Homo sapiens
acugucagccacguaggccauauaacagcuauucuuuccaagccuagaauccaugccauagaa

SEQ ID NO: 175134 - RNA, 43 nt, Homo sapiens
auacuuccugauauagauccuuggggaauuaaaugcauuaaga

SEQ ID NO: 175135 - RNA, 49 nt, Homo sapiens
cuuuauaaacaaagcugcagggaauguuucuuacauguuuuauugcuag

SEQ ID NO: 175136 - RNA, 47 nt, Homo sapiens
ggcuuguucaugccccuugucuguccucuuccucagguugccaauuu

SEQ ID NO: 175137 - RNA, 28 nt, Homo sapiens
aacuuuuuaauugaacauuccuguauaa

SEQ ID NO: 175138 - RNA, 23 nt, Homo sapiens
gcagcggagugaggggugugcag

SEQ ID NO: 175139 - RNA, 35 nt, Homo sapiens
gggccuaggccacgcggggcggcggcccagagcac

SEQ ID NO: 175140 - RNA, 41 nt, Homo sapiens
gccgcgcugaggcccgcgggcccgucauggaggcgcccacc

SEQ ID NO: 175141 - RNA, 23 nt, Homo sapiens
ucauguugaauuuaaagccaaaa

SEQ ID NO: 175142 - RNA, 43 nt, Homo sapiens
ucugcagaaaaggcacccugguguucuaauuccugggcaugga

SEQ ID NO: 175143 - RNA, 44 nt, Homo sapiens
aaaugucguggugucccuugcaaugcccuauuucaggucugcag

SEQ ID NO: 175144 - RNA, 47 nt, Homo sapiens
uuggguggacucuugacugaaacacagaacuuuaagagaaaugcaga

SEQ ID NO: 175145 - RNA, 58 nt, Homo sapiens
uccauagagggguucuuccguuccuggggauuaaaagccccaaaugccccuguaucau

SEQ ID NO: 175146 - RNA, 50 nt, Homo sapiens
caggucagcauccucagggcucgcgugggugacggcccgucucguagcgg

SEQ ID NO: 175147 - RNA, 41 nt, Homo sapiens
gugcagggugcggcuaagugggauguuagccuuguccagga

SEQ ID NO: 175148 - RNA, 40 nt, Homo sapiens
augugggaaaauggcuuuuuagaaaaacauuuauuguaau

SEQ ID NO: 175149 - RNA, 50 nt, Homo sapiens
ggcugaaauuggcugagcugguguggcaggaccugucaaagauguguugg

SEQ ID NO: 175150 - RNA, 46 nt, Homo sapiens
gagaaacaugucgagcuugagguugguccagggucagaaagggcaa

SEQ ID NO: 175151 - RNA, 53 nt, Homo sapiens
auagauggccauuacaguguuccacuuucccacuuauaagguguucuuauaua

SEQ ID NO: 175152 - RNA, 45 nt, Homo sapiens
guauugguaucugaaguuuuauaauacugggcugucauagacaug

SEQ ID NO: 175153 - RNA, 44 nt, Homo sapiens
auuugcaguuccagguaaagacguauuuuggaaauauucuguag

SEQ ID NO: 175154 - RNA, 45 nt, Homo sapiens
ggcugggguagggaggcugacugagcaggagucgucugcuuguag

SEQ ID NO: 175155 - RNA, 43 nt, Homo sapiens
cucagagccggggccccgggcccgugacagacgggccgaggaa

SEQ ID NO: 175156 - RNA, 37 nt, Homo sapiens
acaccaugucaucucccaguccgggcaagaggcggau

SEQ ID NO: 175157 - RNA, 45 nt, Homo sapiens
gaggaggcgcugaaagaacaggaagaggguaccggggacagcuca

SEQ ID NO: 175158 - RNA, 47 nt, Homo sapiens
cucuuggaugugaagauaaaauagugcuuuuuugaaauggagaggaa

SEQ ID NO: 175159 - RNA, 45 nt, Homo sapiens
uuuuuaguuuagaagugcuguauuccacaagguuuaagucaguga

SEQ ID NO: 175160 - RNA, 98 nt, Homo sapiens
ugguucuggaaaagcggggaaagggggugcagccucugggagugacagugcugacaagaaggcucaaggucccaaaggugguggcaaugcaguaaagg

SEQ ID NO: 175161 - RNA, 50 nt, Homo sapiens
ugggaugagauucaaugaaguggccacacaauauagugaagauaaagcca

SEQ ID NO: 175162 - RNA, 50 nt, Homo sapiens
ccuugccuauaagugugauggauaagccuguguuuacagacccagcaguu

SEQ ID NO: 175163 - RNA, 43 nt, Homo sapiens
ugcccauguuggaaagguauccgauugcugcacugguguguag

SEQ ID NO: 175164 - RNA, 43 nt, Homo sapiens
aguaacccaucaccugagcuuggggacauuucaauaacuccag

SEQ ID NO: 175165 - RNA, 44 nt, Homo sapiens
gugaagugaaaaaggcccuuucuaaacaagagaugcagucugcu

SEQ ID NO: 175166 - RNA, 45 nt, Homo sapiens
cuugaaaaagugguuguugagggcaaugacagccccagcauugaa

SEQ ID NO: 175167 - RNA, 45 nt, Homo sapiens
gaggcagggaugauguucuggagagccccguggccaucacgccac

SEQ ID NO: 175168 - RNA, 42 nt, Homo sapiens
agaucccuccaaaaucaaguggggcgaugcuggcgcugagua

SEQ ID NO: 175169 - RNA, 57 nt, Homo sapiens
guuucucagcccgagcugacagaucaggagacagauuccacuuggauuagggagaau

SEQ ID NO: 175170 - RNA, 44 nt, Homo sapiens
aaugugguaaagcuuuuaagugguccucaaaacuuacuguacau

SEQ ID NO: 175171 - RNA, 45 nt, Homo sapiens
ccugcuuuagaugcuucuugggaccacgagccauggcuacguuag

SEQ ID NO: 175172 - RNA, 46 nt, Homo sapiens
gugggaaggccuucaacggcaggucaaauuuccauaaacaucaaau

SEQ ID NO: 175173 - RNA, 46 nt, Homo sapiens
cuguggaaaaaccuucacccaaaagucacaccugaauauacaccag

SEQ ID NO: 175174 - RNA, 42 nt, Homo sapiens
gggcaggccuucauccagaaggcacaccugauuguccaucaa

SEQ ID NO: 175175 - RNA, 55 nt, Homo sapiens
ggucagaaugaaagcaaugacacagaacagcuugaugacguuguugggucugguc

SEQ ID NO: 175176 - RNA, 45 nt, Homo sapiens
cuggaagcuggccacguauggguacaugagauaguggagacagug

SEQ ID NO: 175177 - RNA, 90 nt, Homo sapiens
gguccacgaaacuugcuaacuugaggacagugaacgugcaucuuaagagcgccuuugcggauggugcuggaggacguucagggaagggau

SEQ ID NO: 175178 - RNA, 46 nt, Homo sapiens
ggguuuggggcuccaagggggucucugccgggucugcgggagucgu

SEQ ID NO: 175179 - RNA, 47 nt, Homo sapiens
gcagauggucuuauccugucuuggggaagggaguggcccgguaagag

SEQ ID NO: 175180 - RNA, 62 nt, Homo sapiens
guuacaguccugaucaggacaagguagguaucauuggccugggccaccagggcuguuaaaag

SEQ ID NO: 175181 - RNA, 43 nt, Homo sapiens
agagaggagguggguuacauauggauuccggauugcagggucc

SEQ ID NO: 175182 - RNA, 28 nt, Homo sapiens
gaaagaaagaaaagaaagaaagaaaaag

SEQ ID NO: 175183 - RNA, 45 nt, Homo sapiens
gaguaaugagacagaauagggugggucuggagggcagggacugaa

SEQ ID NO: 175184 - RNA, 45 nt, Homo sapiens
gcgcgugucguuuugggggagcagcgccgccucugcggcuggaga

SEQ ID NO: 175185 - RNA, 26 nt, Homo sapiens
aaggggaccucaguggacauggggag

SEQ ID NO: 175186 - RNA, 35 nt, Homo sapiens
aggcaucuaggaccccagcccguccucccucagau

SEQ ID NO: 175187 - RNA, 38 nt, Homo sapiens
ccccuccuccuucagacucaagaauccuggccccagcc

SEQ ID NO: 175188 - RNA, 25 nt, Homo sapiens
ggucaggcccuuguuguacuucacu

SEQ ID NO: 175189 - RNA, 53 nt, Homo sapiens
ugaaaaugggcuuggagaugggaauggggugggguugggauggaaaugggauu

SEQ ID NO: 175190 - RNA, 46 nt, Homo sapiens
augggaugggguuggaauuagguaugagcuggaagguaggaaugga

SEQ ID NO: 175191 - RNA, 44 nt, Homo sapiens
gagaggaugccuuggagggucucgucacagaccagggggccucc

SEQ ID NO: 175192 - RNA, 84 nt, Homo sapiens
gagugagaggcaggggaaggguagggggaugaagggauguaggggugaggacuacuuuuccagauccagagccaagacagcaag

SEQ ID NO: 175193 - RNA, 45 nt, Homo sapiens
cccacaccguuccuagggacccaagucaccaccaaggcuccaggu

SEQ ID NO: 175194 - RNA, 52 nt, Homo sapiens
aaucauggagaacugagcccgcgcgccacgggggcaccuuggaagaccaaga

SEQ ID NO: 175195 - RNA, 45 nt, Homo sapiens
aucaccuccuucuuggaacagcacagccuguggcuccgccccaag

SEQ ID NO: 175196 - RNA, 54 nt, Homo sapiens
ucugggucugaggggacagggagcugggagcugggacuccuaaauuagggagag

SEQ ID NO: 175197 - RNA, 54 nt, Homo sapiens
aguaucuggggcuguucugggcuucucuggaggaaggaggaggcugggggacug

SEQ ID NO: 175198 - RNA, 45 nt, Homo sapiens
acgucuuggccgcacgaggucgggggcgucccauggugaggucug

SEQ ID NO: 175199 - RNA, 45 nt, Homo sapiens
cagcuguaaggacccaguugccaccuacaaggacaccgccacaga

SEQ ID NO: 175200 - RNA, 45 nt, Homo sapiens
gcucugggccaucuuuauucuguaggcuguggucucccaggcgua

SEQ ID NO: 175201 - RNA, 47 nt, Homo sapiens
cugagacggugcacuucuggccaggcugggugcaaugaucugccagg

SEQ ID NO: 175202 - RNA, 84 nt, Homo sapiens
aggggcuggggguuacuuggaggugccccuuuaugauaccucugacccucucuuuccagucuuccugcccucagacaaccgggu

SEQ ID NO: 175203 - RNA, 111 nt, Homo sapiens
agaccauggcugaaauauuuguggaagagaccacuaucucuacagaacaauccagagacuggcuuucauggcaguaucgcugauggaaacgacuccauuuuuggccaaugg

SEQ ID NO: 175204 - RNA, 38 nt, Homo sapiens
gugcacgguguacucacugcgaggagugacauucacag

SEQ ID NO: 175205 - RNA, 62 nt, Homo sapiens
ggggccuggacuccugggucugagggaggaggggcugaggccuggacuccugggucugaggg

SEQ ID NO: 175206 - RNA, 43 nt, Homo sapiens
gagagaugugggaagacuguucagaaacagaggggaugacaaa

SEQ ID NO: 175207 - RNA, 53 nt, Homo sapiens
gggagagcuagugcuagggacacacuagguccuuugaagacacugguuugacc

SEQ ID NO: 175208 - RNA, 40 nt, Homo sapiens
ggccuggucaggggucaccaagagcagagcgugggggcgg

SEQ ID NO: 175209 - RNA, 45 nt, Homo sapiens
accagcugccacauccugggcuggggcaagacagcagauggucag

SEQ ID NO: 175210 - RNA, 527 nt, Homo sapiens
ugaagggcuaauaggaagggagagccagugggggauggugaggccaguuagaaaaggaccaaggagggaagcagaccaauaggaagagagagccaaugagggagggcagggccaguuaggaaaggaccaaugaggaagguagaccauuggaggaagggccaauagaaagggaggauccaugagggaggguggggacaguuagaaaaggaccaaugauggagguggaccauuggaugaagaaccaauagaaaggaagaaccaaugggagagggcauggccaguuaggaaaagaccaauggucacagagugaccaaucaagaugaaucaaugggcaggaaguguccaaugaagaauggacuacugaucaggagggguacaguagaggagggcguaacagaggaagaguccuccaggucaacugaaacuacugaagaaggugggaccaguggaagagagaaaaguggaggagggaccuaagagaaaaggaaaaccaauaggaaaugaggacuccuggagaagagacuauu

SEQ ID NO: 175211 - RNA, 46 nt, Homo sapiens
gacagaaaagagcccagcucccugucugggcuggggugcuggguug

SEQ ID NO: 175212 - RNA, 26 nt, Homo sapiens
ggaacaauucaggcagagaagggcug

SEQ ID NO: 175213 - RNA, 21 nt, Homo sapiens
aaguuuaggaagucccagguu

SEQ ID NO: 175214 - RNA, 38 nt, Homo sapiens
gcagacgcaggaaugaggagcgaggaugauaaggaaag

SEQ ID NO: 175215 - RNA, 44 nt, Homo sapiens
ugguccccagugcuggcuccugggugggcagguccaugaccuuc

SEQ ID NO: 175216 - RNA, 38 nt, Homo sapiens
aaguuugcaaggauagcauucagcaggaucccugagga

SEQ ID NO: 175217 - RNA, 65 nt, Homo sapiens
uuggauuuagggggucaauugagucaaugagggucaaaaaggaagaucagaaucaguagaggcug

SEQ ID NO: 175218 - RNA, 48 nt, Homo sapiens
gucagaguucaauacauguucuucagagguuaggaggacugucuguag

SEQ ID NO: 175219 - RNA, 63 nt, Homo sapiens
caguggaggucacaggugggaggucagggggccaggugggggucacuauggcccuaccuccuc

SEQ ID NO: 175220 - RNA, 32 nt, Homo sapiens
aggagguggggacagacucagauugcggggua

SEQ ID NO: 175221 - RNA, 22 nt, Homo sapiens
guccccaccuccucucucucug

SEQ ID NO: 175222 - RNA, 59 nt, Homo sapiens
gauucaaagucauggagagagguuaaggaaauaaaggucagaaagaaagaaaggucaac

SEQ ID NO: 175223 - RNA, 41 nt, Homo sapiens
agacgccugggggaggcaguggugggaggaggggacagggc

SEQ ID NO: 175224 - RNA, 41 nt, Homo sapiens
cuucuguugcuaggagaccagaggggacccuaucaccuaga

SEQ ID NO: 175225 - RNA, 37 nt, Homo sapiens
cagguguagaaagacucucuaggaucaaguggggacu

SEQ ID NO: 175226 - RNA, 50 nt, Homo sapiens
uuuuccucccauguccugccugcccaggguccagauagggaacagaggug

SEQ ID NO: 175227 - RNA, 129 nt, Homo sapiens
caggagagggccagggccgugugggaauggacuggagggaggcuggaggcugcgggagaagacagagcccaucuggggccuuggggacagggcagagucagggcaggagagacaggacuuggggacagg

SEQ ID NO: 175228 - RNA, 48 nt, Homo sapiens
agguaggccccagagcagcacagcaugugcugggccgggcacagaggg

SEQ ID NO: 175229 - RNA, 58 nt, Homo sapiens
uggaggaaucaggccugccguaggcccaggaaggcggaaacaaagacgacgcucagag

SEQ ID NO: 175230 - RNA, 29 nt, Homo sapiens
uuugacccccauuacuucucugcuccagc

SEQ ID NO: 175231 - RNA, 47 nt, Homo sapiens
caugucauuucuaaccagaagucucaaggucgucaccccccugcccc

SEQ ID NO: 175232 - RNA, 42 nt, Homo sapiens
agugaccucccucagagaagucauuugcuuccugccucaguu

SEQ ID NO: 175233 - RNA, 47 nt, Homo sapiens
acugacccuucccggcugcccucccuccccagcuuacaccucaagcc

SEQ ID NO: 175234 - RNA, 53 nt, Homo sapiens
cgagccuguagaccuaucggcucucaucccuugggauaagccccaguccaggu

SEQ ID NO: 175235 - RNA, 42 nt, Homo sapiens
cucacacugcucccucaucccugccuccuugcacuugcgcag

SEQ ID NO: 175236 - RNA, 47 nt, Homo sapiens
agagaggaguugcugcucacauucagggaaauugcaauuuagaaaga

SEQ ID NO: 175237 - RNA, 42 nt, Homo sapiens
aagcaacagcggggggcggggcucauggcugcgcgcgggggu

SEQ ID NO: 175238 - RNA, 38 nt, Homo sapiens
ucgcgccucccgcggcuguuuccagggcaacaggagua

SEQ ID NO: 175239 - RNA, 40 nt, Homo sapiens
uaacaaauuuuuuggcccuuuucuaucucaggacugaguc

SEQ ID NO: 175240 - RNA, 69 nt, Homo sapiens
gauuaggggagggcggggucagcucuggguacagaaaggcccucaggggccauauggggagggacugga

SEQ ID NO: 175241 - RNA, 47 nt, Homo sapiens
gccugaguuccagagguugggguucaggaucuguuguagacuuggaa

SEQ ID NO: 175242 - RNA, 46 nt, Homo sapiens
ccaggacccggagggaugugccguuccucagguuuuccaggacuag

SEQ ID NO: 175243 - RNA, 102 nt, Homo sapiens
uggagaagagguaagcgguuacucacuccauggcugcagcaaggagaggcggcggcggccucggcugaagaaagaaggugggagcggagagcgcaggcgugg

SEQ ID NO: 175244 - RNA, 70 nt, Homo sapiens
caaaggggucgaggcuacagagccauggccggggcuacgcaggcagaggcggcgacacuguagugagaag

SEQ ID NO: 175245 - RNA, 41 nt, Homo sapiens
cuguauuuggucaauggccuccacccacugacccugcgcug

SEQ ID NO: 175246 - RNA, 83 nt, Homo sapiens
cggaccagggccuggggaggaggaguuaccgggucauuaaccccucaccggagccagggaguugacggggcaggggucgacag

SEQ ID NO: 175247 - RNA, 31 nt, Homo sapiens
ggacggagacacagagagagagggggacaga

SEQ ID NO: 175248 - RNA, 42 nt, Homo sapiens
ggggacuguccccacugaccucguggaugccaaagugugcgu

SEQ ID NO: 175249 - RNA, 44 nt, Homo sapiens
ggggcugugaaccuggagggguugcuacuaagugucugggggcc

SEQ ID NO: 175250 - RNA, 62 nt, Homo sapiens
uagcuacugggaguggcugugggagggcuggguggcggaaccugggcucuggccggggggug

SEQ ID NO: 175251 - RNA, 43 nt, Homo sapiens
uggguuccagcugcccgcacgccccgaccuuccaucguaggua

SEQ ID NO: 175252 - RNA, 97 nt, Homo sapiens
ugaaaguggggauacuuacuuucgaugaugugggggagggaggaggucuauacuggcggaauugagggaguggagggucugcacugaagacgcuggg

SEQ ID NO: 175253 - RNA, 45 nt, Homo sapiens
gcugcuguccacggucugcgaguccggagugagggcagggggugg

SEQ ID NO: 175254 - RNA, 45 nt, Homo sapiens
ggucuuuuugggcuuggugcugcccggagcugcuuuggccaucuc

SEQ ID NO: 175255 - RNA, 72 nt, Homo sapiens
cgaaucggggggcagguggggcugggggugcagggggcggugggggugggggaggggaaggggaggaagaug

SEQ ID NO: 175256 - RNA, 63 nt, Homo sapiens
agggagaaggggaaggggaggaggaugcagaggagggggcaggggguggggcagggcccccgu

SEQ ID NO: 175257 - RNA, 52 nt, Homo sapiens
cuccuaagaggcaaagccaacaccaagguuuuuugugugugcugcacuguga

SEQ ID NO: 175258 - RNA, 46 nt, Homo sapiens
uucuuagcccuugaacacuccuucuaggccugauaaauggccccag

SEQ ID NO: 175259 - RNA, 55 nt, Homo sapiens
gacgaugccccaagcagcagugucacagggguccuuauuugcauagccccucccc

SEQ ID NO: 175260 - RNA, 42 nt, Homo sapiens
aaggcagcagcagcgguggcgacaugagcagcggggcggcgu

SEQ ID NO: 175261 - RNA, 44 nt, Homo sapiens
aucccucccagggcuugauccuuacagccucccuccaggacaag

SEQ ID NO: 175262 - RNA, 49 nt, Homo sapiens
cccuagccuccacaucacccccuuuccugaaauuccaccccagcccagg

SEQ ID NO: 175263 - RNA, 42 nt, Homo sapiens
cccuugcacccagaggcagucccagagcuggccaaaggcuug

SEQ ID NO: 175264 - RNA, 67 nt, Homo sapiens
gcuaggauguaaucacgaugugggacauguaccuuauaccagaaagagaggaccaggagugacucag

SEQ ID NO: 175265 - RNA, 46 nt, Homo sapiens
cuguauauaacuccccucccccagaaaaauaaaugucacugccaac

SEQ ID NO: 175266 - RNA, 42 nt, Homo sapiens
ggagcccgcggcccccagcccccgccugcgacccgaggagag

SEQ ID NO: 175267 - RNA, 45 nt, Homo sapiens
cucccccccagcugcuccccucgguccucagccaugcccccaguc

SEQ ID NO: 175268 - RNA, 45 nt, Homo sapiens
acagggagggggccagaccacagcggccccuccuccggucauugu

SEQ ID NO: 175269 - RNA, 42 nt, Homo sapiens
ugaccggaggaggggccgcuguggucuggcccccucccuguc

SEQ ID NO: 175270 - RNA, 42 nt, Homo sapiens
cauguuccaauuacccaggauuuccgcuuugcucagccgccc

SEQ ID NO: 175271 - RNA, 64 nt, Homo sapiens
ccugcccaggaccagccccugguggaagccaaccaccugcugcacgagagcgacacggacaagg

SEQ ID NO: 175272 - RNA, 90 nt, Homo sapiens
cgagccuggggaggaggagccggcgugggugcagacggagaggcagcaguuccgggacuuccgggaucugaacaaggaugggcaccugga

SEQ ID NO: 175273 - RNA, 45 nt, Homo sapiens
aaacccuggaggaccuggacagaaacaaagauggcuauguccagg

SEQ ID NO: 175274 - RNA, 50 nt, Homo sapiens
uagccaucuuuguuucuguccagguccuccaggguuuccuggaggagaaa

SEQ ID NO: 175275 - RNA, 57 nt, Homo sapiens
gacgggaaguggccaaggaauucgaccaacucaccccagaggaaagccaggcccguc

SEQ ID NO: 175276 - RNA, 54 nt, Homo sapiens
cuccccaugaugacgcccacgggaacuuccaguacgaccaugaggcuuuccugg

SEQ ID NO: 175277 - RNA, 30 nt, Homo sapiens
ggagcguggagagcggagcgaagcuggaua

SEQ ID NO: 175278 - RNA, 46 nt, Homo sapiens
cacccagcuccacccugaggggcugcgccagccccgcgugcugcac

SEQ ID NO: 175279 - RNA, 46 nt, Homo sapiens
aaguucgcccugaacggcgaggaguucaugaauuucgaccucaagc

SEQ ID NO: 175280 - RNA, 46 nt, Homo sapiens
agcccuguggagcuugggucugggaaaaccagguguccugguauug

SEQ ID NO: 175281 - RNA, 50 nt, Homo sapiens
aaguucuucagguacgaggagggcauuguugucagucuggaccgagcccg

SEQ ID NO: 175282 - RNA, 52 nt, Homo sapiens
acuggggucuccagucacgggagccaggagccggccagggccgcaggcagga

SEQ ID NO: 175283 - RNA, 17 nt, Homo sapiens
ugcucugguaaaggcgc

SEQ ID NO: 175284 - RNA, 41 nt, Homo sapiens
caguuaaucucuagaaaauaaucacggacgcccggaauuaa

SEQ ID NO: 175285 - RNA, 47 nt, Homo sapiens
cugugaaggacugacgggcgggaagugcuagacggugucucgcgaga

SEQ ID NO: 175286 - RNA, 51 nt, Homo sapiens
aagguuuggaaaaugcaaccuucacugcaaaguaagggggccaguuuuggu

SEQ ID NO: 175287 - RNA, 46 nt, Homo sapiens
uuuucaucaacaucugccacucccccucuaucccuccucccgccga

SEQ ID NO: 175288 - RNA, 45 nt, Homo sapiens
gugaggcuggguggaagaagucacagcacccugggucccugggag

SEQ ID NO: 175289 - RNA, 162 nt, Homo sapiens
ggagaggggaauaccccauauuagagacaacagguugaucucauuuaauccucuagacaaagauggggaaacugaggcuccauucugggguuggggagaucaguggaugaguaugagccccaugauuugaacccaggucagucucccucccaagccuagaac

SEQ ID NO: 175290 - RNA, 45 nt, Homo sapiens
cagcccgccuacuucgaagaaguguucggcuucgagaucagcaag

SEQ ID NO: 175291 - RNA, 45 nt, Homo sapiens
aagaccugcacaaaguugggugugguaggacaugaacuaggugau

SEQ ID NO: 175292 - RNA, 39 nt, Homo sapiens
uagagaagucacagaaucccaugaaagggaauggggcag

SEQ ID NO: 175293 - RNA, 45 nt, Homo sapiens
aguuugcauaaggucaguguuuggggucucaggaaauucugggcg

SEQ ID NO: 175294 - RNA, 45 nt, Homo sapiens
aguucugggacuggcaccuaccugaggaccccgaccgggggcagg

SEQ ID NO: 175295 - RNA, 41 nt, Homo sapiens
gcgucaugaacccgagcuauagagaaaggagaugaggucag

SEQ ID NO: 175296 - RNA, 45 nt, Homo sapiens
ucauccugagagguaacgggucggaggcgcaccgcgugcccugcu

SEQ ID NO: 175297 - RNA, 29 nt, Homo sapiens
gcgucgggccugggagggauuggggugug

SEQ ID NO: 175298 - RNA, 41 nt, Homo sapiens
gggggcccucaaggagcuccgcugccuccugggccugguga

SEQ ID NO: 175299 - RNA, 47 nt, Homo sapiens
ccauccacugcucaccggaggcuucuuggagccugagucuucuuccg

SEQ ID NO: 175300 - RNA, 60 nt, Homo sapiens
auggcuacccagccggggcccagccccugccgcuaacccagcccucaucuuccccugugg

SEQ ID NO: 175301 - RNA, 46 nt, Homo sapiens
aggugaagaugucagcccaggagagcugccucagccucaucaagua

SEQ ID NO: 175302 - RNA, 39 nt, Homo sapiens
gaaagagagacggagagcugagagagaaaggaagaaccc

SEQ ID NO: 175303 - RNA, 41 nt, Homo sapiens
cugaguauggacaccaggcccacaggcaccgaggccauggg

SEQ ID NO: 175304 - RNA, 55 nt, Homo sapiens
uccauugaauauagacaccaggcucacaggcaccaaggccacgggauugaagagg

SEQ ID NO: 175305 - RNA, 36 nt, Homo sapiens
gggaccaggaagaugaggaggaugaggaggaagguc

SEQ ID NO: 175306 - RNA, 46 nt, Homo sapiens
uuuuccucuggaccgucagggccgucaggcccgagcuccccuggag

SEQ ID NO: 175307 - RNA, 47 nt, Homo sapiens
cuccuccuugucgcgacuccgugagcgccuccgccggucccgggagc

SEQ ID NO: 175308 - RNA, 41 nt, Homo sapiens
cggucccggucccggucccugugcggaagcggggaggggcc

SEQ ID NO: 175309 - RNA, 41 nt, Homo sapiens
cuuaccucucaucguagcgggaggugucaucgcggccugaa

SEQ ID NO: 175310 - RNA, 25 nt, Homo sapiens
acaaagaaggcuagggaggccucag

SEQ ID NO: 175311 - RNA, 49 nt, Homo sapiens
uggcagggugggggaggggacagacugggaggggcuggggcagcagaga

SEQ ID NO: 175312 - RNA, 45 nt, Homo sapiens
caaugccacaauaagguugauugugguguuuuucauguggcaguu

SEQ ID NO: 175313 - RNA, 20 nt, Homo sapiens
ucggaauuaaaacaggcucu

SEQ ID NO: 175314 - RNA, 40 nt, Homo sapiens
cgagcgcaccaggccgcugcucagccacccgcgcggccuc

SEQ ID NO: 175315 - RNA, 137 nt, Homo sapiens
ccgcccgcgccugcucugcgccuuucccgucccgggguccccuuucucuccguccuucugccgccgggauccuguccugcgucucuccaaguuuccgugugcguguguuucgucagaaucaggcuucaguugcaguc

SEQ ID NO: 175316 - RNA, 42 nt, Homo sapiens
cucgcgcaggcgugccagggccgccgcgcccagcccguagaa

SEQ ID NO: 175317 - RNA, 38346 nt, Homo sapiens
gaggaggguccuggaguccugggucugagagaggaggcgccagggaauuuggaugccagggacugcagaggaaagggcugggggccgacuggaagaggucagaguuugggguggggggugauagggacuccugagucuuucuagcugaugugcggcgccuucucuccaguccacggucgcggacccucuaccuccgacugcaaagcaggauucucgcaucugggcuuucgacgagguccucagcagaugggagacaaccucuggcucggccuacgugcccaagacccauggcgggcccugcgcccagcccagagccccagagccugcagaccccacgcggacuguggggaucaaggauucaggagaaaagguaagauuuggggagcgccggagucugcgggggacugcauuugaguccccugcuccuucacaugagucucuggguugccuuuccgcagcucagacaccgcagcugaacccuccuacugaccacaaaguaccagagcagcgagacgagggcgcaguacacuugcucucccggcccggacgcgcgcgcccccaaauacgucgggccccagccccucacaacucucggaccaccaccgcggggggccuucccaggugucuggguggaagccggcgcuggcgagaccagcggagcuccgggagccuggggcggggccagaaggaaaucacagcuuuggggcguggcuaaaggaucuggggcgggaucgggagguuagaggagcgggaggaagggcugggcauccacgccaggccagaaggaccaggggcuggaaacucgccuucagggcuccuaagcugcugcggagcuagacggcgggcuguggguggggaggagacuagaauauucugagacgugguagggugggaguuaggagagguaaccuggaguuguugcccaagaugcagcucagcuccaguggccacaccaagaaggcuugagaccgggggcagaaccagggggauuuugugguggcugggggccugcauuugaguuccuugaccagcaggagggcuuggauuuagggaggugaggcugggaaggguucggguaugagaaaggaagcugaaguucccuggcguggguggcaggaagggcucugacccuggggcggggugugagggccguggccgucauggcugucgaggccgaaggagagggauucugaacucgggacccaggacuugggaugggguaugaaaucuaugucuuggguaugccuccucccccaaucuugcucaggcucuaaucgccugcacgaagaaccccgcgcugucuggcccacccuucacaguauccgaccggggcguccugaaccgccgccagcucuaucugaccaccucggcgcgggacuuucgguucuaucccaaguaagccgggcucucgcucggcaccgccuccugcacagcccccgccauggccggugcacgccgagccccugggcuggcucccauucccugaccgguggucucagucucgacuccuauagcagcaacaaccacaguucagaccccagccccucccucuuuuagcacccaggaguccuuagugucaccuccaggaaccgcgguagggacaggaagccugcacagcggcucgaggggauucuggaucugagggcagggccuccuucgguacuugagcccccacaugcuccuucgcaaggaagcgaaagcccccguuuccuucccuaggaugcgaaagcucagcuuccaggacguuaaguaccucgaggacccaggaacgcaggcaacgcgugcccggucgcguccuuccuaaggggugcucgccuggaaaugcaggaguuugaaugugcagacuccuuagaucccgaggucugaaacucguccccaaggauccagcuguauccucaccaucccgcccugcucccacaggacggagccguccggauacccccgcaaggacuaccugaccuacuggagcuuagaagagacgccccaacucuggagucacgacccgcagcggcagcccugucucugcucuuccaggccgccucgagcgccgcacggcgggccaugucuccggcucaggaaaccuacagcuccucgccgcacccgcuccgccggcucgaccgcuuccgcccgcuggaggcgacuugggguggcccccacuggaagccccugccgggcauacacagcgucccgaaagccuacagcaccgagaacucccgcucaggccgcuguaagccggggcuagugggagccugccgggccagccccaccccagacacgcccccuggcgugggggcggagcagagcucugggcagccgcucacuacgcggugucggaccuaggugggcucgcacucauuaagucuauccgcaguguggggacaggacuagcccagacacgcccacucagcugcggcuggaucgcggggaagggacuaaguccagacaauguccuccgaggcugcggccccgcgggcaggacacaccuccugcgggccuauucaauaaucaguuaaaucaccugaagcacacgcauuuccggggaccgcuccgggcauccuggcuugaggguagggugggcggagguuccuaagggagagguggggcucgggcugaaucccucguuggggggcaucugggucaaguggcuucccuggcagcacagucacggggagacccucucucacugggcagaagcuaaguccgaagccgcgccccuccuguuagguuggacuguggugcaggaauggcucaaguagaggaggguugaggcuucaguccagcaccuuucucgggucacggccuccuccugguucccaagaccccaccauaggcagaggcaggccuuccuacacccuacucucugugccuccagccucgacuagucccuagcacucgacgacugagucucagaggucacuucaccguggucuccgccucauccuuggcgcuagaccacugaggggagaggacuggggugcuccgcugagccacuccugugccucccuggccuugucuacuucucgccccccgaaggguuaguguccagcucacuccagcauccuacaaccuccugguggccuugacgcccccacaaacccgagguauaaagccagguacaccaggcaggggacgcaccaaggauggagauguuccagguaagacugcagggccccugggcaccuuccaccuccuuccaggccaucacuggcaugagaaggggcagaccagugugagcuguggaaggacgccucuuucuggaggagcgugacccccaauaagcuucacguggggcaguuccugaggguggggaucugaaauguuggggcaucucaggucccucgggcuguggggugggcucugaaaggcagguguccgggugguggguccugaauaggagaugccgggaagggucucugggucuuugugggugguguacccugggggaugggaaggccagggcucagggcuguggucucaggcccgggugaagcaguguccuugucccaggggcugcugcuguugcugcugcugagcaugggcgggacaugggcauccagggagaugcuucggccacggugccgccccaucaaugccacccuggcuguggagaaggagggcugccccgugugcaucaccgucaacaccaccaucugugccggcuacugccccaccauggugagcugcccggggcccgggcaggugcugccaccucagggccagacccacagaggcagcgggggaggaaggguggucugccucucuggucaggggcugcggaauggggugugggagggcaggaacagagggcuuccuggaccccugagucugagaccugugggggcagcuggggagcucagcugaggcgcuggccccaggcacaugcucauucucccacucacacggcuuccagacccgcgugcugcaggggguccugccggcccugccucagguggugugcaacuaccgcgaugugcgcuucgaguccauccggcucccuggcugcccgcgcggcgugaaccccguggucuccuacgccguggcucucagcugucaaugugcacucugccgccgcagcaccacugacugcgggggucccaaggaccaccccuugaccugugaugacccccgcuuccaggccuccucuuccucaaaggccccuccccccagccuuccaaguccaucccgacucccggggcccucagacaccccgauccucccacaauaaaggcuucucaauccgcacucuggcggugucuuucugugggcucagggcaaccacacacacacaggguggguccagcuuccaaaccauuuuauacaaagucacaguaucagaacucugguagaaaacaggguggacggcggggcgcgguggcucacgccuguaaucccaccacuuugggaggccgaggcaggcugaucaugaggucaggagaucgagaccauccuggcuaacacggugaaaccccaucucuacuaaaaauacgaaaacuuaucccggcuugguggugggcgcuugcaguccaagcuacuugggaggcuguggcaggagaauggagugaaccugggagggggagcuugcagugagccgagaucacaccacugcacuccagccugcaugacggagcgagacuccaucucaaaaaaaaaaaaaaagaaagaaagaaagaaggaaagaaagaaaaagaaaagagagugaagaugggggacgacauccagcucaggagguguccauggucuggccuucuguggggagaaggaaggccacaugauugguguggcccagggggcagggccucagccuccuaagccgagcuccgucuuccucccucugacguuggcacuggcagugcagguguggggggggagcggcuuggggacuugaaugggaugaaggggccgagggggaugucaucucuuccauucuccuucauccacugccucucccuuccccuccuccccccuccccuccguccaucugccucccaucccagccaggagccaucaccuaaguagaaaaggggccucuggaaagggggcggggccuugacucuuggguacccugcacuugaagaggaacucugggaggggguuguucagggauuuggccccuuccccaucuggcuguauaaccuuccugugcuuuucuuccccuagccgguuaccccucccucuccugagaugucaggaaagagggggccaccugcguccuccacagugguccccgaagccugggguucccagccccagagcuccgagguggaagaguugcuacagcucuggugaccacugguuguuucccagucuucuccacgccaaccuuucccagaaccacaggcuuccagaauguuguagggaaacugcaaaauccgcgccuccaccagccucucccagcgccaggucaauuucacacacagggaaacugaagccugccucagaggggcagcguuuuaccuccuuaguggcaguuuugaggugaaucagggucucccuaggauuccagguuguggacuuucucuaaauuguggaauguggccaggcaugguggcuugagucuguagucccagcuacucaggagccacagcaggaggauggcuugagcccaggaguucaagugcaguggggaaacauagggagaccucgucuuaaagcaauuuguuuggggccaggcguggugucucaggccuauaaucccagcacucugggaggccagggcaggaguaucacuggagguugggaguuugagaacagucuggccaaugucgugaaaccgcaucucuacuaaaaauacaaaaauuagcugggcacgguggcaggugcuuuuaauuccaguuacucagaaggcugaggcaggagaaucgcuugaaaccaggagacaggcguuacagugagccgggauugugccacuguacuccagccuggccagacagagugagacucuguuucaaaaaaaaaaaaaaaaacaacaaaacaaaacaaacaaaaaaaaauugggccgggcgcaguggcucaugccuguuaucccagcacuuugggaggccgaggugggcagaucacaaggucagcagaucaagaccauccuggcuaacacggggaaaccccgucucuacuaaaaaauacaauaaauuagccagacgugguggcaggccccugcagucccagcuacucgggaggcuaaggcaggagaauggcuugaacccgggaggcagagcuugcagugagccgagaucgagccacugcaguccagucugggugagagagugagacuccaucucaaaaaaaaaaaaaaaaaauugguuggaacauccuccaagaugcaagacucucgguuccucagaguucuacgggaaggauggcagaaugcaguugcccagaggugaagucccaucucugucauuugcugccuaugugaccaggcaaaaagcauuaauuucucugagccuguauuuuacccucuguugcuauugaguaauuguaguuggcuauuuucuauuuuuauuuuuauuucaucuuuuuuuuuuuuuuuuuuuuugagacggagucucgcccugucacccagucuggagugcaguggcgcgcucuuggcucacugcaccuaugcuucccggguucaagcaauucaccugccucagacucccgaguagcugggacuacaggugugcaccaccacacccagcuaauuuuuguaauuuuuuuaguagacacagcguuucgccacguuggccaggcuagucccaaaguccugaccucaggugacgcacccgccucggcgucccauagugcugggauugcaggcaagagccacuguccccggccgaacaauuuuuaucuuuauuuuaugauuauuauuauuauuuuuuuaagauggagcuuuguuuuuguugcccaagcugaagugcaauggcgcgaucuuggcucacuucaaacuccgccuccugggauuaagcgauucuccugccucagccucccaaguggcugggauuauaagcaugcagcaccacgccggaggauauuuuguauuuuuaguagaggugcgguuucucuauguuggucaggcuggucuggaacuccucaccucagcugauccacccacugcagccuccgacaaugcugggauuacaagugugagccaccaugcccggccuuauuuauuuauuuuuuuugagagagagucucacuguguuguccaggccgaagugcagugacacgaucuuggcucacugcaaucucagcccucccggguucaagcgauucuccugccucagccucccgaguagcugagaucacaggcgugcagcaccaggccuggcuaauuuugguauuaucaguagagauguuguuucacaguguuggccaggcugcucucgaacuccugaccucaagucauccacccgccucagccucccaaagugcugggacuacaggugugagccauagugccugaccuguaguuguugaauauuuauuauuaaucuacaaguugggugugaugcaaguccuuuauauggagucccccaaacuucuagagcaagggcuuccccauaauccuggcaggcaggccuccccugggguuuccaacuucugaccccacugaaguguuuauccucuucucuaaucccagccuccuuuucccugucuccgugugcugagaggugcucugagagaugcucccgcucccccaggcucccucugcaucccccucauuuucuuccuccccagugugucaaugggguccuaaccccacccucggcacugucaccuuuuccugauccaaaguaggaccuucuuuuccccugagugguccugucuaggggugccgcugccgggcccccucuggucuuccugcugcagacuggggccuuuugggagucagcaggcgcccgggccaaccgcagccagcgugaggcgagcgaugcuucaccggcgagucaucagggugaggcuggccgugugugaugcagucagugucugggugacagaucccgggaccgcuguggacuugggugugcucgagguggagguguugggcgaggugccugcagcuggcggcaguucccucugccagcacuucuuugucaccgcuucgaggccgauaacucugaggaagguagccgugggguagguggagggggcugccgccaggguguggaccggggggcacugggugucugagugcaaggccaagcaguccuaugugcgggcauugaccgcugaugcccagggccguguggacuggcgauggauucaaauuggcacugccugugucugcacacuccucagccggacuggccgggccugagacuuauacccaggaacuggucaggcagaaaaagaacagagcuggaugcugagagaccucaggguuggcccagcugcucuacggaccccaguuugggaacucaucaaaucaucacaaaaucacaacucucugaauuugagcucagucucugcaggaugggugccaccacgugggguuuugaagguugaauaggaguucuccagggggaaauugagaguaaucaugaugaugaugaugauaauaauagccacuauuuacugaguguuuacucuuucguagcccuaauacauaacuccucagaucaacucucauggauuugaucauuggugaccuuugguguuaaguugcugacugcucagucacagaggacaccaccuugcucauccuggggagugggagggcacauuucacgauguggauggggguggagagaaacuggagcaugcaagcagauggccaggggaccuugaggacauggucuacagaaggccuuuaaguaucugggagcugggguucaaaugagaaaucuuacuuggugagagcaggcagggguuggcuuagaauauucuguuuugagauaaugagcuaccgaucacagggggaguauaagcaagguucaaugagaagcgaucaagaugcugcacaguucagcccuggguggggagcgcaagucagguuucuagcccucuuugcugugccaaccuauacccuacauugggaaagaaacagaccuuaaaauuguccagcuugauggcaucgcggggaagggacuaaguccagauaauguccuccgaggcuucggccccgugggcaggacauaccuccugcgggccuauucaauaaucaguuaaaucaccugaagcacacgcauuuccggggacagcuccgggcauccuggcuugaggguagagugggcggaggucccuaagggagagguggggcucgggcugaaucccuccuugggggcaccagggucaaguggcuucccuggcagcacagucacggggagacccucucucauugggcagaagcuaaguccgaagccgcgccccuccugggagguuggacuguggugcaggaaagccucaaguagaggaggguugaggcuucaguccagcaccuuucucgggucacggccuccuccuggcucccaggaccccaccauaggcagaggcaggccuuccuacacccuacucccugugccuccaggcucgacuagucccuagcacucgacgacugagucucugaggucacuucaccguggucuccgccucacccuuggcgcuggaccagugagaggagagggcuggggcgcuccgcugagccacuccugcgccccccuggccuugucuaccucuugccccccgaaggguuagugucgagcucacuccagcauccuacaaccuccugguggccuugccgcccccacaaccccgagguuuaaagccagguacacgaggcaggggacacaccaaggauggagauguuccagguaagacugcagggccccugggcaccuuccaccuccuuccaggcaaucacuggcaugagaaggggcagaccagugugagcuguggaaggaggccucuuucuggaggagcgugacccccaguaagcuucagguggggcauuuccugaagguggggaucugaaauguugggguaucucagguccucugggcuguggggugggcucugaaaggcagguguccgggugguggguccugaauaggagaugccgggaagggucucugggucuuugugggugguguaccacgugggaugggaaggccaggacucggggcugcggucucagacccgggugaagcaguguccuugucccaggggcugcugcuguugcugcugcugagcaugggcgggacaugggcauccaaggagccgcuucggccacggugccgccccaucaaugccacccuggcuguggagaaggagggcugccccgugugcaucaccgucaacaccaccaucugugccggcuacugccccaccauggugagcugcccggggccggggcaggugcugccaccucagggccagacccacagaggcagcgggggaggaaggguggucugccucucuggucaggggcugcggaauggggugugggagggcaggaacagagggcuucccggaccccugagucugagaccugugggggcagcuggggagcucagcugaggcgcuggccccaggcacaugcucauucucccacucacacggcuuccagacccgcgugcugcaggggguccugccggcccugccucagguggugugcaacuaccgcgaugugcgcuucgaguccauccggcucccuggcugcccgcgcggcgugaaccccguggucuccuacgccguggcucucagcugucaaugugcacucugccgccgcagcaccacugacugcgggggucccaaggaccaccccuugaccugugaugacccccgcuuccaggacuccucuuccucaaaggccccuccccccagccuuccaaguccaucccgacucccggggcccucggacaccccgauccucccacaauaaaggcuucucaauccgcacucuggaggugucuuucugugggcucagggcaaccacacacacacaggauggguccagcuuccaaaccauuuuauacagagucacaguacagaacucugguagaaaacaggguggacggcugggcgugguggcucacgccuguaaucccaccacuuugggaggccgaggcaggcggaucaugaggucaggagaucgagaccauccuggcuaacacggugaaaccccgucucuacuaaaaauacgaaaaguuauccgggcuugguggugggcgcuugcaggagaaugcagugaaccugggagcgggagguugcagugagcagagaucgcgccacugcacuccagccugcacgacagagcgagacuccaucucaaaaaaaaaaaaaaaagaaagaaagaaagaaaaagaaaagaggguggagaugggggaugacauccagcucaggagguguccauggucuggccuuccguggggagaaggaaggccacacgauugguguggcccagggagcagggccucagcauucuaagccgagcucccucuuccacccucugagguuggcacuggcaguccaggugggggcuuggggaucugaaugggaugaaugggccaagggggaugucaucucuuccauucuccuucauccacugccucucccuuccccuccuccaccccucccacccccgguccaucuaccucccaucccagccaggagccaucaccuaaguagaaaaggggccucuggaaagggggcggggccuugacucuuggguacccugcgcuugaagaggaacucugggaagggguuuuuucagggaguuggccucuuccccaccuggcuguauaaccuuccugugcuuuucuuccccuaaccgguugcugcucccucuccugcgaugucaggaaagagggggccaccuguguccuccacaguggcccccgaagccugggguucccagcagagcucagaggugaaggaggugcuacagcucuggugaccacugguuguuucccagucuucuccaugccacccuuuccaaaaacaacaaaacaaaacaaaacaaacaaaauugggccuggcgcagugguucaugccuguaaucccagcacuuugggaagccgagacgggcggaucacaaagucaggagaucaagacuauccuggcuaacacggggaaaccccgucucuacuaaaaaauacaacaaauuagcgaggcguccuggugggcgccuguagucccagcuacuugggaggccgaggcaggagaauggcaggaaccugggaggcggaucuugcagugagccgagaucgcgccacugcaguccagucucaacaacagagcgagacuccgucucaaaaaaaaaaaaauugauuggaacauccuccaagaugcaagacucucaguuccucagaguucuacaggaaggauggcagagugcaguugcccagaguugaagucccaucucugccauuuguuggcugugugaccaggcacaaaucauuaauuucucugagccuguauuuuaccaucuguugcuauugaguaauaguaguggacuauuuucuauuuuuauuuuuauuuuauuuuauuuauuuauuuuuuuugagacggagucucacccugucacccaggcuggagugcaguggcgugaucucagcucacugcaccuaugcuuccgggguucaagucauucuccuuccucagcuuccugaguagcuggaacuacaggcgcgcaccaccacacccagcuaauuuuuuuuuuuuuuuaguagagacaggguuucaccauguuggccaggcuggucucaaaguccugaacucaggugaugcacccgccucagccucccaaagugcugggauugcaggcaugagccacugcgccuggacgaacguuuuuaauuuuuauuuuauuauuauuauuauuauuacuuuuugagauggagcuuuguuuuuguugcccaggcugaagugcaauggcgggaucuuggcucacugcaaccuccgccuccuaggaucaagagauucuccugccuuagccucccaaguaccugggaguauaggcaugcaccaccacgcucgacgauguuuucuauuuuuaguagagaugggguuucuccauguuggucaggcuggucuggaaccccucaccucagcugauccacccaccacagccuccgacaauuacaggcgugagccaccgcgccuagccguccacccuguuuucuaccagaguucuguacugugacucuguauaaaaugguuuggaagcuggacccauccugugugugugugauugcccugagcccacagaaagacaccuccagagugcggauugagaagccuuuauugugggaggaucgggguguccgagggccccgggagucgggauggacuuggaaggcuggggggaggggccuuugaggaagaggaguccuggaagcgggggucaucacaggucaaggggugguccuugggacccccgcagucaguggugcugcggcggcagagugcacauugacagcugagagccacggcguaggagaccacgggguucacgccgcgcgggcagccagggagccggauggacucgaagcgcacaucgcgguaguugcacaccaccugaggcagggccggcaggacccccugcagcacgcgggucuggaagccgugugagugggggaaugagcaugugccuggggccagcgccucagcugagcuccccaguugcccccacaggucucagacucagggguccgggaagcccucuguuccugcccucccacaccccauuccgcagccccugaccagagaggcagaccacccuuccucccccgcugccucugugggucuggcccugagguggcagcaccugcccgggccccgggcagcucaccaugguggggcaguagccggcacagauggugguguugacggugaugcacacggggcagcccuccuucuccacagccaggguggcauugauggggcggcaccguggccgaagcggcuccuuggaugcccaugucccgcccaugcucagcagcagcaacagcagcagccccugggacaaggacacugcuucacccgggucugagaccgcagccccgaguccuggccuucccaucccgcgugguacaccacccacaaagacccagagacccuucccggcaucuccuauucaggacccaccacccggacaccugccuuucagagcccaccccacagcccagaggaccugagaugccccaaaauuucagauccccacccuuaggaacugccccaccugaagcuuacugggggucacgcuccuccagaaagaggccuccuuccacagcucacacuggucugccccuucucaugccagugauugccuggaaggagguggaaggugcccaggggcccugcagucuuaccuggaacaucuccauccuuggugcguccccugccucguguaccuggcuuuauaccucgggguugugggggcggcaaggccaccaggagguuguaggaugcuggggugagcucgacacuaacccuucggggggcaagagguagacaaggccaggggggcgcaggaguggcucagcggagcgccccagcccucuccucucacugguccagcgccaagggugaggcggagaccacggugaagugaucucagagacucagucgucgagugcuagggacuagucgagccuggaggcacagggaguaggguguaggaaggccugccucugccuauggugggguccugggagccaggaggaggccgugacccgagcaaagugcuggauugaagccucaacccuccucuacuugaggcuuuccugcaccacaguccaaccucccaggaggggcgcggcuucggacuuagcuucugcccaaugagagagggccuccccgugacugugcugccagggaagccacuugacccagaugccccccaacgagggauucagcccgagccccaccucucccuuaggaaccuccgcccacucuacccucaagccaggaugcccggagcgguccccggaaaugcgugugcuucaggugauuuaacugauuauugaauaggcccgcaggagguguguccugcccacggggccgaagccucagaggacauuaucuggacuuagucccuuccccgcgaugccaucaagcuggacaauuuuaaggucuguuucuuucccaauguaggguauagguuggcacagggaagagggcuagaaaccugacuugagcuccccacccagggcugaacugugcagcaucuugaucgcuucucauugaaccuugcuuaaacucccccugugaucgguagcucauuaucucaaaacaaaauauucuaagccgaccccugcccacucucaccaaguaagauuucucauuugaaccccagcucccagauacugaaaggccuucuguagaccauguucucaagguccccuggccaucugcuugcauguuccaguuucucuccucccccaugcacaucgugaaaugugcccucccacuccccaggaugaggaaggugguguccucugugacugagcagucagcaacuuaacaccaaaggucaccaaugaucaaauccaugagaguugauccgaggaguuauguauuauggcuaagaaagaguaaacacucaguaaauagugccuauuauuauuaucaucaucaucaugauuauccucaaguucccccaggagaacuccuauucaaccuucaaaaccccaugugguggcacccauccugcagagauugagcucaaauucagagaguugugauuuugugaugauuugaugaguucccaaacugggguccguagagcagcugggccaacccugaggucucucagcauccagcucuguucuuuuucugccugaccaguuccuggguauaagucucaggcccggccaguccggcugaggagugugcagacacaggcagugccaauuugaauccaucaccaguccacacagcccugggcaucagcggucaaugcccgcacauaggacugcuuggccuugcacucagacacccagugccccccgguccacacccugcggcagccccuccaccuaccccugggccaccuucuucagaguuauuggccucgaagcaggugacaaagaaguguuggcagagggaacugccgccagcugcaggcaccucgcccaacaccuccaccuccagcacaccugaguccacagcgguccgggggucugucacccagccagugacugcaucacacacggccagccucacccugaugacucgccagugaaguauugcucaccccucgcuggcugcgguuggcccgggcgccugcugacucccgaaaggccccagucuccagcaggaagaccagagggggcccggcagcggcaccccuaggcaggaccacucaggggaaaagaaggucccacuuuggaucaggaaaaggcgacaaugucgagggugggguuaggaccccauugacacacuggagaggaagaaaaugagggggauguagagggagucugggggagcgggagcaucucucagagcaccucucagagcacauggagacagggaaaaggaggcugggauuagagaagaggauaaacacuucaguggggucagaaguugggaaccccaggggaggccugccugccaggauuauggggaagcccuugcucuagaaguuugggggacuccauauauaggacuugcauaacacccaacuuguagauuaauaguaaauauucaacaacuacaggucaggcauuauggcccacaccuguaaucccagcacuuugggaggcugaggcggguggaugacuugaggucaggacuuugagaccagccuggccaacauggugaaucccugucucuacuaaaaaaaauacaaaaauuagcugggugugguggugggcaccuguacucccagcuacucaggaggcugaggcaggagaaucgcuugaaccccggaagcagagaugcagugagccaagagcgcaccacugcacuccagccugggugacagggccagacucugucucaaacaaaaauaaaaauaaaaauaaaaauaaauaaaaauacauaauagucaacuacuauuacucaauagcaacagaugguaaaauacaggaucagagaaaguaaugauuugugcccggucacacagccaacaaauggcagagaugggacuucaccucugggcgacugcacucugccauccuuccuguagaacucuaaggaaccgagagucuugcauccuggaggauguuccaaucaauuuuuuuuuuuuucagggggagucucacuugucacccaggcuggacugcaguggcucaaucucggcucacugcaagcuccgccucccagguucacaccacucuccugccucagccucccgaguagcugggacuacaggcgcccgccaccaugccuggcuaauuucuuguauuuuuuaguagagacgggguuuccccauguuagccaggauggucuugaucuccugacccugugaucugccuuccucggccucccaaagugcugggauuacaggcaugagccacugcacccggcccaauuuuuuuuucuuuuuuuuuuuugagacagagccucacucugucuggccaggcuggaguagaguggcacaaucccggcgcacuguagcgccugccuccuggguucaagugacucuccugccucagccuucugaguaacuggaauuacaagcgccugccaccgugcccugcuaauuuuuguauuuuuaguagagaugcaguuucacaacauuggccagacuggucucaaacucccaaccuccagugauacuccugcccuggccucccagagugcugggauuauaggccugagaaaccacgccuggccccaaacaaauugcuuuaagacgaggucucccuauguuuccccacugcacuugaacuccugggcucaagccauccuccugcuguggcuccugaguagcugggacuacagacucaagccaccacgccuggccacauuccacaauuuagagaaagugcacaaccuggaauccuagggagaccccgauucaccucaaaacugccacuaaggagguaaaacgcugccccucugaggcaggcuucaguuucccugugugugaaauugaccuggcgcugggagaggcugguggaggcgcggauuuugcaguuucccuacaacauucuggaagccugugguucugggaaagguuggcguggagaagacugggaaacaaccaguggucaccagagcuguagcacccccuccaccucggagcucuggggcugggaaccccaggcuucggggaccacuguggaggacgcagguggcccccucuuuccugacaucucaggagagggagggguaaccggcuagcagaagaaaagcacaggaagguuauacagccagauggggaaggggccaaaucucugaacaaccccuucccagaguuccucuucaagugcaggguacccaagagucaaggccccguccccuuuccagaggccccuuuucuacccagguccuagcugggaugggaggcagauggacggaggggaggggggaggaggggaagggagaggcaguggaugaaggaggauggaagagaugacaucccccucggcccauucaucccauucagguccccaagccgcgccccccaccccgccccaccugcacugccagugccaacgucagagggaggaagagggagcucggcuuagaaggcugaggcccugccaccugggccacaccgaucauguggccuuccuucccccacagaaggccagaccauggacaccuccugagcuggaggucauccuccaucuccacccuguuuucuuuuucuuucuuucuuucuuuuuuuuuuuuuugagauggagucucgcucugucguggaggcuggagugcaguggcgugaucucugcucacugcaagcucccccuccuagguucacuccauucuccugccucagccuuccaaguagcuuggacuacaggggcccgcgaccaagcccagauaaguuuuuguauuuuuaguagagacgggguuucaccguguuagccaggaaggucucgauccccugaccacaugauccgcccgccugggccucccaaaguggugggauuacuggagcgcagcaccacgcccagcuaauuuugguauuaucaguagagauguuguuucacaguguuggccaggcugcucucaaacuccugaccucaagucaaacacccgccucagccucccaaagugcugggacuacaggugugagccauagugccugaccuguaguuguugaauauuuauuauuaaucuacaaguugggugugaugcaaguccuuuauauggagucccccaaacuucuagagcaagggcuuccccauaauccuggcaggcaggccuccccugggguucccaacuucugaccccacugaaguguuuaucuucuucccuaaucccagccuccuuuucccugucuccaugugcucugagagaugcucugagagaugcuccugcucccccaggcucccuccgcaucccccucauuuuccuccuccccagugugucauuggaguccuaaccccauccucgacauugucgcguuuuccuccuccagagugggaccuucuuuucccccgagugguccugucuaggggugccgcugccgggcccccucuggucuuccugcuggagacuggagccuuucgggagucagcaggcgcccgggccaaccgcagccagcguggggugagcgauacuucaccggugagucaucagggugagcuggccgugugcgaugcagucacugucugggugacagaccccuggacugcuguggacuugggugugcucgagguggagguguugggugaggugccugcagcuggcagcaguucccuccgccagcacuucuuuguuacccgcuucgaggccgauaaaucuaaggaagguggcccggggguagguggaggaccugccgccgggguguggaccggggggcacugggugucugagugcaaggccaagcaguccuaugggcgggcauugaccacugaugcccagggccguguggacuggcgauggauucaaauuggcacugccugugucugcacacuccucagccggacuggccgggccugagacuuauacccaggaacuggucaggcagaaaaagaacagagcuggaugcugagagaccucaggguuggcccagcugcucuacggacggaccccaguuggggaacucaucaaaucaucgcaaaaucucaacugucugaauuugagcucaaucucuguaggaugggugcaacaaugugggguuuugaagguugaauaggaacucucccgggggaacuugaggguaaucaugaugaugaugauaauaauaauagccauuauuuacugaguguuuacucuuucguagcccuaauacauaacuccucggaucaacucucauggauuugaucauuggugaccuuugguguuaaguugcugacugcucagucacagaggacaccaccuugcucauccuggggagugggagggcacauuucacgaugugcaugggggaggagagaaacuggaacaugcaagcagauggccaggggaccuugaggacauggucuacagaaggccuuuaaguaucugggagcugggguucaaaugagaaaucuuacuuggugagagcaggcagggguuggcuuagaauauucuguuuugagauaaagagcuaccgaucacacggggaguauaagcaagguucaaugagaagugaucaggaugcuggagaguucagcccugggcggggagcucaagucagguuucuagcccucuucccugugccauccuauacccuacauugggaaagaaacagaccuuaaaauuguccagcuugauggcaucgcggggaagggacuaaguccagauaauguccuccgaggcugcggccucgggggcaggacacaccuccugcgggccuauucaauaaucaguuaaaucacccgaagcacacgcauuuccggggaccgcuccgggcauccuggcuugaggguagagugggcagaggucccuaagggagagguggggcucgggcugaaucccucguuggcggcaccagggucaaguggcuaaccuggcagcacagucacggggaggcccucucucauugggcagaaacuaaguccgaagccgcgccccuccugggcgaggagguuccaccuccuagguuccugugauucuccugccucagcccgaguagugggacaucccacuugcucccgccauucuguuuaccacaggugacgaccgccauggcugacaggcagggaggucccccgaggaccgagcaaggcucgguaucccaaaaaaaaaaaaaaagauacauugaaguaauuuaaaaacacuuaggaagaugucauuucuuccuaucaaggcguccucccuuuauguuuuguuguuauauagggaacgauaaaaaaauuuuuuuuuuuuuuccuaccaauggggcccagguugaccucgaacuccagucccucacacccucgccuagccuugagagcccgagggcaggcucaaucggccggagccacaauggcuccgguugucgggcccauccuuucuucccuuugaucuuacgcagggugauggagccaaucacaagaggcucaucccugacgucacccaguccccagggccagugagggcccugcguuccguggcgcccccuggagggaggaaggggaacugcaucugagagagagcagccaauuggguccgcugacucuggccagguucccgugccgcguccaacaccccucacucccugucucacucccccacggagacucaauuuacuuuccauguccacauucccagugcuugcggaagauaucccgcuaagagagagacaugucaaagguaggguagauccacauuuccgggcaccaaagauggagauguuccaggaaagacugcagggccccugggcaccuuccaccuccuuccaggccaucacuggcaugagaaggggcagacccgugugagcuguggaaggaggccucuuucuggaggagcgugacccccaguaagcuucaggugggucaguuccugagggugcggaucugaaauguugggguaucucagguccucugggcuguggggugggcucugaaaggcagguguccgggugguggguccugaauagaagaugccgggaagggucucugggucuuugugggugguguaccaugcgggaugggaaggccaggacugggggcugcagucucagacccgggugaagcaguguccuugccccagaggcugcugcuguugcugcugcugagcaugggcgggacaugggcauccaaggagccgcuucggccacggugccgccccaucaaugccacccuggcuguggagaaggagggcugccccgugugcaucaccgucaacaccaccaucugugccggcuacugccccaccauggugagcugcccggggccagggcaggugcugccaccucagggccagacccacagaggcagcgggggaggaaggguggucugccucucuggucaggggcugcggaauggggugugggagggcaggaacagagggcuuccuggaccccugagucugagaccugugggggcagcuggggagcucagcugaggcgcuggccccaggcacaugcucauucccccacucacacggcuuccagacccgcgugcugcaggggguccugccggcccugccucagguggugugcaacuaccgcgaugugcgcuucgaguccauccggcucccuggcugcccgcgcggcgugaaccccguggucuccuacgccguggcucucagcugucaaugugcacucugccgccgcagcaccacugacugcgggggucccaaggaccaccccuugaccugugaugacccccgcuuccaggacuccucuuccucaaaggccccuccccccagccuuccaaguccaucccgucucccggggcccuaggacaccccgauccucccacaauaaaggcuucucaauccgcacucuggaggugucuuucugugggcucagggcaaucacacacacaggguggguccagcuuccaaacuauuuuauacagagucacaguacagaacucugguagaaaacaggguggacggcugggcgugguggcucacgccuguaauugucggaggcugcgguggguggaucagcugaggugagggguuccagaccaacaugaccaacauggagaaaccccaucucuacuaaaauuacaaaauaucgucgggcgugguggugcaugccuauacucccagguacuugggaggcuuaggcaggagaaucucuugauccuaggaggcggagguugcagugagccaagaucccgccauugcacuucagccugggcaacaaaaacaaagcuccaucucaaaaauuaguaauaauaauaauaauaauaauaauaauaauauaauuaaaaacguucguccaggcgcaguggcucaugccugcaaucccagcacuuugggaggccgaggcaggugcaucaccugaguucaggacuucgagaccagccuggccaacauggugaaacccugucucuacuaaaaaaaaaaaaaaaaauuagcugggugugguggugcgcgccuguaguuccagcuacucaggaagcugaggcaggagaaucgcuugaacccgggaagcauaggugcagugagccgagaucacgccacugcacuccagccugggugacagggcgagacuccgucucaaaaaaaaauaaaauaaauaaaauaaaaauaaaaauagaaaauaguccacuacuauuacucaauagcaacagaugguaaaauacaggcucagagaaauuaaugauuugugccuggucacacagccaacaaauggcagagaugggacuucaacucugggcaacugcacucugccauccuuccuguagaacucugaggaacugagagucuugcaucuuggaggauguuccaaucaauuuuuuuuuuuuuuuugagacggagucucgcucuguuguugagacuggacugcaguggcgcgaucucggcucacugcaagauccgccucccggguuccugccauucuccugccucggccucccaaguagcugggacuacaggcgcccaccaggacgccuggcuaauuuguuguauuuuuuaguagagacggaguuuccccauguuagccaggauagucuugaucuccugacuuugugauccgcccgucucggcuucccaaagugcugggauuacaggcaugaaccacugcgccaggcccaauuuuguuuguuuguuuuguuguuuugggaaaggguggcauggagaagacugggaaacaaccaguggucaccagagcuguagcaccuccuucaccucugagcucuggggcugggaaccccaggcuucggaggccacuguggaggacgcagguggcccccucuuuccugacaucucaggacagggaggggcaaccggcuaggggaagaaaagaacaggaagguuauacagccagguggggaaggggccaaaucccugaacaaccccuucccagaguuccucuucaagcgcaggguacccaagagucaaggccccgcccccuuuccagaggccccuuuucuacuuaggugacggcuccuggcugggaugggagguagauggaccgggggugggaggggggggaggaggggaagggagaggcaguggaugaaggagaauggaagagaugacaucccccuuggcccauucaucccauucagguccccaagcccccaccuggacugccagugccaaccucagaggguggaagagggagcucggcuuagaaugcugaggcccugcccccugggccacaccaaucguguggccuuccuucuccccacggaaggccagaccauggacaccuccugagcuggaugucaucccccaucuccacccucuuuucuuuuucuuucuuucuuucuuuuuuuuuuuuuuuugagauggagucucgcucugucgugcaggcuggagugcaguggcgcgaucucugcucacugcaaccucccgcucccagguucacugcauucuccugcaagcgcccgccaccaagcccggauaacuuuucguauuuuuaguagagacgggguuucaccguguuagccaggauggucucgaucuccugaccucaugauccgccugccucggccucccaaaguggugggauuacaggcgugagccaccacgcccagccguccacccuguuuucuaccagaguucuguacugugacucuguauaaaaugguuuggaagcuggacccacccugugugugugguugcccugagcccacagaaagacaccgccagagugcggauugagaagccuuuauugugggaggaucggggugucugagggccccgggagucgggaugggcuuggaaggcuggggggaggggccuuugaggaagaggaggccuggaagcgggggucaucacaggucaaggggugguccuugggacccccgcagucaguggugcugcggcggcagagugcacauugacagcugagagccacggcguaggagaccacgggguucacgccgcgcgggcagccagggagccggauggacucgaagcgcacaucgcgguaguugcacaccaccugaggcagggccggcaggacccccugcagcacgcgggucuggaagccgugugagugggagaaugagcaugugccuggggccagcgccucagcugagcuccccagcugcccccacaggucucagacucagggguccaggaagcccucuguuccugcccucccacaccccauuccgcagccccugaccagagaggcagaccacccuuccucccccgcugccucugugggucuggcccugagguggcagcaccugccccggccccgggcagcucaccaugguggggcaguagccggcacagauggugguguugacggugaugcacacggggcagcccuccuucuccacagccaggguggcauugauggggcggcaccguggccgaagcggcuccuuggaugcccaugucccgcccaugcucagcagcagcaacagcagcagccccugggacaaggacacugcuucacccgggucugagaccgcagccccgaguccuggccuucccaucccgcgugguacaccacccacaaagacccagagacccuucguggcaucuccuauucaggacccaccacccggacaccugccuuucagagcccaccccacagcccagaggaucucagauaccccaacauuuuagauccccacccucaggaacugccccaccugaagcuuacugggggucacgcuccuccagaaagaggccuccuuccacagcucacacuggucugccccuucucaugccagugauggccuggaagcagguggaaggugcccaggggcccugcagucuuuccuggaacaucuccaucuuuggugccuggaaaugucgaucuacccuaccuuugacaugucucucucuuagcgggauaucuuccgcaagcacuggggauguggacauggaaaguaaauugagucuccgugggggagugagacagggagugagggguguuggacgcggcacgggaacccggccggagucagcggacccaauuggcugcucucucucagauacaguuccccuuccucccuccagggggcgccacggaacgcagggcccucacuggcccuggggacugggugacgucaggggugagccucuccugauuggcuccaucacccugcguaaggucaaaaggaagaaaggagauccccgacaccccgagcuauuguggcuccgaccgguugcgcgugcccucgggcccucagggaggggaggguucgaggguacgaguucgaggccaaccggguccacauugguugagaaaaaaauuuuuuuaucguucccuauauaauaacaaaacauaaagggaggacgccuugauaggaagaaaugacaucuuccuaaguguuuuuaaauuacuucaauguaucuuuuuuuuuuuugggagaccgaggcuugcucgguccucgggggaccucccugccugucagccauggcggucgucaccugugguaaacagaauggcgggagcaagugggaugucccacuacucgggcugaggcaggagaaucacaggaaccuaggagguggaaccuccucgcccaggaggggcgcggcuucggacuuaguuucugcccaaugagagagggccuccccgugacugugcugccagguuagccacuugacccuggugccgccaacgagggauucagcccgagccccaccucucccuuagggaccucugcccacucuacccucaagccaggaugcccggagcgguccccggaaaugcgugugcuucaggugauuuaacugauuauugaauaggcccgcaggagguguguccugcccccgaggccucagccucagaggacauuaucuggacuuagucccuuccccgcgaugccaucaagcuggacaauuuuaaggucuguuucuuucccaguguaggguauagguuggcacagggaagagggcuagaaaccugacuugagcuccccgcccagggcugaacucuccagcauccugaucacuucucauugaaccuugcuuauacuccccgugugaucgguagcucuuuaucucaaaacaaaauauucuaagccgaccccugcccacucucaccaaguaagauuucucauuugaaccccagcucccagauacuuaaaggccuucuguagaccauguccucaagguccccuggccaucugcuugcauguuccaguuucccuccucccccaugcacaucgugaaaugugcccucccacuccccaggaugagcaaggugguguccucugugacugagcagucagcaacuuaacaccaaaggucaccaaugaucaaauccaugagaguugauccgaggaguuauguauuagggcuacgaaagaguaaacacucaguaaauaguggcuauuauuauuaucaucaucaucaugauuacccucaaguuccccugggagagcuccuauucaaccuucaaaaccccacguuguugcacccauccuacagagauugagcucaaauucagagaguugugauuuugcgaugauuugaugaguuccccaacugggguccguccguagagcagcugggccaacccugaggucucucagcauccagcucuguucuuuuucugccugaccaguuccuggguauaagucucaggcccggccaguccggcugaggagugugcagacacaggcugugccaguuugaauccaucgccaguccacacggcccugggcaucagcggucaaugcccgcacauaggacugcuuggccuugcacucagacacccagugccccccgguccacaccccagcggcagccccuccaccuaccccugggccaccuucuucagaguuaucggccuugaagcaggugacaaagaaguguugguggagggaacugcugccagcugcaggcaccucacccaacaccuccaccucgagcacaaccaaguccacagcgguccgggggucugucacccagacacugacugcaucgcacacggccagcucacccugaugacucgccggugaaguaucgcucaccccucgcuggcugcgguuggcccgggugccugcugacucccaaaaggccccagucuccagcaggaagaccagagggggcccggcagcggcaccccuagacaggaccacuugggggaaaauaaggucccacucuggaggaggaaaaggggacaaugucaaggguggggguuaggacuccauugacacacuggggaggaagcaaaugagggggaugcagagggagccugggggagcgggagcaucucucagaggacauggaaacagggaaaaggaggcugggauuagagaagaggauaaacacuucagugaggucagaaguugggaaccccaggggaggccugccugccaggauuauggggaagcccuugcucuagaaguuugggggacuccauguaugggacuugcaucacacccaacuuguagauuaauaauaaauauucaacaacuacaggucaggcacuauggcucacaccuguggucccagcacuuugggaggcugaggcggguguuugacuugaggucaggaguucaaaagcagccuggccaacacugugaaacaacaucucuacuguuaauaccaaaauuagcugggcguggugcugcgcuccuguaaucccaccacuuugggaggcccaggcgggcggaucauguggucaggggaucgagaccuuccuggcuaacacggugaaaccccgucucuacuaaaaauacaaaaacuuaucugggcuuggucgcgggccccuguaguccaagcuacuuggaaggcugaggcaggagaauggagugaaccuaggagggggagcuugcagugagcagagaucgcgccacugcacuccagccuccacgacagagcgagacuccaucucaaaaaaaaaaaaaaaaagaaagaaagaaagaaaaagaaaacaggguggagaugcaggaugaccuccagcucaggagguguccauggucuggccuucuguggggagaaggaaggccacgugaucgguguggcccagguggcagggccucagccuucuaagccgagcucccucuuccucccucugauguuggcacuggcagugcagguggggcggagaggggcgcggcuuggggaccugaaugggaugaaugggccgagggggaugucaucucuuccauccuccuucauccacugccucucccuuccccuccuccccccuccccuccguccaucugccucccaucccagcuaggacccaucaccuggguagaaaaggggccucuggaaagggggcggggccuugacucuuggguacccugcacuugaagaggaacucugggaagggguuguucagggauuuggccccuuccccaccuggcuguauaaccuuccugugcuuuucuucugcuagccgguugccccucccucuccugagaugucaggaaagagggggccaccugcguccuccacaggggccccgaagccugggguucccagccccagagcucggagguggaggaggugcuacagcucuggugaccacugguuguuucccagucuucuccacgccaaccuuucccagaaccacaggcuuccagaauguuguagggaaacugcaaaauccgcgccuccaccagccucucccagcgccaggucaauuucacacacagggaaacugaagccugccucagaggggcagcguuuuaccuccuuaguggcaguuuugaggugaaucggggucucccuaggauuccagguugugcacuuucucuaaauuguggaauguggccaggcgugguggcuugagucuguagucccagcuacucaggagccacagcaggaggauggcuugagcccaggaguucaagugcaguggggaaacauagggagaccucgucuuaaagcaauuuguuuggggccaggcgugguuucucaggccuauaaucccagcacucugggaggccagggcaggaguaucacuggagguugggaguuugagaccagucuggccaauguugugaaacugcaucucuacuaaaaauacaaaaauuagcagggcacgguggcaggcgcuuguaauuccaguuacucagaaggcugaggcaggagagucacuugaacccaggaggcaggcgcuacagugagccaggauugugccacuguacuccagccuggccagacagagugaggcucugucucaaaaaaaaaaaaaaaaaaauugggccgggugcaguggcucaugccuguaaucccagcacuuugggaggccgaggcaggcagaucacaaggucaggagaucaagaccauccuggcuaacacggggaaaccccgucucuacuaaaaaauacaacaaauuagccaggcauaguggugggugccuguagucccagcuacucgggaggcugaggcaggagagugguguaaacccgggagguggaccugcaguuagccgagaucgcgccacugcaguccagccugggcgacaagugagacacccccucaaaaaaaaauugauuggaacauccuccagggugcaagacccucgguuccucagaguucuacaggaaggauagcagagugcaguugcccagaggugaagucccaucucugccauuuguuggcugugugaccaggcacaaaucauuaauuucucugagccuguauuuuaccaucuguugcuauugaguaauaguaguugaauauuuucuacuuuuauuuuuauuuuauuuuuauuuuuauuuuuuuugagacggagucuggcccugucaccuaggcuggagugcaguggcgcgcucucggcucacuacaccucugcuucauggguccaagcgauucuccugccucagccuccugaguagcugggaguacaggugcgcaccaccauacccagcuaauuuuuguguuuuuuuuuuaguagagacagggauucaccauguuggccaggcuggucucaaagucuugaccucaggugaugcacccaccucggccucccaaagcgcugggauugcaggcgugaaccacugcacccggccgaacauuuuuaucuuuauuuuaugauuauuauuauuauuuuuuuaagauggagcuuuguuuuuguugcccaagcugaagugcaauggcgcgaucuuggcucacugcaaccucugccuccugggaucaagugauucuccugccuuagccucccaaguagcugggauuauaagcaugcagcaccacgcuggaggauauuuuguauuuuuaguagaggugcgguuucucuauguuggucaggcuggucuggaacuccucaccucagcugauccacccacugcagccuccgacaaugcuggcauuacaagugugagccaccaugcccggccuuauuuuuauuuuuauuuuuuuugugagacagagucucacucuguuguccaggcggaagugcaguggcaccaucuuggcucacugcaaucucggccucccggguucaagcgauucuccugccucagccuccugaguagcugagaccacaggcgugcagcaccaggccuggcuaauuuugguauuaucaguagagauguuguuucacaguguuggccaggcugcucucgaacuccugaccucaagucauccacccgccucagccucccaaagugcugggauuacaggugugagccauagugccugaccuguaguuguugaauauuuauuauuaaucuacaaguugggugugaugcaaguccuauauauggagucccccaaacuucuagagcaagggcuuccccauaauccuggcaggcaggccuccccugggguuuccaacuucugaccccacugaaguguuuauccucuucucuaaucccagccuccuuuucccugucuccaugugcucugagagaugcucugagagaugcucccacucccccaggcucccuccgcaucccccucauuuuccuccuccccagugugucaauggaguccuaaccccauccucgacauugucgccuuuuccuccuccagagugggaccuucuuuucccccgagugguccugucuaggggugccgcugccgggcccccucuggucuuccugcuggagacuggagccuuucgggagucagcaggcgcccgggccaaccgcagccagcgaggggugagcgauacuucaccggcgagucaucagggugagcuggccgugugcgaugcagucagugucugggugacagaccccuggacugcuguggacuugggugugcucgagguggagguguugggcgaggugccugcagcugucggcaguucccuccgccagcacuucuuuguugcccacuucgaggccgauaaaucugaggaagguggcccggggguagguggagggggcugccgccgggguguggaccggggggcacugggugucugagugcaaggccaagcaguccuaugugcgggcauugaccgcugaugcccagggccguguggacuggcgauggauucaaacuggcacagccugugucugcacacuccucagccggacuggccgggccugagacuuauacccaggaacuggucaggcagaaaaagaacagagcuggaugcugagagaccucaggguuggcccagcugcucuacggacggaccccaguuggggaacucaucaaaucaucacaaaaucacaacucucugaauuugagcucaaucucugcaggaugggugccaccacaugugguuuugaagguugaauaggagcucucccaggggaacuugaggguaaucaugaugaugaugaugaugaugauaauaauaauagccacuauuuacugaguguuuacucuuucguagcccuaauacauaacuccucggaucaacucucauggauuugaucauuggugaccuuugguguuaaguugcugacugcucagucacagaggacaccaccuugcucauccuggggagugggagggcacauuucacgaugugcaugggggaggagggaaacuggaacaugcaagcagauggccaggggaccuugaggacauggucuacagaaggccuuuaaguaucugggagcugggguucaaaugagaaaucuuacuuggugagagcaggcagggguuggcuuagaauauucuguuuugagauaaagagcuaccgaucacacggggaguauaagcaagguucaaugagaagugaucaggaugcuggagaguucagcccugggcggggagcucaagucagguuucuagcccucuucccugugccaaccuauacccuacauugggaaagaaacagaccuuaaaauuguccagcuugauggcaucgcggggaagggacuaaguccagauaauguccuccgaggcuucggccccaugggcaggacacaccuccugcgggccuauucaauaaucaguuaaaucaccugaagcacacgcauuuccggggacagcuccgggcauccuggcuugaggguagggugggcggaggucccuaagggagagguggggcucgggcugaaucccucguuggcggcaccagggucaaguggcuucccuggcagcacagucacggggaggcccucucucauugggcagaaacuaaguccgaagccgcgccccuccugggagguuggacuguggugcaggaaagccucaaguagaggaggguugaggcuucaguccagcaccuuucucgggucacggccuccuccuggcucccaggaccccaccauaggcagaggcaggccuuccuacacccuacucccugugccuccagccucgacuagucccuagcacucgacgacugagucucugaggucacuucaccguggucuccgccucacccuuggcgcuggaccagugagaggagagggcuggggcgcuccgcugagccacuccugcgccccccuggccuugucuaccucuugccccccgagggguuagugucgagcucaccccagcauccuaucaccuccugguggccuugccgcccccacaaccccgagguauaaagccagguacacgaggcaggggacgcaccaaggauggagauguuccagguaagacugcagggccccugggcaccuuccaccuccuuccaggcaaucacuggcaugagaaggggucagaccagugugagcuguggaaggaggccucuuucuggaggagcgugacccccaguaagcuucagguggggcauuuccugaaggugcggaucugaaauguugggguaucucagguccucugggcuguggggugggcucugaaaggcagguguccgggugguggguccugaauaggagaugccgggaagggucucugggucuuugugggugguguaccacgcgggaugggaaggccaggacucggggcugcggucucagacccgggugaagcaguguccuugucccaggggcugcugcuguugcugcugcugagcaugggcgggacaugggcauccaaggagccgcuucggccacggugccgccccaucaaugccacccuggcuguggagaaggagggcugccccgugugcaucaccgucaacaccaccaucugugccggcuacugccccaccauggugagcugcccggggccggggcaggugcugccaccucagggccagacccacagaggcagcgggggaggaaggguggucugccucucuggucaggggcugcggaauggggugugggagggcaggaacagagggcuuccuggaccccugagucugagaccugugggggcagcuggggagcucagcugaggcgcuggccccaggcacaugcucauucccccacucacacggcuuccagacccgcgugcugcaggggguccugccggcccugccucagguggugugcaacuaccgcgaugugcgcuucgaguccauccggcucccuggcugcccgcgcggcgugaaccccguggucuccuacgccguggcucucagcugucaaugugcacucugccgccgcagcaccacugacugcgggggucccaaggaccaccccuugaccugugaugacccccgcuuccaggacuccucuuccucaaaggccccuccccccagccuuccaagcccaucccgacucccggggcccucggacaccccgauccucccacaauaaaggcuucucaauccgcacucuggaggugucuuucugugggcucagggcaaccacacacacacaggauggguccagcuuccaaaccauuuuauacagagucacaguaugagaacucugguagaaaacaguguggggucgggggaugacaucgcaacuuuacucuacauugggaaagaaacagaccuuaaaauuuuccagcuugauggccaggugcgauggcugaugccuguaaucccagcacuuugagaggccaagacaggcgaaucaccugagguuaggaguucaagaccagccugguuaacauggugaaaccccgucucuacuaaaauuacauaaagaaauuagcugggcguguaggcgggugccuguaaucccagcuacucuggagggugaggcaggagaaucgcuugaacccgggaggcggagguugcagugagcggagacugugccauugcacuccagccugggcaaaaagagggaaaguccgucucaaaaaaaaaaaaaaauuguccaguuugagugggacaugagguucugacuaacucgccgucccccuggcuaggaucaggggguuauucgucauugagagcccuugaguagggucagcaaaauccaacagaagggccccagaagcaugauucagggaggaacaguaagugggauugugggccuggcugcagaaggcagccucagguuuccuugucugaagaaugggcucgugggaugagauaaugaggguugaggaggcagaggccuagaccaaaagcuauuuuuuuuuuuuuuuuugagauggagucuugcucuguccccuaggcuggagugcaguggcaugaucucagcucacugccaccuucaccuccugaguucaagugauucuccugccuuaguugggauuacaggugugcgccaccaugccuggcuacuuuuuauauuuuucgauagagacaggguuuugccauguuggccaggcugguuucaaacuccuaaccucaaguuaucugcccgccucugccucucaaagugcugggauuacaggagugagucaucgugcccggugaccaaaagcucuauauggugaagaaaugacaagggaagccagggacagaccacaggaguucacaguagcccuucaccuaugaccccuauuacccaucucccuacauguguugccaacacacagacauacagacacacacacacucacucucucucucucucucugguccacaggacuucacaauagcccuucaccuauuacccaucuccccacauguguugccaacacacagacagacacacacacacacacacacucugucucucucucucucucucucuuucucucugucugggacagaccacaggacuucacaauagcccuuuaccuauuacccaucuccccacauguguugccaacacacagacacagacacacacacacacucucucucucucacuuucucucccccucucucucucucagguccagcuuugagcaaaggacauaggcacccccuccaccaaucuguacagaccaggccccucggcagggagggguguggcugccuccguuucuacaucuccuuguuaccaucucugauuuugcucuuuuuugccgccuuucucucugucucuaacuuccgguggcucuagccucugggugaguacuaauagcuccguuuccagcguggucugugucuuccucccugucucucuccucucuuguauuucuuucucacucaucaaagcccauguuuuucgcuaugguccggugcacuucucugugggugccucccuguuuccacaccccgccuacccagguggaacuuuucaagccaaucaaaggcaggcaggacagccaaugcuagugcugauuacuucagcacgugcaugcagggagggucggggagccccggggaugucuggaaaucguuacccugaggugggcaggccugguagagggaggaagcagccaggagcaucugggcccuggaagaaagggggguguuucucauggauguccugaguugcuaggugcagcgcaggggucucugucucucugucuggaucucugacaccuccaggucccugucccucuuuuuggguuucucucucccccacccccugggucucugaaauacugaacuucuccuucccuuuccacccuccuaucuuugagucuccauucccccuccuuguguuucuuuguaccccucuuggggucccugucucugggucucuuucucauuccauccauccaggugccugcaggcccuugauugacuagguucugggugggcggguucugucaccuggggcaacaaccacaauaagccagcuccugcuuggcuacggaguggggguggaaccauggccaguggcacccuggcuccgggcugucguaucucugcaaccgagguaccuggauccaggcccaacugccaucucaccagcagcuacuuuucccaccgcauuaucccacccauacccuucaccccgcccacggugcaggugagcggacccuacgcugcagcccugccgggccuggagacccagaaagauaggggcuaaauaaagcggauugggagcuuggacuccucucugaaggaggaggguccuggaguucugggucugagagaggaggcaccagggaagcugaaugccagggacugcagaggaaagggcugggggccgacuggaagaggucagaguuugg

SEQ ID NO: 175318 - RNA, 98 nt, Homo sapiens
cacggucgcggacccucuaccccaaguugcaaagcaggauucucacaacugggcuuucgacgagguccucagcagaugggagacaaccucuggcucgg

SEQ ID NO: 175319 - RNA, 51 nt, Homo sapiens
gugaaggagcaggggacucaaaugcagucccccgcccuguccccugcggac

SEQ ID NO: 175320 - RNA, 27 nt, Homo sapiens
uggggcgggaucgcgagguuagaggag

SEQ ID NO: 175321 - RNA, 127 nt, Homo sapiens
gaaguaaaaggggacuuucgcuuccuugggaaggaguaucugggggcucaaguaccgaaggaggcccugcccucagauccggaauccccucgagccgcugugcaggcuuccugucccuaccgcgguu

SEQ ID NO: 175322 - RNA, 39 nt, Homo sapiens
acagaggcagcgggggaggaaggguggucugccucucug

SEQ ID NO: 175323 - RNA, 53 nt, Homo sapiens
ugguugggaagcugcacccacccuguguaugugugguugcccugagcccacag

SEQ ID NO: 175324 - RNA, 43 nt, Homo sapiens
aaggcgagaccauggacaccuccugaguuggaugucauccccc

SEQ ID NO: 175325 - RNA, 43 nt, Homo sapiens
gcuggaccggcugcuuaucgucuccaccacccccuacagcgag

SEQ ID NO: 175326 - RNA, 82 nt, Homo sapiens
ugacacaggggagaucaagucagaaguccgugagcagaucaaugccaagguggcugaguggcgcgaggagggcaaggcggag

SEQ ID NO: 175327 - RNA, 45 nt, Homo sapiens
ccagaaacgcaaggagguggugcacaccgugucccugcacgagau

SEQ ID NO: 175328 - RNA, 41 nt, Homo sapiens
guagggacgugaucaccaucgacaaggcgacgggcaagauc

SEQ ID NO: 175329 - RNA, 74 nt, Homo sapiens
cuccaaggugggcaaacugacccucaagaccacagagauggagaccaucuacgaccugggcaccaagaugauug

SEQ ID NO: 175330 - RNA, 45 nt, Homo sapiens
aucaucgaaggggaggugguggagauccagauugaucgaccagca

SEQ ID NO: 175331 - RNA, 45 nt, Homo sapiens
cgaggcgcugacgcaggccuuccggcgguccaucggcguucgcau

SEQ ID NO: 175332 - RNA, 57 nt, Homo sapiens
cccugggcccugacacgccauucacagccaucgccggcagugaaaucuucucccugg

SEQ ID NO: 175333 - RNA, 48 nt, Homo sapiens
cagcuggcggcacggcgggcggcuggcguggugcuggagaugauccgg

SEQ ID NO: 175334 - RNA, 50 nt, Homo sapiens
gaggaugcuggaggcccugacuccugggucugagggaggggggaucuggg

SEQ ID NO: 175335 - RNA, 78 nt, Homo sapiens
acgcccccacaauauuuacauauuuaugaggaaccaucgagaucuuugaagaaccagcuagccuagaggagccagaac

SEQ ID NO: 175336 - RNA, 57 nt, Homo sapiens
caaucggccugagcggggcggugguggggcugagcaaaaggaggaggagccaggaga

SEQ ID NO: 175337 - RNA, 56 nt, Homo sapiens
ugucaaucuggagcuggaggccucaaaguggggaggaggaggagggugggauaaag

SEQ ID NO: 175338 - RNA, 42 nt, Homo sapiens
uagccccguccuccuacaacucagaguuccgggcccccaucc

SEQ ID NO: 175339 - RNA, 42 nt, Homo sapiens
uccauucgcccaugucugggauccacccacccacuuccaggc

SEQ ID NO: 175340 - RNA, 34 nt, Homo sapiens
ccucuuaaaaccuagaagggggucaaaaccaggu

SEQ ID NO: 175341 - RNA, 43 nt, Homo sapiens
cugucuccacgaguguugggaaaagaaucggcaauccccagua

SEQ ID NO: 175342 - RNA, 62 nt, Homo sapiens
guccaacgccugccaaccacucauggaagugagcaaccacauguggcuucuccucacucugu

SEQ ID NO: 175343 - RNA, 45 nt, Homo sapiens
cuccagguuguuguagaaguccacggcaccggcacacagguagcg

SEQ ID NO: 175344 - RNA, 44 nt, Homo sapiens
gaucugccucuccccugcuuccuuguccacguugaacugggugg

SEQ ID NO: 175345 - RNA, 42 nt, Homo sapiens
ugguuuccucuugagcaagugcugugccucgauggcggugau

SEQ ID NO: 175346 - RNA, 44 nt, Homo sapiens
aaagaaaguaagauucugagaaaggaccacuuaggcacacaagu

SEQ ID NO: 175347 - RNA, 32 nt, Homo sapiens
agcaacccucguggcagaauaagccacagaaa

SEQ ID NO: 175348 - RNA, 24 nt, Homo sapiens
gggugagcugaggaccucacaguc

SEQ ID NO: 175349 - RNA, 42 nt, Homo sapiens
gcccuccccucucaacugcaaaccaagcggugcagacacagc

SEQ ID NO: 175350 - RNA, 39 nt, Homo sapiens
cuucaaagaugaggacuccggcaggugacguggcaauag

SEQ ID NO: 175351 - RNA, 81 nt, Homo sapiens
uggccucaucugacacugcuccgcauccugcuguguguccuguuccauguuccgguuccauccaaauacacuuucuggaac

SEQ ID NO: 175352 - RNA, 89 nt, Homo sapiens
uccaggaggaggcuggcgaugagauggcuggaagccagggguucagggaggcccaggcuccugguaucaggguucaccggcuauacuga

SEQ ID NO: 175353 - RNA, 69 nt, Homo sapiens
ccggugaacccugauaccaggagccugggccucccugaaccccuggcuuccagccaucucaucgccagc

SEQ ID NO: 175354 - RNA, 86 nt, Homo sapiens
cucauuaaucaaccagaagcuuggcccggagcagcagcggggauuccaguagcugugggcauacaggaugcuagggcggccacaac

SEQ ID NO: 175355 - RNA, 42 nt, Homo sapiens
agccggugaccagaaggagguggacacuucagaaaagaaacu

SEQ ID NO: 175356 - RNA, 45 nt, Homo sapiens
guuucuuuucugaaguguccaccuccuucuggucaccggcuggag

SEQ ID NO: 175357 - RNA, 71 nt, Homo sapiens
ccaaggcccagcgccucagccaggagacagaggcucuagggcggucccagggccgccuggaggcccagaag

SEQ ID NO: 175358 - RNA, 89 nt, Homo sapiens
gcagacaguggagaugcacccugccuacaccgaggaagagcugaggcgcuuugaagaggagcuggcugcccgggaggcagagcugaaug

SEQ ID NO: 175359 - RNA, 46 nt, Homo sapiens
uccacucagaggaaggaguuuggggacaccggggagggcugggagg

SEQ ID NO: 175360 - RNA, 60 nt, Homo sapiens
ccuuccucugaguggaugcgaggaacuccuccagggucacgaggcgguccugguuggugu

SEQ ID NO: 175361 - RNA, 56 nt, Homo sapiens
ccgcaugcgcagucgcuccuccuccaucucccgcaugucguccuccucauucuuug

SEQ ID NO: 175362 - RNA, 46 nt, Homo sapiens
agaaaguguacgacccaaagaaugaggaggacgacaugcgggagau

SEQ ID NO: 175363 - RNA, 46 nt, Homo sapiens
accuccuuggugaagagugccuccagcuccugcucauccaggacac

SEQ ID NO: 175364 - RNA, 45 nt, Homo sapiens
caugcaguaugaagaaggucuugggguuaaaccuguuggggucca

SEQ ID NO: 175365 - RNA, 86 nt, Homo sapiens
gacggcguuaucuggagucacugggagaggagcagagaaaggaggcggagaggaagcuggaagagcaacagcgccggcaccgcgag

SEQ ID NO: 175366 - RNA, 46 nt, Homo sapiens
cccaguacgacgcagcccaucaugaagaguucaagcgcuacgagau

SEQ ID NO: 175367 - RNA, 48 nt, Homo sapiens
uugaacucuucaugaugggcugcgucguacugggcaaggucccgggug

SEQ ID NO: 175368 - RNA, 48 nt, Homo sapiens
ucugaaucuccugaaacaguuugaacaccuggacccucagaaccagca

SEQ ID NO: 175369 - RNA, 44 nt, Homo sapiens
agggcugugagcaggggaggggugggucagcucuggguguagaa

SEQ ID NO: 175370 - RNA, 46 nt, Homo sapiens
auuuccgagagaagcugcaggcugccaaugcggaggacaucaaggu

SEQ ID NO: 175371 - RNA, 25 nt, Homo sapiens
cacaccucagagucagggaccucca

SEQ ID NO: 175372 - RNA, 74 nt, Homo sapiens
cccucgcuccagggggacagccagcacggcgcgaagcaggagcagcagcagcagcggcaacagaaggaggguuc

SEQ ID NO: 175373 - RNA, 52 nt, Homo sapiens
gcaccggagguccuugcccgcccuggaaaacgcccucugcggugaaggagag

SEQ ID NO: 175374 - RNA, 59 nt, Homo sapiens
ccuaugccaaaagagagagaaggcuuucaaagauaacuacaacucccugccggccgggg

SEQ ID NO: 175375 - RNA, 63 nt, Homo sapiens
auggauggugacuguguauaugaaaacuuggccuuccaaaagguaggaaaaugcacaaucacu

SEQ ID NO: 175376 - RNA, 29 nt, Homo sapiens
gcccccaccucccaggcaaaaucccacuc

SEQ ID NO: 175377 - RNA, 45 nt, Homo sapiens
gccucggaaaaugacugugauucucccaggaaccaacagccagaa

SEQ ID NO: 175378 - RNA, 59 nt, Homo sapiens
gggaagguguggccacagcuuggcucaagggcguggucuggacuggggacgaagggaca

SEQ ID NO: 175379 - RNA, 41 nt, Homo sapiens
agcaagcugcucccaggggcccuggcgggcggccugggccg

SEQ ID NO: 175380 - RNA, 46 nt, Homo sapiens
auagacccaggacuucaagaagacaccuguagcaggaguggaagag

SEQ ID NO: 175381 - RNA, 49 nt, Homo sapiens
auacacccaggccuucaagaaagcacuugcaggggguguggaagcagaa

SEQ ID NO: 175382 - RNA, 55 nt, Homo sapiens
auacacccaggccuucaggaaggcacuugguggggggaugcagggaggacacuca

SEQ ID NO: 175383 - RNA, 42 nt, Homo sapiens
caguccugcgcuuccggccgcgcgaggaggaggcgcugcugg

SEQ ID NO: 175384 - RNA, 43 nt, Homo sapiens
cagguucucuggggaagggacugggaccagagaggggauagaa

SEQ ID NO: 175385 - RNA, 27 nt, Homo sapiens
uugggagaucuugggagacuccugaaa

SEQ ID NO: 175386 - RNA, 61 nt, Homo sapiens
cucccuguggggaggagaggaaagcuggaaguccuggagggacagggucccagaaggaggg

SEQ ID NO: 175387 - RNA, 36 nt, Homo sapiens
cuuaagccacuguagauggaacuacaacucccagca

SEQ ID NO: 175388 - RNA, 43 nt, Homo sapiens
acuggaucccagggcugguaucugcugagugggcuguggucug

SEQ ID NO: 175389 - RNA, 67 nt, Homo sapiens
uuggagggaggagcuauugaacccacuggggaugggcaugaauagaggcuggggaauggggugcuga

SEQ ID NO: 175390 - RNA, 45 nt, Homo sapiens
aaggaggggaccuccagacacauugaccacaggucggggugcagg

SEQ ID NO: 175391 - RNA, 45 nt, Homo sapiens
ccuguggucaaugugucuggagguccccuccuuuacagccaccga

SEQ ID NO: 175392 - RNA, 38 nt, Homo sapiens
guagaguuccugguugaagugaaugagcugcaccuggg

SEQ ID NO: 175393 - RNA, 45 nt, Homo sapiens
aggauccaggugacagucucggagcagggcggggugcugagagag

SEQ ID NO: 175394 - RNA, 44 nt, Homo sapiens
gagccucagcgguaacagccggccccugcagcccuuggcccaca

SEQ ID NO: 175395 - RNA, 43 nt, Homo sapiens
cgccugcaugguaugguccagucugcacccccucuaagucuug

SEQ ID NO: 175396 - RNA, 35 nt, Homo sapiens
cugcaggggaccagcaagcccaaagagccggccag

SEQ ID NO: 175397 - RNA, 45 nt, Homo sapiens
acucagguguuuaggccccuagaucccuuagcgcccaggacccaa

SEQ ID NO: 175398 - RNA, 66 nt, Homo sapiens
gggaaggggguacagcgcgcaggggauggggguuggguaauuacagugaaauuacagagcugucau

SEQ ID NO: 175399 - RNA, 84 nt, Homo sapiens
cugcagccacaaccccugggccaggccuggagacugcgggcccggcggaugccccggcuggggcaguggugggcggaggguccc

SEQ ID NO: 175400 - RNA, 45 nt, Homo sapiens
accguggagguguugaugaccuuugaacccgacccagcugaucuu

SEQ ID NO: 175401 - RNA, 62 nt, Homo sapiens
cuagggacuggauuuacccucacaagcaggaacugggcuuuaauuaaauaguggaguagaga

SEQ ID NO: 175402 - RNA, 48 nt, Homo sapiens
ggcaaugugcagggcagggcagugcucuucauugggagaagcccucag

SEQ ID NO: 175403 - RNA, 45 nt, Homo sapiens
gagccggcgguacaagaacaacgaggcagccaagcggucccguga

SEQ ID NO: 175404 - RNA, 47 nt, Homo sapiens
uucccuuccugcccuguggcccacgggccggccagcugggugcccca

SEQ ID NO: 175405 - RNA, 45 nt, Homo sapiens
gaggugaagacagcaguggguccggggacagcggagcauccccag

SEQ ID NO: 175406 - RNA, 42 nt, Homo sapiens
ccagggcaggcuggggcaggggaagaggcaggucagacacag

SEQ ID NO: 175407 - RNA, 46 nt, Homo sapiens
gcaggcuaugggcaggggugggcgaggcagguuccacaguggcggg

SEQ ID NO: 175408 - RNA, 56 nt, Homo sapiens
gcccagggcuggcucaaaucuucacagccggagauggacggacacacagaaggaag

SEQ ID NO: 175409 - RNA, 47 nt, Homo sapiens
aauggauagugggauuggauaugcagaaacagacaugcaaagacuga

SEQ ID NO: 175410 - RNA, 43 nt, Homo sapiens
gggagacuggccgccaucgugggugagggccgacgcgcagcgg

SEQ ID NO: 175411 - RNA, 38 nt, Homo sapiens
gcuacacgcaucucgcucccagaucccuuucuuccgga

SEQ ID NO: 175412 - RNA, 55 nt, Homo sapiens
gggacuguucucccagauccgccacuccccauguccccauguccuucccccacua

SEQ ID NO: 175413 - RNA, 39 nt, Homo sapiens
aggggucacuggaucagagccaggccuucuagagaacaa

SEQ ID NO: 175414 - RNA, 42 nt, Homo sapiens
aagauggugaagccugacagcgccgugcugaccaggagcccu

SEQ ID NO: 175415 - RNA, 45 nt, Homo sapiens
cugccgaaggucccagaucuugagggccccaucauccccgccacu

SEQ ID NO: 175416 - RNA, 42 nt, Homo sapiens
acgcucuguggaggaccugcaguggucaccgacugagaacac

SEQ ID NO: 175417 - RNA, 45 nt, Homo sapiens
cucuggcuccaucaacuuacacacuagugggggaagggaacgaga

SEQ ID NO: 175418 - RNA, 46 nt, Homo sapiens
auuuguuuuuugcuucaaagcuaaaacaucuucugaucagguagac

SEQ ID NO: 175419 - RNA, 33 nt, Homo sapiens
ccuguguccauaacucccaacaccuccucaugu

SEQ ID NO: 175420 - RNA, 47 nt, Homo sapiens
ccccacccucagagggcagugaugaagaagaagaggaggaagaugaa

SEQ ID NO: 175421 - RNA, 51 nt, Homo sapiens
uggggucuaagagaagugauuucauaccggaggcgguugauccaugaggga

SEQ ID NO: 175422 - RNA, 49 nt, Homo sapiens
ucggcuuccauggguuccccgguuucacacgugcgccgccgacccuugc

SEQ ID NO: 175423 - RNA, 46 nt, Homo sapiens
cccucgcccuggucagcggcaucaucuacauccaccuacggaagcg

SEQ ID NO: 175424 - RNA, 46 nt, Homo sapiens
gaucuaugccauucacgccgaggagauccuggagaagcacccgcga

SEQ ID NO: 175425 - RNA, 339 nt, Homo sapiens
aggggacggagucucaagagguuggcacaggccaggcacacucacgccuauaaccccagcacuuugggaggccgaggcgggaggaucaccugaggucaggagaucgagaccagccuggccaacauggugaaaccccaucucuacuaaaaauacaaaauuagcugggugugguggugcacaccuguaaucccagcuacucgggaggcugaggcaggagaaucacuggaauccaggaggcaaagguugcaaugagccaagaucaugccauugcacuccagccugggugacagagaaagacuccgucucaaaaaaaaaaaaaaauuuggcauaaaggcaggu

SEQ ID NO: 175426 - RNA, 75 nt, Homo sapiens
cucuggguuacauacaggccagauagugaaaauucaaguugagaccccacccugcaccccgacaucaggauugag

SEQ ID NO: 175427 - RNA, 45 nt, Homo sapiens
ucaagugcuaagagaucacuuauuaaauuaaaaggauuuccaaga

SEQ ID NO: 175428 - RNA, 53 nt, Homo sapiens
agaaacgggagcaagagagaaggaggcccagacagugagggcaggagggagag

SEQ ID NO: 175429 - RNA, 80 nt, Homo sapiens
gcucucaauuuaucagaguucugggcaccugguccccucccaagagacucguguacauaguagucaucaccccgacccua

SEQ ID NO: 175430 - RNA, 41 nt, Homo sapiens
gucucuucaucugaaaaauagagauaauaguaaauacauua

SEQ ID NO: 175431 - RNA, 44 nt, Homo sapiens
aaucaaguucccugagugggaucggcgccaggcuuggguacccu

SEQ ID NO: 175432 - RNA, 60 nt, Homo sapiens
cggugcugcggagcccugagaggugcacggcugugaggccugagaggggcgugccguagg

SEQ ID NO: 175433 - RNA, 45 nt, Homo sapiens
cccaaggaggucaucgaucaugcugcugucgcaaugggccuuggu

SEQ ID NO: 175434 - RNA, 30 nt, Homo sapiens
gagggaaaagcagugucaggagcagagaga

SEQ ID NO: 175435 - RNA, 42 nt, Homo sapiens
ucguggugggcugcgguggcuucgucaagucggacguggaga

SEQ ID NO: 175436 - RNA, 103 nt, Homo sapiens
uuuuauuucuccggcuccccuccacuucugaaaauggagaguugccagcugcccugauugccuuaaugaguaguuaauggaauuacccuagagauuugugcug

SEQ ID NO: 175437 - RNA, 42 nt, Homo sapiens
uguuaaauguuuaucagcccggugggauuaugacccagaaag

SEQ ID NO: 175438 - RNA, 33 nt, Homo sapiens
uuuugggaggggauuuauggugggguaggacaa

SEQ ID NO: 175439 - RNA, 23 nt, Homo sapiens
agggcauuucagaagcugaaaug

SEQ ID NO: 175440 - RNA, 34 nt, Homo sapiens
ugugugugugugugugugcauguacgcgugcaag

SEQ ID NO: 175441 - RNA, 69 nt, Homo sapiens
cagcuauuacugccugucucuuaagauaauugugaggauuaaaggcacucagcucagugccuggucggu

SEQ ID NO: 175442 - RNA, 51 nt, Homo sapiens
auaugaaaagaauuuaugguuccuccaggacuagaugaagaaccaauggug

SEQ ID NO: 175443 - RNA, 55 nt, Homo sapiens
caguccccucauaguugcuggcuacaaugugucuggcucuguccgaagugauggg

SEQ ID NO: 175444 - RNA, 52 nt, Homo sapiens
gagcccaugaaaggcgugaaguuucuucucuuuucuucuuuaguaacuaaag

SEQ ID NO: 175445 - RNA, 47 nt, Homo sapiens
uccugggcugcaaugucucaccagugccuggguuccagccccaagac

SEQ ID NO: 175446 - RNA, 53 nt, Homo sapiens
gauuaccuuugauguggcgccuuccagacuugacuucacaguggagcaugaca

SEQ ID NO: 175447 - RNA, 37 nt, Homo sapiens
ccuugcagagguggaauccacaggacugaucgaugcu

SEQ ID NO: 175448 - RNA, 88 nt, Homo sapiens
uuccacgucaugggauucuccgucaccgggagggucuugaacggacccgaaggagaugguguuccagaagcaguagucacccugaaua

SEQ ID NO: 175449 - RNA, 48 nt, Homo sapiens
aaaagcugauggcucauuccgccuugagaacauaaccacagggacaua

SEQ ID NO: 175450 - RNA, 46 nt, Homo sapiens
agagcaccucuacuuugaaacggucaccaucaaaauugcaccaaac

SEQ ID NO: 175451 - RNA, 46 nt, Homo sapiens
caagacaaggacaagucuuuggucaccguggagacagaugcucaug

SEQ ID NO: 175452 - RNA, 46 nt, Homo sapiens
ggcugacguugaaaccccagacauuuccucuuacugugaccgacag

SEQ ID NO: 175453 - RNA, 45 nt, Homo sapiens
ggucaacgccaugacuuucaccuuugacaacgugcucccuggaaa

SEQ ID NO: 175454 - RNA, 48 nt, Homo sapiens
aagcaucaugcaugaggauuggugcuggaagaacaagagccuggaggu

SEQ ID NO: 175455 - RNA, 80 nt, Homo sapiens
aagucugugcaggagcugcggagggagcagcagcuggcugagaucgaggcccgcaggcaggagagggagaaaaacggcaa

SEQ ID NO: 175456 - RNA, 49 nt, Homo sapiens
gaccaagccuccugugcaggagaugguagaugaguuacaaggccccuuc

SEQ ID NO: 175457 - RNA, 79 nt, Homo sapiens
ggucuggagagaaaaucacuguuacaccgucaucuaaagagcugcucuuuuaucccccuucaauggaagccguugucag

SEQ ID NO: 175458 - RNA, 69 nt, Homo sapiens
aagcugaucgagauccacgggaaggcaggccuguuuuuagaaggccagauccaccccgaguuggaagga

SEQ ID NO: 175459 - RNA, 73 nt, Homo sapiens
gucgagauugucaucagugaaaagggggcaaguucaccgcugaucacagucuuuacugaugacaaaggugccu

SEQ ID NO: 175460 - RNA, 63 nt, Homo sapiens
agggcuauguucugacugcaguggaaggaaccaucggagacuucaaggccuaugcccuggcag

SEQ ID NO: 175461 - RNA, 89 nt, Homo sapiens
auugguaagaaaaagacaacccacuagaaaaaaaaugaacaaagauuaugaaaaggaaauucauggaaguaacgcaggugacuaauaaa

SEQ ID NO: 175462 - RNA, 45 nt, Homo sapiens
aucccugagugguggccuguuucguuccaaccucuugacccagga

SEQ ID NO: 175463 - RNA, 57 nt, Homo sapiens
uggcagagcccuggccaguauuacuucaaacccaugaugaaggaguuccgguuugag

SEQ ID NO: 175464 - RNA, 74 nt, Homo sapiens
ccauccucacagaugaucgaggugcaggaaggccagaaccugaagaucaccaucacgggguaccgaaccgcuua

SEQ ID NO: 175465 - RNA, 47 nt, Homo sapiens
acaucauuaaaaggagaaaaugugcucaguugaauaaaacuucaaaa

SEQ ID NO: 175466 - RNA, 45 nt, Homo sapiens
acuaguugcuauggcacagugucuuccuuaaacggagagcccgaa

SEQ ID NO: 175467 - RNA, 64 nt, Homo sapiens
caagggguugccauggaagcggugggccagaacgacugcagcauuuacggagaagacaccguga

SEQ ID NO: 175468 - RNA, 44 nt, Homo sapiens
ggcaacgaccacauugagcgggcgcucccccaccauagggugau

SEQ ID NO: 175469 - RNA, 50 nt, Homo sapiens
aauaaugacaucgaugauguaaacaucauaguuuuccggcagauuaauca

SEQ ID NO: 175470 - RNA, 46 nt, Homo sapiens
ccagucccuguucuuccauuuccccccacugcucagagauggcgag

SEQ ID NO: 175471 - RNA, 66 nt, Homo sapiens
agaacuauguugugcuucuggacuccacacuccccagaucccaguaugacuacaucuugccucaag

SEQ ID NO: 175472 - RNA, 32 nt, Homo sapiens
uguggauauaccgugugucuuaggccauuugg

SEQ ID NO: 175473 - RNA, 87 nt, Homo sapiens
ucggcgcgcucggccaggcagccucugacaauagcggcccagaagaugcaaagagacaagccaagaaacagaagacaaggcggacgu

SEQ ID NO: 175474 - RNA, 102 nt, Homo sapiens
guggcauccugcacccauccucaccccuccguagagccccucgugcaaugcaaugaauggacccuccugucacucugcugaacagaauuuauuuucugaguc

SEQ ID NO: 175475 - RNA, 45 nt, Homo sapiens
gagauccugcuggaaaccacggcaaccuguauccacuauuaggag

SEQ ID NO: 175476 - RNA, 138 nt, Homo sapiens
ugccaguuacuuuacccacaucauguuauuuaaucuucacuacaucucuaugaaguuuugucuguguuucacacaugaggaacuaaggcucagagagauuaugggacuugcuuaagguaaccuagcuaaugaguggua

SEQ ID NO: 175477 - RNA, 42 nt, Homo sapiens
ucugauagaauuggggcccugccuugguguugucaacucuuu

SEQ ID NO: 175478 - RNA, 48 nt, Homo sapiens
gccuuuaaccucacuggucuaacuaagcuuacuuguagaccuuuggau

SEQ ID NO: 175479 - RNA, 43 nt, Homo sapiens
gagcagaggagcaggaagcucaguauuucuuaggcaggccguc

SEQ ID NO: 175480 - RNA, 58 nt, Homo sapiens
ccccaggaguauguggaggaggggaaagagccacagguucuccugacucucaagacag

SEQ ID NO: 175481 - RNA, 24 nt, Homo sapiens
aaugauauugauauugcaguagau

SEQ ID NO: 175482 - RNA, 47 nt, Homo sapiens
aauuugaagaggcuucuccuguuuuauacauuaugugaagaauuuag

SEQ ID NO: 175483 - RNA, 46 nt, Homo sapiens
agguuacaggaaugaagaacuauugccuaauuggaaagugccagca

SEQ ID NO: 175484 - RNA, 46 nt, Homo sapiens; identical to SEQ ID NO: 100403

SEQ ID NO: 175485 - RNA, 46 nt, Homo sapiens
caaugagggauuuguauaugaagaauggccaagguuuugcacuagu

SEQ ID NO: 175486 - RNA, 44 nt, Homo sapiens
augcacgucgggcggucgucgggggcgcguggcaaugagauccg

SEQ ID NO: 175487 - RNA, 73 nt, Homo sapiens
cucucgagcgucccaagagaaaaaugcaagccgcgugguacucagccgcuuuccgucuuucaagaacccgccc

SEQ ID NO: 175488 - RNA, 45 nt, Homo sapiens
ugccaacagcaccaaccccaacaacuguaaucuuauucugggggg

SEQ ID NO: 175489 - RNA, 45 nt, Homo sapiens
agacaaucuuugguguucuaaggaaaaggcugccauguuggagau

SEQ ID NO: 175490 - RNA, 42 nt, Homo sapiens
cuggauuugaaacaauaagcaacuugcaguucgggcuguauu

SEQ ID NO: 175491 - RNA, 50 nt, Homo sapiens
caugacagcuuaaugggugaacucccagccuuucccccauuagguaacgg

SEQ ID NO: 175492 - RNA, 46 nt, Homo sapiens
ccgccuaagauucuucauuauacucucugccaaaucugcuacagag

SEQ ID NO: 175493 - RNA, 116 nt, Homo sapiens
uuucacacuaaccaguugaagacuacacaagauuaauaccauccagcaucaggauauagcuguggauuuuacaaaccauucuuauuucuaacuucaggaguugauguuuuucccag

SEQ ID NO: 175494 - RNA, 41 nt, Homo sapiens
aaguauucuucucuuccuuuuaucaguaggugcccagaaua

SEQ ID NO: 175495 - RNA, 45 nt, Homo sapiens
aaacgcuauugaagacacuaucuuuuacuugggagaagccuugag

SEQ ID NO: 175496 - RNA, 45 nt, Homo sapiens
aaaaagggucaccagaaacuggaagagaugguuacccguuuagau

SEQ ID NO: 175497 - RNA, 47 nt, Homo sapiens
aucuugugaaguuuauuuuucuguuauguuuucugauaacuuguaac

SEQ ID NO: 175498 - RNA, 46 nt, Homo sapiens
caauaugccuauggcuacuggacacauacccauauaaucccccuau

SEQ ID NO: 175499 - RNA, 35 nt, Homo sapiens
gaaugcuuauaaugaugaacuuuagucauaaagaa

SEQ ID NO: 175500 - RNA, 58 nt, Homo sapiens
uucauauauaccaggcagcaugauaagcacuuuauuauuuuacugaauccucacaaca

SEQ ID NO: 175501 - RNA, 56 nt, Homo sapiens
aauuugagaggcuggacuucuaccuaaagggaaaagucauuuaauuuuaccuauau

SEQ ID NO: 175502 - RNA, 46 nt, Homo sapiens
gacaugguugacaguauuguaaacaauaagaagaaagugcauucug

SEQ ID NO: 175503 - RNA, 53 nt, Homo sapiens
cacacagcaaacgcucagcaaaugguagcuauuauuacagugauuggcaagau

SEQ ID NO: 175504 - RNA, 48 nt, Homo sapiens
uuuauuguuucucucuugcuauaaagccagguuggucagugauuuaag

SEQ ID NO: 175505 - RNA, 39 nt, Homo sapiens
ccacuugcucuuucccacagaaggcauucaguuuccugu

SEQ ID NO: 175506 - RNA, 63 nt, Homo sapiens
uauuauuacaaauguuuugaaggcacagacuucaggcaaagaaguauggguuauuggcgagca

SEQ ID NO: 175507 - RNA, 45 nt, Homo sapiens
uaccuuguaugcaauauuuaguggaaaucaugaccuauguaacau

SEQ ID NO: 175508 - RNA, 407 nt, Homo sapiens
caucaguagaauugccauuacugauaaaaaccauaaaacuuuagggccuggcacaguggcucacaccaguaaucccaacacugggagucugaggcgggcggaucaccugaggucaggaguuccagaccauccugaccaacauggugaaaccccgucucuaccaaaaauacaaaaguuagccaggcaugguggcgggugccuguaaucccggcuacuuggaaggcugaggugggagaauugcuugaaccccggagauggugguugcagugaggccaagauggugucacugaaccccagucuggccgacagagugagacucucucaaaaaaaaaaaacaaaaacaaaauaaaaaacaaaacaaaaaaagccuuuaaauuauaaagagauggcuagaauauucagcaaaa

SEQ ID NO: 175509 - RNA, 40 nt, Homo sapiens
uuuuccuuucagauuuacuguuauguuggcuuuaguguaa

SEQ ID NO: 175510 - RNA, 75 nt, Homo sapiens
gccaaucuuuuauuguuccuuugcuacuuugaaaggaaaaaaaagguugucucuugauuucuguaauucuucugc

SEQ ID NO: 175511 - RNA, 42 nt, Homo sapiens
cauacugucauuugcaggcugucauuugagcauaaaauauuu

SEQ ID NO: 175512 - RNA, 46 nt, Homo sapiens
gauacaaagaugaaagugauuaugccuuacguuacauggaaaguag

SEQ ID NO: 175513 - RNA, 45 nt, Homo sapiens
ucuuccaagaauaucauuagccgguccagcaauggacagaugaau

SEQ ID NO: 175514 - RNA, 42 nt, Homo sapiens
uccuagccauuccaggccugggcccauggucaccccacacaa

SEQ ID NO: 175515 - RNA, 46 nt, Homo sapiens
ugccaggagagaggaucaaggcaggaucuggcaauagcucccaacc

SEQ ID NO: 175516 - RNA, 44 nt, Homo sapiens
cagauggaaaacuaccuccaacuguguccaaaaaggcacccucu

SEQ ID NO: 175517 - RNA, 46 nt, Homo sapiens
gaggcaggcaacagaaagccauaccagccaaggaaccgaccgagag

SEQ ID NO: 175518 - RNA, 41 nt, Homo sapiens
uuggcaguggggccuccaaaaaaagacccaaaaguuaaagg

SEQ ID NO: 175519 - RNA, 34 nt, Homo sapiens
ucugaaaaaggucuauauuuauguuuauaaauau

SEQ ID NO: 175520 - RNA, 41 nt, Homo sapiens
cccggcgccgggcgcucgggagguauuguccgucccuccgg

SEQ ID NO: 175521 - RNA, 33 nt, Homo sapiens
uaccuggucgucuggacucugaguguuucccaa

SEQ ID NO: 175522 - RNA, 47 nt, Homo sapiens
gaagacucagacccaggagccccuuucacaggccccuaguugggaag

SEQ ID NO: 175523 - RNA, 54 nt, Homo sapiens
gggugcugagccuggcucagggagcugggaccccuccccuccaacacacauacu

SEQ ID NO: 175524 - RNA, 46 nt, Homo sapiens
aaggaagaagucaugguagaaauucacaauuucuaaaaucugggag

SEQ ID NO: 175525 - RNA, 44 nt, Homo sapiens
guguccagccugguccuaguggucaggauccucuguggauccca

SEQ ID NO: 175526 - RNA, 46 nt, Homo sapiens
ugucaacggucguguguguccugcucugggcccugucccugcugua

SEQ ID NO: 175527 - RNA, 40 nt, Homo sapiens
aagucacugaagaaauuaaugaauguuauaaucuggaagc

SEQ ID NO: 175528 - RNA, 47 nt, Homo sapiens
uuugaagacccugaggaaccacugagacauuccugaggugcaacgcu

SEQ ID NO: 175529 - RNA, 42 nt, Homo sapiens
gauauugaugaggcuuaacggaaaacguauaauguggcuucu

SEQ ID NO: 175530 - RNA, 82 nt, Homo sapiens
gaauucaaaaaccaccaaaucaguagcugauuuaccuuuuuucucucugauuugcccccagccuugacuugagcccuggaaa

SEQ ID NO: 175531 - RNA, 46 nt, Homo sapiens
aaagaguugguagaagcaggauaugaugucaggcaaccagauaaag

SEQ ID NO: 175532 - RNA, 67 nt, Homo sapiens
uuuauaauuuuagaccucuccuucauuuaucuuuuucuuuaaguauggguauugaaccauguguaau

SEQ ID NO: 175533 - RNA, 45 nt, Homo sapiens
aguuuagaagaagcauugaaauauuuuacauuuuaauaccacgaa

SEQ ID NO: 175534 - RNA, 46 nt, Homo sapiens
gugcuguuguagaucaguuggguggagauuuaaauucaacuccucu

SEQ ID NO: 175535 - RNA, 40 nt, Homo sapiens
auauagcuaguggucaccauauaaaaaaucaguuauagac

SEQ ID NO: 175536 - RNA, 52 nt, Homo sapiens
aggacauuuaccuauggucauauuauuacuccagcauggugcagaccccacu

SEQ ID NO: 175537 - RNA, 50 nt, Homo sapiens
caguauuguuucaacacaugccuauuauagcauaucucaucucaaaggga

SEQ ID NO: 175538 - RNA, 45 nt, Homo sapiens
augugguugauaaaauacaccaaaacacuccacuucacugggcag

SEQ ID NO: 175539 - RNA, 45 nt, Homo sapiens
aacaaaaaucagcucauuauucauaugcuaaaaacagaagccaaa

SEQ ID NO: 175540 - RNA, 42 nt, Homo sapiens
gauuuuuaucaugcuguaaauauuacuuaccauauaacagca

SEQ ID NO: 175541 - RNA, 46 nt, Homo sapiens
acuugguugacuugacaacugguggaaaauaaauauccugggucac

SEQ ID NO: 175542 - RNA, 45 nt, Homo sapiens
cugacuucuuaucccccuggaguuuacccccacuuagcaaucaag

SEQ ID NO: 175543 - RNA, 54 nt, Homo sapiens
uaacaaauaucauuuuagucucuggaagaaagcuugcuaaauguaaaggugaau

SEQ ID NO: 175544 - RNA, 40 nt, Homo sapiens
uaaccauuugugacuucagguagguggaaggcauuuucaa

SEQ ID NO: 175545 - RNA, 49 nt, Homo sapiens
acuucucuuucugguaauagcauuuccgaaaagaaagaacagaauguuu

SEQ ID NO: 175546 - RNA, 44 nt, Homo sapiens
auaaguucagcaaguaaugucuggcuugugcgaggggggauuga

SEQ ID NO: 175547 - RNA, 104 nt, Homo sapiens
ggagccccuuucuauuucaguuucauuuucagcauaguagccuuucuauacuuuuucuauaagacuugggcaacugauccaggcuucacuaaggcuucugaaga

SEQ ID NO: 175548 - RNA, 37 nt, Homo sapiens
ccuuggugcuuguaacuuucaguuuugauguauacug

SEQ ID NO: 175549 - RNA, 45 nt, Homo sapiens
ucagaauaucaucacccuugcagaaacuggcucucuggacuucag

SEQ ID NO: 175550 - RNA, 46 nt, Homo sapiens
aaauacaagaugagguuaguucucaguacuuuaggaaaaaaaugug

SEQ ID NO: 175551 - RNA, 44 nt, Homo sapiens
uauucugaugauaucuaggugcuugugggauaucuugugcccac

SEQ ID NO: 175552 - RNA, 43 nt, Homo sapiens
ugaauaagguagggaguguucuaaacaaauaauuaacuucagg

SEQ ID NO: 175553 - RNA, 43 nt, Homo sapiens
cuaaaauugaaucaugaucugugccauacuuucucuucucccu

SEQ ID NO: 175554 - RNA, 46 nt, Homo sapiens
auuguggccuguuccccuuggguuuuauauaucuugaugcuagcaa

SEQ ID NO: 175555 - RNA, 46 nt, Homo sapiens
cagaagaugcacauucuguuuuuaccucugucacugacucuguggg

SEQ ID NO: 175556 - RNA, 142 nt, Homo sapiens
guggcuuugacuguagcaagucaagaugagugucuagguuguugguuaggagcauggcuuuauucucacacugaccaaggagucagucccagcucucccacucuaagcuguguggcuuugaaucaguuacuucaucucucua

SEQ ID NO: 175557 - RNA, 42 nt, Homo sapiens
accucccaugagagaaucagccugcagaagcagagcaagcau

SEQ ID NO: 175558 - RNA, 48 nt, Homo sapiens
aggggaucagagacugggauauaacuacaauguguauuuaggagagga

SEQ ID NO: 175559 - RNA, 46 nt, Homo sapiens
caaagaggaggaauguuuauuugagccucuaggcagaggaguaucu

SEQ ID NO: 175560 - RNA, 61 nt, Homo sapiens
gguacagaagucuugguucugaaccuggacccaggagggaagucugugggaaaggggagaa

SEQ ID NO: 175561 - RNA, 54 nt, Homo sapiens
cuacaguuaggccaauuuugaaauauauaaauucuaugcaacauuuauguugag

SEQ ID NO: 175562 - RNA, 45 nt, Homo sapiens
cauuagggguggggugggagugggacaggaacaagacuugccuag

SEQ ID NO: 175563 - RNA, 49 nt, Homo sapiens
agcuuuuggaaggugacagagaagacucaauauguauguugugccuuga

SEQ ID NO: 175564 - RNA, 67 nt, Homo sapiens
gaaaaguuaaggcugggaccaagacuuaaagugaacugauguggggagaacuauuuggaguugguuu

SEQ ID NO: 175565 - RNA, 34 nt, Homo sapiens
cccacucacucgccaccuccccccacccugcagc

SEQ ID NO: 175566 - RNA, 45 nt, Homo sapiens
uuuucuauugcuguuuuaguugauguacgcagguuuguuucccua

SEQ ID NO: 175567 - RNA, 36 nt, Homo sapiens
aaugcaaaagccacugaaaugauaaaagcuuagggg

SEQ ID NO: 175568 - RNA, 41 nt, Homo sapiens
uuucugucucccucucuccuucuguccccccuccaucgccc

SEQ ID NO: 175569 - RNA, 53 nt, Homo sapiens
guguuugucuuucuguuccuggguuauuucacuuaacacaauguccuccaagu

SEQ ID NO: 175570 - RNA, 31 nt, Homo sapiens
uuccuuaaucccccaugccccagccauuuua

SEQ ID NO: 175571 - RNA, 52 nt, Homo sapiens
ggguguucuuaauauauuuuuuuuuaauuucaaaacuaauuuaaacccauau

SEQ ID NO: 175572 - RNA, 20 nt, Homo sapiens
aguguggccaugcgaggaau

SEQ ID NO: 175573 - RNA, 46 nt, Homo sapiens
caucguuucuuggaugucaacagccacaaaauagaaaaaacaaucg

SEQ ID NO: 175574 - RNA, 45 nt, Homo sapiens
uuuaugaaaaauuugucauucauucugaucuaagcaaagcugcua

SEQ ID NO: 175575 - RNA, 45 nt, Homo sapiens
cauagggaccaacacuuguacagcagugauccauuguauguucca

SEQ ID NO: 175576 - RNA, 46 nt, Homo sapiens
agguuacuuucaggagugaaaaagcucuuuauauuucaguugauag

SEQ ID NO: 175577 - RNA, 41 nt, Homo sapiens
guccgggccucucaccugcuuaacacccuguacaaggccau

SEQ ID NO: 175578 - RNA, 60 nt, Homo sapiens
aacuuccaaauuuaaggcuguaggaaacuggcuuuucagcucuaauugccaagauccuca

SEQ ID NO: 175579 - RNA, 36 nt, Homo sapiens
uucuuugugccccaaaaaacauagaaauccgaucac

SEQ ID NO: 175580 - RNA, 45 nt, Homo sapiens
ggucucccuccuuuucucucucuggguggaaacggugcggccuua

SEQ ID NO: 175581 - RNA, 46 nt, Homo sapiens
aaccugaugaagaugcaguccauugcugaaagccaucuugaacugg

SEQ ID NO: 175582 - RNA, 47 nt, Homo sapiens
gacagauggauuguagguggguuuucuggagauuaguagauacugua

SEQ ID NO: 175583 - RNA, 45 nt, Homo sapiens
cuuaauuugcagcacauugugggugugacaagaagggugcaagaa

SEQ ID NO: 175584 - RNA, 20 nt, Homo sapiens
uuacaaaugaagaaaaacag

SEQ ID NO: 175585 - RNA, 45 nt, Homo sapiens
uggagccugaggucacaaaacugaugaauuucauguacuuccagg

SEQ ID NO: 175586 - RNA, 44 nt, Homo sapiens
aaccccugcagagguggaguucaagguugcauacaauaacagga

SEQ ID NO: 175587 - RNA, 41 nt, Homo sapiens
guugaguuaaaacccaagcuugaagcuccauaucccugggu

SEQ ID NO: 175588 - RNA, 50 nt, Homo sapiens
uaauuauuagcauuagucaguuuccuugugcuuauguauuuggugacuaa

SEQ ID NO: 175589 - RNA, 42 nt, Homo sapiens
gaacuggcaagauauaucaagaccagcgcccacuacgaggaa

SEQ ID NO: 175590 - RNA, 46 nt, Homo sapiens
cagcccucaguacaacaucugcgagcagaugauccagauccgcgag

SEQ ID NO: 175591 - RNA, 45 nt, Homo sapiens
uugugcaccccaccgacaaguacuccaacaaggacugccccgaca

SEQ ID NO: 175592 - RNA, 46 nt, Homo sapiens
ggugaucgccaugaucaaaggccugcaggugcugaugggcaggaug

SEQ ID NO: 175593 - RNA, 63 nt, Homo sapiens
cccaggugacccuuagggagccgcugcggcaggccaucaagaagaagaagaacgucauccaga

SEQ ID NO: 175594 - RNA, 52 nt, Homo sapiens
gggagacggggcaugagcccuucaaugacccagccuugcggggcgagaagga

SEQ ID NO: 175595 - RNA, 46 nt, Homo sapiens
ucuucugccacucuucuggaaagucaccagcaaugcacgcugcugg

SEQ ID NO: 175596 - RNA, 25 nt, Homo sapiens
cucggccugugcguggugccagcca

SEQ ID NO: 175597 - RNA, 45 nt, Homo sapiens
gagugacuaacgucucucuccugccucucccuccugucuguccgu

SEQ ID NO: 175598 - RNA, 45 nt, Homo sapiens
ggcauggagaggcucuugcaugcgguuaacacguuucugaggcag

SEQ ID NO: 175599 - RNA, 46 nt, Homo sapiens
acauagaaaaauuucaucgagagucauucuucuacacucacuugau

SEQ ID NO: 175600 - RNA, 33 nt, Homo sapiens
gacucguccugcccucuguggcgguggcuguac

SEQ ID NO: 175601 - RNA, 46 nt, Homo sapiens; identical to SEQ ID NO: 100587

SEQ ID NO: 175602 - RNA, 46 nt, Homo sapiens
cagguacgugcucuacucccuggaccuguacaaugacagcgcccac

SEQ ID NO: 175603 - RNA, 39 nt, Homo sapiens
ccacacgugcacgcugccccacagggugcuggacagcag

SEQ ID NO: 175604 - RNA, 32 nt, Homo sapiens
ucugggagcucaacuaugacuuccugcccaac

SEQ ID NO: 175605 - RNA, 42 nt, Homo sapiens
uaggcagugcuuuggugaugggcuacacugggcuggcuguau

SEQ ID NO: 175606 - RNA, 196 nt, Homo sapiens
cuuggggugauuucugcccuuuuuuuuguuuuguaagaaagagguuccuucauucaguaacuuaguuuucccuuaauaaauauuucaaaaauaaaaccaaucaucaucaaacaaacaggagccacuuuuguagguaagguaaaucacaggauaauguauugggauaacucuguuuuuuuaaaauaaaaaagccuua

SEQ ID NO: 175607 - RNA, 48 nt, Homo sapiens
cucccauuugccauccaggccucacacccacacucgagcccacccggc

SEQ ID NO: 175608 - RNA, 42 nt, Homo sapiens
gugcagcgacgguugguggcggggcagcuacaacgggcagau

SEQ ID NO: 175609 - RNA, 45 nt, Homo sapiens
aguguagaaaaugaaaaggaugcuuuccucaucuuggugguaaag

SEQ ID NO: 175610 - RNA, 92 nt, Homo sapiens
ucaugaagaaauguggauaugacccguaauuuuggaucauuuuacugccugcaauauugagagaagcagcaaauuauuacaguuuuuuuugg

SEQ ID NO: 175611 - RNA, 47 nt, Homo sapiens
cacauaauggaacuucauuuucccaugcccuuccaaucuaagagcag

SEQ ID NO: 175612 - RNA, 41 nt, Homo sapiens
cagaccuguuguguuaaucugaucaauggcaagugaaucau

SEQ ID NO: 175613 - RNA, 69 nt, Homo sapiens
ucucuaaagcucauguuaaacucauguucuuuauuuucuucucagaugauuccuuuggcacugcaugua

SEQ ID NO: 175614 - RNA, 45 nt, Homo sapiens
gaaccauaaugcuguucuuuagaaagcaaaggaugaagugcacag

SEQ ID NO: 175615 - RNA, 51 nt, Homo sapiens
cuuguuaauugucuuaauacauuuuuccuaagaauucuauugugccucugu

SEQ ID NO: 175616 - RNA, 29 nt, Homo sapiens
auuaccucacaggguuuuucuuagugugu

SEQ ID NO: 175617 - RNA, 40 nt, Homo sapiens
uuuuuuggaauucguauugcauguguaucuuaaugucaua

SEQ ID NO: 175618 - RNA, 45 nt, Homo sapiens
auaugcauaaaaagauugagagggcagguuuggauuuugggcuau

SEQ ID NO: 175619 - RNA, 40 nt, Homo sapiens
gccuuggagccuuuugagcaccggaucucauaaaagaggg

SEQ ID NO: 175620 - RNA, 23 nt, Homo sapiens
gaugccucagauuuggccuggau

SEQ ID NO: 175621 - RNA, 66 nt, Homo sapiens
gcacaaaaugaucuuuugauacugggauauuucagauguaugguaucuuugccagaacuacagugu

SEQ ID NO: 175622 - RNA, 24 nt, Homo sapiens
uagagaguuacaguggagguaaaa

SEQ ID NO: 175623 - RNA, 37 nt, Homo sapiens
gguuaaaagaaaggaaucauuuagcaguaaaugggag

SEQ ID NO: 175624 - RNA, 49 nt, Homo sapiens
aagcaugagcggcuuauuccaggcagaaguaugagccaaaguuagaagc

SEQ ID NO: 175625 - RNA, 56 nt, Homo sapiens
uuuuagaucauaaacuagcugagagguaggaaaaugaagaagauaagaugugauag

SEQ ID NO: 175626 - RNA, 28 nt, Homo sapiens
guauaauaggaauucaaaauaaauuuuu

SEQ ID NO: 175627 - RNA, 51 nt, Homo sapiens
gugaauuugggaccaaaaggaauggcuaugacuuauguuucuuuggaucca

SEQ ID NO: 175628 - RNA, 56 nt, Homo sapiens
ugagaacucgaaaggugcccccaacaacuccugcucugagauaaaaaugaacaaga

SEQ ID NO: 175629 - RNA, 30 nt, Homo sapiens
uugacuaauuuuuaucuauauaccugaaaa

SEQ ID NO: 175630 - RNA, 35 nt, Homo sapiens
gauaguaguauuuucuguuauguuacauuuuagga

SEQ ID NO: 175631 - RNA, 48 nt, Homo sapiens
acaacacaccaaggaagaacugaaaucucuucaagcaaaagaugaaga

SEQ ID NO: 175632 - RNA, 52 nt, Homo sapiens
cugcugcuauggaagaagacucagaagcaucuuccucaaggauaggugauag

SEQ ID NO: 175633 - RNA, 46 nt, Homo sapiens
uuugucaccuaacguggaaugugacuugacguaucacaauguauac

SEQ ID NO: 175634 - RNA, 82 nt, Homo sapiens
guugcugcuucgaagugcuugaaaaugguuuacuaugcaaauguagugggaggggaaguggacacaaaucacaaugaagaag

SEQ ID NO: 175635 - RNA, 46 nt, Homo sapiens
caaagaauuugggauuauauuaugacaauagaauucgcauguacag

SEQ ID NO: 175636 - RNA, 40 nt, Homo sapiens
aacaagagaaauguggagauacccaauaauaaguguggau

SEQ ID NO: 175637 - RNA, 65 nt, Homo sapiens
aaauccugcagacuugaagaagcaguuguauguggaauuugaaggagaacaaggaguugaugagg

SEQ ID NO: 175638 - RNA, 35 nt, Homo sapiens
auuuuguuuguguuuuagugaaaucuuaagagaua

SEQ ID NO: 175639 - RNA, 42 nt, Homo sapiens
uggaagaugacaugaugaucacuuuccagauaucacagacag

SEQ ID NO: 175640 - RNA, 48 nt, Homo sapiens
aguacuuccacauuuuugcugaacuggauacaguaggcagcuuaccaa

SEQ ID NO: 175641 - RNA, 48 nt, Homo sapiens
cauauggugaccaaugaaucucccuuaaaguacuuauucagaccagaa

SEQ ID NO: 175642 - RNA, 46 nt, Homo sapiens
gaaaauuaaagaugauuauagccaaaaauggcccagacacagaaag

SEQ ID NO: 175643 - RNA, 48 nt, Homo sapiens
cauuuaauucuaaguguauuucccaugacuuacaguuuuccuguuuuu

SEQ ID NO: 175644 - RNA, 68 nt, Homo sapiens
gccaaaggauuuggcaugcuguaaaacaaaacaaaacaaaauaaaacaaaaaaaaggaaggaaaaaaa

SEQ ID NO: 175645 - RNA, 54 nt, Homo sapiens
uagcccccaaagaguuuucugugcaaaaucuugagaaucaaucaauaaagaaag

SEQ ID NO: 175646 - RNA, 42 nt, Homo sapiens
auggcuacugugccuuguguuacuuaaucauacaguaagcug

SEQ ID NO: 175647 - RNA, 237 nt, Homo sapiens
cccugaacaauaaggaagagcaaaacauagacauuuugacuacaguggauacuuccucuaccccaaauguuauguuauaaaaguacuuuuuuugcccagguacucuauuauauauuuugguuuucuuugaauuagaccucaaucuccaggaagcucuggagggaaaaaaaggaaccauaaacuaaaguaacugguuuuccaaauaaauguaaacuuuuuuaaccuuuuauuauuaua

SEQ ID NO: 175648 - RNA, 54 nt, Homo sapiens
caaaguauaaggaaguaaaggcaagaaaugcacaauuauugaaaaugcuucagg

SEQ ID NO: 175649 - RNA, 29 nt, Homo sapiens
uucaauucuuccaucuuucagaaccacuu

SEQ ID NO: 175650 - RNA, 30 nt, Homo sapiens
auaauuguacagcucaugaacacaaccagg

SEQ ID NO: 175651 - RNA, 34 nt, Homo sapiens
uaucacuaaaagauuuucauucggaagguaaugu

SEQ ID NO: 175652 - RNA, 42 nt, Homo sapiens
gcggaggagggccgcgcccaccaggccccgagcgcggcccag

SEQ ID NO: 175653 - RNA, 41 nt, Homo sapiens
cggcccuggaagaagcacuccaccuucggggacgugcggaa

SEQ ID NO: 175654 - RNA, 99 nt, Homo sapiens
aacuguggggagcugggagaggggcuaagccaugcugggguuuggggguccuacaggugccaagcagaggggggacucuucggguaccaggcugcaugg

SEQ ID NO: 175655 - RNA, 46 nt, Homo sapiens
cuugagguugggagcuagaaguggccccaaaccagugcccacaggg

SEQ ID NO: 175656 - RNA, 44 nt, Homo sapiens
acaacaacaaacagucgcuguggaauuuuauuaagccaucaaaa

SEQ ID NO: 175657 - RNA, 55 nt, Homo sapiens
guagaaaaaaaauacucucuguccaugcuaauucuuauuuugccauaaaaaauau

SEQ ID NO: 175658 - RNA, 25 nt, Homo sapiens
aaagaggcccauuuauuucaaggga

SEQ ID NO: 175659 - RNA, 43 nt, Homo sapiens
uggaugcaucuauaugauuagaugugcaaaaagcuggaaaacu

SEQ ID NO: 175660 - RNA, 63 nt, Homo sapiens
ggaauggaagaaacugcaggguagccagcaagcaggcugugcaucuguggccaaaugcacaaa

SEQ ID NO: 175661 - RNA, 43 nt, Homo sapiens
agcugcuaaugacagcaacuggacugaggccagagggcagaga

SEQ ID NO: 175662 - RNA, 45 nt, Homo sapiens
acuaacacucacuggggcuacuuccuccaugguuauggcuggcag

SEQ ID NO: 175663 - RNA, 45 nt, Homo sapiens
uuauccucuguuuaaugauaucuuccaguugaagggugguuuccu

SEQ ID NO: 175664 - RNA, 42 nt, Homo sapiens
ccucacagaagcaaugucaaaagaaauaugcuaucugccaag

SEQ ID NO: 175665 - RNA, 46 nt, Homo sapiens
gugcuacguuagaccaguuugaugcuauugauuuuucugacaauga

SEQ ID NO: 175666 - RNA, 77 nt, Homo sapiens
cagaccucuugagugcugugccaugaacaaguuugccauugugucauuccuuuucuuguaguauccuaagaaauccg

SEQ ID NO: 175667 - RNA, 81 nt, Homo sapiens
guaaccaauaagaagcauuacagauuguaugugauuuauaaaguuccgcaagucagaguacuggauuuccagaaagugaaa

SEQ ID NO: 175668 - RNA, 54 nt, Homo sapiens
cuaaaugaguaaauuuuaccauuaguuuguaauaaaagugggagggaaaauguu

SEQ ID NO: 175669 - RNA, 45 nt, Homo sapiens
cugguuugccaacugacaaaaagaaaggugggccaucuccagggg

SEQ ID NO: 175670 - RNA, 40 nt, Homo sapiens
gagaggcugaagggguugcugcagucuggucagaucccug

SEQ ID NO: 175671 - RNA, 52 nt, Homo sapiens
gugugucaucauggugcauuugcagugaggucuaaggacacguugaaauugg

SEQ ID NO: 175672 - RNA, 44 nt, Homo sapiens
ccgggauuucucccccgccacgccccucggccacgccccccugc

SEQ ID NO: 175673 - RNA, 53 nt, Homo sapiens
ggaccacgaccgcguccgggcgcgccacgugugcguaggagcgcaccggaagc

SEQ ID NO: 175674 - RNA, 77 nt, Homo sapiens
cgcccggcuaagagccuugaggcagaggcagcuggaccgagcugcggcugcuguggguuagugccugauaaccgaaa

SEQ ID NO: 175675 - RNA, 92 nt, Homo sapiens
guuaaacgacaagaagcuuuagcagcugcucgacugaaaaugcaagaagaacuaaaugcgcaaguugaaaagcauaaggaaaaacugaaaca

SEQ ID NO: 175676 - RNA, 71 nt, Homo sapiens
cccauuagauucaauaagcauuucaguuccuaccauguaaguauuggugauaucaagaagaauacacgauu

SEQ ID NO: 175677 - RNA, 50 nt, Homo sapiens
agaagaaaaaaggagacagaagauugaaaugugggacagcaugcaagaag

SEQ ID NO: 175678 - RNA, 44 nt, Homo sapiens
gcuccuggagaccuggacgcagaggcccgucaucuggcggauga

SEQ ID NO: 175679 - RNA, 49 nt, Homo sapiens
uucuguuccuaacuacaccugcauaugucagggcuccagucagcaaaag

SEQ ID NO: 175680 - RNA, 41 nt, Homo sapiens
auucaaggagauuuauggacuucaauuugucuaucaaacau

SEQ ID NO: 175681 - RNA, 40 nt, Homo sapiens
agugguggugacuuggauugcuuucaagaaggauuaggug

SEQ ID NO: 175682 - RNA, 40 nt, Homo sapiens
gcgcgcaggaggcaaggcgcugcggcgcgaggcgcucggg

SEQ ID NO: 175683 - RNA, 42 nt, Homo sapiens
ccuggcgagaggugucguacgcugugguuucagcgccagggu

SEQ ID NO: 175684 - RNA, 68 nt, Homo sapiens
uuuucuaaacuuucagcggacucgauugggcgaaagccuuccggcucccuuuacuaagucguuuaggu

SEQ ID NO: 175685 - RNA, 72 nt, Homo sapiens
aaauaggcuguuuuucuuuuggagcguucuucuugaaggauauucuuugugcaagacggcgauuuuugagaa

SEQ ID NO: 175686 - RNA, 44 nt, Homo sapiens
uugacaggcugaugucucucucucuuuucauuuaugaguuuuuc

SEQ ID NO: 175687 - RNA, 41 nt, Homo sapiens
gcuuagcaacagggauucaaucccgcaguagaaaugggcaa

SEQ ID NO: 175688 - RNA, 43 nt, Homo sapiens
cagggcauuuuauaauuuguaaauaacuugguguuuuuaaaag

SEQ ID NO: 175689 - RNA, 44 nt, Homo sapiens
acuggacagguuggcccagcugagggaggugacuggugagaugg

SEQ ID NO: 175690 - RNA, 57 nt, Homo sapiens
cugcacaaagcucggaggggcauuucuggugcuugguagaugguaggccugccccca

SEQ ID NO: 175691 - RNA, 23 nt, Homo sapiens
gaaagaaugagaaagcugaagcc

SEQ ID NO: 175692 - RNA, 35 nt, Homo sapiens
uagcgguuguacaguaaauagaugaucauucucgc

SEQ ID NO: 175693 - RNA, 93 nt, Homo sapiens
gguuguaguuugucugaaaaagauuuggaaaaaauguacagccauguuucucuugucuagagaagcugucuuaaggacuucgacaaguuucau

SEQ ID NO: 175694 - RNA, 26 nt, Homo sapiens
aagucauagcgauaaagucucagcuu

SEQ ID NO: 175695 - RNA, 57 nt, Homo sapiens
aacugaaagccugccuaauaagggaguaggccgacaggggcugacuuuucucaaguu

SEQ ID NO: 175696 - RNA, 28 nt, Homo sapiens
gcuuuuguccucgugaacacaagaugac

SEQ ID NO: 175697 - RNA, 100 nt, Homo sapiens
caaagggacuuuugcuugugugggcauugcccaguuguguuacaacuuguuuacagccguugguuuuuaagggaugagguaaucuuagcucagcuuagug

SEQ ID NO: 175698 - RNA, 41 nt, Homo sapiens
caauguuagugaaauuaaaucacuugaucuuaaaagcagca

SEQ ID NO: 175699 - RNA, 46 nt, Homo sapiens
uggaguagugccauuuccauguagaggggcaagauuuaccacccug

SEQ ID NO: 175700 - RNA, 44 nt, Homo sapiens
acacuucacugccugauuugcuuuaaaggcaaggguugcucaug

SEQ ID NO: 175701 - RNA, 55 nt, Homo sapiens
agaagcacugugggcggcaggguaucacagaggaggagcucgguguguuggaggu

SEQ ID NO: 175702 - RNA, 37 nt, Homo sapiens
aaaauaguuuaaaaauuauuuccuucuaacugagacg

SEQ ID NO: 175703 - RNA, 67 nt, Homo sapiens
cagggaccauggaggagaagccgaugugugagaagaccaccaucaacaaugaguacaacuaccgcug

SEQ ID NO: 175704 - RNA, 28 nt, Homo sapiens
cuaguuaugaagaaccaagaaaccccaa

SEQ ID NO: 175705 - RNA, 41 nt, Homo sapiens
ccaguacaucccuuaguggugaucauauaugggcaugagga

SEQ ID NO: 175706 - RNA, 70 nt, Homo sapiens
acacuccaugugccacucccucccgccugccugcuguguccuuggccccaguggugcucucccgugcuga

SEQ ID NO: 175707 - RNA, 68 nt, Homo sapiens
gaccucugaauggccccuucugcuuugcuaaguagaugauauuauuaggugcuuagacuauucuucag

SEQ ID NO: 175708 - RNA, 42 nt, Homo sapiens
uacugaguguguuuuuccacucacaaggaaagacagcagcug

SEQ ID NO: 175709 - RNA, 45 nt, Homo sapiens
aucuuauugggcgguaguguuauccuaauucuuggaaauacucag

SEQ ID NO: 175710 - RNA, 49 nt, Homo sapiens
gcagcuggagugaucaaagcaaaauuaaaauacuuucucagugguuugg

SEQ ID NO: 175711 - RNA, 75 nt, Homo sapiens
uugugaauuauuugggguccuaugguccuccccaucauucuuauucaugucaguccaccaucauuaaggaagugg

SEQ ID NO: 175712 - RNA, 48 nt, Homo sapiens
acuuaaugcaaagauaaaguagugggaaaagguugucauuugaaauaa

SEQ ID NO: 175713 - RNA, 40 nt, Homo sapiens
guaucagcaauuaauauuuugagaaaauggaaauaauuaa

SEQ ID NO: 175714 - RNA, 70 nt, Homo sapiens
ugcucugauguagaaagcaagaggauuuuccuugcagucacugaagguaccuuguguacacagaaagaag

SEQ ID NO: 175715 - RNA, 65 nt, Homo sapiens
ucgugcaguuugcugcacuaauacauugcaaguggugccaaccuaaagguauucugaugguggaa

SEQ ID NO: 175716 - RNA, 112 nt, Homo sapiens
cuggcagcugucuggggaaggagggaagcuggcagagccguggguggaggcagaugccauugcuauggagugagcauggggaagggggucggaggccuuuuggagauagaua

SEQ ID NO: 175717 - RNA, 36 nt, Homo sapiens
acccuugccauuaacuaggauaggaaacaacaaagg

SEQ ID NO: 175718 - RNA, 56 nt, Homo sapiens
gcacgagcaaggggagugagcuggucuaggagguuuuuggaaacacugaccuggcu

SEQ ID NO: 175719 - RNA, 45 nt, Homo sapiens
uaauguugccaggaggccgauuguguaaccuuuggaggcuucccu

SEQ ID NO: 175720 - RNA, 36 nt, Homo sapiens
agaaacacacaugagauaauucuggggauggagcuu

SEQ ID NO: 175721 - RNA, 61 nt, Homo sapiens
cuguaaagggacccagguggcuccagcacagcgaggaaagcaugcgagugugauggccagg

SEQ ID NO: 175722 - RNA, 59 nt, Homo sapiens
uuauuaaguugaaugccugucucauuugcuuuuuagucuucuuaaaauaauggcauuua

SEQ ID NO: 175723 - RNA, 31 nt, Homo sapiens
uuuuaaauagagcuggacuuuuaaaacccau

SEQ ID NO: 175724 - RNA, 80 nt, Homo sapiens
gcagucccagguuugaguccuggcuccacuggagguugucugacuuggagguuaauaauaaccugccuuagucccagagu

SEQ ID NO: 175725 - RNA, 56 nt, Homo sapiens
gggaccauugccucguuccccccaccuccacauggaaggugccuuuuguguccugc

SEQ ID NO: 175726 - RNA, 41 nt, Homo sapiens
ucuauuaaacaaaucuuugcaaauuagggagguguguugug

SEQ ID NO: 175727 - RNA, 49 nt, Homo sapiens
auagccuguuggcacaggggugaagaugacagaggcgaacccaagcaaa

SEQ ID NO: 175728 - RNA, 40 nt, Homo sapiens
accuacuucccuucuaucucuccucucuccuucaugccug

SEQ ID NO: 175729 - RNA, 51 nt, Homo sapiens
aauaacuucacaguuugcgcaaguuugcaaacggucuauacugcucagccu

SEQ ID NO: 175730 - RNA, 46 nt, Homo sapiens
ggugaacccagggcccuuucauggccuugggaggguccucagcuuu

SEQ ID NO: 175731 - RNA, 36 nt, Homo sapiens
cauuuagugucugugacuuagccaaaggaaauguac

SEQ ID NO: 175732 - RNA, 41 nt, Homo sapiens
aagacagagcccucccgguuccucuucuggaugugugcuuu

SEQ ID NO: 175733 - RNA, 40 nt, Homo sapiens
gggagggcagcuguggaaaagggugugggcgagggagaca

SEQ ID NO: 175734 - RNA, 40 nt, Homo sapiens
gccacagagguuaagaacucccucuuccaagguagacauu

SEQ ID NO: 175735 - RNA, 27 nt, Homo sapiens
uuuccugcuguuuuuuuaaagcuggau

SEQ ID NO: 175736 - RNA, 55 nt, Homo sapiens
agggagccaguaauucgaaagcacuugccuguguugaauaugguggaaaaaacaa

SEQ ID NO: 175737 - RNA, 189 nt, Homo sapiens
ucuuccauacucaagcucuggggagaucccuuucuccuuucacaccagacauuucgugauuugcccuuucugaccaccccagcccuacuuucccagucuugccucugccuacuucaccucuucucuccagcgucaugguuggagaagcauauucucaugguucuggaugcugaaaguccaaggucaggu

SEQ ID NO: 175738 - RNA, 83 nt, Homo sapiens
gucagaaaugccucagacauccagggggggcaagcuaagauggaguugaacacagcaguguagggcucaggggacaggccagg

SEQ ID NO: 175739 - RNA, 50 nt, Homo sapiens
augaagaauuaaaauuaauaacuuuaaaaagauuuauugauucagaaaca

SEQ ID NO: 175740 - RNA, 24 nt, Homo sapiens
cauuaaaaagaauauaaugaacau

SEQ ID NO: 175741 - RNA, 46 nt, Homo sapiens
ggaucuucaggaauagaguaccuggggcucaggagccaagacuaga

SEQ ID NO: 175742 - RNA, 58 nt, Homo sapiens
ccuaggggauaauaaaagucuagcaugauaaaagaucucgucuuacaaggucccgaug

SEQ ID NO: 175743 - RNA, 28 nt, Homo sapiens
auuuauccuaauauauuugcugagcaug

SEQ ID NO: 175744 - RNA, 46 nt, Homo sapiens
cagacccuucgagaucagcuuaagcuucacugccuuagagaaacuu

SEQ ID NO: 175745 - RNA, 44 nt, Homo sapiens
uaauuuagcuuacugacaaaaagaaaagcaaaggaaauuccaga

SEQ ID NO: 175746 - RNA, 51 nt, Homo sapiens
guuuuagagcugauuuagauacaugcauugcuaauacagucagcccagcca

SEQ ID NO: 175747 - RNA, 47 nt, Homo sapiens
gagucagcuuccgucauuguuagaucaguacuuguuucuuucccuug

SEQ ID NO: 175748 - RNA, 38 nt, Homo sapiens
cuggcaggugggcaugguggugagggugguguuugagc

SEQ ID NO: 175749 - RNA, 342 nt, Homo sapiens
ucaaaguguugcuuuccucuuuuagaauaaacguggcuggguguggugccucaugccuguuaucccagcacuuugggaggccauaggcaagaggauugcuugagccaggaguuugggaccagcuugggcaacauagggaaaccacaucacuacaaaaaaaaaaauuagccugucaugguagcaugcaccuguggucccacuuacuugggaggcugaggugggaggaucaccugaguucaggaggucaaagcugcagugaggugugaucaugccccugcucuccagccuggacaacagagcaagacacugucucaaauaaauaggcaaacauuaccaacaugg

SEQ ID NO: 175750 - RNA, 45 nt, Homo sapiens
uucccauggcacuggcaccaggaugacuuuuugugaagcagagca

SEQ ID NO: 175751 - RNA, 68 nt, Homo sapiens
cagugcucuuuucaaucagaaaacagccugcguauguucuugcuugcaacucagauauccagcccacu

SEQ ID NO: 175752 - RNA, 38 nt, Homo sapiens
cuggcucacuuucaaguuuuauggugcacacaggagca

SEQ ID NO: 175753 - RNA, 36 nt, Homo sapiens
gcccggcagagcucuugcauggggugagaaugguaa

SEQ ID NO: 175754 - RNA, 46 nt, Homo sapiens
gugaauuagaucucaauaaagcuauuguaaaaaaugugugaaggaa

SEQ ID NO: 175755 - RNA, 31 nt, Homo sapiens
caggaugcuguacucuacuacgcacaacugc

SEQ ID NO: 175756 - RNA, 63 nt, Homo sapiens
agacccacuggaaaccauucagauguucaucagcagaugaguggauagaaagauaaauggaua

SEQ ID NO: 175757 - RNA, 45 nt, Homo sapiens
acuguaaaugagaaucaggcugaggauugaccagcugguuagagg

SEQ ID NO: 175758 - RNA, 151 nt, Homo sapiens
ggguucuguuuuguccuggcuacgcuggcucugcagggagggcugggguucuuucuccuuuguguguuuauacauuagaucugugaguggaucuuagaagucacucaaaguacugcacugauucccaaacuuaguaagaagcagagcagga

SEQ ID NO: 175759 - RNA, 46 nt, Homo sapiens
ugacggggacuaaagggcgccaaagcaaaggggacauaaacaccag

SEQ ID NO: 175760 - RNA, 43 nt, Homo sapiens
gcuggugucuggauuuaccuggcgacacuuguugcucuggggg

SEQ ID NO: 175761 - RNA, 48 nt, Homo sapiens
cuaaaguggcugagcaucaagugguuguguuuucucugaaaacgccag

SEQ ID NO: 175762 - RNA, 45 nt, Homo sapiens
ugccgacggcaccaucgacauugaggaggucacagagaaccccaa

SEQ ID NO: 175763 - RNA, 48 nt, Homo sapiens
acaacaucaccgacccggaagagcuggagacagaguacccuuucuuug

SEQ ID NO: 175764 - RNA, 38 nt, Homo sapiens
uguucauggcugucuuauuuucuguuaaaauggaguug

SEQ ID NO: 175765 - RNA, 46 nt, Homo sapiens
gcagauuuggggagauguuagucaaaggauacaaaauuucaguuag

SEQ ID NO: 175766 - RNA, 45 nt, Homo sapiens
acgaauauacagguauuuuuuucauacuuccaacugaaugugaag

SEQ ID NO: 175767 - RNA, 66 nt, Homo sapiens
cucugcccgucgcuguccuguugaucgugggaggguuggugauuaugcuguacgucuuccauagaa

SEQ ID NO: 175768 - RNA, 47 nt, Homo sapiens
gcaggcuggggaauggagugcuguaugccucugugaacccggaguac

SEQ ID NO: 175769 - RNA, 49 nt, Homo sapiens
uacguuccugaugagugggagguggcucgggagaagaucaccaugagcc

SEQ ID NO: 175770 - RNA, 57 nt, Homo sapiens
augaaggaguugccaaggguguggugaaagaugaaccugaaaccagaguggccauua

SEQ ID NO: 175771 - RNA, 43 nt, Homo sapiens
ggccagccaacacuggucaucauggaacugaugacacggggcg

SEQ ID NO: 175772 - RNA, 50 nt, Homo sapiens
agacggcauggcauaccucaacgccaauaaguucguccacagagaccuug

SEQ ID NO: 175773 - RNA, 46 nt, Homo sapiens
aagguuguaugauugagugcaaaaucaaaaucugacaaagcagcaa

SEQ ID NO: 175774 - RNA, 41 nt, Homo sapiens
accccagaccaaucaaaucagaguuucuauugggugcccag

SEQ ID NO: 175775 - RNA, 37 nt, Homo sapiens
ggaaacguagugacguaaaaggucccggcugcugcgg

SEQ ID NO: 175776 - RNA, 43 nt, Homo sapiens
ucuucgaccugcugauccuuggauccugaaucugugcaaacag

SEQ ID NO: 175777 - RNA, 50 nt, Homo sapiens
acaaagggccaucguucauccaaggcuguuaccauuuuaacgcugccuaa

SEQ ID NO: 175778 - RNA, 37 nt, Homo sapiens
gcuggagugcuagguggaggcagcacagacgccacgg

SEQ ID NO: 175779 - RNA, 43 nt, Homo sapiens
guuucauuuuuagcacuucucaccagagagaugacagcacaag

SEQ ID NO: 175780 - RNA, 54 nt, Homo sapiens
uuaggaguaagaacaaagcugggauacggugauugcuaguugugacugaagauu

SEQ ID NO: 175781 - RNA, 96 nt, Homo sapiens
guuucaaucacuguagaaaagccccauuaugaauuuaaauuucaaggaaaggguguguguguguguauguguggggugugugugugugagagugau

SEQ ID NO: 175782 - RNA, 94 nt, Homo sapiens
ccuguuuuguguugcuuuuuuuguuuuguuuucuaucuugguuuccaccaagguguuagauuucuccuccuccuagccagguggcccugugagg

SEQ ID NO: 175783 - RNA, 44 nt, Homo sapiens
guggcuucguaaaauagaagagcagucacuguggaacuaccaaa

SEQ ID NO: 175784 - RNA, 43 nt, Homo sapiens
cacuccuuaagaaccaguggcgaaagacacuuucuuucuucac

SEQ ID NO: 175785 - RNA, 51 nt, Homo sapiens
guacagaaccauugucacagggauccuggcacagagaagaguuacgagcag

SEQ ID NO: 175786 - RNA, 36 nt, Homo sapiens
agaaaccuaacauccuacucuggaaacugaucucgg

SEQ ID NO: 175787 - RNA, 52 nt, Homo sapiens
caucuggcuugauuggucuggcugccgucauugucagcacagugccauggac

SEQ ID NO: 175788 - RNA, 42 nt, Homo sapiens
aagagacgcccggugaaaacaccugucugcuuucuaagccag

SEQ ID NO: 175789 - RNA, 41 nt, Homo sapiens
uggcagggcaugaacuauauaacucagaagucaauaaacag

SEQ ID NO: 175790 - RNA, 46 nt, Homo sapiens
acauuugccuaauguguguagaaaauucccugaucaaauggccaac

SEQ ID NO: 175791 - RNA, 43 nt, Homo sapiens
guguccagagaugcucucagcucacaaaaccaacagauggaag

SEQ ID NO: 175792 - RNA, 64 nt, Homo sapiens
agaaugucaaaauaaacaccaaaccaaaagaagguaggagugccauuuuuagaaaagacacaac

SEQ ID NO: 175793 - RNA, 48 nt, Homo sapiens
ggaaagaugaauuucaaugugaaaacacguuuuguugagggcuguacu

SEQ ID NO: 175794 - RNA, 58 nt, Homo sapiens
ugaaggggugaagacuugauuuuggagagggcaacaaaacaagggugugugugcauag

SEQ ID NO: 175795 - RNA, 79 nt, Homo sapiens
ugagagaaaggaaucuguaaacaguggaaacacugugggaguuucccauggugaagaguggaacgaaggcgauaugaac

SEQ ID NO: 175796 - RNA, 51 nt, Homo sapiens
acugggaugaagaugugcaaagucacagaauguaauggaaguccugauggu

SEQ ID NO: 175797 - RNA, 52 nt, Homo sapiens
gacuuugcacaucuucaucccaguuuuuaacagggauauauauacgaccauc

SEQ ID NO: 175798 - RNA, 44 nt, Homo sapiens
aagcaaagcucuuuuuuaaaaaaaaauguguaugauggacaaua

SEQ ID NO: 175799 - RNA, 46 nt, Homo sapiens
uuuccaaacgcagacauauuuggcuaguggaaaaacaaagaccauu

SEQ ID NO: 175800 - RNA, 45 nt, Homo sapiens
uuuggaacaaucagacgagaggaacaauuuucuauuucugcauag

SEQ ID NO: 175801 - RNA, 26 nt, Homo sapiens
acaguaucccuuucuuucaauuuugg

SEQ ID NO: 175802 - RNA, 37 nt, Homo sapiens
uguugguuuuucacuucugguccagucucgcugagug

SEQ ID NO: 175803 - RNA, 85 nt, Homo sapiens
acuaauaaugcugguguguugacaucgacaugacuaacaaccuggaguucccgcuuuacacucugaucagguaccuugggucguu

SEQ ID NO: 175804 - RNA, 43 nt, Homo sapiens
ugugugcgggcaguguuggaacgacccaagguaccugaucaga

SEQ ID NO: 175805 - RNA, 41 nt, Homo sapiens
ugcuuccauauuucccaguaaacgaggugaccaaaggucug

SEQ ID NO: 175806 - RNA, 42 nt, Homo sapiens
gaaauggaaauucauguuuuccaggcuguaauaaaaugaugc

SEQ ID NO: 175807 - RNA, 34 nt, Homo sapiens
aauggaauauauguguguauguaugugugagugu

SEQ ID NO: 175808 - RNA, 45 nt, Homo sapiens
uuagcaauaaaaaacugcuuugguaaaaucugggcuaacauuuuu

SEQ ID NO: 175809 - RNA, 76 nt, Homo sapiens
auuagauaccaaaauuggaucccuuuagucacgaaaauacuaagaaccaugagucuuacucauuucauggauggaa

SEQ ID NO: 175810 - RNA, 27 nt, Homo sapiens
ccugggucugguguucgaggacgagcg

SEQ ID NO: 175811 - RNA, 24 nt, Homo sapiens
ucuucacgcggcccucggcaccca

SEQ ID NO: 175812 - RNA, 42 nt, Homo sapiens
cgcgaccccggcuccgggccucugccgaccucaggggcagga

SEQ ID NO: 175813 - RNA, 45 nt, Homo sapiens
gggucagaagagcccaccccagcccaggaagaccagcugcuaggg

SEQ ID NO: 175814 - RNA, 45 nt, Homo sapiens
ucuugucuucaaggauaugcuuaaugcaaaacuccugccccucca

SEQ ID NO: 175815 - RNA, 41 nt, Homo sapiens
cgacuagcucaccugcaugaauuucaggaacaagccaugca

SEQ ID NO: 175816 - RNA, 46 nt, Homo sapiens
cacgauuccaagucaccccuggaucauaggucuccuuuggagagau

SEQ ID NO: 175817 - RNA, 127 nt, Homo sapiens
caugacuccaagcggaggagauccgaugaauuuaggccucaaaauuaccaccagcaggauuuccgacgaaugucugaucaccgccccgcuaugggcuaccauggccagggacccucagaccauuacc

SEQ ID NO: 175818 - RNA, 57 nt, Homo sapiens
ggccuuaugaccaguacagcagugaccgagaccaccggggacacagagauuauuaug

SEQ ID NO: 175819 - RNA, 44 nt, Homo sapiens
gauaacuacaaucaccccaacaagagacacuucaguaaugcagg

SEQ ID NO: 175820 - RNA, 53 nt, Homo sapiens
cgaaaacugcauaaguuauacaagauggcucauaagaaaaggucucaagaaga

SEQ ID NO: 175821 - RNA, 47 nt, Homo sapiens
gccgagugccuuaaagccuacucagaucaggagcacaucaaacucug

SEQ ID NO: 175822 - RNA, 46 nt, Homo sapiens
gaaacagcucgacaaaccugacaaggggcucaacgugcaagaacag

SEQ ID NO: 175823 - RNA, 50 nt, Homo sapiens
ugaggcaugccaugccucucuugcagaugaggaagcaguauuuagagagg

SEQ ID NO: 175824 - RNA, 59 nt, Homo sapiens
acauuacuugggaaacacauugcuuacaguaucggaagaccaugugcucuucagcaggc

SEQ ID NO: 175825 - RNA, 35 nt, Homo sapiens
ugaugaucuggaccaggagacauucagcauaguaa

SEQ ID NO: 175826 - RNA, 75 nt, Homo sapiens
aaacaaaugaguucuaggaaagacaaagaaggggacaaggaaagaaagaagucaaaagauaagaaagagaaggua

SEQ ID NO: 175827 - RNA, 70 nt, Homo sapiens
ggaugauggcuuggaaaaaaguccaaugaaaaaaaaacagaagaagaaagagaacaaggagaacaaggag

SEQ ID NO: 175828 - RNA, 41 nt, Homo sapiens
ucagguuuggcuugccaguuuguaaccucuggucuaaguaa

SEQ ID NO: 175829 - RNA, 84 nt, Homo sapiens
auaaaaucaucugaaauguguuugguuuacgaguggauuaaauggaaauagaauauguaagucuucgcuuaaucugucagcgag

SEQ ID NO: 175830 - RNA, 43 nt, Homo sapiens
ucaucuccuaggcauucagauaauccaucagaagagggagaag

SEQ ID NO: 175831 - RNA, 64 nt, Homo sapiens
ccaggccaaauuaaagaagcggaagccucggguaaagaaggaaaacaaagugcccaggcugaaa

SEQ ID NO: 175832 - RNA, 58 nt, Homo sapiens
gagcggauuacuuguugaagcugcucagaaagggucuggagaagaagggggcugugac

SEQ ID NO: 175833 - RNA, 47 nt, Homo sapiens
uuguugucucuguuuauccugauccacuaaccaggauguggguggug

SEQ ID NO: 175834 - RNA, 45 nt, Homo sapiens
cggcucgugagggauuuucagugacugggagccauggacaugaga

SEQ ID NO: 175835 - RNA, 46 nt, Homo sapiens
cuccuggaaggaggaaauccacgacggcugggaugcucuagcagau

SEQ ID NO: 175836 - RNA, 62 nt, Homo sapiens
ucucgccuguugcuggggauuuaugaacauggcuauggaaacugggaguuaauuaaaacaga

SEQ ID NO: 175837 - RNA, 74 nt, Homo sapiens
uaaugugaaauccauuauccaacaugaagaggaguuugagaugcugcauaaaucuaucccuguggacccugaag

SEQ ID NO: 175838 - RNA, 26 nt, Homo sapiens
cuaaugugaaacugguauuuuucagg

SEQ ID NO: 175839 - RNA, 80 nt, Homo sapiens
gaucacaagcauuguuaauuaucuuggauauauauugugcguuauggcaaacacaaaggauuuagagaauuaauuggaau

SEQ ID NO: 175840 - RNA, 76 nt, Homo sapiens
cugggugaacugauccacaacagcugugugucagcaaugcaggaauacgaagagcagcugaaagaaaaugccagcg

SEQ ID NO: 175841 - RNA, 67 nt, Homo sapiens
uucagucaauguccagggguucuuguuggagccuuagaaugaccacuaaaggaacgcaaagaaaagu

SEQ ID NO: 175842 - RNA, 46 nt, Homo sapiens
ugaccguuuaugccagcauuccuauugcuuuuaugggggagcagau

SEQ ID NO: 175843 - RNA, 47 nt, Homo sapiens
gguauuagaucaucuggugauucagcgcauggacaccacuggccgga

SEQ ID NO: 175844 - RNA, 62 nt, Homo sapiens
uaaauauuuaccgcuuaguuacaaaggggacuguggaggaggagaucauagaacgggccaaa

SEQ ID NO: 175845 - RNA, 43 nt, Homo sapiens
uuuuuauuucuauggcauaauguuguugaaugugacuauuaga

SEQ ID NO: 175846 - RNA, 77 nt, Homo sapiens
caaggcucucguucauuaaggauaagaggaauggaauaauuaaagacaucggucaucaacuaauucccauuccuccu

SEQ ID NO: 175847 - RNA, 49 nt, Homo sapiens
uuuuguuuggggggcacauauagaagagcuacuuaggaugaaauagaag

SEQ ID NO: 175848 - RNA, 43 nt, Homo sapiens
acucuuuuggugacuaaguccugaaaaauauauuugccauguc

SEQ ID NO: 175849 - RNA, 74 nt, Homo sapiens
gugguucuccugguagcuuccagauaccaaauccuugggcguggaagagcaguaaggcaggaguaggggagagu

SEQ ID NO: 175850 - RNA, 47 nt, Homo sapiens
aauucugacuggagaugugaaagauguaugauuagauggcaggagau

SEQ ID NO: 175851 - RNA, 46 nt, Homo sapiens
caaaaaagauguggagaaaucccuuccugcuaaaguggaacagauu

SEQ ID NO: 175852 - RNA, 46 nt, Homo sapiens
uuugaauuuugggaagauuuugaagaagaccaugggaaggggagag

SEQ ID NO: 175853 - RNA, 50 nt, Homo sapiens
aaugucuuuccuuaugggaaagauucauuuuuuuacaguuuuuuuuccua

SEQ ID NO: 175854 - RNA, 34 nt, Homo sapiens
aauauaaguaaaaugaaauauacaagguacacaa

SEQ ID NO: 175855 - RNA, 34 nt, Homo sapiens
gcugauuaagcacauauuauauauacgugcaaac

SEQ ID NO: 175856 - RNA, 30 nt, Homo sapiens
augcacuuuggagacuagacacgugcuagg

SEQ ID NO: 175857 - RNA, 83 nt, Homo sapiens
cauccacagcacaugggagagugaagaauccuuacagcaacagaaagugaagggccuaaaaaaacuagagaacuucaagaaaa

SEQ ID NO: 175858 - RNA, 46 nt, Homo sapiens
augcgauugaagcuaauggcgacccuaguggugacuuugacacuga

SEQ ID NO: 175859 - RNA, 42 nt, Homo sapiens
aguugaugaacagcaagauaauagugaaacuauugaaaaggu

SEQ ID NO: 175860 - RNA, 46 nt, Homo sapiens
guguuaaaaagcagccgaagacucagcguggaaagagaaaaaagca

SEQ ID NO: 175861 - RNA, 46 nt, Homo sapiens
gaagaugaacaggaacaaggcaccagugcagagagugagccagaac

SEQ ID NO: 175862 - RNA, 25 nt, Homo sapiens
ugguucucagaguuucuacccagua

SEQ ID NO: 175863 - RNA, 49 nt, Homo sapiens
uuugacuguguaagcccccucugagggguaaacuguuguggacuugguc

SEQ ID NO: 175864 - RNA, 50 nt, Homo sapiens
uuaaauugcauuuugacuuuuuccaugucuauuuacauugccuuggggcc

SEQ ID NO: 175865 - RNA, 62 nt, Homo sapiens
ugauguuuauggggucaggcggucaaaccgaagcagacaagaaccaucgcgauuuaauauua

SEQ ID NO: 175866 - RNA, 39 nt, Homo sapiens
ucuucaauugcaauaaacguuugauaauaauaauggggg

SEQ ID NO: 175867 - RNA, 39 nt, Homo sapiens
uuuucuucagcuuacuucaucauuuuuauguuguuguug

SEQ ID NO: 175868 - RNA, 49 nt, Homo sapiens
ucccagaagccaaagagaagccagccucuaagaaggaacggauagcuga

SEQ ID NO: 175869 - RNA, 45 nt, Homo sapiens
cucagccucugaagaagcuucggguucagacucaggcagucaguc

SEQ ID NO: 175870 - RNA, 350 nt, Homo sapiens
ccccacaauaacaaauuauccagccucaggcaucuauaaugccaccacuaggcugggcacggcgguucacgccuguaaucccagcacuuugggaggcugaggugggaucccuugagcuaggaguucgagaccagcuugggcaauuuagggagaugccauuucuacaaaaaauguaaaaauuagccggguguggcaguaugcaccuauagucccagcuauuuggaaggcugaggugggaggauugcuugaguccaagagcuugcggcugcagugagcugugaucacauuacgugcacuccauccugggcaacugagcaagacccuauccaaaaaaaacaaaaacccuauga

SEQ ID NO: 175871 - RNA, 44 nt, Homo sapiens
aguuaaaauguugcccugaagugaugcucauggggauaguauaa

SEQ ID NO: 175872 - RNA, 31 nt, Homo sapiens
acuuccuuucccuuggguuuauaaaaacauu

SEQ ID NO: 175873 - RNA, 49 nt, Homo sapiens
uugucuuggccuaccaggagaguuuguuuaggccaguuacaggagagau

SEQ ID NO: 175874 - RNA, 58 nt, Homo sapiens
gguuauuuuauucuuacuguuuguuucaucuuacuuucuugcaccccuccuucauauc

SEQ ID NO: 175875 - RNA, 42 nt, Homo sapiens
cacuuguguaugcuuaacuguuaccucugugccuggcaagag

SEQ ID NO: 175876 - RNA, 42 nt, Homo sapiens
uggugucacuugaacaaagaaacuuaaaaaaaaauuccucua

SEQ ID NO: 175877 - RNA, 49 nt, Homo sapiens
uccugccauacuagaguuuuuuuagcaguuggaguaggcuguccuguag

SEQ ID NO: 175878 - RNA, 46 nt, Homo sapiens
uaccguacauuuucucaguuggcauuugauggagaaaaacucaggu

SEQ ID NO: 175879 - RNA, 48 nt, Homo sapiens
acggguguuaacagcuguuuaauacauggcucauaaacaaagggaaga

SEQ ID NO: 175880 - RNA, 46 nt, Homo sapiens
auaccuuagcgucccuucuccccgcccccguucagugugaagagau

SEQ ID NO: 175881 - RNA, 70 nt, Homo sapiens
aaaaagugcaggcacuauuuauaaauuuuaaaggcacuauuuggaaaucuuaaaauagaaaauuugccca

SEQ ID NO: 175882 - RNA, 45 nt, Homo sapiens
aaaggaagggaacucuaguugggacuuuccggugggcggcuucuu

SEQ ID NO: 175883 - RNA, 50 nt, Homo sapiens
cccccucucugcucuucuggggaacucuggugccgacauaaaaggcaguu

SEQ ID NO: 175884 - RNA, 59 nt, Homo sapiens
aaauccuacaauuuucaggggcgcuuuaccagauauucuaaaaggcuggggaugauuag

SEQ ID NO: 175885 - RNA, 59 nt, Homo sapiens
ccauacuuuuuaucugaauaauuugcagcuuggggauaacuuaaguaacaucaaagaau

SEQ ID NO: 175886 - RNA, 46 nt, Homo sapiens
augugauuuaucaaaaccuuuacuugaugguuagaguuccugcauu

SEQ ID NO: 175887 - RNA, 46 nt, Homo sapiens; identical to SEQ ID NO: 100995

SEQ ID NO: 175888 - RNA, 46 nt, Homo sapiens
uuugagaaaguuuccuuauugauagugaugcuuccacuguucgguu

SEQ ID NO: 175889 - RNA, 46 nt, Homo sapiens
ggacauacuacauggaucagguaaguucacgaucauuggugauaau

SEQ ID NO: 175890 - RNA, 65 nt, Homo sapiens
uugaggguuauuuuauuuauuuuucguuuuuuaacggaggauuuugccuuuauuuuuaauuauuu

SEQ ID NO: 175891 - RNA, 71 nt, Homo sapiens
agaaaagcagcuuuuaggagcuuucuuuucgugccuuguuggaaagaagcagccguacugagagcccaggu

SEQ ID NO: 175892 - RNA, 45 nt, Homo sapiens
gaccccaguaagucccuaggaaaggcagggggcuacgggggcccc

SEQ ID NO: 175893 - RNA, 50 nt, Homo sapiens
ggggcccccguagcccccugccuuuccuagggacuuacuggggucgauuc

SEQ ID NO: 175894 - RNA, 46 nt, Homo sapiens
ccagaggggguuaagaagcccuccccccucccccuguugggguggu

SEQ ID NO: 175895 - RNA, 50 nt, Homo sapiens; identical to SEQ ID NO: 101003

SEQ ID NO: 175896 - RNA, 45 nt, Homo sapiens
gaaucuaaagcucagcuaaguacuaaucuuuuuaaaaauuaaucc

SEQ ID NO: 175897 - RNA, 57 nt, Homo sapiens
auucccccuuaaauuuugucuuuagauuauuuuuaggcaucauaaagaaggaaaaac

SEQ ID NO: 175898 - RNA, 197 nt, Homo sapiens
ccauacucuugaauuuuugccugaaucaguaugggaaguaaauauauugugauuaugagaaguuucuuuggggggaggaguguaauauuuucaagguuauauaauggguuaaagaauuuugugaaagaacaaagaaaaauggauauucuugaauaaaaauugguugcauuaacuuuugcuccagugcaacuugaaca

SEQ ID NO: 175899 - RNA, 124 nt, Homo sapiens
auuguugaaauggguguauacuuacuugauuugaaauauaagggaaguguugggauauguguuuucuguuggauuuggacguggaguuucuuggguuacugauuuaaaggugaucguguuugga

SEQ ID NO: 175900 - RNA, 49 nt, Homo sapiens
uacgugauugcaaauuaucaaaguaaugucacaaagcaaauucuccuaa

SEQ ID NO: 175901 - RNA, 69 nt, Homo sapiens
auuuaggagaauuugcuuugugacauuacuuugauaauuugcaaucacguauguccuauuguuaauaac

SEQ ID NO: 175902 - RNA, 47 nt, Homo sapiens
ggauuuuuuugggugugugaauaugcuugucugaauggagugcuugg

SEQ ID NO: 175903 - RNA, 40 nt, Homo sapiens
uguauauaguaaacaguauccuaauuguugccaaggagac

SEQ ID NO: 175904 - RNA, 40 nt, Homo sapiens
ugaaaauucgagucagaauuguaaagagggauuuagugaa

SEQ ID NO: 175905 - RNA, 72 nt, Homo sapiens
ggaaugagaaaguggccuuacaggugggcaauguaaacuuuccuguagaaggauugaaaguaaauagaugua

SEQ ID NO: 175906 - RNA, 363 nt, Homo sapiens
gauaugggaaacgcuauuuuccauguuuaguuaugggguauucaagucuaacuaguggaaaguauggauacauuuuauuuauuuuuugagacggagucucgcucuguugcucaggcuagagugcagcgaugcgaucucagcucacugcaacuucugccuccuggguucaagcaauuucuggcuaauuuuuguauuuuuaguagagacgggguuugaccauguuggccaggcuggucucaaacaccugaccucaagugaucugccugccuccaccuccccaagugcugggauuauagguguaagccaccgggccuggccggauacauuuuuauuaucaaguauauauuuuaggaaugauuagug

SEQ ID NO: 175907 - RNA, 56 nt, Homo sapiens
augauuauuguaaucauacuugggaacagaagugaugaaaaagguauguuacuuga

SEQ ID NO: 175908 - RNA, 49 nt, Homo sapiens
uuacuauuagucaucguuuuuugauuauuuaaaaauuuguacuauggac

SEQ ID NO: 175909 - RNA, 54 nt, Homo sapiens
uaaauguuuuuacccaacaucugcaauugaauaguuaccaacauuuaaguagaa

SEQ ID NO: 175910 - RNA, 44 nt, Homo sapiens
ugggcagacuuacauaguacaucugaaaucagauacugguuuau

SEQ ID NO: 175911 - RNA, 49 nt, Homo sapiens
auggaaauagauuugauaauuacggugcuagcuagcugaugacguuugg

SEQ ID NO: 175912 - RNA, 46 nt, Homo sapiens; identical to SEQ ID NO: 101026

SEQ ID NO: 175913 - RNA, 36 nt, Homo sapiens
ccuuccucuuuccauauuuguauagugugguggugu

SEQ ID NO: 175914 - RNA, 44 nt, Homo sapiens
cucgagagccgggcuggggaaggggcccgcggcggaguuggcuc

SEQ ID NO: 175915 - RNA, 42 nt, Homo sapiens
cgacacgagccgauccaucauccgcaauguaaaaggccccgu

SEQ ID NO: 175916 - RNA, 45 nt, Homo sapiens
uaguaaugaacuuugucuugggcccgaggaaacugagcacuucuu

SEQ ID NO: 175917 - RNA, 45 nt, Homo sapiens
caguuguugaaauggaaacguauaaaaagcuugagcuugcugaag

SEQ ID NO: 175918 - RNA, 47 nt, Homo sapiens
uuguuucagaccucugaugggccgagcugccuguggacggugcucag

SEQ ID NO: 175919 - RNA, 45 nt, Homo sapiens
gacuuuucccaggcugggaauaagggccaucaugugugggucacu

SEQ ID NO: 175920 - RNA, 55 nt, Homo sapiens
uuccaauugugauuuuucuuuccucccucuucagaaaacaacauggaagccaagu

SEQ ID NO: 175921 - RNA, 72 nt, Homo sapiens
aaacaguagcuuggcacaugggagugagccuggugaaucuggacuccaugggccaggaggcauuuggauuga

SEQ ID NO: 175922 - RNA, 42 nt, Homo sapiens
agaugaagacugaagaacagagaaaguaggggcuaguuaagu

SEQ ID NO: 175923 - RNA, 43 nt, Homo sapiens
gaguaggacucucccagaagaaagaaugugaggaaaaacauuc

SEQ ID NO: 175924 - RNA, 46 nt, Homo sapiens
cugcagcggccaccuguagucuccaagccguugaccccauugcagg

SEQ ID NO: 175925 - RNA, 45 nt, Homo sapiens
cccggcugucuggggccaaguccaggaccgcaggaaccgcgaccc

SEQ ID NO: 175926 - RNA, 45 nt, Homo sapiens
gaccaucugcacaggcgcucgacagcuccaagacgcugcggccaa

SEQ ID NO: 175927 - RNA, 63 nt, Homo sapiens
uugcuauccgugggaccuuaugcaaauaaaucugagccucagccuucucaucuaaaaaugcgg

SEQ ID NO: 175928 - RNA, 69 nt, Homo sapiens
uaagcucuuuggcugcuguguugauauuaaaccauuggagagcaagaauggaagcugggaaaaguccuc

SEQ ID NO: 175929 - RNA, 41 nt, Homo sapiens
uuaaaugcaguuagccuauguccuuauuagucugaggggaa

SEQ ID NO: 175930 - RNA, 45 nt, Homo sapiens
uuccuguggcacagagggauuucggaaugccaagaagggcacagg

SEQ ID NO: 175931 - RNA, 51 nt, Homo sapiens
guuugcuuucugcauggcucaucacugaguggagaauccucauuauacuac

SEQ ID NO: 175932 - RNA, 52 nt, Homo sapiens
cguggccuaggcccaaacucugcucugagaaaauaaauaucuguaccaccug

SEQ ID NO: 175933 - RNA, 50 nt, Homo sapiens
cguuuggggcccucuaugcuggcuuuucaccccagaggacacaggcagcu

SEQ ID NO: 175934 - RNA, 42 nt, Homo sapiens
gugugucucugucucuccuagccccucucucacacaucacau

SEQ ID NO: 175935 - RNA, 105 nt, Homo sapiens
ucucacgggcccugccccagccccuaagccccguccccuaacccccaguccucacuguccuguuuucuuaggcacugagggaucugaguaggucugggauggaca

SEQ ID NO: 175936 - RNA, 70 nt, Homo sapiens
gcauccuacaagguugccuacaguaaugacagugcgaacuggacugaguaccaggaccccaggacuggca

SEQ ID NO: 175937 - RNA, 72 nt, Homo sapiens
accuggggcuugcaucucuucagcuggaaccccuccuaugcacggcuggacaagcagggcaacuucaacgcc

SEQ ID NO: 175938 - RNA, 45 nt, Homo sapiens
uaauggacacgaauucgauuucauccaugauguuaauaaaaaaca

SEQ ID NO: 175939 - RNA, 46 nt, Homo sapiens
cagguguggugacgcagggugccagccgcuuggccagucaugagua

SEQ ID NO: 175940 - RNA, 46 nt, Homo sapiens
augccuggacacccagcagcaaugacgauaaccccuggauccaggu

SEQ ID NO: 175941 - RNA, 65 nt, Homo sapiens
gugcgugugaccuucuuggguuugcagcauugggucccggagcuggcccgccugaaccgcgcagg

SEQ ID NO: 175942 - RNA, 44 nt, Homo sapiens
gaggagauuucccaagaagugcgaggagaugucuuccccucgua

SEQ ID NO: 175943 - RNA, 44 nt, Homo sapiens
agagaggaagaagggucgugagucaccgaacccgaaggagagga

SEQ ID NO: 175944 - RNA, 78 nt, Homo sapiens
uuuauauaagugugucuuagauauauuuuaaauagaaaauaagcuuucugauuuacuuguuugguauuuaaagcacag

SEQ ID NO: 175945 - RNA, 45 nt, Homo sapiens
gcauaaaugaggacuuuuagcuuuguuaagcauaaccucccggag

SEQ ID NO: 175946 - RNA, 47 nt, Homo sapiens
caauaaucaggauagaucaugguucccaaacugguucugaguggcag

SEQ ID NO: 175947 - RNA, 39 nt, Homo sapiens
ggcuuucaacucacugccuacucggucaggcugugggaa

SEQ ID NO: 175948 - RNA, 144 nt, Homo sapiens
gcucagccaagaacuggggcccuaugauacaccaaucaagagcauaaaccaucugggaaccggccaggccuccgagcgagcuuccgcuccucuccggggggcauccaugaggcgcuccuuccaccaaugccucuuccuacacac

SEQ ID NO: 175949 - RNA, 66 nt, Homo sapiens
gguccuacagcaccauucuuuuuacauuaacagggaaacugaagcuagaggggagaccugcccaag

SEQ ID NO: 175950 - RNA, 45 nt, Homo sapiens
uccuccaucuugggcaggaaguccuuggcaaaggggcuucccaca

SEQ ID NO: 175951 - RNA, 45 nt, Homo sapiens
cauugccauggugauagcugggcuggguguccuuggggccaccac

SEQ ID NO: 175952 - RNA, 51 nt, Homo sapiens
cuagggguugaccuggcacugcagcucgcaaguucuccaucuuggccucag

SEQ ID NO: 175953 - RNA, 94 nt, Homo sapiens
cacugugaacaucucaacauacucccucccagagcucugagauccagaggguaaggguagccauggaagaaaaaaccugaacccagagagugag

SEQ ID NO: 175954 - RNA, 43 nt, Homo sapiens
gugagugagagagugagugagugagagagugagagagagugag

SEQ ID NO: 175955 - RNA, 44 nt, Homo sapiens
ggggcagaccaccccagcugacuccagggugguaccugucggca

SEQ ID NO: 175956 - RNA, 26 nt, Homo sapiens
gggacuucuggccuugcuuugugggg

SEQ ID NO: 175957 - RNA, 40 nt, Homo sapiens
aagggaggcucagagacguuugggaccaaccgagaucaca

SEQ ID NO: 175958 - RNA, 29 nt, Homo sapiens
aauuuguuugcacuuaucuguacuucaaa

SEQ ID NO: 175959 - RNA, 35 nt, Homo sapiens
guuguagguguucagucaguauuggcugacuaaau

SEQ ID NO: 175960 - RNA, 47 nt, Homo sapiens
aguacuucugaggaggcugcagguuccaugaaaccagucugaaaucg

SEQ ID NO: 175961 - RNA, 46 nt, Homo sapiens
ggaauccaaaagauaccuagugggagaacaguggauaaauuggaag

SEQ ID NO: 175962 - RNA, 46 nt, Homo sapiens
agcugcuaucauauauacgugaaaauuaccaaaagacuguggccac

SEQ ID NO: 175963 - RNA, 46 nt, Homo sapiens
ugaaucaaguaaaaaguagucucuuaaaaacuaguaaaagucuucg

SEQ ID NO: 175964 - RNA, 49 nt, Homo sapiens
aguuucgugccauugaaauacgcccuagaugcuuucagcuucccugcag

SEQ ID NO: 175965 - RNA, 45 nt, Homo sapiens
guguuuaacugaggauucagcguaccuagcagaguuucuggagga

SEQ ID NO: 175966 - RNA, 58 nt, Homo sapiens
ugacacaagagaacaaaucaccacuucuuucugugccuuuuuugucaagugcucguag

SEQ ID NO: 175967 - RNA, 48 nt, Homo sapiens
caucuuuguccauauaauuuguugaacuaauagcugcccuuaugucug

SEQ ID NO: 175968 - RNA, 37 nt, Homo sapiens
gauuguuggcuaauaaaauauguccaaauaccaugga

SEQ ID NO: 175969 - RNA, 42 nt, Homo sapiens
agccauucugugucagcuguggauggucuagaggauaaacuu

SEQ ID NO: 175970 - RNA, 46 nt, Homo sapiens
gagcuuuucuaaaacuacaccaagaaggaucucucauacaccacaa

SEQ ID NO: 175971 - RNA, 42 nt, Homo sapiens
aaaggauaaagcuaucaaaacuccaaaaagaccagggaauuc

SEQ ID NO: 175972 - RNA, 66 nt, Homo sapiens
cucccccugaacucucacagagagcuacauuggacaccgucccuccuccacccccuucuaaaguug

SEQ ID NO: 175973 - RNA, 46 nt, Homo sapiens
gcggcuggcguaguugaggguguugagggucucgucgaagucggag

SEQ ID NO: 175974 - RNA, 50 nt, Homo sapiens
cuagguguuacccaagccuccucaucccucccggcugaggcugcagccac

SEQ ID NO: 175975 - RNA, 44 nt, Homo sapiens
cagcgcucccgcuccgaaggugcucugacaaccccgcaggcgcu

SEQ ID NO: 175976 - RNA, 46 nt, Homo sapiens
ggccugcggaaggcggcggcggcgguggcgggagaaggcgggcagg

SEQ ID NO: 175977 - RNA, 42 nt, Homo sapiens
uucacaaauaaauaaauucacauuaggcagagccuccugcuu

SEQ ID NO: 175978 - RNA, 55 nt, Homo sapiens
accgaggcuuuuuggccucagcaccuucgaagugguuccuuggcagacugccuuu

SEQ ID NO: 175979 - RNA, 57 nt, Homo sapiens
gcccucuuccaggaaaggcagucugccaaggaaccacuucgaaggugcugaggccaa

SEQ ID NO: 175980 - RNA, 50 nt, Homo sapiens
ugauuugaggggcauucggggggcaaaaucaacaggaccuggggggagac

SEQ ID NO: 175981 - RNA, 65 nt, Homo sapiens
ccuuggggguguaaccuguuucggggaagccuuuacagcagcucuuugauguuucuccaguggaa

SEQ ID NO: 175982 - RNA, 45 nt, Homo sapiens
cagugcucagccucucccuccccagaaaggagagaaggagaaaag

SEQ ID NO: 175983 - RNA, 41 nt, Homo sapiens
cagcgggcuguggugcaugaaagcuuugagcuggaggccag

SEQ ID NO: 175984 - RNA, 55 nt, Homo sapiens
ccauguuuggagacauuuaugguugucacaacuggggugaugcuacuggcaucuc

SEQ ID NO: 175985 - RNA, 42 nt, Homo sapiens
ggcaaguugauucaccucucuaaaccucagccuucugagcug

SEQ ID NO: 175986 - RNA, 46 nt, Homo sapiens
ccuuggaacacauggugccauauuuagcuacuaaaaagcucuucac

SEQ ID NO: 175987 - RNA, 35 nt, Homo sapiens
ggccuuucuaggggauguuuuuuuauaagccagau

SEQ ID NO: 175988 - RNA, 48 nt, Homo sapiens
guuugcccagaugcuggagaaggugugcguggagacgguggagagugg

SEQ ID NO: 175989 - RNA, 47 nt, Homo sapiens
gcccuggggagaaaggcuucugauuggauaagccagggacacacugu

SEQ ID NO: 175990 - RNA, 25 nt, Homo sapiens
uccgggagcccaucaucugcaaaaa

SEQ ID NO: 175991 - RNA, 41 nt, Homo sapiens
guggggcaguuggccaugucacucaucucgggacugggagg

SEQ ID NO: 175992 - RNA, 44 nt, Homo sapiens
agaaguacaguguggcugucaagugugccaccaucaccccugau

SEQ ID NO: 175993 - RNA, 50 nt, Homo sapiens
uagcacaccaccuucagcaaaaauaugguggaaguuagccacauucuuua

SEQ ID NO: 175994 - RNA, 40 nt, Homo sapiens
ggucccuuggcccugccuaaugccuguugccauggaaacc

SEQ ID NO: 175995 - RNA, 46 nt, Homo sapiens
caggcccacgucagcuauuuuuggagccuuuuacacgacagcugga

SEQ ID NO: 175996 - RNA, 45 nt, Homo sapiens
aggggugguguccugccgggcugcuccugguucucaccaaagaug

SEQ ID NO: 175997 - RNA, 45 nt, Homo sapiens
gcagcgagaaggacagcauccgcauccgggcgcuaguggugagac

SEQ ID NO: 175998 - RNA, 23 nt, Homo sapiens
ggguagguggaguggagaggcug

SEQ ID NO: 175999 - RNA, 42 nt, Homo sapiens
auguuucagauacuguuggacccagaagagaagggcacugag

SEQ ID NO: 176000 - RNA, 55 nt, Homo sapiens
ccgccuggaccaggcuguccuugaccugcagagaugugugagcuuggagcccaag

SEQ ID NO: 176001 - RNA, 58 nt, Homo sapiens
cccacauucgucccccccaccuucuucuggccuuuccucgagaucuuucccuacugcu

SEQ ID NO: 176002 - RNA, 41 nt, Homo sapiens
acucaggcccugggucuggacgcgacgccccaggaccaggc

SEQ ID NO: 176003 - RNA, 46 nt, Homo sapiens
gugggcagcgcagguggugaaggggcuucagggaacaaaccggcaa

SEQ ID NO: 176004 - RNA, 54 nt, Homo sapiens
ugggucuguuugcuauuuugcauggugggaucucuggccccucagggacuugag

SEQ ID NO: 176005 - RNA, 49 nt, Homo sapiens
cacacaguggaaccccauuuauaucauagcagaagaaauaggauuauca

SEQ ID NO: 176006 - RNA, 41 nt, Homo sapiens
ggagagugaaugugugagaacacuaagaccacucugaacga

SEQ ID NO: 176007 - RNA, 47 nt, Homo sapiens
aguuccuggcacaggggacuaggggcauguagaguauaugaggaggc

SEQ ID NO: 176008 - RNA, 71 nt, Homo sapiens
gaaggacucgcuagagauugucauggccagagaucauaggucacuucagguagcaagaccccuggcaaacu

SEQ ID NO: 176009 - RNA, 52 nt, Homo sapiens
agagugacucugggaggacagggguggggacccagaguuagcaguggggaug

SEQ ID NO: 176010 - RNA, 32 nt, Homo sapiens
ccauccuuuuuccaaacagggauauagaagug

SEQ ID NO: 176011 - RNA, 53 nt, Homo sapiens
ccacaaacccagugauggguaaauagggcagacgccagugagaucagggagag

SEQ ID NO: 176012 - RNA, 51 nt, Homo sapiens
ucuggucucagcaugucacgcugacaguacggagcagguuggaucuguggg

SEQ ID NO: 176013 - RNA, 46 nt, Homo sapiens
aggaugacaaccggggccuaggccaagggcucaaggacaacaagag

SEQ ID NO: 176014 - RNA, 45 nt, Homo sapiens
ucaauguccaaaagagagcggcaguccgaaggccaguaccaggcg

SEQ ID NO: 176015 - RNA, 46 nt, Homo sapiens
accuggagccccugggugggugguggggaggggcgcuggcccagcc

SEQ ID NO: 176016 - RNA, 53 nt, Homo sapiens
acuauagcaccgagaaugacguggagaccauccgggccagcgucugcgccccc

SEQ ID NO: 176017 - RNA, 42 nt, Homo sapiens
ucagccccaugggcacccgcuccacccugcuggcagccaggu

SEQ ID NO: 176018 - RNA, 42 nt, Homo sapiens
ggccacgaccuacagcaguggcaaccagaaugagaagcagau

SEQ ID NO: 176019 - RNA, 44 nt, Homo sapiens
uacaccaacaguaucuacacgcuguccaucagcagcgccacgca

SEQ ID NO: 176020 - RNA, 42 nt, Homo sapiens
guucuaucagugaggucagccuucuccugaugguggccaaau

SEQ ID NO: 176021 - RNA, 26 nt, Homo sapiens
aucgagaagaaccacccggacuuggc

SEQ ID NO: 176022 - RNA, 41 nt, Homo sapiens
cuggcaucgaggagugacgaagcggucccugucgccucacc

SEQ ID NO: 176023 - RNA, 27 nt, Homo sapiens
agcauggguuccucaaccugggccagg

SEQ ID NO: 176024 - RNA, 45 nt, Homo sapiens
ggcacucuucacccucccgagcccugcccgucucggccccaugcc

SEQ ID NO: 176025 - RNA, 50 nt, Homo sapiens
gagcuaauaaucuaguagagcaagaugggcagaaacaaauaagcaaagca

SEQ ID NO: 176026 - RNA, 58 nt, Homo sapiens
acguacugugugcacuauagucugaaaguccuagucugaaagggcagggcaggcccca

SEQ ID NO: 176027 - RNA, 54 nt, Homo sapiens
augggcagggggugguggugggggagggauuccgucucucugccugggcagggg

SEQ ID NO: 176028 - RNA, 55 nt, Homo sapiens
ccuucacaggcuccuccuuccccucucacccuuuaaugacacacugaccacaggg

SEQ ID NO: 176029 - RNA, 53 nt, Homo sapiens
gcagcuuccccaaagagggcaguuucccuggauccccagagcucugauucagu

SEQ ID NO: 176030 - RNA, 56 nt, Homo sapiens
cugacuccaaaauuugugcucauuucuccagucucacaccugggcugucccuagag

SEQ ID NO: 176031 - RNA, 45 nt, Homo sapiens
caaaaguguguguaaacauagacaaagaaacaaaaacugggauau

SEQ ID NO: 176032 - RNA, 48 nt, Homo sapiens
gguugaugauaauaaagacuccagaaaaauucaguuuguggguuguca

SEQ ID NO: 176033 - RNA, 48 nt, Homo sapiens
aggaagggaggucagcagaugcagcccgagcugcggaacgcgggcaga

SEQ ID NO: 176034 - RNA, 31 nt, Homo sapiens
gcuaauggggaggugaaggcucgaggaccaa

SEQ ID NO: 176035 - RNA, 55 nt, Homo sapiens
cacacgaucugugcacagugaggacagaacaugcuugugcuucugcgcuucugag

SEQ ID NO: 176036 - RNA, 40 nt, Homo sapiens
caacaagggaggcgggacgccgagguccugccuaggaggg

SEQ ID NO: 176037 - RNA, 52 nt, Homo sapiens
cccagaagcggcaaggucagcgccgggagucgucaaggccguacuucucugc

SEQ ID NO: 176038 - RNA, 65 nt, Homo sapiens
ccggagcggcggggcccgaugugaaguugacugaggcgcuugcaucaauuuccucuccaagagcg

SEQ ID NO: 176039 - RNA, 49 nt, Homo sapiens
guguucaguuugaacacuuagaguuuuguuuauuuuuaaucagugugag

SEQ ID NO: 176040 - RNA, 45 nt, Homo sapiens
uaacagaaagcuaaaauacccuuaagccagugauuaaucuguggg

SEQ ID NO: 176041 - RNA, 48 nt, Homo sapiens
cauuaaaagaaaauauaauaaaugcuuagaagaugaaggaccaaaggg

SEQ ID NO: 176042 - RNA, 65 nt, Homo sapiens
ugaagacacauuuagacacauuuaacacuuuuuuuucuauugaaagaaacaugguagagcaaagg

SEQ ID NO: 176043 - RNA, 27 nt, Homo sapiens
uguucacaaaauuugcuucugaauauu

SEQ ID NO: 176044 - RNA, 46 nt, Homo sapiens
acgggagccauacuggcagcaagaaauggaccaguggcuauaguug

SEQ ID NO: 176045 - RNA, 44 nt, Homo sapiens
uggugguaucuuucaagcaauuaaguuuucacaauucuccagua

SEQ ID NO: 176046 - RNA, 51 nt, Homo sapiens
aacaccugcccaccccagcagccaguggacgaccucugcgaugggcaacaa

SEQ ID NO: 176047 - RNA, 25 nt, Homo sapiens
uuccuaaucuuacccugaggcaguu

SEQ ID NO: 176048 - RNA, 46 nt, Homo sapiens
ucaaaaagaguuuaaguaacuuaaaaaauacauauaauaaguuuaa

SEQ ID NO: 176049 - RNA, 44 nt, Homo sapiens
auuggaguuuugcauuucgcagaauguccaguagcuacugauga

SEQ ID NO: 176050 - RNA, 41 nt, Homo sapiens
gggggcaguggcaccgugggaagggaggcaguggcaccgug

SEQ ID NO: 176051 - RNA, 58 nt, Homo sapiens
aguguguaguuucccuguuauauccucugugggcaccauguccugaaccacagcuagg

SEQ ID NO: 176052 - RNA, 37 nt, Homo sapiens
uccugauguuuaaacuugaggacgcugggccuauuua

SEQ ID NO: 176053 - RNA, 41 nt, Homo sapiens
uuaguaggagguuggagccccugugagguugcauggaacau

SEQ ID NO: 176054 - RNA, 59 nt, Homo sapiens
uuuuggagaaccugauccacuguuaacucuaauaaucguuuccugaagaacagccccau

SEQ ID NO: 176055 - RNA, 84 nt, Homo sapiens
auggaagguaguauuuacauacaaaauucacagauuuggaccuuagcaacuuugauccugaugggcuugauagagaaauuacaa

SEQ ID NO: 176056 - RNA, 45 nt, Homo sapiens
auaugaacauguuuacaugcuaaagggacagagucaguaggagag

SEQ ID NO: 176057 - RNA, 44 nt, Homo sapiens
aauuaucuguuuauauuuuuauauccuucuauauuuagcuucug

SEQ ID NO: 176058 - RNA, 35 nt, Homo sapiens
agcccucaguccacaccccugcuuccuagcugugu

SEQ ID NO: 176059 - RNA, 40 nt, Homo sapiens
auucauuuagacaaaaagaucauuucucaauucaaaucag

SEQ ID NO: 176060 - RNA, 35 nt, Homo sapiens
uuuuaagauucaucauauuauuauccccuaguuag

SEQ ID NO: 176061 - RNA, 49 nt, Homo sapiens
ucuuuuaguuucaagauaaaaugcuuaacuaaaucuuuguugaguucug

SEQ ID NO: 176062 - RNA, 45 nt, Homo sapiens
ugaacugugccucaagcacuucagucuuugaagcugaaauaccag

SEQ ID NO: 176063 - RNA, 63 nt, Homo sapiens
uguaaacaggaugagaaggggggccugugaaaagugccaccacauaaugaggggggaaagaac

SEQ ID NO: 176064 - RNA, 49 nt, Homo sapiens
aggaguaggucucuguaauaaaagggaagaucucauaaagggauauaga

SEQ ID NO: 176065 - RNA, 73 nt, Homo sapiens
acuagaaacaacuaaaaguuucagaaauaacauaccuaguaagugcugaauaaauuacacauuauuagcaaag

SEQ ID NO: 176066 - RNA, 69 nt, Homo sapiens
cucuccagucuuucacuuuaauaugacuugugacuuccuuguugaagaggugaugguguugacuuugag

SEQ ID NO: 176067 - RNA, 50 nt, Homo sapiens
cuuaguucauagccugcuuuccauacacaucauuuauucgaaccauauga

SEQ ID NO: 176068 - RNA, 48 nt, Homo sapiens
gccaauaagcaaaguaacuugaauugacacuuaacaaucauuguuuuu

SEQ ID NO: 176069 - RNA, 45 nt, Homo sapiens
caaaacaaaaauuccugccuuagagagcucauauucagggguugg

SEQ ID NO: 176070 - RNA, 33 nt, Homo sapiens
acucuagguccugagggacucuggaaggcuaag

SEQ ID NO: 176071 - RNA, 94 nt, Homo sapiens
auggucgagaggaaagaaaacaauggccagggaauaauaaggugaugacaguaggaagagagaagagagaccagaugugaugauggugugggac

SEQ ID NO: 176072 - RNA, 50 nt, Homo sapiens
auguuucuggccagccaagcauuagcaaguagcacagauguggaagugau

SEQ ID NO: 176073 - RNA, 50 nt, Homo sapiens
ucauuugucugggccugugucaccuacucugucacuaacuggguauggag

SEQ ID NO: 176074 - RNA, 123 nt, Homo sapiens
gaggaguuugaaucuuauccuaaagacaaggaugagccauugaaguguuuugauugagagaucugguuggauuuuuguuuuacaacgaucgcuuggcugccugcagagaauaaguugaaaggg

SEQ ID NO: 176075 - RNA, 49 nt, Homo sapiens
ggauagaaccuuuugaaaaaccaccuuuggaaacaccagggguacugag

SEQ ID NO: 176076 - RNA, 68 nt, Homo sapiens
uugaacuggaggcugccacccacaauaggugaguucaugcagagcucagcagcgggagaacuagauuc

SEQ ID NO: 176077 - RNA, 45 nt, Homo sapiens
cuuuggaaucugugaauucuuacacugcuccgagucaacgcuaag

SEQ ID NO: 176078 - RNA, 56 nt, Homo sapiens
cagcugaggucccuuuggaagccaagaacccauagcuuuaucauuugaggauuagc

SEQ ID NO: 176079 - RNA, 46 nt, Homo sapiens
gucucuccuuucucucuccuccuccugcagcuugauggagauaccu

SEQ ID NO: 176080 - RNA, 45 nt, Homo sapiens
gaucuccucgcacacgcgcuuguucguguggaagucguugcccag

SEQ ID NO: 176081 - RNA, 42 nt, Homo sapiens
gacccgggccgccuucuucacgguuuuggugcgaacgcggcc

SEQ ID NO: 176082 - RNA, 60 nt, Homo sapiens
gaaagccgcuuccgcccggccacggucgcucugagccuacucgggagccacacagcgccc

SEQ ID NO: 176083 - RNA, 88 nt, Homo sapiens
ucaucgcgcuuacauuucuccaccucauuugaagaacgagcuucguagcccacggagcugagguuaguauaaauguggaagggagaag

SEQ ID NO: 176084 - RNA, 24 nt, Homo sapiens
ucacugagcaagcuaugugcucac

SEQ ID NO: 176085 - RNA, 45 nt, Homo sapiens
aaauucuagccaucgaucacuuuauaagaaaaggaugaaauuuca

SEQ ID NO: 176086 - RNA, 46 nt, Homo sapiens
ugaaaucaagcugacucugcuuuuagccuccuaaaugaaaagguag

SEQ ID NO: 176087 - RNA, 46 nt, Homo sapiens
cgaccugcaugacuuccgccgagggcucuccaagcugggcaccgau

SEQ ID NO: 176088 - RNA, 42 nt, Homo sapiens
aaucauaccucagcucaugucagagugcgaauaugucucuga

SEQ ID NO: 176089 - RNA, 62 nt, Homo sapiens
cuuauuuaaauguaaaaaaaauuuuuuuuuuacaucuuuuaaagacuauauuuaccauuuug

SEQ ID NO: 176090 - RNA, 361 nt, Homo sapiens
uucuuuaaaggcuguguuugaaaacaaauccuuucuuuuucuuuugggacgguguuuucgcucuuguugcccaggcuagggugcgauggcgcaaucucggcucacugcaacauccgccccgcgccccgccccuccccgguucaagugauucuccugcuucagccucccgaguagcugggauuggaggcgcgcgccaacacgucuggcuaauuuuuaguagagacaggguuuugccacauuggccaggcuggucucgaacuccugaccucaggugauccacccgccucagccucccagagugcuaggauuacaggugugagccaccacaccuggccaacaaauccuuuuuaaaguuuuaagu

SEQ ID NO: 176091 - RNA, 47 nt, Homo sapiens
ggcucuucacauaccaagggcaauuuccaguugccuaaauccaggau

SEQ ID NO: 176092 - RNA, 61 nt, Homo sapiens
aaagcuuucuagguggccagaagucccuggacaccacugaugagccuaguuugucuguuaa

SEQ ID NO: 176093 - RNA, 45 nt, Homo sapiens
caaggaauuggaaauacaaagcagagggaggagcaagcauuaagg

SEQ ID NO: 176094 - RNA, 33 nt, Homo sapiens
aagggguaacugaauauaugugacuggaguuug

SEQ ID NO: 176095 - RNA, 47 nt, Homo sapiens
uauuuuacaauaugguuaaacuuuacacauggccucaaaacugaagg

SEQ ID NO: 176096 - RNA, 32 nt, Homo sapiens
ccaaccucuucagcuccuuaaaaggagucugu

SEQ ID NO: 176097 - RNA, 41 nt, Homo sapiens
uggccacauccuccuuccugcccgucacaacaaagacaggc

SEQ ID NO: 176098 - RNA, 41 nt, Homo sapiens
aaucucagggcugccugccucaugguugcagaaaggcucac

SEQ ID NO: 176099 - RNA, 44 nt, Homo sapiens
aaguggguuuugagccugcuggccaaugcaauggcugggaguag

SEQ ID NO: 176100 - RNA, 48 nt, Homo sapiens
agugauaauuucuauaguuuacugagccucucauucugacccaggcac

SEQ ID NO: 176101 - RNA, 45 nt, Homo sapiens
gcugacuuacaguguggucucagaacugcccuuuaggccugaguu

SEQ ID NO: 176102 - RNA, 45 nt, Homo sapiens
uuugcugucaacaugcaugauucccaggguaaacaagggaccuuc

SEQ ID NO: 176103 - RNA, 46 nt, Homo sapiens
caggguguuuaccaaauucaccauugguuucaguguucgggaaggu

SEQ ID NO: 176104 - RNA, 46 nt, Homo sapiens
auucuuggucugaagcagaaugcguaauucaaccaucucaucagug

SEQ ID NO: 176105 - RNA, 46 nt, Homo sapiens
cauucugucaaaaccaccucuuccccgcaugggaaaucccacuggg

SEQ ID NO: 176106 - RNA, 59 nt, Homo sapiens
caggucucccucuucugucauaggccaugaggucucccccucuagguggugguggagga

SEQ ID NO: 176107 - RNA, 46 nt, Homo sapiens
ggagguagggaaggacccugaacuuguaaucacaucccccucucca

SEQ ID NO: 176108 - RNA, 50 nt, Homo sapiens
uacuauuuccucaagaaaaaguacugcucaagaaguacucccuugagcag

SEQ ID NO: 176109 - RNA, 62 nt, Homo sapiens
ccuaauucaacacgauugcuuaaaaaaaaaaaagacauacaaaaaaagguagcuacauccau

SEQ ID NO: 176110 - RNA, 45 nt, Homo sapiens
uguuuuuaauuaaaagaaagguuaccucaguuuucacuccuuaga

SEQ ID NO: 176111 - RNA, 32 nt, Homo sapiens
aauucugugaauuagcaccccacccccauacc

SEQ ID NO: 176112 - RNA, 98 nt, Homo sapiens
gggugcagccuucagacacggcgcaggccgaguuccucagccucucccugugguccgacaucuuggcgcccccgucggggugcugcgccagaucccug

SEQ ID NO: 176113 - RNA, 47 nt, Homo sapiens
cacugggucaggagcacgcaggccgacaccacgcucauggcgccgcc

SEQ ID NO: 176114 - RNA, 43 nt, Homo sapiens
cccgcgcuccuccccgaggaaaggauuuugauuucaaagaaag

SEQ ID NO: 176115 - RNA, 45 nt, Homo sapiens
agaggaccuguuucaggacugcgugacuggcguuuugcugggagu

SEQ ID NO: 176116 - RNA, 25 nt, Homo sapiens
cuuuuuguuucuuaaaaagauuuug

SEQ ID NO: 176117 - RNA, 45 nt, Homo sapiens
ccaggcguagcucccaucgcgaagcaugaagauagcacggucuga

SEQ ID NO: 176118 - RNA, 40 nt, Homo sapiens
cgcucugaucacaaaggaccaucuccucuaugcuucagca

SEQ ID NO: 176119 - RNA, 40 nt, Homo sapiens
uuuauucaccagucuuugauuaaauaaaaaggaaaaccag

SEQ ID NO: 176120 - RNA, 45 nt, Homo sapiens
cuuucagauuauguucauggguuuguguguauacaauaugaagaa

SEQ ID NO: 176121 - RNA, 52 nt, Homo sapiens
uacuuucuauauauaaaauagggcuaaucauacguuguuguguggguucagu

SEQ ID NO: 176122 - RNA, 86 nt, Homo sapiens
aauagcaaaaucuuacagaauaauuaaauuuugccaccuucguauuuuuguuagcuucaguaucagacacagcacagcagccaucu

SEQ ID NO: 176123 - RNA, 73 nt, Homo sapiens
uuuuagagcaaaaugucacgucugcaaggucauauuauaugauucugacucuggcgacagcauucaugagggc

SEQ ID NO: 176124 - RNA, 45 nt, Homo sapiens
uggaucccuggggaaagucuaguuggggauaaaacuggagagguu

SEQ ID NO: 176125 - RNA, 78 nt, Homo sapiens
ggguuucccaccccaagguuguuggagaggcaguggaggaagagcugauuauauaagcuuaaacaagaaaaacaaguu

SEQ ID NO: 176126 - RNA, 37 nt, Homo sapiens
aaaucuuugauaaauuagguauaaguuucaucucagu

SEQ ID NO: 176127 - RNA, 45 nt, Homo sapiens
aauguauaaagcuuaagaauacaauaguauuuacagaaguuugac

SEQ ID NO: 176128 - RNA, 54 nt, Homo sapiens
uaaauaagcuagguaguuccucuugcuuuuuuuucauacccagcaaauacuuga

SEQ ID NO: 176129 - RNA, 46 nt, Homo sapiens
aucuucaaagacagaauaguaguaaugguagaauaagcccaccugg

SEQ ID NO: 176130 - RNA, 45 nt, Homo sapiens
ugcuuuguuccacuggcuguggauuuuauggaaacccucguacaa

SEQ ID NO: 176131 - RNA, 48 nt, Homo sapiens
uuuucuuuacagucuuaaagcauuuaaucuugaauuuuuaauccugcu

SEQ ID NO: 176132 - RNA, 46 nt, Homo sapiens
cuuguucuuuaagguaugugauaugaaaccuaggucaguuugagaa

SEQ ID NO: 176133 - RNA, 44 nt, Homo sapiens
uuugccagcccuaaucuagagugcugggaauauaacucugaaaa

SEQ ID NO: 176134 - RNA, 53 nt, Homo sapiens
gaggccuuuggaacauacuaaugaaacuuugauuuuuaaaaugagauuaggag

SEQ ID NO: 176135 - RNA, 65 nt, Homo sapiens
uuagauugcuguuuauuuugcauugauuucagccauuuaaaguuaauauuuugaccaaacaacca

SEQ ID NO: 176136 - RNA, 41 nt, Homo sapiens
ucuuuaauuccaguguaguuucgggaagggugcaguagaau

SEQ ID NO: 176137 - RNA, 27 nt, Homo sapiens
acucugucagaaucugcauuucauucu

SEQ ID NO: 176138 - RNA, 40 nt, Homo sapiens
ugaugcugguauguuugucauuguguuuguuucagaggga

SEQ ID NO: 176139 - RNA, 50 nt, Homo sapiens
acauugguuuguuccucuuagcaacauauuguaauggauuuucuguugcc

SEQ ID NO: 176140 - RNA, 61 nt, Homo sapiens
auucuaggugcucacucaguggccuuauguggcuaguggcgauuguguuggacagcagaga

SEQ ID NO: 176141 - RNA, 84 nt, Homo sapiens
gagaaacuggugaaaauacguuuuauguaacccaaaaacuauuauuucaacauguaaucaguauaagaaauuguugaugggaua

SEQ ID NO: 176142 - RNA, 44 nt, Homo sapiens
cucuuacuguggcuuauauaccucagaccagcaaaguccacuag

SEQ ID NO: 176143 - RNA, 42 nt, Homo sapiens
aauauaggccacaaggaauaucagaaacauggcugcccgcau

SEQ ID NO: 176144 - RNA, 46 nt, Homo sapiens
cauucacaucuuuucgaccgugcucggguuuccaagaggagcagac

SEQ ID NO: 176145 - RNA, 42 nt, Homo sapiens
cacaucuuuucgaccgugcucggguuuccaagaggagcagac

SEQ ID NO: 176146 - RNA, 38 nt, Homo sapiens
agaugucaacuucaaccaaguggggaagcugcgucgau

SEQ ID NO: 176147 - RNA, 48 nt, Homo sapiens
ccuucucaggagcacgcauacgacccaugauggcggcgaucaggcaac

SEQ ID NO: 176148 - RNA, 72 nt, Homo sapiens
uguauguuuuuauuuuauggcucucggccuaagcacuucuuucuaaauguaucggagaaaaaaucaaaugga

SEQ ID NO: 176149 - RNA, 56 nt, Homo sapiens
cuuggugguggguuuuuuuguuuuuuuaauucagugccugaucuuuaaugcuucca

SEQ ID NO: 176150 - RNA, 45 nt, Homo sapiens
cccuccuggcagcaauuaagggucuucauguucuuauuuuaggag

SEQ ID NO: 176151 - RNA, 55 nt, Homo sapiens
gucagaaucacuccucucaaauaugcccagauuugcuauuggauuaaaggaaacu

SEQ ID NO: 176152 - RNA, 46 nt, Homo sapiens
auucugacagccacguugaaauccuguggggaaccauucaugucca

SEQ ID NO: 176153 - RNA, 46 nt, Homo sapiens
cgaugcccagccaggggccagcgggucuggggucuaugugaggaug

SEQ ID NO: 176154 - RNA, 60 nt, Homo sapiens
cucuuccacauccucacauagaccccagacccgcuggccccuggcugggcaucgcauugc

SEQ ID NO: 176155 - RNA, 42 nt, Homo sapiens
cuggucggucauugucauaaccagagaagugaauucugcccc

SEQ ID NO: 176156 - RNA, 51 nt, Homo sapiens
auuaugauuaugcccuccuggaacucaaaaagccccacaagagaaaauuua

SEQ ID NO: 176157 - RNA, 26 nt, Homo sapiens
guuccuuucacauagguuuuuccauc

SEQ ID NO: 176158 - RNA, 51 nt, Homo sapiens
uucaggaaagucucgaaggaagcggcagauuuauggcuaugacagcagguu

SEQ ID NO: 176159 - RNA, 53 nt, Homo sapiens
ugucuuaugaaacgcucuaugccaauggcagccgcacagagacgcaggugggc

SEQ ID NO: 176160 - RNA, 48 nt, Homo sapiens
cccagaagccacuauguuuauuugugaaaguguuugcaccccaucugc

SEQ ID NO: 176161 - RNA, 41 nt, Homo sapiens
acauuaccucacuguguucacaaaacuacuuuguaacacag

SEQ ID NO: 176162 - RNA, 37 nt, Homo sapiens
aacuuuuuagcauggauaauauaacaguuugauuuau

SEQ ID NO: 176163 - RNA, 44 nt, Homo sapiens
uacagccaaagugcucuuuuuagcugcuaaaggauaggcccuga

SEQ ID NO: 176164 - RNA, 42 nt, Homo sapiens
gugcucaucuccauuaugagauugugauacuuaaccgacaau

SEQ ID NO: 176165 - RNA, 42 nt, Homo sapiens
gcuucacucacaguccaggugcuuuuucuugggccccaugau

SEQ ID NO: 176166 - RNA, 45 nt, Homo sapiens
gcucaacgggcacaggaccggccgugccagagaagacgcagggag

SEQ ID NO: 176167 - RNA, 48 nt, Homo sapiens
augagucgaagaaacuacacugaagcuacuauagaggcgaugaaaagg

SEQ ID NO: 176168 - RNA, 63 nt, Homo sapiens
aagacuuuuuaauuuucucaaagcauguuagugugugcaaggaagguauuuguuuaguaaacc

SEQ ID NO: 176169 - RNA, 51 nt, Homo sapiens
aaauuacuugaaaugacagguuucuguauuaaagccuaaaguucaugaugu

SEQ ID NO: 176170 - RNA, 45 nt, Homo sapiens
uaaaugcugccauuuuaaaaugaaaucauuuucauuagauucaua

SEQ ID NO: 176171 - RNA, 51 nt, Homo sapiens
auaauguaguaugaauuaagccauaauucaugaauuauuaauaaucacuuc

SEQ ID NO: 176172 - RNA, 42 nt, Homo sapiens
aaugccuaguguuccuaauaacuuaucauuuaagguccaguu

SEQ ID NO: 176173 - RNA, 39 nt, Homo sapiens
acccagcuaguaucacuauucuaaaagagaaaguuuaca

SEQ ID NO: 176174 - RNA, 46 nt, Homo sapiens
gucaacauuaaggccagcugaaggguguggcugugcaacuggagaa

SEQ ID NO: 176175 - RNA, 46 nt, Homo sapiens
guuggcuaaagaugaauccaagucaucagauacuaacuugcuaggu

SEQ ID NO: 176176 - RNA, 46 nt, Homo sapiens
uauuaagguugguugcgucauuacaggaacacuucccauuugugga

SEQ ID NO: 176177 - RNA, 49 nt, Homo sapiens
ucccaauuuccuucaugggccuucacugaguuacuuguagcauucuaau

SEQ ID NO: 176178 - RNA, 46 nt, Homo sapiens
ccuauuuugcuccagacuauguuuucagcauaccuugggucugaac

SEQ ID NO: 176179 - RNA, 49 nt, Homo sapiens
uauugguggucuauacccuguuuucuuggcuauaccuguaaaugguggu

SEQ ID NO: 176180 - RNA, 42 nt, Homo sapiens
aucgguuuauguuggauuaaaugcugcucuuuguggccucau

SEQ ID NO: 176181 - RNA, 109 nt, Homo sapiens
uuaaagguauggaacauucuaaaaggaaggugauauucaaaccuaaaaguguaucaacgguauccacauggagaagagggucaaggaugggggaacaaagacugguagg

SEQ ID NO: 176182 - RNA, 40 nt, Homo sapiens
cacguaacagcugaacuuacguauaugaacacugccauag

SEQ ID NO: 176183 - RNA, 33 nt, Homo sapiens
auaggcauauaaaacacugaguuuuauugagca

SEQ ID NO: 176184 - RNA, 51 nt, Homo sapiens
cuuucuuguugucuuucaucuguuuuuugaaacaugaacaugguacuugcu

SEQ ID NO: 176185 - RNA, 44 nt, Homo sapiens
cauugucaaaaacgaauugcaggaacccugugacagucccaaag

SEQ ID NO: 176186 - RNA, 45 nt, Homo sapiens
acccaggacuaggucuucugaaucuaguuagucguuuuucugucg

SEQ ID NO: 176187 - RNA, 61 nt, Homo sapiens
ugaacaauacugggaugaagaagaggaggaauggcauuugaaaaaugcuauuagaguagau

SEQ ID NO: 176188 - RNA, 53 nt, Homo sapiens
auuucauuuuauaugauucuauuuuagaguugugaaaucugucaagaacaauu

SEQ ID NO: 176189 - RNA, 46 nt, Homo sapiens
uaauugaagaaguaagugaaguaacugcucagccucccccugaaga

SEQ ID NO: 176190 - RNA, 45 nt, Homo sapiens
agcuagagaugguuagcggggacuuguaguccacuaaacaaaggg

SEQ ID NO: 176191 - RNA, 91 nt, Homo sapiens
gcaaggguuaggaguucuggccucaguuuugcuccuaacuagcccuugugauuguguauagaucauauugcauuaugucaguucuucuauu

SEQ ID NO: 176192 - RNA, 43 nt, Homo sapiens
ggagguggaaucagauuugagggcccuuugcuacagcaagggg

SEQ ID NO: 176193 - RNA, 41 nt, Homo sapiens
gaggucagccuguagguggacuuagauuugaggggggucau

SEQ ID NO: 176194 - RNA, 45 nt, Homo sapiens
aguggggacaccucugcgguuugagggcccaauuggucaagcagg

SEQ ID NO: 176195 - RNA, 46 nt, Homo sapiens
cuucucuucgguuugaugggucaccaggacaaauggggggaggagg

SEQ ID NO: 176196 - RNA, 46 nt, Homo sapiens
ccaacgaagaugauuuuugaaggacccaauaaauuaagcccucgaa

SEQ ID NO: 176197 - RNA, 47 nt, Homo sapiens
agaucuccauucaaugaucguuuuccacuuaagcgaccucgauauga

SEQ ID NO: 176198 - RNA, 48 nt, Homo sapiens
aauaacuugcucucaaaaugaaauaauuaguauguugauaggauggua

SEQ ID NO: 176199 - RNA, 44 nt, Homo sapiens
ucacacagcagugaagggaaaaugaacaagcuaaguggggaugg

SEQ ID NO: 176200 - RNA, 44 nt, Homo sapiens; identical to SEQ ID NO: 101481

SEQ ID NO: 176201 - RNA, 45 nt, Homo sapiens
aggacacagguucagcauucauuuccaagacuugaucucuuagau

SEQ ID NO: 176202 - RNA, 42 nt, Homo sapiens
gcuggaaagauucgccaaucuggagcuaagcagucacauaug

SEQ ID NO: 176203 - RNA, 42 nt, Homo sapiens
uaaaaucauaaauggcauuguacaaaaacaggauacaauaac

SEQ ID NO: 176204 - RNA, 46 nt, Homo sapiens
caggauaagaccgauggcaaagaugaugaugugaaagagaagagaa

SEQ ID NO: 176205 - RNA, 42 nt, Homo sapiens
cuuacacaagaacaacuaauaaggcagcaguuacuggcaaag

SEQ ID NO: 176206 - RNA, 45 nt, Homo sapiens
ucaguuguuaaagugcuuuccacaccacaauaucuuguuccuaug

SEQ ID NO: 176207 - RNA, 43 nt, Homo sapiens
uuucuaaacauuuuuacgccaucacaaaccugaacagaaaagu

SEQ ID NO: 176208 - RNA, 46 nt, Homo sapiens
guuauuauauuuuaguagaugaacaccugugugucaguugucagau

SEQ ID NO: 176209 - RNA, 71 nt, Homo sapiens
aagggauuugcugagguaauucucugccugucaggcuauaucuuucacauugaacaaaaaggcacuuauga

SEQ ID NO: 176210 - RNA, 42 nt, Homo sapiens
uuauguaccuuauggauucuauugugaaaaacguuggaagag

SEQ ID NO: 176211 - RNA, 37 nt, Homo sapiens
uuucaggugguccuuucauaauuuaaagaggacgaaa

SEQ ID NO: 176212 - RNA, 48 nt, Homo sapiens
ccuguuaggagcccaacauggcgccugaaaagcacaugaugcgaaagg

SEQ ID NO: 176213 - RNA, 43 nt, Homo sapiens
uuuggggugggggagacuuaaaggcaguuugugguuuggggaa

SEQ ID NO: 176214 - RNA, 66 nt, Homo sapiens
ccauguuguagcauaaaucaguacauuguuuucauguuuaaauaauauuccauugcauguauaugc

SEQ ID NO: 176215 - RNA, 51 nt, Homo sapiens
aucuugguucuuggaccaccuacaauauuguuuauuuucuaauuugcaaag

SEQ ID NO: 176216 - RNA, 46 nt, Homo sapiens
cugaaacugauauuucuccacauccauucaaauauuuguuauuuag

SEQ ID NO: 176217 - RNA, 46 nt, Homo sapiens
uuucaagaacugccagaaacuuguucaggcuuucagagaauggcag

SEQ ID NO: 176218 - RNA, 47 nt, Homo sapiens
caacugagguucuuuugggcccugcuggcaucuccccauuggcuuuc

SEQ ID NO: 176219 - RNA, 46 nt, Homo sapiens
gagaguuaaaggaccaaaacaaaggaggaaagcugugagaacagag

SEQ ID NO: 176220 - RNA, 46 nt, Homo sapiens
ucuucacucagugaaggaauauuuacuaagaaccuguaagugccag

SEQ ID NO: 176221 - RNA, 49 nt, Homo sapiens
guggguacaaggauugagucaaucaacagaugcggaggcccuuugaaaa

SEQ ID NO: 176222 - RNA, 46 nt, Homo sapiens
caggcacuuuucucacccucuaauuauggaaguuugauggcauuua

SEQ ID NO: 176223 - RNA, 47 nt, Homo sapiens
aaucuaacugccaaucacagcugaugcccagcauuugaugucugcag

SEQ ID NO: 176224 - RNA, 84 nt, Homo sapiens
cgagaaagcaaaggagguaaaaggagagaagauggagaaggcggcggagaggaagggggaaggagacagaggaaccgagacugg

SEQ ID NO: 176225 - RNA, 45 nt, Homo sapiens
agucauuuuaauugccauuuuuaaaugcggucguuacauuggagg

SEQ ID NO: 176226 - RNA, 46 nt, Homo sapiens
aaaccacaguaagaguaugcuuuuaaaucuugauuuucgucuguag

SEQ ID NO: 176227 - RNA, 40 nt, Homo sapiens
uccugaaaccucucguccccucccacugaaauccccgauc

SEQ ID NO: 176228 - RNA, 49 nt, Homo sapiens
gcggaaggcuuguggaauugccaucuucuguggugggggaagggaucag

SEQ ID NO: 176229 - RNA, 48 nt, Homo sapiens
gggggaaguccaguccucccauuuccaaggugcccccaugcucagcag

SEQ ID NO: 176230 - RNA, 47 nt, Homo sapiens
cagagcuuuucuuucauuuggaaaacagaaaggaaacaggccauaug

SEQ ID NO: 176231 - RNA, 36 nt, Homo sapiens
ugcuuucugugugucagagaaacugaagcucaguaa

SEQ ID NO: 176232 - RNA, 29 nt, Homo sapiens
uccuuuuucugggccuacuuugaaagugg

SEQ ID NO: 176233 - RNA, 47 nt, Homo sapiens
gaauaaguaaaauguggccaagccuagcagcggaauauuauucaaag

SEQ ID NO: 176234 - RNA, 23 nt, Homo sapiens
aucuauaaagagggaagcaauag

SEQ ID NO: 176235 - RNA, 46 nt, Homo sapiens
aggauaaguauuacuuugaaaauuuuauaaccuuuauuauguuuuu

SEQ ID NO: 176236 - RNA, 37 nt, Homo sapiens
gcacugaugaacaaagccuuguuucaagaauuaauuu

SEQ ID NO: 176237 - RNA, 46 nt, Homo sapiens
agaagagauuagacagcuuguggagggagugagcucccugucauug

SEQ ID NO: 176238 - RNA, 45 nt, Homo sapiens
agacugaccuaaguuuaaaucugggcugagccacaacuagaccag

SEQ ID NO: 176239 - RNA, 70 nt, Homo sapiens
gcuguuuuaaaauguagaggugacaagcaaaugccugccuuaccuuuguacaaagaggagugauuagaag

SEQ ID NO: 176240 - RNA, 46 nt, Homo sapiens
ggaggugaacagaguugagaagaugagccucagaagguugagcacu

SEQ ID NO: 176241 - RNA, 119 nt, Homo sapiens
uugaccagugugcuuucgaaugccucuacuugugauuuugcaaagagaaaagcaaagggagaguagggagagucacguuuaaaaaauaguuuacacauuuaaaaaauacucccuaccag

SEQ ID NO: 176242 - RNA, 89 nt, Homo sapiens
gcacucuagaagccugguuuucacuuacagcaaagcuaagugaaagcuuuggaagguuuggaaagcuuuggaaacuucuggaaguugaa

SEQ ID NO: 176243 - RNA, 54 nt, Homo sapiens
acaaagaguaaggauuuaacauguuaaaaaaauguauuucaaaugaucaggagg

SEQ ID NO: 176244 - RNA, 47 nt, Homo sapiens
auucucucucucacucacacacacaugcacauacacauaaaauauca

SEQ ID NO: 176245 - RNA, 24 nt, Homo sapiens
cacgaagccaguucaugggacguc

SEQ ID NO: 176246 - RNA, 44 nt, Homo sapiens
cagucauucaacuaaugucuguuaagaguguccaauuuccaggc

SEQ ID NO: 176247 - RNA, 42 nt, Homo sapiens
uaaacuguccuagguuucuagcaaacaaggaaugacugugug

SEQ ID NO: 176248 - RNA, 44 nt, Homo sapiens
cagccagcuucuuaggaagcagggaguuuucccaaaggaguggu

SEQ ID NO: 176249 - RNA, 47 nt, Homo sapiens
gucuaguuccauucuuaauacugacacagugccuggcuguggugcaa

SEQ ID NO: 176250 - RNA, 78 nt, Homo sapiens
ccuaccugcuccacauuaagauaagaguuaguuaugaaaucccuggacaaaauauuguauaucuauucaaaaugauau

SEQ ID NO: 176251 - RNA, 46 nt, Homo sapiens
agucuggguacugacuuguggaguggauagugguugagggaagaca

SEQ ID NO: 176252 - RNA, 44 nt, Homo sapiens
guuaguagguguuuuccuuuauccaaguggucugagcuggaaaa

SEQ ID NO: 176253 - RNA, 46 nt, Homo sapiens
gauagauugcaucuauuagcugccucuugucaucaugaccugccag

SEQ ID NO: 176254 - RNA, 83 nt, Homo sapiens
ggucaggagucuuugcucauuccuaugggggaacugaugaaaucugcccagagguuggggaagagggaaguaggugaaauggc

SEQ ID NO: 176255 - RNA, 45 nt, Homo sapiens
uagcacaaggcuugcauacauaacugcucaauacaugcuuguucu

SEQ ID NO: 176256 - RNA, 24 nt, Homo sapiens
gacacuccugaaguuguaggcaau

SEQ ID NO: 176257 - RNA, 50 nt, Homo sapiens
cggccucccaauuauggcugcaauuuggcagccauuuccuugcccugggg

SEQ ID NO: 176258 - RNA, 40 nt, Homo sapiens
ugggagccaggaaggcagaagugaccauuuaggucugggg

SEQ ID NO: 176259 - RNA, 41 nt, Homo sapiens
acuccuugaacaagaacuagauauaaagcaugauacaaaga

SEQ ID NO: 176260 - RNA, 47 nt, Homo sapiens
agcuuucaucugagucuuaaaaauguguuggccaugaaguacuagag

SEQ ID NO: 176261 - RNA, 38 nt, Homo sapiens
agaaggggcagggcccaggcagcccaaucugggaagcc

SEQ ID NO: 176262 - RNA, 47 nt, Homo sapiens
aguucacaauauguucucuccugcucagcuucagcucaugucuucug

SEQ ID NO: 176263 - RNA, 74 nt, Homo sapiens
uaggaaagauaaagacaguaaauagcuucacauuacuucaugucagguuuuucacccaaugaguuauaaaaaaa

SEQ ID NO: 176264 - RNA, 42 nt, Homo sapiens
ggaaucucauguuuucuguaacuugcauuuucucacauugug

SEQ ID NO: 176265 - RNA, 37 nt, Homo sapiens
cuaauguucauaaggggaagagacuaggucucagguc

SEQ ID NO: 176266 - RNA, 46 nt, Homo sapiens
aacauuauugaccaucugguggaaauuacccaaaauguugacagug

SEQ ID NO: 176267 - RNA, 45 nt, Homo sapiens
acaggcagagcgugccugcucgcagccccugggggcugugugcuu

SEQ ID NO: 176268 - RNA, 65 nt, Homo sapiens
aguucaccuacuaucuuugugccucauaucccuccauccacauaggugaaacccaccaaaggaga

SEQ ID NO: 176269 - RNA, 34 nt, Homo sapiens
uauagauauagauauauauaguuggaaacaaggu

SEQ ID NO: 176270 - RNA, 47 nt, Homo sapiens
cucugcccuaaugaacaaaacaggcccaaacuuccuauccuaagcau

SEQ ID NO: 176271 - RNA, 44 nt, Homo sapiens
ggcuggugauguaggugaucauauuugcuaugugcauuccccag

SEQ ID NO: 176272 - RNA, 50 nt, Homo sapiens
auuugacccagucacaguugagagaagguucuggaaggauaugggcuaag

SEQ ID NO: 176273 - RNA, 51 nt, Homo sapiens
guuaagcugguagagagggaagagcuuguaggauggacagagggaugguug

SEQ ID NO: 176274 - RNA, 46 nt, Homo sapiens
ugcuggcuuauuucauuaaacauauaaaauaauuccuggaggcuug

SEQ ID NO: 176275 - RNA, 83 nt, Homo sapiens
aauacaguugcuacugggagcuuuucggcugucugauuuuuuaggggccaugaugggccuaaggaggaggaagggcccauggg

SEQ ID NO: 176276 - RNA, 42 nt, Homo sapiens
aaagucugaguggcaaucacauauuuauccucgcaaucaaag

SEQ ID NO: 176277 - RNA, 52 nt, Homo sapiens
agaaaaagcaauguaucuguuguacuguaaauuccucuagcuaauuuugauu

SEQ ID NO: 176278 - RNA, 46 nt, Homo sapiens
caguagacaggaccacaggcaugaguguuagacugggcugggguua

SEQ ID NO: 176279 - RNA, 59 nt, Homo sapiens
aacagauguuuaauaagugcucauuauuuuuuguuuucauuguuaaauaauaucauaua

SEQ ID NO: 176280 - RNA, 83 nt, Homo sapiens
aaaggaaggugaguguuuugucauuauaccuuuuauuguuccaagagaaacuggaaaucuagauuuuuaauguaaaguuuuau

SEQ ID NO: 176281 - RNA, 39 nt, Homo sapiens
uauuuuaauauauuuucaguuaauuuaauuaaaagaaaa

SEQ ID NO: 176282 - RNA, 54 nt, Homo sapiens
acuuucuuucuucuucuuuucaaaguagucuauuugugccauucagggucucug

SEQ ID NO: 176283 - RNA, 41 nt, Homo sapiens
uuuauguagcuuucacuuuuuaacuuuauucucuaucuggg

SEQ ID NO: 176284 - RNA, 57 nt, Homo sapiens
aaucagugaguagaugauaccauauaugagaaggcaagagugauaggaagaaaaacc

SEQ ID NO: 176285 - RNA, 46 nt, Homo sapiens
cacaguaagcgauaguaggugggcaaugugauagaaugggacacga

SEQ ID NO: 176286 - RNA, 47 nt, Homo sapiens
cagguaaauggggugacaauuucaagugggugugcucagugucaggg

SEQ ID NO: 176287 - RNA, 46 nt, Homo sapiens
cuucuuaugaaaccacuaauaccaucaugagugucucacccucaug

SEQ ID NO: 176288 - RNA, 55 nt, Homo sapiens
ggcaguacugcacaccacuauauccucgguguagccuuauaccagaacgugaaag

SEQ ID NO: 176289 - RNA, 41 nt, Homo sapiens
uagaauccauuuggaauucucaagcaaauaugaguggggaa

SEQ ID NO: 176290 - RNA, 63 nt, Homo sapiens
uucacuaaagccucaugcuuugagcacccccucugccaccugugugaguaaugguugaaaaac

SEQ ID NO: 176291 - RNA, 78 nt, Homo sapiens
aaggcuuacugaugcucagggugagcugcgugugccagugccucggaagcccaccacgcuucagggcagggccaccag

SEQ ID NO: 176292 - RNA, 72 nt, Homo sapiens
gugaaguaucacauucaugcaaagcugcagggcgccagggacgcaggcagggggaagggaacugcacugaga

SEQ ID NO: 176293 - RNA, 45 nt, Homo sapiens
ucaucugccuauugauucuguuguucuuuucucacuggaucacgg

SEQ ID NO: 176294 - RNA, 37 nt, Homo sapiens
augguaaggacugaacacugaacuuccugccuuggag

SEQ ID NO: 176295 - RNA, 67 nt, Homo sapiens
cauuagcuggauggguuugggcacauugcuuaauggcuccgaaccuccuuuccucaucugccaggag

SEQ ID NO: 176296 - RNA, 48 nt, Homo sapiens
caaaagcucuauauugccaguaacugagguugggauguuggaggugcc

SEQ ID NO: 176297 - RNA, 37 nt, Homo sapiens
cuuggguggccuggcagggcuggguugauguguauag

SEQ ID NO: 176298 - RNA, 46 nt, Homo sapiens
ugcaacccaaagcgggaacaggagacgcacgcagagaugcgagcag

SEQ ID NO: 176299 - RNA, 41 nt, Homo sapiens
uagggauauggaguaagucacaagaggggauguagcaggag

SEQ ID NO: 176300 - RNA, 93 nt, Homo sapiens
auccacccacacaggacaauuccucagugacagacaaaagcagugggaaaugucagccuacucagaugcaagacccggagaaaugaaagcgcc

SEQ ID NO: 176301 - RNA, 48 nt, Homo sapiens
cugugcauaacucuuuagaacccuaagcauauauauuauuaaaaacau

SEQ ID NO: 176302 - RNA, 63 nt, Homo sapiens
gcuagcugccugguucuuugcuaggcacugaggcuauaaaggugaauaaauucagagguggua

SEQ ID NO: 176303 - RNA, 54 nt, Homo sapiens
gagaaggcagcugagacacagagagagcaaaaagcccagggucacgcagaaugg

SEQ ID NO: 176304 - RNA, 46 nt, Homo sapiens
caagucaauaaugcuaauaaugcaaauugguuuuaaaauguuggga

SEQ ID NO: 176305 - RNA, 44 nt, Homo sapiens
auuaauuaucaugcguaauuuauuauugcacuucauuuuuuagu

SEQ ID NO: 176306 - RNA, 34 nt, Homo sapiens
gcacucugguggugggauaauuuucugcaaggga

SEQ ID NO: 176307 - RNA, 41 nt, Homo sapiens
uagccaugcauuaaagacaggacuaggauugcucucucugg

SEQ ID NO: 176308 - RNA, 42 nt, Homo sapiens
aggaacaauagccaucucgcaugcauuuuccaaacaccccuu

SEQ ID NO: 176309 - RNA, 41 nt, Homo sapiens
ggacugugagguuucugagggcagaaacugggagucucagc

SEQ ID NO: 176310 - RNA, 38 nt, Homo sapiens
cagcaugcucauugguggucgagggcaggagaaagggg

SEQ ID NO: 176311 - RNA, 26 nt, Homo sapiens
ugggaaagagaggggcuuggaguggc

SEQ ID NO: 176312 - RNA, 69 nt, Homo sapiens
cuuucacuucuuuuuuuaaauuuauucuuaaauacuuuauccuuuuugaugcuauuauaaauggaauua

SEQ ID NO: 176313 - RNA, 85 nt, Homo sapiens
aaaaagagcucaccagacagaaaaguacgcagagggaaaguuuucauaaaggcccugagaccuggaaggcccuggaguccuagag

SEQ ID NO: 176314 - RNA, 47 nt, Homo sapiens
gggaagaaggugaugaagaaacagcugugaaaaugaacauauugaca

SEQ ID NO: 176315 - RNA, 49 nt, Homo sapiens
gggccaagauggugagaacuagccaucaaaauaaagaagacccucagaa

SEQ ID NO: 176316 - RNA, 72 nt, Homo sapiens
aaaaccaaggcucagacaggccuaauaaguuacuccaagucugccugacagcagcaggcccccaguucacau

SEQ ID NO: 176317 - RNA, 84 nt, Homo sapiens
uguaaaauagggauaauucuaccccucucauagaguuauuguaaagauacaaugaaaucauguacacaaaauccuuagcagugu

SEQ ID NO: 176318 - RNA, 45 nt, Homo sapiens
uauuuaucugcucguuuuuaggcggcauaaugaagauauaaucag

SEQ ID NO: 176319 - RNA, 67 nt, Homo sapiens
acaagcuuggguaacuuccccacauuaggacuucccuccuaacauccuccugcuccacauuuaccac

SEQ ID NO: 176320 - RNA, 24 nt, Homo sapiens
cagagggugaagagaaagcccaga

SEQ ID NO: 176321 - RNA, 45 nt, Homo sapiens
gagagugcuuuauuucugcuuucugucuguagaagccccugggag

SEQ ID NO: 176322 - RNA, 48 nt, Homo sapiens
acaucucacucaugcccaaaacucucauguuuugauauaggaaaguaa

SEQ ID NO: 176323 - RNA, 49 nt, Homo sapiens
uaggaaaugagaagaaaggcaucagagagaggaaaucuuugugggaggg

SEQ ID NO: 176324 - RNA, 44 nt, Homo sapiens
guaaagcacccgugccggccauguuuucacugcucccgugguau

SEQ ID NO: 176325 - RNA, 45 nt, Homo sapiens
uuucuuuggagggacucagaggccugccccaguauuugucucugg

SEQ ID NO: 176326 - RNA, 40 nt, Homo sapiens
cucuguauauucccagcccagccuccagacccaaggaagg

SEQ ID NO: 176327 - RNA, 35 nt, Homo sapiens
ucauggaaucacagcaagcauuucuugaaggaauu

SEQ ID NO: 176328 - RNA, 26 nt, Homo sapiens
agguggguggauggauggauggaugg

SEQ ID NO: 176329 - RNA, 48 nt, Homo sapiens
acaaagacuugaguuugaauggaggccccacugccuacuagcuugggg

SEQ ID NO: 176330 - RNA, 41 nt, Homo sapiens
cuaggcuggcccagaccuugggccccagucugauacuugag

SEQ ID NO: 176331 - RNA, 47 nt, Homo sapiens
ggguagagaaaagagcuggaggagcaaagacuguccagcccagcucu

SEQ ID NO: 176332 - RNA, 46 nt, Homo sapiens
gcuacaucuuuuuucccccacguggauguuaaaacucuagccucua

SEQ ID NO: 176333 - RNA, 47 nt, Homo sapiens
uaguggauccuuucauuuuaaaccucuuucaaggauacagcccaaag

SEQ ID NO: 176334 - RNA, 46 nt, Homo sapiens
ggcaauuaaugguguuaagugcacuucauaacucaaaggucucuug

SEQ ID NO: 176335 - RNA, 57 nt, Homo sapiens
auccacugugccgagauguguccgaguacaacgacaagacagcccaugcacaccgug

SEQ ID NO: 176336 - RNA, 46 nt, Homo sapiens
cuaaaugcuccacuuuagggaauugguuagguaaauuaugguucau

SEQ ID NO: 176337 - RNA, 30 nt, Homo sapiens
guaucugucuauuuucucuuguuuaaaaaa

SEQ ID NO: 176338 - RNA, 37 nt, Homo sapiens
gucuggguucuucagaaaaacagaaccaacaggagag

SEQ ID NO: 176339 - RNA, 49 nt, Homo sapiens
gagccaaguccugcuguacaguuguguucugaggguucgcucaccaucc

SEQ ID NO: 176340 - RNA, 46 nt, Homo sapiens
gugggcacgugaggucugagaagguggguggggauggcgagguggc

SEQ ID NO: 176341 - RNA, 22 nt, Homo sapiens
ggacggagcagaagaaacaaag

SEQ ID NO: 176342 - RNA, 45 nt, Homo sapiens
cuccaggauccaauggccuuggagagagggcugcagggcccacgg

SEQ ID NO: 176343 - RNA, 56 nt, Homo sapiens
agugaaaacugguuacauugagggaggcugaggacacaggaaggauccagggaaga

SEQ ID NO: 176344 - RNA, 86 nt, Homo sapiens
ggaagauuuaccaugagugcagcacuauguuaagcucuggggauaucacaaggaauaaaaacaaagguaggcuuuucccucacccu

SEQ ID NO: 176345 - RNA, 50 nt, Homo sapiens
auuugaguagguuaacaauuuaaaauuaagcaauuaaguccaagaacauu

SEQ ID NO: 176346 - RNA, 67 nt, Homo sapiens
uaauaaaaagcuuaggguagaaaguaggggacaaaaaagggaagaggagaagaaaaagagauucuca

SEQ ID NO: 176347 - RNA, 38 nt, Homo sapiens
aaaagaaacagaaaugaauggaguggcauuguuuuaca

SEQ ID NO: 176348 - RNA, 40 nt, Homo sapiens
uaaauacagguacuggugacagagauuauuacauggucag

SEQ ID NO: 176349 - RNA, 45 nt, Homo sapiens
uuccugggccaaguuugcucugggaguaaaucucugaggucccuu

SEQ ID NO: 176350 - RNA, 56 nt, Homo sapiens
uuuacaugaauuagcaaauuuaaucuucacaaaaacccuuugaaguagguaguauu

SEQ ID NO: 176351 - RNA, 44 nt, Homo sapiens
uggagaggaggacagagaggcaagauuugaauccagacacaccg

SEQ ID NO: 176352 - RNA, 39 nt, Homo sapiens
cucuaugcccugagccuguguuccagcaguggccugcac

SEQ ID NO: 176353 - RNA, 46 nt, Homo sapiens
ccugaacaucaaaauaaaaugccaaaugggaacaugaaaucacagg

SEQ ID NO: 176354 - RNA, 45 nt, Homo sapiens
gugggaacaucccagccuguuuccagucacaccuuugccuccaag

SEQ ID NO: 176355 - RNA, 94 nt, Homo sapiens
cuaugggugcucagagaggcuucaaauauggagggggagaagaaagaaaagaaaagaagaggaaagggaaaaggaaaaggaaagaaaagaaaaa

SEQ ID NO: 176356 - RNA, 41 nt, Homo sapiens
acuuugugaaaugcaaagauccacuuuccagcugccuuucc

SEQ ID NO: 176357 - RNA, 42 nt, Homo sapiens
accucauccuaacuaaacuaauuacaucugcaaugccccugu

SEQ ID NO: 176358 - RNA, 41 nt, Homo sapiens
aguuacugcagcacaaaugugcuaguuaaagaggcagcuug

SEQ ID NO: 176359 - RNA, 41 nt, Homo sapiens
aagauggcucacuaaaaagggccaugcuuuagccaguaggu

SEQ ID NO: 176360 - RNA, 52 nt, Homo sapiens
aaaaugaauucgugaauaaauaaaucaacaagaaaauaaaugaagaagcuaa

SEQ ID NO: 176361 - RNA, 46 nt, Homo sapiens
guaggaaggaugggauggcuggcaggugggaaggguggggggauaa

SEQ ID NO: 176362 - RNA, 75 nt, Homo sapiens
gguggagagauggaugcauggucagauggaugaauggaugguuucauaucauuguagagcugccacagcaaagag

SEQ ID NO: 176363 - RNA, 53 nt, Homo sapiens
ucaggaaaucucucugaaaaggagaaaaggaacuugggggcaggacaggggac

SEQ ID NO: 176364 - RNA, 46 nt, Homo sapiens
ugcauacuucaaggauuauuugaaggacuauucuuagacccuuuua

SEQ ID NO: 176365 - RNA, 46 nt, Homo sapiens
aaaagacucagauacuucauaaaagaagauguccaaauagccaaaa

SEQ ID NO: 176366 - RNA, 106 nt, Homo sapiens
cccggagggaaggggaugguaugucuucaaagaagguuucaaaucucaagaggcuugagcaaaggauuaaagaaagggaaaccacacagcagagguugcugaggac

SEQ ID NO: 176367 - RNA, 47 nt, Homo sapiens
augauggugauggcagcacaguagugugaauguacucaaugccauug

SEQ ID NO: 176368 - RNA, 46 nt, Homo sapiens
ccugggaagcccagaccaggaucgcagacaauccugggaauggaug

SEQ ID NO: 176369 - RNA, 40 nt, Homo sapiens
cugugugcauuguugccuggaagucagacaccgucugggc

SEQ ID NO: 176370 - RNA, 97 nt, Homo sapiens
acagacuugucuugauugccuuagccaaauuaugagucauugccccagggcuaaguguguugcuuucuccagcaaaauuuggcuuguguuagccugg

SEQ ID NO: 176371 - RNA, 52 nt, Homo sapiens
agcucaguaaacaucucacgcauugccacaaaccugugucaagaacauguac

SEQ ID NO: 176372 - RNA, 81 nt, Homo sapiens
augaggggaagguuauucuaggggagggcagcaugcguacaaagguuuggaugcaggagaugacaggugugcaggccagag

SEQ ID NO: 176373 - RNA, 42 nt, Homo sapiens
gcaggaagcaucagucacgcugacaaauaucugugcccucag

SEQ ID NO: 176374 - RNA, 39 nt, Homo sapiens
guuuccagccaucuagccuguuguggggccuggcccucu

SEQ ID NO: 176375 - RNA, 67 nt, Homo sapiens
auuuuacuugcauuuaucugaaugagugugugugcaugcaugugcguguuuacuucuauacuauuuu

SEQ ID NO: 176376 - RNA, 51 nt, Homo sapiens
auggaauaauguaggaugaaagcuuuggcgauuggcuauguguugacucag

SEQ ID NO: 176377 - RNA, 48 nt, Homo sapiens
accaacggcaaaguccuuugaggccuuggaugaaaggaaugggagcag

SEQ ID NO: 176378 - RNA, 24 nt, Homo sapiens
uugaaccuuggggucagacagaca

SEQ ID NO: 176379 - RNA, 40 nt, Homo sapiens
cagacaugaaaaaaagaucaucuagugggcugcaugugca

SEQ ID NO: 176380 - RNA, 49 nt, Homo sapiens
gcaggugccauuugaguugaggcuuaagggaaauggaggguucaggcug

SEQ ID NO: 176381 - RNA, 42 nt, Homo sapiens
gacauuggccucccccacugcggcuacuccaugggggcuggc

SEQ ID NO: 176382 - RNA, 53 nt, Homo sapiens
uccugccuguccagccgggccaauuccaaucucacacucaccgacaccgagca

SEQ ID NO: 176383 - RNA, 59 nt, Homo sapiens
cuucuagcuucaaauguagauccucgugauuccugcccgggauuccccuggaucagggc

SEQ ID NO: 176384 - RNA, 64 nt, Homo sapiens
gagggguuagucucugaagaggaggcuccaacugaguggugcaaaaccaagauugauccccaga

SEQ ID NO: 176385 - RNA, 45 nt, Homo sapiens
aaggagcaguucauuuugcccugagggugcagaggcucauuccuu

SEQ ID NO: 176386 - RNA, 64 nt, Homo sapiens
gcagaagcaugaugggucuggggaacaguaagaauguacaugauuuaaucccagaggcaaauua

SEQ ID NO: 176387 - RNA, 44 nt, Homo sapiens
ucacaguuaccccugccccaaauugucaagcagccuggugucaa

SEQ ID NO: 176388 - RNA, 45 nt, Homo sapiens
cauuaccaauuaacuccauuuauccucugcucuccuuggccccau

SEQ ID NO: 176389 - RNA, 57 nt, Homo sapiens
accaggcacuguuuuaaauacugggguuccagcaaugaccaaagcagacaaaacugc

SEQ ID NO: 176390 - RNA, 56 nt, Homo sapiens
ggauguuucucuauaauaguuguuauggaaagggggacaguaaguccccaggguga

SEQ ID NO: 176391 - RNA, 53 nt, Homo sapiens
aggaugucuggaaguaaaacaaucuugggagagggaagggcaggugcuagggc

SEQ ID NO: 176392 - RNA, 47 nt, Homo sapiens
ggguucugaguggagaagugaugaggucugacuaauacuugaacagg

SEQ ID NO: 176393 - RNA, 41 nt, Homo sapiens
auugcauucccgaaacuggguugagaccugcugagugugca

SEQ ID NO: 176394 - RNA, 58 nt, Homo sapiens
cugcuugaacuucaucugacccaggaugacuucaaggaagaaagaguauaaccaacau

SEQ ID NO: 176395 - RNA, 55 nt, Homo sapiens
cuuccaacccauagauccuuaccacaaauuuaauuucacacuaaucaacccaggc

SEQ ID NO: 176396 - RNA, 45 nt, Homo sapiens
gcugguggagacuauuuaggaaacagcaaagaucuauuauggcua

SEQ ID NO: 176397 - RNA, 52 nt, Homo sapiens
aaggcucucaggcaggcuguacauagcagucuacucuccagaauagucugug

SEQ ID NO: 176398 - RNA, 38 nt, Homo sapiens
ugugagaaauucuguuagagcgcacugcuagugcugau

SEQ ID NO: 176399 - RNA, 46 nt, Homo sapiens
ggagacuuuguuccacacagucucucauggacccagggugacagaa

SEQ ID NO: 176400 - RNA, 47 nt, Homo sapiens
ucuuuaauuuccacuccaaauaagccagucaccagcauguucucccu

SEQ ID NO: 176401 - RNA, 42 nt, Homo sapiens
cucuagcuuuuugauagcagcacagccuucccauagaaucaa

SEQ ID NO: 176402 - RNA, 46 nt, Homo sapiens
auuugaaagcaggugaaucuagcaggcggaggaggccaggggaaag

SEQ ID NO: 176403 - RNA, 41 nt, Homo sapiens
cagcuguagagaagggcaccacagggucacggaaugaaaaa

SEQ ID NO: 176404 - RNA, 37 nt, Homo sapiens
cagacaugaggccgucggggaaaagccaaauacacac

SEQ ID NO: 176405 - RNA, 56 nt, Homo sapiens
uauuucucacauauaacccaguggcccauucuaaagaucagaaaacuaaggcccag

SEQ ID NO: 176406 - RNA, 46 nt, Homo sapiens
gugugcagugcauagucaugauaaagagccaacuucccacuguucu

SEQ ID NO: 176407 - RNA, 16 nt, Homo sapiens
aagaaaauucaauguu

SEQ ID NO: 176408 - RNA, 47 nt, Homo sapiens
uguguuaaauaagagaaucacgucuacaccucauagaguuuugguga

SEQ ID NO: 176409 - RNA, 44 nt, Homo sapiens
ugggguugcaauuucuaacugaagguagaaagggagguacugag

SEQ ID NO: 176410 - RNA, 4810 nt, Homo sapiens
gugauuucagacuuuuucuugacuuagcucucagcuuaggcauuguuaguguauagaaaugcuacugauuuuuguacacugauuuuguauccugaaacucggcugaaguuauuuaucagaucuaggagcuuuuggguagaaacuguggaguuuucuagguauagaaucauauuaucugaaaacaaggauaguuugacuugcugucuuccucuuuguaugccuuuuauuuauuucuuuuucuugauugcuuuggcuaggacuucaagaacuguguuggauaggaguggugagagugggcauccuuuucuuuuucuugcucucaggggaaaugcuucaaguuuuugcccauucaguguaauggguuugucauagauggcuguuauuauuuugagguauauauuccuucaaugccuaguuuguugaggguuuuuaacaugaagcaauguugaauuuuauugaaagccuuuucugccucuuugagaugaucaugugguuuuuguuuugaguuuuguuuaugugaugaaucacauuuauugacuugcguauauugaacaaaccuugcauuccagggauaagccuaauugaucgugguggauuaccuuuuugaugugcuccuggauuugacuugcuaauacguuguugaggauuuuugcaacuauauugaucaaggauauugccuaaaguuuucucuuuuucucugccagguuuugguaucaggauaaugcuggccucauagaaugaguuagggaggaguaccuccuccuaaauuuuuuggaauaguuucaguaggaauggaucaacucuucuuuauacaucugguagaauucagcugugaauccaucugguccugguuuuucucugguggguaggcuuuucauuacugauucaauuucaggauucauuauugguacguucagggauucaauuucuuccugguucaaucuggggacauuguauguuuugaggaauuuaucaauuccuacuuaguuuucuaguuuguguacauagagguauucauaguagucagaguuguuuuuuuuuuuuuuuuuuuugguauuucuaugggaucauuaauaaugucaccuuugucauuucugauuguguuuauuuguaucuucucucuuuuuuucuuuauuagccuagcuagcagcuugucagucuuacuuguaucaaaaaaccaacuccuggauucauugaucuuucuuaugguuuuuugcaucucaauuuccuuccauucagcucugauguugguuauuucuugucuucuacuagcuuuggaguugguuugcucuuguuucucuaguuaguguaggugugauguucgguuguuaauuugagaucuuucuaacuuuuugaugugacuguuuagcgcuauagucuuucaucuuaacaaugcuuuagagauccugauauguuguaucuuuguucucauuaauuucaaagaauuucuugauuucugccuuaguuucauacuuuacacaaaagguuguuuaauuuccauuuaauuccauguaauuguaugguuuugugcaauuuucucaguauugauuucuauuuuuauugugcugugguccaagagcgugguugguaucucuuaauuugccgaugauuguguagucgauuuaaagugugugccuugugcagaugguaagaauuuauauucuguugguuugggguggagaguucuguagauaucuguuagguccauuuggucaagcauugaauucagauccugaaucucuuugcuaguuuucuaccuuggugaucuaucuccuaccgucagugggacauugacagcucccacuauuauuaucugguuacccaacucucuuucuagaucucuaagaacuugcuuuaugaaucugaguucuccgguguuggaugaauacauauuuaggauagcuagaucuucuuguuggauugaacccuuuaccauuaaguaaugcccuucuuugucuuuuuugaucuuuguugguuuaaagucuguuuuuuuuuuuuucugaaauuagaauagcaaccccuguguuuuucuguuugcuuucugcuugcuagauuuuucuccauuccuuuauuuuaagccugugggugccauagcaugugagauggucucuugaagacaacauacaguugggucuugcuucuuuauccgaguugauaugugcagauuugauccugucauuauguuguuagcugguuauuaugcagacuuuauuguguugucacuuuauagugucaauggucuauauacuuauguguguacauagaccuuuggggauggucaucuuguacaauaucuagcaguuacugaagaccaguaaccaucuugucuuuccauauuuagcacucccuugcagaccuuuuguaaggcaggucucaugguagcaaauucccuuaccauuugcuuaucugaaaaguauuuuauuucuucuuugcuuaugaagcuuaguuuggcuggauaugaaauucuugguugaaauuuguuuucuuaaagaaugcugaauauaggcccccaauuucaggcuugugggauuucugcugaaaguucugcuguuagccugauggaguuauuuuuguaggagaccuuccccuucccuuuagcugccauuaacuuuuuuuuuuuucauuuugaccuuggagaauaugaagacugugugucuuggggauggccaucuuguacaguaucucacaaggguugucuacauuuucugaguuuaaauguuggccucucuagcaagguuggggaaauuuuccugggugauauccucaaauaugaaguugcuugcuuucucuuccucucuuugagggaugccagugacuuacagauuuggccucuuuacacaauuccauauuucuuaaaggcuuuguucauucuucuuucuucuuuuuucuuuauuuuugucugacugaguuauuuuggggaacuggucuucaagcucuguuuucucagcuugguuaauucuacuguuaauacuuacaauuguauuaugaaauucuuaaagugaauuuaucagcuguaucagaucagcucuaucagaucaguuugguucuuucuuaaaauggccauuuuaucuuucaucuccuguauuguucuguuguauuccuuagaauccuuggauuagguuucuucugaauccugaugaucuuugcuccuaugcauauugugaauucuguuucuuuaguuuuggacauuucagccugguuaagaaucauugcuggggaacuagugcagucaauuggagaugagaagaccccuuggcuuuuugaaaucucaaaguuauugcacuaguucuuucucaucugugugggcugauguuccuucagucuuucaaguugcuauccuuccaauggguuuuuuugauuuuaucuuguuugaugcgcuuggggguuugauuuugguauaagguggauucacucaacuagccuuguuucuugaagauuuuagagggccaagacucagcuuggcacuuuugggcugugugcuguaacucuuggaaacuaguacugggccccugccuuuguucuagagguuaggaaccugcugcauuggaggggcugagguguucccaguucacuggccacaacacuccaauggguggugccagccagagcaccucaucagggaaggggcagcaggauccauuucacuugcacaugucaguagcuguagcagcauggcaggguacccauguguuggcuggggcagaguacucacaggagugaaccccaacauuccugugugcauuugcacuggcaggagugaggugcuggcaggcacaaagcugcuggcuucugugcacacguuuacagaaggggaggugcagggccacuaguguuuguaugugcuuucaugccagcaagggcagcacaaccagguacccauguaucaguggggggguggggauggcagggugugcucaugccagcuagugcagugggguaugcuugcacacaugugcugguggggguggggaagccaggugcacccuggaugcaccagaaaagcaggggagauggggagcuaugggcaaaugcaugacagcaaaacaguggagggaggcugcaggcauugggggaagaauacaggugaguuggugcacauuggcaggggauguucugcuggagcucuccaauggucaggcaugguuugcugacaaaggagcuauggugagagcccccaggaugcacccugguugggcauccaaggcugcauugcaaguaggcauggccaaacucgggucccaggagaggccaacauacaggggggcaauuaguucagacuggcuguaucucacaaguaagaccacccugcucuguccagcuucaguagucccccucaaggcuaaaaucuccuaaaggagaauaguaagccauggagaauggccaucccuggccgugcucuacugcagauguuccugcaccaaacccuuugggcucugcgcaggcuggagcccugcuccuacaaccucuauaagcaucucuccuugacagcucaaguguucaugggauuuggggggggucuccugcugccaggauucuggaaguucauggcaagagcaugccauuccuugccuguucaacccaacccuuccccaggaguugcugagggccaggcuggugcucaguagccccaugcaggguucccagcuuccccccgccuucagcccagcaucugcauccucccuucauccacuaucaaugucuucccucugaagauccacuuagaauguaucagucuuccugaugucccagccucucaguggcagacauuucuccuggcuccauucuuuuacuuugaagcuguuugugucuu

SEQ ID NO: 176411 - RNA, 39 nt, Homo sapiens
acaaguuacauggucguuccagcuuucagcuuagaggaa

SEQ ID NO: 176412 - RNA, 25 nt, Homo sapiens
agcaggugcucucaggucugaacuc

SEQ ID NO: 176413 - RNA, 49 nt, Homo sapiens
auuuauuugauuacugggauuaaacaaaaaguaaacagcagaaguugcc

SEQ ID NO: 176414 - RNA, 46 nt, Homo sapiens
ccagcucugccucucuuugcugagcugagacucugaguaagaccag

SEQ ID NO: 176415 - RNA, 36 nt, Homo sapiens
cucuccagcucucucuaccuuuuuacgaggccuagg

SEQ ID NO: 176416 - RNA, 46 nt, Homo sapiens
ucgcaggugcucccuugcauuguucauccugcuucaucaaccccua

SEQ ID NO: 176417 - RNA, 46 nt, Homo sapiens; identical to SEQ ID NO: 101754

SEQ ID NO: 176418 - RNA, 63 nt, Homo sapiens
ggcagaagagcuccagggugaccagcuuguauccccugaucaggugcuguuagacuugagcca

SEQ ID NO: 176419 - RNA, 60 nt, Homo sapiens
uagauguagcaggccuaauaaaugcuuuuaugguuuuuaauuugauuuuuuucauggaaa

SEQ ID NO: 176420 - RNA, 29 nt, Homo sapiens
gauuccuuuuaccucacaaaccuuuacga

SEQ ID NO: 176421 - RNA, 46 nt, Homo sapiens
uguacgucucaucacacaugagguacacuugccaaaaacauguaac

SEQ ID NO: 176422 - RNA, 41 nt, Homo sapiens
ugcaauuugccaaaggucaggcagcuagcaagugucaagcc

SEQ ID NO: 176423 - RNA, 69 nt, Homo sapiens
aaaugaagcaacuaaagcacagcguuucauuaaccgguugaaggucacuaaagaauugaauucacaccu

SEQ ID NO: 176424 - RNA, 44 nt, Homo sapiens
uccucucuguaaagcacccaugguaaaaucuaaauucauuuagg

SEQ ID NO: 176425 - RNA, 42 nt, Homo sapiens
ugguugaccugacacaaggaagggucaugaaaacagccacag

SEQ ID NO: 176426 - RNA, 46 nt, Homo sapiens
ccuaacaucuaucagauggcugcuuuugccuaauuucagucauuag

SEQ ID NO: 176427 - RNA, 36 nt, Homo sapiens
aguaaugcagcgagaggacgagaccgugaacaaagc

SEQ ID NO: 176428 - RNA, 46 nt, Homo sapiens
ucucuucuggaagauagagauaacaauagcuaacauuaggugagua

SEQ ID NO: 176429 - RNA, 60 nt, Homo sapiens
ccggacgccgccgccgccgcucucgcacgcccacacccccaaccagcaccacgcggccuc

SEQ ID NO: 176430 - RNA, 45 nt, Homo sapiens
aacuucacgccgaggagcaaccccagcccggcccccacggaccac

SEQ ID NO: 176431 - RNA, 45 nt, Homo sapiens
gggagaaaggaaggcuuccuggaagaccugguacagcaugacuga

SEQ ID NO: 176432 - RNA, 41 nt, Homo sapiens
ugagucccccauugaggagccugggccuaccugugcucccu

SEQ ID NO: 176433 - RNA, 30 nt, Homo sapiens
gcauauauauauuggauaugugugugugug

SEQ ID NO: 176434 - RNA, 45 nt, Homo sapiens
guccugaaaaaucaguacaaggggccagggagugauugggaagag

SEQ ID NO: 176435 - RNA, 77 nt, Homo sapiens
uaggagcuugugggcccugguaaggacuaugguuuauucuaaaaugcuuaugaagccauuggaggguugagagcaga

SEQ ID NO: 176436 - RNA, 100 nt, Homo sapiens
uaguacuccuauaauauuuguauagcccuuaauacuucuuccaccauuaucucagccgauccauauaacaaccuugugagcucaguacuguaaucccuuu

SEQ ID NO: 176437 - RNA, 46 nt, Homo sapiens
ucuucugcaccacaucaccaggguacccacugacguccagcacagu

SEQ ID NO: 176438 - RNA, 40 nt, Homo sapiens
ggaaaaaauuacaaggcauugagcuuguaaaucaaguaag

SEQ ID NO: 176439 - RNA, 63 nt, Homo sapiens
uccagcagucaaugcacucucuauaauuauuaacugcauuuccuugcccugcaagccccagau

SEQ ID NO: 176440 - RNA, 45 nt, Homo sapiens
uuauaaagaaauauuaucccaaguuacaaaucuggguggcaggcu

SEQ ID NO: 176441 - RNA, 42 nt, Homo sapiens
ucacuggacaggaaaaggcgacggggaaaaugucagcccugg

SEQ ID NO: 176442 - RNA, 45 nt, Homo sapiens
ggacuauuaucaguaaaaucugccuugugaggccuaaucuugcug

SEQ ID NO: 176443 - RNA, 39 nt, Homo sapiens
uuauugauagugcacauuuuaacuuuuuuguuggcauau

SEQ ID NO: 176444 - RNA, 49 nt, Homo sapiens
cccuuggggaggacccauacugcuuuggaagaaugcauauuuuuagcag

SEQ ID NO: 176445 - RNA, 75 nt, Homo sapiens
aggcauucaucaggcauuccuaggccaaaugcagccuuccuagcccuaguaguuauuuaagauuuuuagcuaaaa

SEQ ID NO: 176446 - RNA, 46 nt, Homo sapiens
uuucucuagguaugccucgauacuucaccuaaguuccuaucuucca

SEQ ID NO: 176447 - RNA, 47 nt, Homo sapiens
gaaugaaauuguaggccaagggagcucaggucagcacauuggagaca

SEQ ID NO: 176448 - RNA, 44 nt, Homo sapiens
cuccaugggagcagagaggagggcugcuaccucugccaggcaug

SEQ ID NO: 176449 - RNA, 33 nt, Homo sapiens
gauggugauaucacuaauuacauuaggaaauaa

SEQ ID NO: 176450 - RNA, 37 nt, Homo sapiens
aguuaccugguggacagcaugaguguggguguaacag

SEQ ID NO: 176451 - RNA, 45 nt, Homo sapiens
ccugaggaggaggcagguucaaguaaagguuuauguaaggugggg

SEQ ID NO: 176452 - RNA, 61 nt, Homo sapiens
ggaggcccaggagagaggggagaugacuaauggaagaaggugggaggcauggaauggcagg

SEQ ID NO: 176453 - RNA, 45 nt, Homo sapiens
cucugccauggaccagggaguucagccuugucaagucaaaacaug

SEQ ID NO: 176454 - RNA, 46 nt, Homo sapiens
aauuuucaauuccuucaagaauucuuuauuugaaaugugguuucaa

SEQ ID NO: 176455 - RNA, 42 nt, Homo sapiens
auuauucauaggcugcugaauuuuuaauuuggauccaagcag

SEQ ID NO: 176456 - RNA, 63 nt, Homo sapiens
cgucccuggccgugcaucuuugaaguuuaucuucaugcuagugugaugucucucuggccugua

SEQ ID NO: 176457 - RNA, 19 nt, Homo sapiens
caggccaggaggagaaaga

SEQ ID NO: 176458 - RNA, 46 nt, Homo sapiens
cugagugagaugcuuuaaugccagagaaauugucuuauguucaugg

SEQ ID NO: 176459 - RNA, 50 nt, Homo sapiens
aucaaaguucagaauaauaaauauccaggagauugacaguggcauagaga

SEQ ID NO: 176460 - RNA, 43 nt, Homo sapiens
agaugcucaguauauuuuuaaaucuguuuuaaaacucugauag

SEQ ID NO: 176461 - RNA, 45 nt, Homo sapiens
acauaauauauuuaacaaaauaaccuguguacaacguggcacuga

SEQ ID NO: 176462 - RNA, 58 nt, Homo sapiens
ucuucauuguuuuuguuuugaagccuaacauuaguuuguauccuuggucccugccccu

SEQ ID NO: 176463 - RNA, 64 nt, Homo sapiens
agucuguagcauaaauagcuauaguaccuuuauuaucuccggcuuuucacacagagauaggaac

SEQ ID NO: 176464 - RNA, 42 nt, Homo sapiens
uauuucuaaauuccaacuucuuggaaaggccucugccgagau

SEQ ID NO: 176465 - RNA, 46 nt, Homo sapiens
auuaagaugcuggcaaccaggguggguggccugagaaaggaagaga

SEQ ID NO: 176466 - RNA, 45 nt, Homo sapiens
ucucaaaucaccugcucugcucuucaguucagaaaauaucaucac

SEQ ID NO: 176467 - RNA, 22 nt, Homo sapiens
ucccucugaaacuuauaggaua

SEQ ID NO: 176468 - RNA, 44 nt, Homo sapiens
ccuuggagaaggggguuggcaggauuguuaauauaaggacuuga

SEQ ID NO: 176469 - RNA, 61 nt, Homo sapiens
aguuggaaaaaguaacacccuuuagaaugauacccagaagugaugaaggaagcaaggaaua

SEQ ID NO: 176470 - RNA, 59 nt, Homo sapiens
ccauuugaaucaauugaaauuaacuaauguaaaugaaaguaauugauauccagcagcca

SEQ ID NO: 176471 - RNA, 52 nt, Homo sapiens
ucaauccuccaagaccucaggagaacauaggccuucuguuucugccuagcua

SEQ ID NO: 176472 - RNA, 42 nt, Homo sapiens
aagggcucucuauucagagacaucauuaugggccaagccagg

SEQ ID NO: 176473 - RNA, 41 nt, Homo sapiens
acuaaggcucagagaacugaaaugauuugcccaaagucaca

SEQ ID NO: 176474 - RNA, 35 nt, Homo sapiens
uaguaucugaggaggcccuggggguggaaggugga

SEQ ID NO: 176475 - RNA, 45 nt, Homo sapiens
uaacccucagcucgggcuguaauuauguguuuaagcaaugucuga

SEQ ID NO: 176476 - RNA, 46 nt, Homo sapiens
gaagacuuugcuaggcaggggguggguacaucugcugccaucccag

SEQ ID NO: 176477 - RNA, 48 nt, Homo sapiens
uccccaggguacuguggagcacagaggauguacuccuggguaggaggg

SEQ ID NO: 176478 - RNA, 46 nt, Homo sapiens
auuuuaccuaauuuuauacugaggauucagaguccagagaaguuaa

SEQ ID NO: 176479 - RNA, 42 nt, Homo sapiens
cauucaucucuccaaaccuguaauacuuuggccagggccagg

SEQ ID NO: 176480 - RNA, 48 nt, Homo sapiens
ccuguuuuggaggagguuuucuuuuccccacucagaaaugaccaucaa

SEQ ID NO: 176481 - RNA, 23 nt, Homo sapiens
uguugaauucuauuuuauaccag

SEQ ID NO: 176482 - RNA, 42 nt, Homo sapiens
ggaaaccacugacugaauuagcauuaaccagauuguguggag

SEQ ID NO: 176483 - RNA, 118 nt, Homo sapiens
ucaucuaggaucagggaaggccuggagaccaucauagagcaaacccauuuggugucacauugaagacagaacuaggacuaggagggcagguuucuccucagaccuccccagcauccuc

SEQ ID NO: 176484 - RNA, 27 nt, Homo sapiens
uuuaaacugcuuagcuauuuuguaauu

SEQ ID NO: 176485 - RNA, 53 nt, Homo sapiens
ugugaccuuucucaguccucacacaaagccagugaggagacugagauucagag

SEQ ID NO: 176486 - RNA, 42 nt, Homo sapiens
ggaggauggagccuagacaaacaucaugcccucaacauucaa

SEQ ID NO: 176487 - RNA, 46 nt, Homo sapiens
uuugggcugaucuacuucguggauggcaccaugaucagacgcaucg

SEQ ID NO: 176488 - RNA, 46 nt, Homo sapiens
uucacacaaugggguccuguauauugcugagacugaugagaaaaag

SEQ ID NO: 176489 - RNA, 42 nt, Homo sapiens
auccggaagaacaagccuuuccucaacacccagaacauguau

SEQ ID NO: 176490 - RNA, 54 nt, Homo sapiens
caccuacacuggggacggcgacaucacacucaucacagacaacaauggcaacau

SEQ ID NO: 176491 - RNA, 46 nt, Homo sapiens
uggcaauuccggccuucuggcaaccaaaagcaaugaaaacggaugg

SEQ ID NO: 176492 - RNA, 43 nt, Homo sapiens
ggcccuguaucuaaaggguagguuucucugccuccucccucag

SEQ ID NO: 176493 - RNA, 48 nt, Homo sapiens
uuacccaaacuaaaauacagagaggaaaaaaaagaguggaaaaugcag

SEQ ID NO: 176494 - RNA, 40 nt, Homo sapiens
ccgaagugauacagacaguucagugcauguccagguagag

SEQ ID NO: 176495 - RNA, 45 nt, Homo sapiens
ugacauccgcgaccgcaucacucggcugggugacgugcaauacaa

SEQ ID NO: 176496 - RNA, 44 nt, Homo sapiens
acagacuuggggccuauggauaaacaugaauaugcuaacaaugu

SEQ ID NO: 176497 - RNA, 43 nt, Homo sapiens
augaguuuccugugagaugucuuggcagguuacuguagcugaa

SEQ ID NO: 176498 - RNA, 46 nt, Homo sapiens
ugucgagcaguacccagaacugucagacagcgccaacaacauccac

SEQ ID NO: 176499 - RNA, 42 nt, Homo sapiens
gaagcccacccaauguguuuuuuagugacaggaagaaaggag

SEQ ID NO: 176500 - RNA, 39 nt, Homo sapiens
uacacaaguuaaugaaacugagaaggucugacugcauga

SEQ ID NO: 176501 - RNA, 44 nt, Homo sapiens
auucccagcuagguuuauacacuugucuauauuuuacuggagga

SEQ ID NO: 176502 - RNA, 41 nt, Homo sapiens
aaaaaaagcauaaaaacaaaaccagaagugaucccguguag

SEQ ID NO: 176503 - RNA, 45 nt, Homo sapiens
gcuacugcuccggccugauugauaaccuaauccggcggaggccga

SEQ ID NO: 176504 - RNA, 23 nt, Homo sapiens
cagauuaacagcagcuugcccaa

SEQ ID NO: 176505 - RNA, 29 nt, Homo sapiens
uuaaauaaauauuaagugcuauaugcuaa

SEQ ID NO: 176506 - RNA, 47 nt, Homo sapiens
cugugagggaccgugaaauguuuggauauaugaaauuacauccagag

SEQ ID NO: 176507 - RNA, 45 nt, Homo sapiens
uguguuauucuguacauuagcaaugaacaauccaaaaaugaaauc

SEQ ID NO: 176508 - RNA, 37 nt, Homo sapiens
gaaaaacaauagcuauaaacuuucaaggccaaaagau

SEQ ID NO: 176509 - RNA, 45 nt, Homo sapiens
aauugauuuaaucaaaauauaaggugagaagggguacauucacua

SEQ ID NO: 176510 - RNA, 46 nt, Homo sapiens
aacuagucagcuuuucacacagcagaagcuuugaacugaaauaugu

SEQ ID NO: 176511 - RNA, 53 nt, Homo sapiens
guacugguaaagagcggaguuccuagcuuuuucugaauauuaaacuuguagau

SEQ ID NO: 176512 - RNA, 45 nt, Homo sapiens
aagugugcuaaggacugaauacuugccucgugcuuuuugccacug

SEQ ID NO: 176513 - RNA, 52 nt, Homo sapiens
uugcuugagagucaccuuuuuuuaaaaaaaauaacuguacagcuuuuaaggg

SEQ ID NO: 176514 - RNA, 39 nt, Homo sapiens
uaggcggcacccaccgccgggaggaggaggaggagccga

SEQ ID NO: 176515 - RNA, 60 nt, Homo sapiens
uguugcaauuacuugaguuugugccugucuuuuuuugguagccugugaauuucuuuucuu

SEQ ID NO: 176516 - RNA, 43 nt, Homo sapiens
guuuggggagcccuguguaguuuaguaugcuuagaagauaggg

SEQ ID NO: 176517 - RNA, 98 nt, Homo sapiens
ucuguacauucaccccucuuugucaguaagugcuuuucuaaugguaggauuauuaacauugaacaauguaaugcaaguggauucuaaaaugaauguug

SEQ ID NO: 176518 - RNA, 44 nt, Homo sapiens
guucaugcccaauuaauaauuccaaaccucacauuucaacaagg

SEQ ID NO: 176519 - RNA, 47 nt, Homo sapiens
cugccucugcugcaguuuguuccagcaaaagggauguccugugcuag

SEQ ID NO: 176520 - RNA, 24 nt, Homo sapiens
gugugggaagcaucacaggcuagg

SEQ ID NO: 176521 - RNA, 55 nt, Homo sapiens
gaucuccgccggcuuucggagaguggugacacgggguccaguagauuuugagggg

SEQ ID NO: 176522 - RNA, 40 nt, Homo sapiens
aucugggaagagaaacuggaagaaauggauaaaaagaaca

SEQ ID NO: 176523 - RNA, 44 nt, Homo sapiens
aguagcugcugcugguggugacaaugucaaauaacggccuagac

SEQ ID NO: 176524 - RNA, 45 nt, Homo sapiens
agaagaaaaagaaggaccgauuuuaccgauccauuuuaccuggag

SEQ ID NO: 176525 - RNA, 45 nt, Homo sapiens
gcuuccuggucccacuuucagguuuggggacuacguaucaguaag

SEQ ID NO: 176526 - RNA, 45 nt, Homo sapiens
uuaguuggggaggcuaaggcuuagagaaaaguaaguugcucaagg

SEQ ID NO: 176527 - RNA, 47 nt, Homo sapiens
cuuggugguguagcagacucagugucuugggaauuaacaggaagaag

SEQ ID NO: 176528 - RNA, 45 nt, Homo sapiens
agagaaagagcggccagagauuucucucccuucagauuuugaaca

SEQ ID NO: 176529 - RNA, 46 nt, Homo sapiens
cgcugagucugucucacuuacuccauugagggacugagucauuuca

SEQ ID NO: 176530 - RNA, 54 nt, Homo sapiens
aauuggaucaagauaguaaacugaauucaugugcccaucucucuugcuaucuca

SEQ ID NO: 176531 - RNA, 57 nt, Homo sapiens
auaauauaaaauauaaaagauagaaaauuugagaauaaaugacaauagaggguuggu

SEQ ID NO: 176532 - RNA, 27 nt, Homo sapiens
acauaguucuuggcaccugcagaggug

SEQ ID NO: 176533 - RNA, 57 nt, Homo sapiens
gaauacugagaagcagaagaagaagccuaaaaugucugaugaggagaucuuggagaa

SEQ ID NO: 176534 - RNA, 48 nt, Homo sapiens
uccuagugcugagauccaccagcacuaauauaaaauggaagacccaaa

SEQ ID NO: 176535 - RNA, 60 nt, Homo sapiens
uguugcuaaugaugucauugaaauuuucuuuuuuuuuuuaaauuauacacccaagaauuu

SEQ ID NO: 176536 - RNA, 46 nt, Homo sapiens
auaccagcuuuauaacagaagauagcuaggggcaggauaaucaggc

SEQ ID NO: 176537 - RNA, 42 nt, Homo sapiens
acuguagcauacaaaagccaaauagcaggauaacauuaugaa

SEQ ID NO: 176538 - RNA, 42 nt, Homo sapiens
agucuuugugaguucuugcuuauuggggguuauccagcugag

SEQ ID NO: 176539 - RNA, 41 nt, Homo sapiens
uguuuuuagagagaauguguacaauagaaagaacagacugg

SEQ ID NO: 176540 - RNA, 46 nt, Homo sapiens
cuccuugacagauguggugacagaaacuugcauggaugaaggccaa

SEQ ID NO: 176541 - RNA, 51 nt, Homo sapiens
ucuugucaccuauguguagguacacagucaacacuuacugaagugagugua

SEQ ID NO: 176542 - RNA, 46 nt, Homo sapiens
aacuccugaugcccucuucuccuugccuugcuucucccauuuccug

SEQ ID NO: 176543 - RNA, 88 nt, Homo sapiens
uggauuugggcaguggagaguggcuggcacccuggaggcuguguaggcccagcuguggcucuucugggccugacuucaggguggagaa

SEQ ID NO: 176544 - RNA, 66 nt, Homo sapiens
cuaggggccagugugcauggacagugaggccagggccaucugccuucucucugcuucauuguggga

SEQ ID NO: 176545 - RNA, 42 nt, Homo sapiens
ccacugaugcccagcuucccccaacaccccaacacaggccca

SEQ ID NO: 176546 - RNA, 40 nt, Homo sapiens
ccaguuucucacccuggguuggggucccccagcauccaga

SEQ ID NO: 176547 - RNA, 24 nt, Homo sapiens
aaggggagcccaggcggggagggu

SEQ ID NO: 176548 - RNA, 42 nt, Homo sapiens
aggaauugcaaagaaucaaguccacccuucucaugugacaga

SEQ ID NO: 176549 - RNA, 46 nt, Homo sapiens
ucgggaccugaggcagcccaggacagcagucuguuauguggcccug

SEQ ID NO: 176550 - RNA, 47 nt, Homo sapiens
ugcaggagcuggaccuuucgggcaccaaccuggugccccugccugag

SEQ ID NO: 176551 - RNA, 41 nt, Homo sapiens
gguucaggcucugaauggugggcgcaggcaggccggcccuc

SEQ ID NO: 176552 - RNA, 45 nt, Homo sapiens
cgugaaggcagacacugagaccucccggagcugguuguggcuaag

SEQ ID NO: 176553 - RNA, 82 nt, Homo sapiens
aggccauuguggcugaggucaagcgacuccagguagcgaaggcgggagaaggcagugggugagaugcuggugagcagguugu

SEQ ID NO: 176554 - RNA, 46 nt, Homo sapiens
ccagcaucucacccacugccuucucccgccuucgcuaccuggaguc

SEQ ID NO: 176555 - RNA, 61 nt, Homo sapiens
uccccaaaacccaucugggaaucuggacacccacguuggacaccaggaugcccaaugagaa

SEQ ID NO: 176556 - RNA, 44 nt, Homo sapiens
gccucuuucccccuuacucugucccuugccaccagcagauuaag

SEQ ID NO: 176557 - RNA, 86 nt, Homo sapiens
gagcaccaccaucccaggagcuacaguggacgugaacacaggcuuugaauccaacagcaguggguggugugaccauuagaugugac

SEQ ID NO: 176558 - RNA, 47 nt, Homo sapiens
caggaaggaggugagagagggggaggagaugggccagggaccugccc

SEQ ID NO: 176559 - RNA, 73 nt, Homo sapiens
ucuuuuguagaggccaauuucaggauuaaauccagcccaggugcauccugggcauggucccagcugaggcagg

SEQ ID NO: 176560 - RNA, 46 nt, Homo sapiens
cauucaucugauuuaucaccuucauguggccaggcucgugcaggca

SEQ ID NO: 176561 - RNA, 42 nt, Homo sapiens
auuaaauaagauaaugaauuacaugugcaaauaaauaaaaag

SEQ ID NO: 176562 - RNA, 53 nt, Homo sapiens
gggauuugagccuguaggcaauggagagcuccuggaggauuuaaacaggcaca

SEQ ID NO: 176563 - RNA, 55 nt, Homo sapiens
cagagcaaggcuggccugggcacugaggacacuuccuaaagaggguuggguccuc

SEQ ID NO: 176564 - RNA, 48 nt, Homo sapiens
cuuuaaccuagaacuuugucggaugcugcagacaugauggaagggcac

SEQ ID NO: 176565 - RNA, 21 nt, Homo sapiens
gaagaagcuugaaguccaggg

SEQ ID NO: 176566 - RNA, 41 nt, Homo sapiens
ggaguauccuggccucaccccugggcuucuacacagcacuu

SEQ ID NO: 176567 - RNA, 46 nt, Homo sapiens
ucgaggauggcgccuucgagggucugccccgccugacccaucucaa

SEQ ID NO: 176568 - RNA, 46 nt, Homo sapiens
gcuuucuugagcaccugaccucccugugcuuccugaaccucagcag

SEQ ID NO: 176569 - RNA, 42 nt, Homo sapiens
gaccugcccccauacaccuuugccaaucuggccagccugcag

SEQ ID NO: 176570 - RNA, 42 nt, Homo sapiens
uggaccuuucuuccaauccugggcuggagguggccacggggg

SEQ ID NO: 176571 - RNA, 46 nt, Homo sapiens
ccgggcugcacuuuggguccagcuguggaagccagaaguugggcgg

SEQ ID NO: 176572 - RNA, 42 nt, Homo sapiens
gcuuuucauuuucagagagacugaaagucauucucagaagac

SEQ ID NO: 176573 - RNA, 43 nt, Homo sapiens
agccccacuucuccaucgcagccccaccuuggcugcugagcca

SEQ ID NO: 176574 - RNA, 42 nt, Homo sapiens
acggccugcagccccugcagugguaaagaucaggcccuggag

SEQ ID NO: 176575 - RNA, 45 nt, Homo sapiens
ccugaucuuuaccacugcaggggcugcaggccguuaaguggacag

SEQ ID NO: 176576 - RNA, 56 nt, Homo sapiens
agggucuggaagcauccugugcugugcacaccugcucucuccucucucccaggcag

SEQ ID NO: 176577 - RNA, 32 nt, Homo sapiens
ggaaaggaagggaggagggaaacaggcagaga

SEQ ID NO: 176578 - RNA, 21 nt, Homo sapiens
auggggaaacugaggcuuagg

SEQ ID NO: 176579 - RNA, 55 nt, Homo sapiens
ggaagaauggacgugcugggaccaacucaagaccuuguuuugcugucuucaucau

SEQ ID NO: 176580 - RNA, 42 nt, Homo sapiens
cucucuccaccccauuuuacagaggagaacaccaaggcccag

SEQ ID NO: 176581 - RNA, 25 nt, Homo sapiens
aaaauaaacaaagguuagaggguag

SEQ ID NO: 176582 - RNA, 138 nt, Homo sapiens
ggccagccauggagauaccuugggcagcagcauuccaaagaaggcaaagacagggcaaccaggaguccagggagagggacugggagagaggugagaugagaccagaaagguguguguaugguaggggcaaauucuuua

SEQ ID NO: 176583 - RNA, 51 nt, Homo sapiens
gguaggaccuuguaggucuuggaaggcacuaugguuuuuauuaugagugaa

SEQ ID NO: 176584 - RNA, 46 nt, Homo sapiens
aggugaaagccggaagaccaguuaaaaggcuguuguaauaauccag

SEQ ID NO: 176585 - RNA, 88 nt, Homo sapiens
agaaguggguggagaacuguaggagagcagacuuagaagauaaaacaccugaucagcuaaauaaacauuaucgauuaugugccaaaca

SEQ ID NO: 176586 - RNA, 70 nt, Homo sapiens
uuuucauucauacauucuguuuucugaucuauaauaucuuugcuuuauuugcaaauagaaaaucaauuug

SEQ ID NO: 176587 - RNA, 32 nt, Homo sapiens
cucucagugugguagggguggcaggcacacag

SEQ ID NO: 176588 - RNA, 45 nt, Homo sapiens
accuaccuguguuggugagguuuguugaugaaucucauaaccuaa

SEQ ID NO: 176589 - RNA, 45 nt, Homo sapiens
uuucacacuaugauaacugagaaguggggauuaaauauggaguau

SEQ ID NO: 176590 - RNA, 45 nt, Homo sapiens
gaaacucccugggaaauuccgcagagcucaccaggguaacuugga

SEQ ID NO: 176591 - RNA, 43 nt, Homo sapiens
auacauuagccauugauaaucuaccuguuuaaauggccccugu

SEQ ID NO: 176592 - RNA, 54 nt, Homo sapiens
uuggguguuaugaauucuuugaagaaauauauuuugaagaggugugggaggaag

SEQ ID NO: 176593 - RNA, 47 nt, Homo sapiens
gugggaaccacauuggccggucaggaucggaggcugaaggaagauua

SEQ ID NO: 176594 - RNA, 45 nt, Homo sapiens
ccucggcgcgcgcgguugccauagagacgcagccagcccagggcg

SEQ ID NO: 176595 - RNA, 28 nt, Homo sapiens
cguccggggcggacgagcgcgacacgcg

SEQ ID NO: 176596 - RNA, 49 nt, Homo sapiens
uaauagacaucucuuaggauuguucacacuuuuauugauuuaauauuaa

SEQ ID NO: 176597 - RNA, 47 nt, Homo sapiens
ugguaauuaguacaucuugguuccauuccuaccuuccacaugauacc

SEQ ID NO: 176598 - RNA, 52 nt, Homo sapiens
augucgugcuucacaugccaugcuucacauuacacacauacuggaaaugacu

SEQ ID NO: 176599 - RNA, 45 nt, Homo sapiens
auggggacugagguuauagaaacaguuaguggcugagcuggcuca

SEQ ID NO: 176600 - RNA, 46 nt, Homo sapiens
auuaacccugcaagauagaaguuacuacuccuauuuuacauguugg

SEQ ID NO: 176601 - RNA, 50 nt, Homo sapiens
gacuuugcucaaaagacugacuuuauauucuuauauucuuuuauuuugag

SEQ ID NO: 176602 - RNA, 80 nt, Homo sapiens
aagccugugaaaccaauaaaggccaagccccaguacaagcccccagaugauaagaugguucaugagaccagcuacagugc

SEQ ID NO: 176603 - RNA, 32 nt, Homo sapiens
cuggcccaguauuguaggcccccaugcccggc

SEQ ID NO: 176604 - RNA, 42 nt, Homo sapiens
ugguguggcacccggggcaugggguuagcauuggacaaaaga

SEQ ID NO: 176605 - RNA, 53 nt, Homo sapiens
cuaugccugugggugaguugagcaacgugaugagguguuaacuuccuacaggg

SEQ ID NO: 176606 - RNA, 66 nt, Homo sapiens
ggccagugggugcugccaaagugacggaacagggaguucagacgggagaugccgaaugcccuaaug

SEQ ID NO: 176607 - RNA, 56 nt, Homo sapiens
guggaaaaaccuaguguucagaguuccaaaccaaaaaagaccucagcgagccauaa

SEQ ID NO: 176608 - RNA, 41 nt, Homo sapiens
uuggaagugucuguggggucuccuccucccagauccccaag

SEQ ID NO: 176609 - RNA, 66 nt, Homo sapiens
gugggcuuuaaauuguauaccgagucauagauacgccacugauaacuaaaacuagaucagggcugg

SEQ ID NO: 176610 - RNA, 51 nt, Homo sapiens
ccccggcgcaggcuugcucuucuuuuacaaugaaaggggugaagagugagg

SEQ ID NO: 176611 - RNA, 52 nt, Homo sapiens
cugcaugcucccuugucaugcuucucuugcuugcuuaugcgucaggcaacac

SEQ ID NO: 176612 - RNA, 84 nt, Homo sapiens
agcauauuauuaagcucucuuuugaugaguuaagggagagagacaaaacggggauugagagaggugguaagaaagacaggcgag

SEQ ID NO: 176613 - RNA, 46 nt, Homo sapiens
augaugugcaaaacugacauggucccugcccucuggacacuucagu

SEQ ID NO: 176614 - RNA, 51 nt, Homo sapiens
gaguaaacacuagccaggugaagagggaacaagagaauauuccaggagcag

SEQ ID NO: 176615 - RNA, 44 nt, Homo sapiens
uuucagauacugugcugggcauuggggcugcaggcaaggagguu

SEQ ID NO: 176616 - RNA, 41 nt, Homo sapiens
ugauuaaagauacccacuaaagaaaaaaguuuucuaaccua

SEQ ID NO: 176617 - RNA, 46 nt, Homo sapiens
uggcaaugcuugccuuugaguguuaguguugucacacgcucuccac

SEQ ID NO: 176618 - RNA, 32 nt, Homo sapiens
ggccacagugaggcgagggaacagugccugag

SEQ ID NO: 176619 - RNA, 97 nt, Homo sapiens
ggagagaggggcauucccacugcuuccuuuccugguaugccauggaccccuugccccuucuugcagccagcacuuaacaagggggucagggagucag

SEQ ID NO: 176620 - RNA, 46 nt, Homo sapiens
ggucccagggacccucagcuaccuacugucucaccucuaccccgag

SEQ ID NO: 176621 - RNA, 46 nt, Homo sapiens
ggaagggggaacaugagccuuuguugcuaucaauccaagaacuuau

SEQ ID NO: 176622 - RNA, 73 nt, Homo sapiens
ucccaaccucucccaacuauaaaacuaggugcugcagccccugggaccaggcacccccagaaugaccuggccg

SEQ ID NO: 176623 - RNA, 70 nt, Homo sapiens
gucauucugccugcccugaaagucccagaucaagccugccucaaucaguauucauauuuauagccaggua

SEQ ID NO: 176624 - RNA, 43 nt, Homo sapiens
uucccagcuagaauucacuccacuuggacaugggccccagaua

SEQ ID NO: 176625 - RNA, 99 nt, Homo sapiens
cauugggcgccugguccggccuaagggugacaagaugcgagacgaguuauagggccucagggugcacacaggauggcaggaggcauccaaaggcuccug

SEQ ID NO: 176626 - RNA, 60 nt, Homo sapiens
aguuggacacagauggcaaccccuuugaccaggacaucuacgggcgcgaggagcugcgca

SEQ ID NO: 176627 - RNA, 47 nt, Homo sapiens
cugggccugacugaggccauugacaagaacaaggccgacuugucacg

SEQ ID NO: 176628 - RNA, 95 nt, Homo sapiens
ucucgagcgccuugaaaagcugcuaaccaaagagcagcugaagaucuggauggggaagaugcagaagaaggcuguugccaucuccuugcccaagg

SEQ ID NO: 176629 - RNA, 45 nt, Homo sapiens
gccucuacaacuacuacgacgacgagaaggaaaagcugcaaaucg

SEQ ID NO: 176630 - RNA, 46 nt, Homo sapiens
caaccguggcuucauggugacucgguccuauaccgugggugucaug

SEQ ID NO: 176631 - RNA, 50 nt, Homo sapiens
ggccaagcuaggagagcugaggucuccccgagucaguggcugagcuugga

SEQ ID NO: 176632 - RNA, 48 nt, Homo sapiens
acuucgugcgcagcagcaagcagcacuacaacugcgagcacuccaaga

SEQ ID NO: 176633 - RNA, 45 nt, Homo sapiens
ugggcgagcugcugcgcucacucagcaacuccacggcgcgcaacg

SEQ ID NO: 176634 - RNA, 32 nt, Homo sapiens
ucgugucgcugggcggcaaggcgaccacggcg

SEQ ID NO: 176635 - RNA, 63 nt, Homo sapiens
ccugcagccgcagcagcuccuggcacugcggagaaguugagccccaaggcggccacgcuugcc

SEQ ID NO: 176636 - RNA, 53 nt, Homo sapiens
gcuaugucaggaagccuccuccccagccccaccgagucuucaaaggaguuggu

SEQ ID NO: 176637 - RNA, 42 nt, Homo sapiens
ggggaggaggccugagggcaacccugaagccguggagcagau

SEQ ID NO: 176638 - RNA, 39 nt, Homo sapiens
guuugugcaauaaauuauaugguugcucugccuuugagg

SEQ ID NO: 176639 - RNA, 39 nt, Homo sapiens
ucaggagcauaauggccacaguuaguaaugguaaagagg

SEQ ID NO: 176640 - RNA, 42 nt, Homo sapiens
cgcauguucgacaaugagaggcggacugugagccggcgaaaa

SEQ ID NO: 176641 - RNA, 48 nt, Homo sapiens
aaaaacugcgacaaaccaguggggaggugggucuggccccaacagacc

SEQ ID NO: 176642 - RNA, 52 nt, Homo sapiens
gagagccuaagugaagagccacuuccuucuuugcgucgaggccggaaaagac

SEQ ID NO: 176643 - RNA, 46 nt, Homo sapiens
augggggaagaguuacuaggcucugaagguauccauucuagcaagg

SEQ ID NO: 176644 - RNA, 54 nt, Homo sapiens
uuaugaggccaguccacggauccucaaaaagugggaacagaucuuucaggagcg

SEQ ID NO: 176645 - RNA, 46 nt, Homo sapiens
agagacucccugauggccgugugcuaaguccucucaucaucaaauc

SEQ ID NO: 176646 - RNA, 45 nt, Homo sapiens
ccuccaaccccaucauugguguccucuugucaacucaaaacaacc

SEQ ID NO: 176647 - RNA, 46 nt, Homo sapiens
agagcgaagagcagagucagagcaguuccaggcaacaaagccaagg

SEQ ID NO: 176648 - RNA, 72 nt, Homo sapiens
caaggaaucucuugauccuuuagacuuuguaggcccugggaaggaaaggaagagggaauuggauagaugaug

SEQ ID NO: 176649 - RNA, 77 nt, Homo sapiens
gagauaaaagggacugggggagcaaagguauuuguuguggcuacuuugguggggagguggaaggggagaaaagaggu

SEQ ID NO: 176650 - RNA, 45 nt, Homo sapiens
auuuguuuccaagaacaacuccuacuccuuagcuuuccuggcagg

SEQ ID NO: 176651 - RNA, 46 nt, Homo sapiens
cuuucuggucagcuggaaucgauaaagcuuuaccaucuauaaugac

SEQ ID NO: 176652 - RNA, 58 nt, Homo sapiens
gaucaaauccacaagcuguuaccagaggauacagaaacagggaaaaggaaaauggaug

SEQ ID NO: 176653 - RNA, 46 nt, Homo sapiens
cuuccccauacuucucccccaguucuauaaaaaccuccucaaaaaa

SEQ ID NO: 176654 - RNA, 64 nt, Homo sapiens
cuguugcugccauuuauuugcugccuuuggguaagaaauggaaaacucaaaaagucauaguugg

SEQ ID NO: 176655 - RNA, 50 nt, Homo sapiens
agccaaauuaaggaauuuuccagaagcuguuacaacuguugucucuagua

SEQ ID NO: 176656 - RNA, 30 nt, Homo sapiens
cuaggaagugguggucucaauauaaaaggc

SEQ ID NO: 176657 - RNA, 45 nt, Homo sapiens
auacaaggaaguuguuacaguuuuggaugauggaucuagguuaag

SEQ ID NO: 176658 - RNA, 80 nt, Homo sapiens
uucagacuuuauauucagagcaccaaucaaauuaagcaagccuggggaacuucgugaggaauaugaaagcuugagaaagg

SEQ ID NO: 176659 - RNA, 46 nt, Homo sapiens
gggugaaggugauggaauguuugccuuccaaaccuagggucuaaca

SEQ ID NO: 176660 - RNA, 130 nt, Homo sapiens
uaacuacauaaaaauaaccacuauaaacaaagucaacacaauugauacaccgggaagaguauugcuagucauguaacauaaagcuaauuuuucuuaacaaaucaagaagaaaaaguuaauacaaguagga

SEQ ID NO: 176661 - RNA, 47 nt, Homo sapiens
auuuuuaaaaagcagaucugagaagaaucuuaugcauucuaccagaa

SEQ ID NO: 176662 - RNA, 27 nt, Homo sapiens
ugucccacgaacaggguguggugugga

SEQ ID NO: 176663 - RNA, 27 nt, Homo sapiens
ugucccacgaacaggguguggugugga

SEQ ID NO: 176664 - RNA, 57 nt, Homo sapiens
aauguucucaaccagggaaacucguuagagacuuagugauugggguuuauauuagcu

SEQ ID NO: 176665 - RNA, 55 nt, Homo sapiens
guguuguauguguguguugggaggucuccaagaccacccacagguucacugauuu

SEQ ID NO: 176666 - RNA, 44 nt, Homo sapiens
uagaaaaugaauguacagggguaaaaacucacgcauacucaggu

SEQ ID NO: 176667 - RNA, 44 nt, Homo sapiens
cugaucucaguuggauccuuggagggcuacaaacuaggggagaa

SEQ ID NO: 176668 - RNA, 64 nt, Homo sapiens
uaagaacccucacagaaagcuacugaaaagcaaggcagacucuaacaguucuccaguguugagg

SEQ ID NO: 176669 - RNA, 49 nt, Homo sapiens
guucagagcugccaaggcaaccagaaccugaggguccaagaucccaaag

SEQ ID NO: 176670 - RNA, 39 nt, Homo sapiens
agcaaagauaaauacugguaggcacauagucacuaggug

SEQ ID NO: 176671 - RNA, 81 nt, Homo sapiens
agugaaaggggaagaaaaucauucugggaggaggaaguggcauauauaaaguccuaguggaggcaggauauggcauaucua

SEQ ID NO: 176672 - RNA, 62 nt, Homo sapiens
agugggaaaacugcaaaggagagagcagugaacaggguuuugaaguaugaauagcaaaucau

SEQ ID NO: 176673 - RNA, 70 nt, Homo sapiens
gaaagcagaaacagugaauauaacauuuagacaauucuuuggaggaauuugcaguaaugggggcagauaa

SEQ ID NO: 176674 - RNA, 49 nt, Homo sapiens
gcugcaauaucuggcauauaguagguucauaaauauuugugcgauaaau

SEQ ID NO: 176675 - RNA, 51 nt, Homo sapiens
acuuguauuuuguacuuucuaagaacuuaaacugagcuuuuggugacuagg

SEQ ID NO: 176676 - RNA, 60 nt, Homo sapiens
uuggcuagguacuaauaguccauaguaugucaucaauaaauguuagugacaauagaaaua

SEQ ID NO: 176677 - RNA, 36 nt, Homo sapiens
uucauagugauauuuaaacaguaaaaucagauuaau

SEQ ID NO: 176678 - RNA, 342 nt, Homo sapiens
cuuguaccccccaacaaggucucccucugacauccaggcuggaguucagugaugaaaucauggcacauuacagccucuacuuuucaggcugaagcgauccucccaccuccaaaguaacugggacuacaggcaugugccaccgugcccaacuaauuuuuuguauuuuuaguacuauacagggucucaccauguugcccagguuggucuugaacuccuggguucaagcaauccuccugccucagucucucaaagugcugggauuacaggugugagccaccauaccuggcuuuagacuacuguuucacaguuugauaaugaaaggaaggaaauagagugcaugaa

SEQ ID NO: 176679 - RNA, 38 nt, Homo sapiens
uuagaaugaaugaacuggguauauaucaacauggauaa

SEQ ID NO: 176680 - RNA, 67 nt, Homo sapiens
gaugcucacauuacagcacuguaguacuagaaaauguaguaacaguugucuuugauaggagaaggga

SEQ ID NO: 176681 - RNA, 48 nt, Homo sapiens
ucuaugucucucauucuacagaagagaaaacugaggcccagaacagau

SEQ ID NO: 176682 - RNA, 50 nt, Homo sapiens
uggucucccuauuaguacuacugauuauauggccacauaggauagaaauu

SEQ ID NO: 176683 - RNA, 44 nt, Homo sapiens
cuuggguuuaaaaguuuuggaaacaaagguuggguggcaggggc

SEQ ID NO: 176684 - RNA, 71 nt, Homo sapiens
auccggaguuuagggaacagguugaauuugaggaugugaagggagcuuuucagacucgagagcagaggggg

SEQ ID NO: 176685 - RNA, 42 nt, Homo sapiens
gccuuggaucagagaagugcuugguuuaauguuggaugaaga

SEQ ID NO: 176686 - RNA, 46 nt, Homo sapiens
uguuugugaauuuugaacuucagagugaaggacaggcacguugcau

SEQ ID NO: 176687 - RNA, 48 nt, Homo sapiens
agccacguccuggucuguagccagguguccguguacugcauaauggag

SEQ ID NO: 176688 - RNA, 45 nt, Homo sapiens
caaccaaaacuuaaaagacuuacagagaacagccucaggagguua

SEQ ID NO: 176689 - RNA, 47 nt, Homo sapiens
aaaccucacaggaugaaagaacagucuuuugauacaggugaggugga

SEQ ID NO: 176690 - RNA, 42 nt, Homo sapiens
aguugcucaucauauucccuuucccuggugccuuguugccug

SEQ ID NO: 176691 - RNA, 60 nt, Homo sapiens
uucaggcacccagcucaagaccuggcacauagaaaagugcuggaaacgacauguugaaag

SEQ ID NO: 176692 - RNA, 55 nt, Homo sapiens
ucagcauuguuugacauuguugacugguuccuccuacuugaaccucuuuccuuag

SEQ ID NO: 176693 - RNA, 46 nt, Homo sapiens
uucugaaugagacugccagacaccaaguagguaacaugcaguuggg

SEQ ID NO: 176694 - RNA, 48 nt, Homo sapiens
aagugcacucacauccaucaauucgcucgaucuuuuccucacccgugu

SEQ ID NO: 176695 - RNA, 43 nt, Homo sapiens
acaucacuccacacagaaacauuacagccuggcauccccaguc

SEQ ID NO: 176696 - RNA, 46 nt, Homo sapiens
uuuuaaucaucaaauuuaaccauuuucauaacugguuccuggaggu

SEQ ID NO: 176697 - RNA, 49 nt, Homo sapiens
gauagcaucacaagaaacgagccugaaaaucagguccagccgguccaag

SEQ ID NO: 176698 - RNA, 41 nt, Homo sapiens
cccugccucaugggauggacaaugcaugggguggucuuuau

SEQ ID NO: 176699 - RNA, 48 nt, Homo sapiens
uaccaaaugccucaagggaggcaaaaauucccccucuauuggucuaga

SEQ ID NO: 176700 - RNA, 46 nt, Homo sapiens
gaccaagaaagaccauccauacaccuggagaauugaacuggcaaaa

SEQ ID NO: 176701 - RNA, 51 nt, Homo sapiens
aaaucuauaguggaaggaaucauagaggaagaagaagaagaugaggaagga

SEQ ID NO: 176702 - RNA, 421 nt, Homo sapiens
aucuuugucgccuuuauuuaauuaauuuguuuguuuguuugcuugcuuauuuauuuauuuaggagacaaggccucacucugucacccaggcuggagugcaguggcaugauccuagcucacugcaaccuugaacuccuagguucaagcaauccucccaccucagccucccaaguugcuaagacuacagguacacaccaccaagccuggcuaauuuuuaaauuuuuuguagaaacgaggucuugcuauguugcccaggcuggcuucaaguaauccuccugcuuuagccuggccucaaguaaucaaguaaucaaauuccuggccucaaguaauccucccacuuuagccucccaaaguguugggguuguggcgugagccacagugcccagccacuguugccuuuauucuaaauguuagauuguag

SEQ ID NO: 176703 - RNA, 23 nt, Homo sapiens
cugucuuuauaucuuuuuuaagu

SEQ ID NO: 176704 - RNA, 46 nt, Homo sapiens
ucugcauggaggaggucauucugcccuuucuugggcuguguucacg

SEQ ID NO: 176705 - RNA, 68 nt, Homo sapiens
uuccccuguuccuuggagucaguauuuugaguccauggaagauguagaaguagagaaugaaacuggca

SEQ ID NO: 176706 - RNA, 53 nt, Homo sapiens
aaaggaauaaagcuaaaggacaaagaagaguagggauauaagaugcuaacaaa

SEQ ID NO: 176707 - RNA, 32 nt, Homo sapiens
gagaaauaguuugcuggaaaggaaggagagcc

SEQ ID NO: 176708 - RNA, 60 nt, Homo sapiens
cagagguguaaagacagauucagcgaaugagaggugagauuaggucucuuaagggagaau

SEQ ID NO: 176709 - RNA, 44 nt, Homo sapiens
cuugugaaaggcccugucugugccuggggcugauaaaacagcaa

SEQ ID NO: 176710 - RNA, 45 nt, Homo sapiens
ucggccuguaugauucugucaaacaguucuacaccaagggcucug

SEQ ID NO: 176711 - RNA, 38 nt, Homo sapiens
caagcccgcuggccacugaccccauggcucgcccacag

SEQ ID NO: 176712 - RNA, 45 nt, Homo sapiens
gccauugucaacugugcugagcuggugaccuaugaccucaucaag

SEQ ID NO: 176713 - RNA, 51 nt, Homo sapiens
ccaugcuuuccuuuucuuccuucuuucucuucccuccuucccuucucuccu

SEQ ID NO: 176714 - RNA, 89 nt, Homo sapiens
ugugggaggccucguaccagccaggaucccaagcgucccgucccuuggaaaguucagccagaaucuucguccugcccccgacagcccag

SEQ ID NO: 176715 - RNA, 42 nt, Homo sapiens
uggaagcacagaggaucugaacccuuaccugcccuuucccac

SEQ ID NO: 176716 - RNA, 56 nt, Homo sapiens
aauugaagacucacagggcucuguuuuauuuuguuuuuguuuuuaaagagagcagu

SEQ ID NO: 176717 - RNA, 59 nt, Homo sapiens
uuuuaaaaauacauuuauuuuagaacaguuuuagaguuuagaaaaguugagaagacagu

SEQ ID NO: 176718 - RNA, 47 nt, Homo sapiens
accagcugaucucccgcucuggcugugcugccucccacuuugcagug

SEQ ID NO: 176719 - RNA, 51 nt, Homo sapiens
gcugcagaggaggcaagaacaagccggugcccaccacugagaccccaaacc

SEQ ID NO: 176720 - RNA, 54 nt, Homo sapiens
uggugugggaggucuaaaacauggggagaguuuuuggaucuggaguugagagcc

SEQ ID NO: 176721 - RNA, 42 nt, Homo sapiens
auggggcuuccugggcugguguagagguggaucaggccccag

SEQ ID NO: 176722 - RNA, 25 nt, Homo sapiens
acuucuaggcuuagugauucugcac

SEQ ID NO: 176723 - RNA, 46 nt, Homo sapiens
cagcaugugcgaaggcuggcagagggaaaaggucugguguggcugg

SEQ ID NO: 176724 - RNA, 49 nt, Homo sapiens
agugggagguagaauagaggccagggcagagagaagggucagcagagcc

SEQ ID NO: 176725 - RNA, 39 nt, Homo sapiens
acaggagauggacaggcagagaaggacgaggccgcuuca

SEQ ID NO: 176726 - RNA, 53 nt, Homo sapiens
uacugcuguagccuccuuacucccagcuuucuccaauucacccgccacuugga

SEQ ID NO: 176727 - RNA, 20 nt, Homo sapiens
uucugggcagugcaggcggc

SEQ ID NO: 176728 - RNA, 46 nt, Homo sapiens
ugcucagggcccuuaagaaggccaggguugcccucugcuggcagau

SEQ ID NO: 176729 - RNA, 45 nt, Homo sapiens
ccucauggggcuguugggcauccuggugugcaaccuccucaagcg

SEQ ID NO: 176730 - RNA, 23 nt, Homo sapiens
gcacucagcguggcaggcgugug

SEQ ID NO: 176731 - RNA, 38 nt, Homo sapiens
ggcuggguaauaggaucugcauggcaccaugaaugcug

SEQ ID NO: 176732 - RNA, 46 nt, Homo sapiens
agccaccuacugggugcuacuagcuugcuagccuccaccaucaggu

SEQ ID NO: 176733 - RNA, 65 nt, Homo sapiens
uggggcuggaguggcagagaggacaagagccaaugcugcaucccuacucugcccauccgugggau

SEQ ID NO: 176734 - RNA, 47 nt, Homo sapiens
uagacauucacuucucugccuggguguccuuucuucaguuccuuggg

SEQ ID NO: 176735 - RNA, 56 nt, Homo sapiens
ggaggagggaccggaccuaggacaccuuccggcagauguggggcgaugaggaaguu

SEQ ID NO: 176736 - RNA, 47 nt, Homo sapiens
uuugagggugggacccaggugucuauauguuuuucagaaaccuuuag

SEQ ID NO: 176737 - RNA, 87 nt, Homo sapiens
gaaaugggcccaugaucuccucacagucgcccccaguccuuggcccugcuucccugugucucaugcacuggcacauauggucaccuu

SEQ ID NO: 176738 - RNA, 42 nt, Homo sapiens
uguguguauauaaaguucuauccagagaaaugucaugagaga

SEQ ID NO: 176739 - RNA, 32 nt, Homo sapiens
agugugaguugugagggauggacacuggugaa

SEQ ID NO: 176740 - RNA, 42 nt, Homo sapiens
guggcugggcacugaggauggcugguagggacaggggaggga

SEQ ID NO: 176741 - RNA, 45 nt, Homo sapiens
agagaauggggaaagggagaccugccuggcuggacuucgugaggg

SEQ ID NO: 176742 - RNA, 46 nt, Homo sapiens
agggauggcucccagcagaggguaugucagggacaaaggccaggag

SEQ ID NO: 176743 - RNA, 43 nt, Homo sapiens
agguggggaagcccaagaugaugucugggcuccuggccucgga

SEQ ID NO: 176744 - RNA, 90 nt, Homo sapiens
ccgugucccuggcauccgucgccuuuccaugaagaacccccagcauggccauuccagagaaggaggaaggcuucucccgggcaagagaga

SEQ ID NO: 176745 - RNA, 47 nt, Homo sapiens
cccagggccgcgccuggccuggcccugcugucagggagcuccccacg

SEQ ID NO: 176746 - RNA, 48 nt, Homo sapiens
gucagcugggggcuuggugagcguggcagcgugcagcacacuaaaagg

SEQ ID NO: 176747 - RNA, 52 nt, Homo sapiens
uggaaguuaaaacggaaguggcuggagcacaucaagcaaagagaugagagga

SEQ ID NO: 176748 - RNA, 57 nt, Homo sapiens
cggauagugcugggcuggaauuaccuugaaggcauccucacucacaaauuggugauu

SEQ ID NO: 176749 - RNA, 70 nt, Homo sapiens
cacuaaacauuagccagcuguauacaugagcucccaccaaggauacagugagcacaccucauucccagag

SEQ ID NO: 176750 - RNA, 23 nt, Homo sapiens
uccuggagccuuuguuuccucau

SEQ ID NO: 176751 - RNA, 44 nt, Homo sapiens
gugaccuuggauugagucccuguucccuggggucccuauccauc

SEQ ID NO: 176752 - RNA, 49 nt, Homo sapiens
gguccaggaaucguccugacuccuguaggaugagugaauuagguuagaa

SEQ ID NO: 176753 - RNA, 38 nt, Homo sapiens
ccagcuaaaaauagucccgggccuggccccaaggcugg

SEQ ID NO: 176754 - RNA, 46 nt, Homo sapiens
agaacugucuaccuggaaagacucuuagaaaccagccauguuuucu

SEQ ID NO: 176755 - RNA, 39 nt, Homo sapiens
ugguuucaagaugaaggauucuggguucuuuuccaagag

SEQ ID NO: 176756 - RNA, 45 nt, Homo sapiens
ccuggcuuccagagguggcaggccauaguuuugcugacuagaagu

SEQ ID NO: 176757 - RNA, 59 nt, Homo sapiens
cugagccccuggagggacuuccaggacccaacccuccaguagcucuaggguucacuagg

SEQ ID NO: 176758 - RNA, 40 nt, Homo sapiens
uggggggaacacuguccaggaaugaguccuccccagcgag

SEQ ID NO: 176759 - RNA, 43 nt, Homo sapiens
cucagaaggagggagucagccugcagggggugucaagugaaau

SEQ ID NO: 176760 - RNA, 74 nt, Homo sapiens
caucuuuuccccacucuacccccuucuuggugacucugagaugcaccccguuucugccagacccccagcccugg

SEQ ID NO: 176761 - RNA, 41 nt, Homo sapiens
ggccuacaggucccugagugacccaauuccucagcgccacc

SEQ ID NO: 176762 - RNA, 28 nt, Homo sapiens
uuaaaucuaagcagcaugaacucagcag

SEQ ID NO: 176763 - RNA, 45 nt, Homo sapiens
cugcucaaaccggcacggucugauccggaaauauggccucaauau

SEQ ID NO: 176764 - RNA, 373 nt, Homo sapiens
gcauuuuggccgggcgcgguggcucaugccuguaauccaagcacuuuggaaggccgaggcagguggaucaucugaggucacgaguucaagaccagccuggccaacauagugaaacccccgucucuacuaaaaaaaaaaaaaaauacaaaaauuagcugggcaugguggcacacaccuguagucccagcuacuccggaggcugaggcaggagaaucgcuugaacccaagaggcagagguugcaaugagccgagaucacaccauugcacuccagccugggcgacaagagugaaacuccaucucaaaaaaaaaaaaaaaaaaaaggaguaagcauuuuacaacaucuaagaaaggguaaacguuaguauggcuaga

SEQ ID NO: 176765 - RNA, 61 nt, Homo sapiens
auuuuagaaaugcugggucaagaaaacaguguaacaguucaguuaagagaguggaagagga

SEQ ID NO: 176766 - RNA, 46 nt, Homo sapiens
agagcaucaugguagucaguguuauggggacgcucagagagccuuu

SEQ ID NO: 176767 - RNA, 46 nt, Homo sapiens; identical to SEQ ID NO: 102202

SEQ ID NO: 176768 - RNA, 46 nt, Homo sapiens
gaaggggaauucaaugggcguauuggaguuuucccaucggugcuag

SEQ ID NO: 176769 - RNA, 45 nt, Homo sapiens
acacuccauggaugagagagauucagguaccugagaggggagaca

SEQ ID NO: 176770 - RNA, 55 nt, Homo sapiens
uugguacauuuucaauagaacccuagagaguagcuucacuugauaacuguuuaag

SEQ ID NO: 176771 - RNA, 45 nt, Homo sapiens
gccucccagcagccccuaccccagcccagauaagaggagcucccu

SEQ ID NO: 176772 - RNA, 46 nt, Homo sapiens
guuauuugaaaucuuuuguuguauuuuaaaauauuuuuuggaagag

SEQ ID NO: 176773 - RNA, 45 nt, Homo sapiens
auaaccccuccauccaggauauggaauccagcaccacagugcaca

SEQ ID NO: 176774 - RNA, 45 nt, Homo sapiens
cuugacagccauggggacugagccuguguccucaucuggaaccug

SEQ ID NO: 176775 - RNA, 44 nt, Homo sapiens
cucaucuguaaaguaggaacaagcagauagugcaacuucuaaga

SEQ ID NO: 176776 - RNA, 46 nt, Homo sapiens
gggucccuguagucugcucuccaguuucccgguguccacaucccag

SEQ ID NO: 176777 - RNA, 42 nt, Homo sapiens
caguaggaaaggacauugaugguccuggagccuggggaccaa

SEQ ID NO: 176778 - RNA, 45 nt, Homo sapiens
gccucuuccacuucucacaagcuuccuucuccaggggcucuggcu

SEQ ID NO: 176779 - RNA, 31 nt, Homo sapiens
accacugcgggguacugcccgcugagggucc

SEQ ID NO: 176780 - RNA, 62 nt, Homo sapiens
cagagaaauuuuccuggcuaagagcagauuugauuguggggguuuggccaagauuagcccca

SEQ ID NO: 176781 - RNA, 27 nt, Homo sapiens
ugaggggcgacgagggcagggggacca

SEQ ID NO: 176782 - RNA, 97 nt, Homo sapiens
cuggccucagagaaguugagcuacuggccucaguucacacagagcagauggaggaagagcuggcacuaggacccagggggcaggggggagccucccu

SEQ ID NO: 176783 - RNA, 34 nt, Homo sapiens
gcaucuccucaccccuuucccuguccccgcuggg

SEQ ID NO: 176784 - RNA, 60 nt, Homo sapiens
gauccugaaggcagggcuccaauaccccugccuugcacagagccaggcuacaggugggcu

SEQ ID NO: 176785 - RNA, 46 nt, Homo sapiens
cacaucagucgcucacagccaucuccccugcucuucccaaccccac

SEQ ID NO: 176786 - RNA, 333 nt, Homo sapiens
agcugguuguucccugagagcagggacaggucuccuauccuuuuuucuuuuuuuuuugagaagccucacucugucucucaggcugaaguguaguagcgagaucuuagcucacugcaaucuccaccucccagguucaagugauucuccugccucccagcaguagcugggacugcuggugcacaccaccacacucagcuaauuuuuguauuuguaguagagauaggguuucaccacauuggccaggcuggucuugaacuccugaccucaagugauccacccgcuucagccucucagguccuguccucuuugcguccccagcauccaacacaguua

SEQ ID NO: 176787 - RNA, 45 nt, Homo sapiens
cugcuggcccgggcgggccgcgauggcagcuuccugguccgagac

SEQ ID NO: 176788 - RNA, 42 nt, Homo sapiens
aguugaggccggcgcugcaggcagcggcggcugcgcggugaa

SEQ ID NO: 176789 - RNA, 43 nt, Homo sapiens
guuuggggaacucgaugcagccaagcuguaagggggacgagag

SEQ ID NO: 176790 - RNA, 33 nt, Homo sapiens
agccagggaaucuccccgcaggcuuugccgggg

SEQ ID NO: 176791 - RNA, 42 nt, Homo sapiens
gccugcgggugugggggguggugcuggggaacuuggccgaga

SEQ ID NO: 176792 - RNA, 45 nt, Homo sapiens
ggucugcaggauaucacccaugggagaagcuggagaaccugagag

SEQ ID NO: 176793 - RNA, 32 nt, Homo sapiens
uugauccuguugcuggaugguggcauugagug

SEQ ID NO: 176794 - RNA, 45 nt, Homo sapiens
ugugucacugaggucugggcacugucccgggcuucauuagccacc

SEQ ID NO: 176795 - RNA, 42 nt, Homo sapiens
uccuuucguucccgcuuaugcugcuccaccaggcuucggguc

SEQ ID NO: 176796 - RNA, 44 nt, Homo sapiens
ugacuuccuucucuuggaccugcuggagugcucuggccagguug

SEQ ID NO: 176797 - RNA, 46 nt, Homo sapiens
cccuuuccugcugcccacgcuccuccugcugcugccccuggcucuc

SEQ ID NO: 176798 - RNA, 45 nt, Homo sapiens
ucugcucuggccgccuucuccagggcaaggucagccugggcacgg

SEQ ID NO: 176799 - RNA, 45 nt, Homo sapiens
cacgguuugccgaaguuccuccagcucuuuuaucugggcugccuc

SEQ ID NO: 176800 - RNA, 48 nt, Homo sapiens
cgggccugguccaacuccacuuccagaaacugccggccaagguuggcc

SEQ ID NO: 176801 - RNA, 56 nt, Homo sapiens
cuucacccucggucuuccugcuacagacaucucuaugcugugcucgggguuagagc

SEQ ID NO: 176802 - RNA, 24 nt, Homo sapiens
accaauccucagggaacacccagg

SEQ ID NO: 176803 - RNA, 26 nt, Homo sapiens
auucagcugggccuggaggcgcuggg

SEQ ID NO: 176804 - RNA, 46 nt, Homo sapiens
caggcugcucuccaggggggccugacuccgagcagggaugggagug

SEQ ID NO: 176805 - RNA, 81 nt, Homo sapiens
ggcagcaguggcggcgcuggcuguggugguggcaaugcgcggagaacggcggguuccacugcgaguguugggggaagccuu

SEQ ID NO: 176806 - RNA, 75 nt, Homo sapiens
gcagcucugggugcucuccaugagaauggggccaucugucuucucuccuuggagaggagcuaccaggacagggac

SEQ ID NO: 176807 - RNA, 43 nt, Homo sapiens
uggcuacuguuggccugggagcugagagaaggcacugagaggg

SEQ ID NO: 176808 - RNA, 46 nt, Homo sapiens
ccuucagagccucagccacuagcugcgaugcaugugaucaagcgag

SEQ ID NO: 176809 - RNA, 46 nt, Homo sapiens
gcauuuaugacacucuaaagcaaugugcauugauuucuaagucugc

SEQ ID NO: 176810 - RNA, 46 nt, Homo sapiens
cauuuuguugauuuuauuugggcauuuuuccaaagcagaaguagag

SEQ ID NO: 176811 - RNA, 45 nt, Homo sapiens
uuuagacuaauggcaauuccaauggccuuguaccgaugcugagag

SEQ ID NO: 176812 - RNA, 50 nt, Homo sapiens
gagaucuuuucuuugcucuuuggauuccggaucucuucaugaaacgagug

SEQ ID NO: 176813 - RNA, 46 nt, Homo sapiens
ggucuggaugagguuuggggagaggaauuugagaaacuauaugcaa

SEQ ID NO: 176814 - RNA, 51 nt, Homo sapiens
uauuccuuuuuuucuuuagcaaaacuuagagaaaauuuaagaguuuucaua

SEQ ID NO: 176815 - RNA, 45 nt, Homo sapiens
agacggaaacaggcaccccguauaugcucuacaaagauuccugua

SEQ ID NO: 176816 - RNA, 42 nt, Homo sapiens
ucacaucagaacacacauacgacuuuaagaaguuggcugaag

SEQ ID NO: 176817 - RNA, 53 nt, Homo sapiens
gaugagauacccuuuugagagugcagaagcccaguuacugaauaagcagaucu

SEQ ID NO: 176818 - RNA, 48 nt, Homo sapiens
uuucuuagccugcuucugaucaauaugacuacauggaauuuuguccag

SEQ ID NO: 176819 - RNA, 51 nt, Homo sapiens
uuuccagaaggggccuagcacaaugauuuuauaggcacuuggaaaagagug

SEQ ID NO: 176820 - RNA, 48 nt, Homo sapiens
aacaguuuacuuauugccccgaugccuacagcuuccacugcucagauc

SEQ ID NO: 176821 - RNA, 26 nt, Homo sapiens
aggauacguuuccaauuuuuuuaacc

SEQ ID NO: 176822 - RNA, 47 nt, Homo sapiens
aauccucacuuauugaaagaucuuaccgagcggggccuauggcauga

SEQ ID NO: 176823 - RNA, 57 nt, Homo sapiens
uaauccaauccaguucacucuaaauaaggagaagcuaaaagauaaagaaaagguauc

SEQ ID NO: 176824 - RNA, 43 nt, Homo sapiens
agagaccagcaugucuucaguagccaaacuacuucuugagcau

SEQ ID NO: 176825 - RNA, 26 nt, Homo sapiens
cuggacccuguugcaggcaaaaggag

SEQ ID NO: 176826 - RNA, 54 nt, Homo sapiens
aggaaacagcccagaaggcuggggagaagccaaagaggcugcagaacaugagac

SEQ ID NO: 176827 - RNA, 45 nt, Homo sapiens
aaacccaaugaugagaggcuuccaggccuggaaaaccagugagga

SEQ ID NO: 176828 - RNA, 45 nt, Homo sapiens
gcccaucaggaaaagacuggccaucuugggcauggugauagagga

SEQ ID NO: 176829 - RNA, 46 nt, Homo sapiens
gauggagguccagaucugacggguuucaaggccagggaugccagua

SEQ ID NO: 176830 - RNA, 65 nt, Homo sapiens
auccaugcacugcuuuggcauccaugaacugcuuuggcaagcacagguccccacuggccaugauc

SEQ ID NO: 176831 - RNA, 42 nt, Homo sapiens
gaaauucccauggcauugaacaagaagacccucaacauggua

SEQ ID NO: 176832 - RNA, 45 nt, Homo sapiens
uuuuuucuuuccucaccuaccgcuuuggccaugaugugccccgag

SEQ ID NO: 176833 - RNA, 46 nt, Homo sapiens
ggaaaauccuuaacaugguagggagagaggagagggauagucccag

SEQ ID NO: 176834 - RNA, 42 nt, Homo sapiens
acccgucccagaaaugcaggcaauugucagaaugguugugua

SEQ ID NO: 176835 - RNA, 45 nt, Homo sapiens
ggguggugagggugagacccagguccgucagggccagcauggaga

SEQ ID NO: 176836 - RNA, 45 nt, Homo sapiens
aggcagucgcuugaguaagaaaagggagggaagaaccgccagaac

SEQ ID NO: 176837 - RNA, 44 nt, Homo sapiens
ggguggugagggugagacccagguccgucagggccagcauggag

SEQ ID NO: 176838 - RNA, 31 nt, Homo sapiens
gucccccaaaaugguguguaaagaagguaaa

SEQ ID NO: 176839 - RNA, 46 nt, Homo sapiens
uguuuccuagccauggagucuugcacauucauggucauggccuaug

SEQ ID NO: 176840 - RNA, 46 nt, Homo sapiens
ccuuggccacagcacccucggccuugauccuaagcacaacuuucaa

SEQ ID NO: 176841 - RNA, 42 nt, Homo sapiens
cuggauggugaucaggagggugguguuagcucccauggccag

SEQ ID NO: 176842 - RNA, 78 nt, Homo sapiens
aggaaugcgagcugauggcuguagcaccaaaccagaaaauggccagcaucuuaggcaguguggagagagagaggacca

SEQ ID NO: 176843 - RNA, 46 nt, Homo sapiens
cgccagcccauguuucuuuuucuugccaugcucuccuuugucgacu

SEQ ID NO: 176844 - RNA, 44 nt, Homo sapiens
ggaagccgccugaaggccucuggguaggaggaacaggaucagau

SEQ ID NO: 176845 - RNA, 47 nt, Homo sapiens
cauuuaggaacacauaauuuuauauugcugguauguaugguaugagg

SEQ ID NO: 176846 - RNA, 41 nt, Homo sapiens
acgcaacgguucuucucugaacagcaacagagcaaacagau

SEQ ID NO: 176847 - RNA, 42 nt, Homo sapiens
uaauuccugcuggaacacagcauagcaugauugcaaccacag

SEQ ID NO: 176848 - RNA, 43 nt, Homo sapiens
aauugcuuugccucagacucuucagcccccauuacagcauacc

SEQ ID NO: 176849 - RNA, 46 nt, Homo sapiens
aaguacaacagccuggucagacaaauuuuuauaacacugcccaguc

SEQ ID NO: 176850 - RNA, 46 nt, Homo sapiens
caauccggucuugccuuucagcaaacaucaaauacucagcccauuc

SEQ ID NO: 176851 - RNA, 4039 nt, Homo sapiens
gaauuguucagcuccucacuucaaccauauagguaaaugcuuuaaaaguuauguuuguaaugauguugaaaacauuguaacugcugauccuccuugccguaauccauacuguuccuucccaaaaaaaccuaggaugacucugcuauaaacuacauuggcuaauugagcauguugauuauaugucaugaaccucagccucugguaauuucaaccauaucuuauuaaagaaugucagguuucaaacccucuugaaguagugaacaacagcaaccccaaaacuguuagaaauuauagaaaguagcugcuaaagaaccuaaaaguaugugugccaucuggcuaccaaaaacuauaaaucugaaucuccucuauguacgagcugaggcauggcaguuaacuacaucauguuagggggugcagggcaggguggaauauaacagaacagagagggguaaauaucaaagcauggaaguaaugaugauaaauaugcuguguagugaagaaagcauuuuuuccaaaaauucacucagaugcacuguaaguuaccuuugcaacuagggaaauaaugaaaacugauuuuuauugaacuuuccuuauauaugauagauauucagccuuucacauacauuaacuaaauuuagucuucacacaaccaccuaagauaagucacccucauuuaacauguggauguuaggacuugaagagggugaggcuuuuuuuguuuuguuuuguuuuaaccugagguuauacauaaaguggcagacccucagugucucugguuuccaguuuaaugagggaagaagagugaguaagagucagauaguaggagcagugcaucauggcauagcugucauccauacucaugaugguggccuuaaaucaucauaaagaaaaauaaguuacauucaggacacuuaguuuaggaaggcugugcauuuguuuuuaggaauuuguuuucagaaguggguucagauagaauuucuauacuuuauagauuaaaccugucaucaguuaauacaguauguuuuauauuaccauaaugauacuccuagagaagccagguucagcuaaugaaacuuucuuaacagagagccuagucauuaguaaaccucauaaauguggcuuuuauuuuuaccuuuugauuaaagaugcuuuaguaaaauuuaagacaccuguaucauuacuuauauagcuguuguaggucuucccuccucauuuuacucucauuuaauuucguuauuuucucccguuagaagccccaacuagaagcuaaaggaagucuuguauugaauuugggauuaucuuggaauuuauauuaaaaauaaaacuugaaaauuucugacacaggaauagcagcuagauuuaaucucacaagccagucuccuuuuaaauuguauuggcugcuugaaacacuguugaaaaguuugcaaccgcuuuucaguacugugaaaaagaguacagugauuaauuaguaauguuuuccacaggccgugggagguggaguagcaauguacuauauuuguaauccccauuucacuaauugucuuggaagauauacuuuuuaagaccagacguggucaauagaaauaaaauguaagacacauauauaauuguggcacuuggcuaccacauuggaaaguacagguuuagauuuugaaagcaguuauuuuaucccuaaacauuccuugcuuguuccuuaaccuaaucagcauaguguuuauuagggaaucucugaacugguuucugcaaagacaggauaguuuauagcaguauauucauguuuucuuaccucguguuugaaacauaaauuauaaguagguauuguaaagacugcuaugauccuagacuagcauucuuccuuaguggcuuuuguuccugccacauaggucaguuuuaacaaagcaacaaagcauaauguucuuuaacccacuacuuuugauuuaggugcuuauucuuuaucucugcaucuuaaaaguguagacuggaggcauccaucucagaugauagggaagucugggguuagauucuggcauauugugguuuuguuuugaggggguguguuuuggcuugguuugguuuugguuuauguucuuguuuguuuguuugcuugcuuaaucuucauggguaacucugacaugagcuacuacugugcuuuauuccauggagaucuugaggcuaggccauuuauauuaaaaauauauguggggaaguaaugaaauacaaauaagaaaaguuggggcuauuggggcuaugaauuagaauguugccaaagagaaaaagagauuuuguucugaacuuuguagugaacacaaaaagagaauuauucucacuguucaaaaggaaagagcaauccacuucuuagggagaacaggccuuuucacagaacuuuuacaugugaagcuuccuuguauacagggcuuuaaaucuugaaauaaguugcuuuagacacagucuguauucucugccucuuuucuugauuucugagcuaauuagagugcauccaaguaucagugauggggagacauucugaaguaugcauccuuuuucaaacaucauagaguguaccuacaggaaccuagguggcauagccugcagcuauacaccuaggcuguagaguacagccuauugugucuaauuaggcuauaaacccgugcagcauuuuacuguacuuaauacuguaggcaguuguaacacagugguaaauauuugugucuaaacauagaaaucuaaacaaucuaaacagaaaagguacaauaaaaauauagcauacaagauuaaaaaugguacguaccauguauagagcacuuaccaugaauggagcuugcaggacuggcaguugcuguaggugagucagugagugaguggcgagugauauuacuguacacuacuguggacucuauacuacacuguggguacacuaaauuuguuaaaaaaaaaaaaacaaauuuuucuucaauaauaaauuaaccucaacuuacuauaauuuuuugacucuuauaauaacauuuagcuuacaacacaaacacauuguacaucugcacagaaguauuucuuuuuuuguuuguuuuuuugagacaaggucugugucacccaggcuggagugcaguggcacauacagcucacuaccucgaacuccugagcucaagccauuguccagccucagcuucccaaguagcuaggacuacaggcacuugcuaccaugcccaccuaauuuuuuauuuuuuuguagagaugaugucuuguucucuugcccaggcuggucucaaauuccuggccucaagcagcccuuucaccucagccucccaaagugcugggauuaugagcaugaacaccaugucuggccuuuucuuuuguaacguuuuucuguuuuuuaauuuuuuaauuuuuuuuuaacuuuuuaaacuuuuuuguuaaaaacuaagaugcaaacacacacauuaggcuaggcuacgcagggcuaggaucaucaauauacuuucaucuaccuccacauccugucccacugggaggucuucaggggcaguaacacauacagagcugucauguccuaugauaacaaugccuucuucuggaauacccgcuaaaggaucuaccugaagcuguuuuauaaguuuuaaguaaaaagaguacacucuaaaauaaccagaaaauguauaguaaauacauaaacuaguaacauaauucuuuuuaucaguaucagauauuauguacuguauguaacuguauguacugaacuguuaggacuguagguguaguagguuuguuuauauuuaauacuagcaccagcaaaaacacuugagucauauguucuaugauauuagaacagcuaugaugucacuaggugauaggaauuuuucagcuuccuuaugaucuuaugggaccaucaauauauauguggucuguuguugacuaaaaugucaugcagcacaugacuguauugggucauuugggauuugcauucuuaagauuuucagauuccagaugaaauuaacuucuaacaauauuuucucuuuaauccuuauguagaucucagccagcuuuu

SEQ ID NO: 176852 - RNA, 62 nt, Homo sapiens
gauaguuuuuauuuuugcuauggaguuggagaucugguuaucagagaguggugugugugugu

SEQ ID NO: 176853 - RNA, 46 nt, Homo sapiens
uagggcgugagugcuacauucugaaaggauuuauuuugggacaagg

SEQ ID NO: 176854 - RNA, 41 nt, Homo sapiens
cuggggggaaaggcaggcgugggaagguaaggggagggaaa

SEQ ID NO: 176855 - RNA, 42 nt, Homo sapiens
agcgcccaggccgcucuggaugcggcgcacggacccugccag

SEQ ID NO: 176856 - RNA, 41 nt, Homo sapiens
cagaaaacuagagaaaagaaaccagauaaugcuacccaaga

SEQ ID NO: 176857 - RNA, 42 nt, Homo sapiens
ccgagaugucuuugggugggggaaccucaccugcccaaucug

SEQ ID NO: 176858 - RNA, 45 nt, Homo sapiens
uugagugggcugggcccagccggcccuuuugauaugguguacugg

SEQ ID NO: 176859 - RNA, 46 nt, Homo sapiens
cgcaggacagcuccaguggcuggugggggagcuucaggcugcugag

SEQ ID NO: 176860 - RNA, 46 nt, Homo sapiens
uuucucuaccauaagggccacccacccucggagcccuguggcacgc

SEQ ID NO: 176861 - RNA, 48 nt, Homo sapiens
gauguaggaaagggugaaaaagcccaaaugcugcugugguucaaccag

SEQ ID NO: 176862 - RNA, 55 nt, Homo sapiens
aacccuguacugcugcugcgaccugaugcugccagucuguuaaaauaaagauaag

SEQ ID NO: 176863 - RNA, 44 nt, Homo sapiens
cuggagaaggagcugagaaguguuuuaagcagaaauuugacugc

SEQ ID NO: 176864 - RNA, 45 nt, Homo sapiens
gcgcugugggagcacaaaggaggggcaucuggcauggacuggggu

SEQ ID NO: 176865 - RNA, 50 nt, Homo sapiens
uuugucggggacucuaggaggguggccuggguggagacaagcucagucua

SEQ ID NO: 176866 - RNA, 46 nt, Homo sapiens
ugucuuucuugauagccaaguugggcugggagcagcucacugcucc

SEQ ID NO: 176867 - RNA, 42 nt, Homo sapiens
agauguggccaucaagcucaaguuccuggaagaaaacaaggu

SEQ ID NO: 176868 - RNA, 41 nt, Homo sapiens
ccucuaagucuguucgguaggcaucauauuccagccugggg

SEQ ID NO: 176869 - RNA, 46 nt, Homo sapiens
ugaccaauguguugaugcuagagacaaagaaguucacggcuccuag

SEQ ID NO: 176870 - RNA, 42 nt, Homo sapiens
gaacuucuuugucucuagcaucaacacauuggucaccaagac

SEQ ID NO: 176871 - RNA, 46 nt, Homo sapiens
guccuccccggggaggaggggaaugaagggcucuacagcuucaguc

SEQ ID NO: 176872 - RNA, 35 nt, Homo sapiens
ucuuggguaaguucacaagacuggaacagucugag

SEQ ID NO: 176873 - RNA, 46 nt, Homo sapiens
auuucuugacgaugucaaacuuuucuccagcaaugccccgagccac

SEQ ID NO: 176874 - RNA, 43 nt, Homo sapiens
gcucuggugauggacucauccccacagguaugaauguucagaa

SEQ ID NO: 176875 - RNA, 40 nt, Homo sapiens
gugcuuuggugugccuguuucaaaugugcguuuuggaggg

SEQ ID NO: 176876 - RNA, 51 nt, Homo sapiens
ucuccucagcauaaacacgccugcauggagauaaguucuaagagagcagac

SEQ ID NO: 176877 - RNA, 46 nt, Homo sapiens
gccugguggggagggcccgaggaagacgagguguaugagacggagg

SEQ ID NO: 176878 - RNA, 41 nt, Homo sapiens
agggcuaccaucucacucuucuguaauuucacaacauucua

SEQ ID NO: 176879 - RNA, 46 nt, Homo sapiens
cguucagguagucaaaccacacacuccauuaauaagguuuccugac

SEQ ID NO: 176880 - RNA, 46 nt, Homo sapiens
uucgaacauccucaaagcggcugcugaccucagccacuuucaggag

SEQ ID NO: 176881 - RNA, 46 nt, Homo sapiens
cucaaugaacaguuguacucagggcccagcagugcugcacagcguc

SEQ ID NO: 176882 - RNA, 42 nt, Homo sapiens
cugaguacaacuguucauugagguagcgaaaucgggccccau

SEQ ID NO: 176883 - RNA, 46 nt, Homo sapiens
ccccacagagaagacagaggugucuccuguucccaggacagacagc

SEQ ID NO: 176884 - RNA, 34 nt, Homo sapiens
aguggcggaaccggcaaaagaacaagagaagaug

SEQ ID NO: 176885 - RNA, 45 nt, Homo sapiens
gaaggguaguacuacaaaugauccaccaaagcaaagcccuggguc

SEQ ID NO: 176886 - RNA, 49 nt, Homo sapiens
uuggcagugacucugcugaagaugagaaaagaaagaggaaaugccagaa

SEQ ID NO: 176887 - RNA, 44 nt, Homo sapiens
uccccccagccuauguauaagugacucugaggaggaggaggagg

SEQ ID NO: 176888 - RNA, 50 nt, Homo sapiens
aaugggagcuguuucaggccgcgaagcggacauugguggaucccagcgcu

SEQ ID NO: 176889 - RNA, 43 nt, Homo sapiens
cucucggacauccguucagcagacacuaccucuucgucacccc

SEQ ID NO: 176890 - RNA, 42 nt, Homo sapiens
ggcaacgcagucgccguucgccuguggcuggacaacacggag

SEQ ID NO: 176891 - RNA, 48 nt, Homo sapiens
caguguaaugagugcuaagcauagccuguggggggcagaggguuuuca

SEQ ID NO: 176892 - RNA, 51 nt, Homo sapiens
aaauugucuggaguuccauauggcuggaggauagaugaucucugugggucg

SEQ ID NO: 176893 - RNA, 41 nt, Homo sapiens
uguggggagugaguaagggcaaagaugaggaccaggguucu

SEQ ID NO: 176894 - RNA, 45 nt, Homo sapiens
ggaaauguugaguguguuguugguuaugcagauuugcaauucagg

SEQ ID NO: 176895 - RNA, 46 nt, Homo sapiens
acuggugacacgggagguacccuuugcugaccucuccaauauggag

SEQ ID NO: 176896 - RNA, 44 nt, Homo sapiens
ggccccaagaggggcgggcucagagcuuugucacuugccacaug

SEQ ID NO: 176897 - RNA, 55 nt, Homo sapiens
gcaucauuggcaauaucugagaugaauuucugggcagcuaaggagaugagccgaa

SEQ ID NO: 176898 - RNA, 45 nt, Homo sapiens
ucaaagccagcacgguucagguaguaaccagucacugcaucuggg

SEQ ID NO: 176899 - RNA, 45 nt, Homo sapiens
acuagaaucguguccuauuuaacuuuguguucccagguccuagcu

SEQ ID NO: 176900 - RNA, 54 nt, Homo sapiens
ccaucucguuucuucuugguaaaugaugcuaugcuuuuuccaaccaagccagaa

SEQ ID NO: 176901 - RNA, 49 nt, Homo sapiens
uuguagauuuuugcucuucucaguuuacucauuguccccuggaacaaau

SEQ ID NO: 176902 - RNA, 104 nt, Homo sapiens
cucccaacccuaccaugcuccaucauacucaggucucccuacuccugccuuagauuccucaauaagaugcuguaacuagcauuuuuugaaugccucucccuccg

SEQ ID NO: 176903 - RNA, 99 nt, Homo sapiens
guggcucaugcugcucaguaaugagucagcccugccacaugugcauacugugagcuauggagaugaugaggacucccucagcagcgccuacauccagcg

SEQ ID NO: 176904 - RNA, 42 nt, Homo sapiens
caggcaucaguagcccgugugguuggacaacagggccggggc

SEQ ID NO: 176905 - RNA, 48 nt, Homo sapiens
gggacugcaccguuuucccccaacaucaucccugaggcaacguccuga

SEQ ID NO: 176906 - RNA, 40 nt, Homo sapiens
uucacagcagggggagugugugcuugugaacugcagaggc

SEQ ID NO: 176907 - RNA, 53 nt, Homo sapiens
accccugacccuacaggcugcccccaggcugggugucccugggccgugcggac

SEQ ID NO: 176908 - RNA, 45 nt, Homo sapiens
aggcaugaacaauagggaaucagcuuugcaggaaguucuuuuuua

SEQ ID NO: 176909 - RNA, 43 nt, Homo sapiens
gagcaccucagcugacgaagucaugaauuuagcuguggggaug

SEQ ID NO: 176910 - RNA, 100 nt, Homo sapiens
uuuuacucucugagaagaacuggagcuagagauguaaaauggacagucuugaugggguugagaaccuucuggggagccagaugacccucucuuugcacaa

SEQ ID NO: 176911 - RNA, 50 nt, Homo sapiens
cgguacaaagaucaaacugggggcuacacaagaaugcugcagaucccaaa

SEQ ID NO: 176912 - RNA, 45 nt, Homo sapiens
ggggccaguacuugaaacagcuuugggaucaaauccuucuccuag

SEQ ID NO: 176913 - RNA, 67 nt, Homo sapiens
gcugacuucuggcucacagugagugcgaccuaucugccuucaaaaucccacccuuugcucccugggg

SEQ ID NO: 176914 - RNA, 47 nt, Homo sapiens
agccaugcgcauggcucguucguuagugucucccagcuucccauagu

SEQ ID NO: 176915 - RNA, 46 nt, Homo sapiens
cucugcgcagaaaguccgcaagggccuugggagugacaacagaugu

SEQ ID NO: 176916 - RNA, 44 nt, Homo sapiens
acaauccuauacauguuggcacugaccagcaauggucugcugcu

SEQ ID NO: 176917 - RNA, 42 nt, Homo sapiens
uagucagaauuaaguaugauuaccuggaagagcuggcuugau

SEQ ID NO: 176918 - RNA, 45 nt, Homo sapiens
ccccagugacaggaccaggaugucccucaucuuugccaaccaggu

SEQ ID NO: 176919 - RNA, 33 nt, Homo sapiens
auucuuaaaacgaucacauuuacccgucauugu

SEQ ID NO: 176920 - RNA, 21 nt, Homo sapiens
agcuugcccccaagccugacc

SEQ ID NO: 176921 - RNA, 57 nt, Homo sapiens
uuucuuccuaaacuggauguaucacugagaucugugaauaaauuacaacuacuccau

SEQ ID NO: 176922 - RNA, 57 nt, Homo sapiens
caggauacagauggaguaguuguaauuuauucacagaucucagugauacauccaguu

SEQ ID NO: 176923 - RNA, 61 nt, Homo sapiens
ccuauggaucaugacuacaucccacugucagaugacacacugggcagcuacgaccuguugg

SEQ ID NO: 176924 - RNA, 47 nt, Homo sapiens
agauggauagaaaccaagaccuaaggugcagggaggaggaggaggca

SEQ ID NO: 176925 - RNA, 86 nt, Homo sapiens
aaagacuuggcucauccccuugaaucagcuucagggaccagccccucuagugccuacucugccugcuuuuuucuccuccugccucc

SEQ ID NO: 176926 - RNA, 46 nt, Homo sapiens
uaggcagguucugucagcuuucuagaagccuugcugggcagcugag

SEQ ID NO: 176927 - RNA, 50 nt, Homo sapiens
cucauaauggagaccugcaucuucaccuggaugaacaugugccugucguu

SEQ ID NO: 176928 - RNA, 66 nt, Homo sapiens
cagccaucacuacagucccgcgccguggccucugcggcccacaaacuccgaggagaccugcaucaa

SEQ ID NO: 176929 - RNA, 62 nt, Homo sapiens
ucagcacccauagucuuuaaagacgugagagcucagaggccgauaagguccacgucgcuccg

SEQ ID NO: 176930 - RNA, 48 nt, Homo sapiens
agcugcuaugguaaagauauggccagcugcgauaucaacggugaagau

SEQ ID NO: 176931 - RNA, 52 nt, Homo sapiens
aaauuagucuuaaaaccuuacggaaaucuuuuaacuugaauaaaaguaaaga

SEQ ID NO: 176932 - RNA, 40 nt, Homo sapiens
gaaggaggcgggagaaggacuugcuggaggaaaggcgagc

SEQ ID NO: 176933 - RNA, 44 nt, Homo sapiens
cccuuuaucuauagucugaggaacagagauguaaaggaggcacu

SEQ ID NO: 176934 - RNA, 45 nt, Homo sapiens
ugguuggauggcaagcaugugguguuuggcaaagugaaagaaggc

SEQ ID NO: 176935 - RNA, 46 nt, Homo sapiens
gugggaagcgcagguggagaaagccuucuuccuucccucaguagag

SEQ ID NO: 176936 - RNA, 45 nt, Homo sapiens
uccaagaagccaucaucaucugcaagcagaucuuucuugucauaa

SEQ ID NO: 176937 - RNA, 44 nt, Homo sapiens
cugagcuccaggugcagcucuuugggguuuuccuaguuauuuau

SEQ ID NO: 176938 - RNA, 36 nt, Homo sapiens
ggaugcagauauagauuaagaggucauuggggaugg

SEQ ID NO: 176939 - RNA, 60 nt, Homo sapiens
auccaauuuuauggguucaauuaccuucuauauuccaaugacauaauuccuaaccugaca

SEQ ID NO: 176940 - RNA, 42 nt, Homo sapiens
aaauuccaugucaacagccaccuaagagggaaggcaggaaag

SEQ ID NO: 176941 - RNA, 50 nt, Homo sapiens
agacaguaagucacaguaguaucagcaguaaaugagacaauggaaucaug

SEQ ID NO: 176942 - RNA, 33 nt, Homo sapiens
cucccagcggcuucuucucuucccaggaagcga

SEQ ID NO: 176943 - RNA, 37 nt, Homo sapiens
gaaaaagcuuggugguaaggccuaaggaauuaggggc

SEQ ID NO: 176944 - RNA, 45 nt, Homo sapiens
accaggacaagaguugugucaggaugugacucuagucucggcaaa

SEQ ID NO: 176945 - RNA, 26 nt, Homo sapiens
cugcagauguuccuggcccccggggc

SEQ ID NO: 176946 - RNA, 22 nt, Homo sapiens
agaagggaacagcucgggauug

SEQ ID NO: 176947 - RNA, 32 nt, Homo sapiens
ggucuacauuuuggggugucgcuacucuuguu

SEQ ID NO: 176948 - RNA, 63 nt, Homo sapiens
gcguacaaagaugaaugaaaugguuucucacugugaaccucuuggaggaaaggaggaaccaca

SEQ ID NO: 176949 - RNA, 42 nt, Homo sapiens
uuuguguauacaaauuucuccagucaaaggauuucuuuucaa

SEQ ID NO: 176950 - RNA, 41 nt, Homo sapiens
agaagcagaucaauuccagguguguuucagaguacaauauc

SEQ ID NO: 176951 - RNA, 54 nt, Homo sapiens
aaaugcuuuuucaaaacugacuagaauuaggaaugaugcugggggaaagauggu

SEQ ID NO: 176952 - RNA, 42 nt, Homo sapiens
gcccuaguucacugaaauugccauuucuggccccaggagggc

SEQ ID NO: 176953 - RNA, 39 nt, Homo sapiens
gcccgagcgccgccgcucgcccgggccggcccccggcag

SEQ ID NO: 176954 - RNA, 45 nt, Homo sapiens
cuccggauucuuuguugcuucauuccucaggacagugucgucgua

SEQ ID NO: 176955 - RNA, 42 nt, Homo sapiens
gcuugagguauauucauucaaugucuuugguucacauggaua

SEQ ID NO: 176956 - RNA, 52 nt, Homo sapiens
ccuuuaaaaaauuguuuuaauuuuacagaauuauacccaucuaccaaaagca

SEQ ID NO: 176957 - RNA, 38 nt, Homo sapiens
cugguaaagcauucaguauugcuguccgcuucuagaaa

SEQ ID NO: 176958 - RNA, 34 nt, Homo sapiens
agauggcaaaagcugcagcugaggaaagagcacu

SEQ ID NO: 176959 - RNA, 46 nt, Homo sapiens
cuguugcauuguaauaaaaggugucuuucccuguagugaccuguaa

SEQ ID NO: 176960 - RNA, 46 nt, Homo sapiens
uggcacuuggagcagcagcaggccauucagacaaccgaggcggaga

SEQ ID NO: 176961 - RNA, 81 nt, Homo sapiens
ggaguuggagaaucagcguguccugaaggaacaggcccugcaggaggccauggagcagcuggagcagcuugaguuagaacg

SEQ ID NO: 176962 - RNA, 45 nt, Homo sapiens
ucaggaaguuaaaaagaagcuggagauggcaacuaauaagaccaa

SEQ ID NO: 176963 - RNA, 45 nt, Homo sapiens
ucaccugaucacuaacuggggaccugcagcuuucacugaggcaga

SEQ ID NO: 176964 - RNA, 91 nt, Homo sapiens
uuucgaaacuccgacgcgacauccaaccgagcggugucagcgccuaggaaggcgagcgaacccagguacaucagggcgacggaaaccagcu

SEQ ID NO: 176965 - RNA, 56 nt, Homo sapiens
agggggaagaaaggcaacuugagaccccaucaagcagagcuuuggccccaacaccg

SEQ ID NO: 176966 - RNA, 29 nt, Homo sapiens
uccuuguccuuaucugugaacugguagau

SEQ ID NO: 176967 - RNA, 47 nt, Homo sapiens
gaaagaugggcuccuuucaggcaagauuguagaggcuggagcuggag

SEQ ID NO: 176968 - RNA, 40 nt, Homo sapiens
uuuuuaauuguuaucuuacauuauucucacaaugagcuag

SEQ ID NO: 176969 - RNA, 45 nt, Homo sapiens
cuaacugcugaagacaaaguaggaagagaggaaaaugggugccac

SEQ ID NO: 176970 - RNA, 50 nt, Homo sapiens
gugguugugcacuaggaggaaucauaguuaucuggggcugaagcuuuggc

SEQ ID NO: 176971 - RNA, 47 nt, Homo sapiens; identical to SEQ ID NO: 102465

SEQ ID NO: 176972 - RNA, 43 nt, Homo sapiens
uaaacuugccucccaucucuccaaacugcgauugugugggagg

SEQ ID NO: 176973 - RNA, 44 nt, Homo sapiens
cuccaagugggucccuauccauuuucauccuggguggcaugaac

SEQ ID NO: 176974 - RNA, 46 nt, Homo sapiens
gcugccaccgcagcugccuccucaggauccggucgucggggauagg

SEQ ID NO: 176975 - RNA, 62 nt, Homo sapiens
uucggcagccuuagggaacccagaaaguaguggggaggaggcgagacgugcgcccggaugcc

SEQ ID NO: 176976 - RNA, 54 nt, Homo sapiens
aaaaggaaacugggguuuaaaaaagauaaggggaguuucuccaaguagggaaac

SEQ ID NO: 176977 - RNA, 43 nt, Homo sapiens
aauggacuuggacuuaagagcaggaaucuagucuccaaggagg

SEQ ID NO: 176978 - RNA, 43 nt, Homo sapiens
ucagcucagggauaucgccuaggccaucuccauagagauccga

SEQ ID NO: 176979 - RNA, 18 nt, Homo sapiens
uauuuuuacaaauggguu

SEQ ID NO: 176980 - RNA, 46 nt, Homo sapiens
gucccgagauggaacguccagcucuccucuaacgaaaagcguuugc

SEQ ID NO: 176981 - RNA, 44 nt, Homo sapiens
cggccgcuccucuccgcccugccgggggaggguggaggguggcg

SEQ ID NO: 176982 - RNA, 38 nt, Homo sapiens
ccuccacccucccccggcagggcggagaggagcggccg

SEQ ID NO: 176983 - RNA, 37 nt, Homo sapiens
cgagaagccuugacuacuuggcuucucuugaauagua

SEQ ID NO: 176984 - RNA, 51 nt, Homo sapiens
agaugaguuaaucagaauucuugccuugggaacuuucugagcuacuaagaa

SEQ ID NO: 176985 - RNA, 58 nt, Homo sapiens
uuuuuugaccauuagaaaaauaucauauagguggaacucugcuuuaagaaaacccaac

SEQ ID NO: 176986 - RNA, 42 nt, Homo sapiens
ugauaugauaauagauaccgagcuuugcagaaacaucuguug

SEQ ID NO: 176987 - RNA, 41 nt, Homo sapiens
gguuccuuucaugauuccuggaagcaugaucugugguucuu

SEQ ID NO: 176988 - RNA, 42 nt, Homo sapiens
uuguaacucucuaaguacauauauaugugaaaauaaauggca

SEQ ID NO: 176989 - RNA, 40 nt, Homo sapiens
ucuucugugaggagaauuuguccuuccccccacccccauu

SEQ ID NO: 176990 - RNA, 50 nt, Homo sapiens
aagaugaauaaggaaucuggccuaguucuagauccuagucuagacuaaug

SEQ ID NO: 176991 - RNA, 715 nt, Homo sapiens
agggaggcaguaguuaugaggcaggagaauagagucuggacucaggagcuuaaggccauuucacgcuuacuucuuagaacuaaauugaaaggaaaacccucacuuuccaugccuaaguaacaaaagagccggaggcuacucccuuugcagaccccuaccuuuucugcguggcagauggaaaauugaaaguaccucugguugguugcagaaagcaaccaaucagacguuugcaaaggaguguaacuuuguaacuucgcuucagccucugguugguuguuggcaaacagacugauuacgggccaaaucuucauuugcauagaagugcagcuuuguaacuucacuucagccucugauugguugcuuuccacaaccaaucagauguuugcauaggagagugaccuuuguagcuucacuucagccucugauuuggcaccacuucauuuacaugaggugaauaccaagugaccaaugggaaaccuuuggcagguauuuggacccaagaagauucuguauccaggcccuuuagccgcugcuggugcaguucccauuaguggaguguacuuucguuuucaguacaucucugcucuuguuguuucauucuuuuccuugcuucuuuuguacauuuuguccaauucuuuguucaaaacgccaagaaccuggacaugcuccaccgguaacgguuaaauacuaauauuauagccccuccauuuucucg

SEQ ID NO: 176992 - RNA, 35 nt, Homo sapiens
agcuacuauaaauauuuguauacaagcuuuugggu

SEQ ID NO: 176993 - RNA, 42 nt, Homo sapiens
uauagguuacuuuuauuuccuuuuauauguuuuuguauuaau

SEQ ID NO: 176994 - RNA, 44 nt, Homo sapiens
cuuggacccugcauucacauauuuagggaaagaaccaggaacug

SEQ ID NO: 176995 - RNA, 44 nt, Homo sapiens
cagcagccaggcagaugauggugccauucauugagauggccauu

SEQ ID NO: 176996 - RNA, 67 nt, Homo sapiens
accuagagucuuauguauuauacaagauacuacuaauucaaagacagugaaugaacggaucacuuua

SEQ ID NO: 176997 - RNA, 50 nt, Homo sapiens
aaagauagagaaccccggaggaaucuguuauuaaaccaggcauggauaua

SEQ ID NO: 176998 - RNA, 46 nt, Homo sapiens
ccauuggucauccgaccuuauggguccagccaagcauuugcuagug

SEQ ID NO: 176999 - RNA, 58 nt, Homo sapiens
guggagcagaaaaugaagguaguugucacagugaucagaugagcaacgauuucuccaa

SEQ ID NO: 177000 - RNA, 46 nt, Homo sapiens
ucuagaaguggaugaauacccagaacauauuaaaaacuuggugcag

SEQ ID NO: 177001 - RNA, 50 nt, Homo sapiens
uuggaagaacaagaaaagagacaacgagaaauugagcgcaauacaugcaa

SEQ ID NO: 177002 - RNA, 50 nt, Homo sapiens
uccuacaaaacaaguaaugauggaaaauaaauuggagguucauaaggaua

SEQ ID NO: 177003 - RNA, 93 nt, Homo sapiens
uucuacuagguggcgucaagucaacauauauguuugaucugcuguuggagacgagaaagccugaucagguuuuccaaucuuauaaaccuggag

SEQ ID NO: 177004 - RNA, 42 nt, Homo sapiens
aaggcagaaucuguagcugcuccuauaacuguucgugcuuac

SEQ ID NO: 177005 - RNA, 53 nt, Homo sapiens
guuuagcagaguuguagugaacauuaaugaaaaauaaauaaaugcucugagga

SEQ ID NO: 177006 - RNA, 45 nt, Homo sapiens
gaacgcugcuacaaugauuugcgucuucucagugucuccaguaaa

SEQ ID NO: 177007 - RNA, 46 nt, Homo sapiens
agcauaccagaaagcuggaggcgauucugguaauguggaugaugac

SEQ ID NO: 177008 - RNA, 43 nt, Homo sapiens
agcacugaaaaacucaaaagcuugucacugcagcaacagcagg

SEQ ID NO: 177009 - RNA, 48 nt, Homo sapiens
ucugaagaacgaucagacucagaugugaauaaugacaggaguacaagu

SEQ ID NO: 177010 - RNA, 66 nt, Homo sapiens
ccuuuggcuaauggacuugacucucacaguaucacaaguaguagaagaacgaaagcaaaugaaggg

SEQ ID NO: 177011 - RNA, 36 nt, Homo sapiens
agaaaugcaguacauguauuucaaagcugaaccuua

SEQ ID NO: 177012 - RNA, 28 nt, Homo sapiens
uaguucuaagaucauuuguaacuuucug

SEQ ID NO: 177013 - RNA, 27 nt, Homo sapiens
augaaauaauacaaguauuuaaauuug

SEQ ID NO: 177014 - RNA, 53 nt, Homo sapiens
uuaggguugauggugcauguugauaaaagaauuacucuggcagcuuucaaaca

SEQ ID NO: 177015 - RNA, 47 nt, Homo sapiens
agcguccggcugaaugagacacuuucaucauuuucugaugacaauaa

SEQ ID NO: 177016 - RNA, 49 nt, Homo sapiens
agauuugagaacagcuuuuacuacuuccaagugaggugaaguagauaaa

SEQ ID NO: 177017 - RNA, 48 nt, Homo sapiens
agauuacaauuagacuggggagagcacuuaaaaaaggagaauacagag

SEQ ID NO: 177018 - RNA, 65 nt, Homo sapiens
uuuuucugggccuugcaguuuagcaggccauacugccucuguugcaguuacucacuucugcuauu

SEQ ID NO: 177019 - RNA, 93 nt, Homo sapiens
cuagaugcuguguuugcuaaaggaaugacuguacggcaaucaaaagaggaauuaauuccucagcucagggagcaaugugguuuagagcucagu

SEQ ID NO: 177020 - RNA, 55 nt, Homo sapiens; identical to SEQ ID NO: 102536

SEQ ID NO: 177021 - RNA, 67 nt, Homo sapiens
gaguaauugguaaugcaguguucaacaggagucaggagggaguggaauuaggaguacugguuugaag

SEQ ID NO: 177022 - RNA, 32 nt, Homo sapiens
ugaaguccaugucacagcuugcaguuuuguca

SEQ ID NO: 177023 - RNA, 50 nt, Homo sapiens
cccuuccaggagguuguauuggaaagcaguaguguggacgaauugcgaga

SEQ ID NO: 177024 - RNA, 46 nt, Homo sapiens
uagaggaacauuucccugugauauuucuguccuugauauucaucag

SEQ ID NO: 177025 - RNA, 88 nt, Homo sapiens
auguagggauaaaacagaagaauuaauggaauugacagaugagcaaagaaaugaacugaugaaaaaagaaagcagucgacuccagaag

SEQ ID NO: 177026 - RNA, 42 nt, Homo sapiens
aaagagaaagcacuaaaaauauaucuggauggagcaccaaau

SEQ ID NO: 177027 - RNA, 87 nt, Homo sapiens
aaucauguugugcacuauagucaaauguacuguaaagugaaaagggaugugcaaaaaaauaaaaaaaaacaacaaaaaaagcuaacc

SEQ ID NO: 177028 - RNA, 53 nt, Homo sapiens
uauaaaagcuuucuaaagcauacuaaagaagccuucccagagccccgucuugc

SEQ ID NO: 177029 - RNA, 31 nt, Homo sapiens
ucauuuuacccugugaaagcaucucuccuag

SEQ ID NO: 177030 - RNA, 44 nt, Homo sapiens
uucccguaagcagugccuuaguaauaccuuagucaugccgccag

SEQ ID NO: 177031 - RNA, 55 nt, Homo sapiens
uacacaaugauaccauuuugaaaguuggaagccucaaacugagacgacagugcag

SEQ ID NO: 177032 - RNA, 45 nt, Homo sapiens
uuuauugcauugcaaaggguaguuucacugaagucaugcaccauu

SEQ ID NO: 177033 - RNA, 33 nt, Homo sapiens
uacaucucccuauuaccuccuugaaagauuuac

SEQ ID NO: 177034 - RNA, 40 nt, Homo sapiens
ggaaaaaaaaaguaaaaacaaaaacaguaugugccugaaa

SEQ ID NO: 177035 - RNA, 46 nt, Homo sapiens
ugaauuuaucuuuaguaugauaguuauaugaaaauuauaggauuug

SEQ ID NO: 177036 - RNA, 46 nt, Homo sapiens
uucuagcuuuugcgguacauaugugugauaacuuuaauacccauga

SEQ ID NO: 177037 - RNA, 42 nt, Homo sapiens
cggguucagcaggaggaguugcuggagcgccuuucagccgag

SEQ ID NO: 177038 - RNA, 39 nt, Homo sapiens
acuugaaaccaggcuguugcgagcccagagcuccggcug

SEQ ID NO: 177039 - RNA, 43 nt, Homo sapiens
ucucauaguacuccuugggugaacaaugugauuaacgauggca

SEQ ID NO: 177040 - RNA, 54 nt, Homo sapiens
ccagcgggagcggccgggcugcgggcuccuccucgccuggcucgggaagugguu

SEQ ID NO: 177041 - RNA, 111 nt, Homo sapiens
ggcggggugguuagccgagcagcgggcuccgcgugcucgcgggaggguagcggcaaagggaggccuagugauugcaggauuccgggucuggggaggaagaaagugguggga

SEQ ID NO: 177042 - RNA, 45 nt, Homo sapiens
auuagaaguaaggauugauagggccuggguggagaucagcuggga

SEQ ID NO: 177043 - RNA, 42 nt, Homo sapiens
gaggcaccuacugaaaccggaagguggcugagaagguuuuau

SEQ ID NO: 177044 - RNA, 96 nt, Homo sapiens
uuuauguuaaaaaaaaaaguguugguuuaaagacaacaucagaagauacucucagaaaaucugcccuccaggggaguuucucagcugucauguugg

SEQ ID NO: 177045 - RNA, 66 nt, Homo sapiens
guuuagagaaaccugggauagaguuuuaaagagguggugguuagcaacaaaguauauagcugagag

SEQ ID NO: 177046 - RNA, 24 nt, Homo sapiens
gguaagucuauugugcuuauuuau

SEQ ID NO: 177047 - RNA, 60 nt, Homo sapiens
uuuacuugcagaaggcacagaagagccaauuuuaauagaaaaaacacguaaaugggcugg

SEQ ID NO: 177048 - RNA, 40 nt, Homo sapiens
auccuuuaguacaaauuguaccaaagaaacucaaguccag

SEQ ID NO: 177049 - RNA, 46 nt, Homo sapiens
agcuaccgguuuucuagggaaggugcuucuggaaaaguugcugagg

SEQ ID NO: 177050 - RNA, 87 nt, Homo sapiens
caagagcgaguggaagaaguccuuaguggcaagguaaguauggaaaaugagcacucagaacaaagaaaaaagcgugugcuuguguau

SEQ ID NO: 177051 - RNA, 46 nt, Homo sapiens
cgaacucacccaaccuaaacuggcucucagugaagaagauaaagag

SEQ ID NO: 177052 - RNA, 36 nt, Homo sapiens
caacagggaagaggcaaaaaguggaguagaagaaaa

SEQ ID NO: 177053 - RNA, 35 nt, Homo sapiens
ugaugcuuagaaaagaucaagaaacuauugaguuu

SEQ ID NO: 177054 - RNA, 24 nt, Homo sapiens
aacauuauuuuucauuauuauaaa

SEQ ID NO: 177055 - RNA, 46 nt, Homo sapiens
caagcauauugaugaaguagucuauccaccaccuguggaucccaag

SEQ ID NO: 177056 - RNA, 47 nt, Homo sapiens
ggcuuauauaucuuaagguguuguuuuuaauuucaacaaaggcaggg

SEQ ID NO: 177057 - RNA, 69 nt, Homo sapiens
cccugaaguuuuaauguuagaauaccuaugaggcauuaaggccacugaguuaccaauuuguucuuaauu

SEQ ID NO: 177058 - RNA, 78 nt, Homo sapiens
gucgucuuagaaguauuaucuaccaauacuaccuugugguccuuaauaauguuucacaaauuuaaaaauauacugcug

SEQ ID NO: 177059 - RNA, 47 nt, Homo sapiens
uuacaagaggugguauaucaagugguacccagaguaauaaaugaagg

SEQ ID NO: 177060 - RNA, 49 nt, Homo sapiens; identical to SEQ ID NO: 102588

SEQ ID NO: 177061 - RNA, 56 nt, Homo sapiens
ucauaaaugaugguaagcauaggauaauggcuuuagacaguuuuauucaaaaagag

SEQ ID NO: 177062 - RNA, 67 nt, Homo sapiens
cagcauguguuuuucccccagaugcuuuuuaucuacagaacuaucccuguccagaaauugccuuaga

SEQ ID NO: 177063 - RNA, 70 nt, Homo sapiens
uauguuauuaauucacaggaaaucuuagcaaaugcagcugugaauuaaaauguaguuuaaggaauagaaa

SEQ ID NO: 177064 - RNA, 47 nt, Homo sapiens
ucgucuucacaaagcuaugguguuucuugaauauuucacaaguaauu

SEQ ID NO: 177065 - RNA, 51 nt, Homo sapiens
gcaucugauucugccaucuauuacuugagcuaggucucacccauggcaccu

SEQ ID NO: 177066 - RNA, 234 nt, Homo sapiens
acuagccauauuaaaagugcccaagaggcacagguggguacagaaacagaagccuguacugccugcagaaccaugagccaguuaaaccuuuuuaucuuuacaaauuacccauucucagguaguucuuuguaggguugcgagaauggacuaaugcaccuaaucacuaccuccucugucuucccagagggaacaacucuugaauucuagcacucaauauuaguuuuaccuauuuuu

SEQ ID NO: 177067 - RNA, 26 nt, Homo sapiens
uacuguuauccaaacuccuuagccag

SEQ ID NO: 177068 - RNA, 133 nt, Homo sapiens
uuucugacugguugugagaaaaauuagucaagaaaauaaucaguaauuuuuuuguuaacguagaccuucaauauugauguacggcaguuacauugggcagaauauauagagaacuacugcuugggaacuaaga

SEQ ID NO: 177069 - RNA, 28 nt, Homo sapiens
ucacauuauuaucccucucaugccucau

SEQ ID NO: 177070 - RNA, 45 nt, Homo sapiens
acguuaugguuuuaauacuauccuugugauccucaucuggcgcau

SEQ ID NO: 177071 - RNA, 26 nt, Homo sapiens
ucuguguuacaaguuuuugucauacu

SEQ ID NO: 177072 - RNA, 43 nt, Homo sapiens
caaaaccaugacuuaauauuuugagcccuagaagaaaggggug

SEQ ID NO: 177073 - RNA, 44 nt, Homo sapiens
gcuuuuaaaaucagaaggcuauauuauucuaaugacccuauucg

SEQ ID NO: 177074 - RNA, 56 nt, Homo sapiens
guguucuccucccuuuauaaauuuuauucauaggacuuuuaaaaggcuugugcuau

SEQ ID NO: 177075 - RNA, 45 nt, Homo sapiens
uucuaauuaaguuuaucaaguuguacuguauuagauaaucagcag

SEQ ID NO: 177076 - RNA, 46 nt, Homo sapiens
gcaaaagaguuggggacaacuugggcaggccuaugaagugcauagg

SEQ ID NO: 177077 - RNA, 47 nt, Homo sapiens
aauuaguuugucauucuagaauuuaaaguucuaagauuaguauaaag

SEQ ID NO: 177078 - RNA, 55 nt, Homo sapiens
uagccagguccuagccaauggucuggacaacaagcuccgugaagaccuggagcga

SEQ ID NO: 177079 - RNA, 48 nt, Homo sapiens
guggaacgugugaucaccguuaugcagaauccacgccaguacaagauc

SEQ ID NO: 177080 - RNA, 66 nt, Homo sapiens
auacugaugacaauaaucuauacuuugaaccaaaaguugcagagugguggaaugcuauguuuuagg

SEQ ID NO: 177081 - RNA, 46 nt, Homo sapiens
uuguauucgauagaccacugccugugucucgucuuguaucucuaau

SEQ ID NO: 177082 - RNA, 73 nt, Homo sapiens
aauugaauaugcaauggaagcuguuaaacaagguucagccacaguuggucugaaaucaaaaacucaugcaguu

SEQ ID NO: 177083 - RNA, 51 nt, Homo sapiens
ccuugauucucaguuuugcuggaggccgcaaccaggcccgcgccgccacca

SEQ ID NO: 177084 - RNA, 45 nt, Homo sapiens
aaacaaauacuucugucaaggcacagcauuaccauguguccccag

SEQ ID NO: 177085 - RNA, 42 nt, Homo sapiens
cuucaccacacccccugaucugcucagcaagccugccagccg

SEQ ID NO: 177086 - RNA, 45 nt, Homo sapiens
ucagaaucauugcccagaagagagccugugacacugccaccugug

SEQ ID NO: 177087 - RNA, 54 nt, Homo sapiens
cauucacaaaggacuauaaaaucuacaccccagucacgggcaccaaauacccuu

SEQ ID NO: 177088 - RNA, 50 nt, Homo sapiens
gagagcaggacucacagguuggaagagaaucaccugggaaaauaccagaa

SEQ ID NO: 177089 - RNA, 51 nt, Homo sapiens
caauaccagcccaaagagccaccagagaggaaccaaaccacaugcaucaag

SEQ ID NO: 177090 - RNA, 43 nt, Homo sapiens
gagccugagcagagaccagccccuggccuggccccagcacugc

SEQ ID NO: 177091 - RNA, 236 nt, Homo sapiens
gcacuggaugaguuaagacuaguaagggugaagucagggauacacauaguacaucucaggaaguuuuagaaauuuggauccaccuuguuaaucugcauacgacauucuuucacaccugcaaggagcuuucauuucacauuugcaaggugaaggugaggcccuugcaggggauggggauggguagagcagugucugagguagguuugagccuuuaaauguguggcaucuguggagau

SEQ ID NO: 177092 - RNA, 42 nt, Homo sapiens
cagaacuaugugcagaugaaggccagugagcuggagcaggag

SEQ ID NO: 177093 - RNA, 53 nt, Homo sapiens
ugaggaaaggguacccaccucaccauuguugaagagagagacaaaagacuggc

SEQ ID NO: 177094 - RNA, 46 nt, Homo sapiens
cuagcaguuguugucuauuuuuaacuaacuccauaugcugccagua

SEQ ID NO: 177095 - RNA, 53 nt, Homo sapiens
auugccagagcccccugcucugcugcucugccuguccgccuaucugccauucc

SEQ ID NO: 177096 - RNA, 44 nt, Homo sapiens
accccagccugccaaauggggcaucuggugcugcaggagcugau

SEQ ID NO: 177097 - RNA, 32 nt, Homo sapiens
agaguccuugaaaucuuggcuguccucugucc

SEQ ID NO: 177098 - RNA, 61 nt, Homo sapiens
aggccuggauccugccccacugcaccugugggcuugggcccagcauggccuguuccagagc

SEQ ID NO: 177099 - RNA, 57 nt, Homo sapiens
aauuuaauaagagccuccagcuagagccgugaacuuaaggucuguggccuucccaaa

SEQ ID NO: 177100 - RNA, 52 nt, Homo sapiens
ugccuguacaguuguugaguuuuggggucugcuggggcucuaggaguuaaca

SEQ ID NO: 177101 - RNA, 46 nt, Homo sapiens
ugaggccaacuugggcagucugacuaggggaaaauggggggcaggu

SEQ ID NO: 177102 - RNA, 42 nt, Homo sapiens
gaauucaggaccugggaauacaggguucagagaggagaggag

SEQ ID NO: 177103 - RNA, 45 nt, Homo sapiens
caaauaacaauaaagagaccaccuguuuuauaccaacagcuagac

SEQ ID NO: 177104 - RNA, 46 nt, Homo sapiens
cuucacucucaacuucugagagcaagccgcccccacagcccagucc

SEQ ID NO: 177105 - RNA, 51 nt, Homo sapiens
aagggcccugcugucccucuauucaugcagagaugguucccagagagcccu

SEQ ID NO: 177106 - RNA, 45 nt, Homo sapiens
aacaggagauggaaaaugcuuggaacgaauaccugaaguuggaga

SEQ ID NO: 177107 - RNA, 25 nt, Homo sapiens
ugcuggagguguugcacagacagau

SEQ ID NO: 177108 - RNA, 45 nt, Homo sapiens
gagggaugggaaauguaaaaucccauuggcccgcaaguuugggug

SEQ ID NO: 177109 - RNA, 77 nt, Homo sapiens
gacagaguugagcaugaguuucuugggagggaacagcaguuauuggucaucuuccaagagccaggguauccucagau

SEQ ID NO: 177110 - RNA, 44 nt, Homo sapiens
cuucaucacuugcuuaaccaguugcucuccugaccgccccaggc

SEQ ID NO: 177111 - RNA, 43 nt, Homo sapiens
ccuguuacguuuuguuguaucugccuuuuuguuuggaacagau

SEQ ID NO: 177112 - RNA, 43 nt, Homo sapiens
ccuucuucuguucugucuuacuccuauggcaaguguguaggga

SEQ ID NO: 177113 - RNA, 50 nt, Homo sapiens
cccuaaacugucgcuucucuggcuguaaguagugacugccaggcuggugu

SEQ ID NO: 177114 - RNA, 41 nt, Homo sapiens
cggugcuaacuuccuugugcugugucuacacaucugcagcu

SEQ ID NO: 177115 - RNA, 46 nt, Homo sapiens
caagugacuacaaguaugcgcaggaccgagccagccaccugaagau

SEQ ID NO: 177116 - RNA, 34 nt, Homo sapiens
uccuggcagaggaaguugacagagaaaaaugguu

SEQ ID NO: 177117 - RNA, 29 nt, Homo sapiens
gaagagaucuuaaaauuaucuacuguaau

SEQ ID NO: 177118 - RNA, 24 nt, Homo sapiens
cccagguggagcacugggcaaggg

SEQ ID NO: 177119 - RNA, 360 nt, Homo sapiens
uucaguauaaguagcagaaaccaaacucuaacaacugaaaaagggaauuuaggcccccggcaggguggcucacgcuuguaaucauaaaacuuuggggggcugaggcagguggaucacuugaacccaggaguuugagaccagccugggcaacauagcaagacccagucucuacagauuuuuuuuuuuuuuaauuagcagagcuaauuaaaacaugcaugcaccuguagucccagcuacucaggaggcugaggugggaggaucacuugagcccagcagaucaaggcugcagugagccgugaucauugccaccgcacuccagccugggugagagagcaagacgcugugaaaaaaaaaagaagg

SEQ ID NO: 177120 - RNA, 67 nt, Homo sapiens
ccaacuuaggcaacuugaggacuguugguucaguuuacacuaaucuaguuauggaggcuuaaaggga

SEQ ID NO: 177121 - RNA, 71 nt, Homo sapiens
ggcaggaggcagccucagccuagcauucugguuuguuucguuuauucugcagccucgcucuucucuguggg

SEQ ID NO: 177122 - RNA, 42 nt, Homo sapiens
agccuaugauguuuucuagguguggaaacaaguuggguggug

SEQ ID NO: 177123 - RNA, 366 nt, Homo sapiens
gagagaagagauaggcuuuuaagaauggguagagcuggcugggcacuguggcucacaccuguaaucccaacacuuugggaggccgaggcagguggaucaccugaggucaggcauucgagaccagccuagcuaacauggugaaacccugacuccacuaaaaauacaaaaauuagccaggcaugguggcgcaugccuguaaucccagcuacucaggaggcuaaggcaggagaaucgcuugaaucugggaggcagagguugcagugagccgagaucaugcucuugacuccagcuugggcaacaagagcgaaacuccgucucaaaaaaaaaauaaauaaauaaaaagaauggguagagcuuugccugugu

SEQ ID NO: 177124 - RNA, 29 nt, Homo sapiens
uaaaaauaucagagcagcaauguaaguuu

SEQ ID NO: 177125 - RNA, 47 nt, Homo sapiens
ccugccugggguucucuguucauggcuggguugugaguucccagagc

SEQ ID NO: 177126 - RNA, 60 nt, Homo sapiens
cucaaauuccaaaucagccaaacucagcucauuaucuccucaccaccuuggccugccauu

SEQ ID NO: 177127 - RNA, 83 nt, Homo sapiens
guuugggcugguuucuagcuccugggguagaguggggugaggaacugcagccuguguucaagaaaggacuugagggggaagga

SEQ ID NO: 177128 - RNA, 57 nt, Homo sapiens
aaauaucauuauguaaugagagaaguagcugcuuguuaagcuaggaggagcagauag

SEQ ID NO: 177129 - RNA, 48 nt, Homo sapiens
ugugcugggcaaaaaugcugcagugguggcuuugcugugugaggaagg

SEQ ID NO: 177130 - RNA, 64 nt, Homo sapiens
uuuaguucauucaaacaccuggguguuggcugggccuuugguauugcuguuuugaagggcauca

SEQ ID NO: 177131 - RNA, 46 nt, Homo sapiens
cuuugccuguuguauuugguugccaugguagcagaaaaaugaggaa

SEQ ID NO: 177132 - RNA, 31 nt, Homo sapiens
cagauuucuguagggcuagcuaguucauuua

SEQ ID NO: 177133 - RNA, 102 nt, Homo sapiens
aagggguucaagugccuacuccaugaauauucuucuuugcuguaggagauaaguaaggaguaaggaaugacuccucccaacccuuggaucuuacuugaaggg

SEQ ID NO: 177134 - RNA, 47 nt, Homo sapiens
auuuuuuucauucaaauauuuguggaauaccuacuaugugccaggca

SEQ ID NO: 177135 - RNA, 35 nt, Homo sapiens
auuugugaauuuuuuucuaaaaagauauauauaua

SEQ ID NO: 177136 - RNA, 47 nt, Homo sapiens
gaucugaauuuaugagaucuauaaaaauucgaguuguugaaagagug

SEQ ID NO: 177137 - RNA, 50 nt, Homo sapiens
cuccagauaaggaaacuaaaucucagagagguuaaguaacuaacucaaag

SEQ ID NO: 177138 - RNA, 53 nt, Homo sapiens
uaaaguuaccauaugagucaugaauuccauuccuagguauauacccaagagaa

SEQ ID NO: 177139 - RNA, 54 nt, Homo sapiens
gggggaaaaaaaaauguggcuggagcagggacuaauugcauuucagccccaauu

SEQ ID NO: 177140 - RNA, 45 nt, Homo sapiens
gagagaagaaugacuuucagggccccuugugggacauuuugucua

SEQ ID NO: 177141 - RNA, 24 nt, Homo sapiens
ccuagaguggagcuguggagguga

SEQ ID NO: 177142 - RNA, 75 nt, Homo sapiens
caguaucaacgggcucauuguacugauguguauauauugagaaagcucagagaaguugauuaacaagcucaaggu

SEQ ID NO: 177143 - RNA, 81 nt, Homo sapiens
ugggaaauuuagaauauuauacuacaaagaagauggaggaaauuaaggaccaagcaccaaagacaaccacuguccauauuu

SEQ ID NO: 177144 - RNA, 52 nt, Homo sapiens
ugaacaacauuuaugcaggugugacaccaauaaagcaauacaggucugguuu

SEQ ID NO: 177145 - RNA, 47 nt, Homo sapiens
aguucucaauguguuagaaaaaaaauguaaaaggaacaacaacaaca

SEQ ID NO: 177146 - RNA, 46 nt, Homo sapiens
uaaguagggacaaggccacucccccauccucaggacaauugugaga

SEQ ID NO: 177147 - RNA, 23 nt, Homo sapiens
ugagggguuaauugaagcagugu

SEQ ID NO: 177148 - RNA, 48 nt, Homo sapiens
gagccgacagggcgcagggugcacgggcuccuuuugggggugcuuugu

SEQ ID NO: 177149 - RNA, 49 nt, Homo sapiens
accuggcuuaugaguacaagaugagacugugcaggugucaaagguauac

SEQ ID NO: 177150 - RNA, 44 nt, Homo sapiens
acuaaaaucccugugauucccaaacccuaaaaauauucugugac

SEQ ID NO: 177151 - RNA, 40 nt, Homo sapiens
gagaugugaauggcucaggcugagggaaugggcaggugga

SEQ ID NO: 177152 - RNA, 61 nt, Homo sapiens
ggaggaaacacuuuaucuauagcauaaaggccugggaguuaggcaaggguaucugaaugag

SEQ ID NO: 177153 - RNA, 36 nt, Homo sapiens
agagaaagauguagcuggggaaacaugaacgaggaa

SEQ ID NO: 177154 - RNA, 47 nt, Homo sapiens
ccccaugcugcauggaggaggcugaagggcaaggugaaacugccugg

SEQ ID NO: 177155 - RNA, 42 nt, Homo sapiens
aauauguagagcauaaaaugaaaucuaccugucaagcaugug

SEQ ID NO: 177156 - RNA, 23 nt, Homo sapiens
ugaaccugaaaaaagauaaucca

SEQ ID NO: 177157 - RNA, 54 nt, Homo sapiens
agugaagggggccccugaaaggaacguggccuaaaguggagagugaagccggag

SEQ ID NO: 177158 - RNA, 45 nt, Homo sapiens
ugaggaaacuucgcugaaugacccgauuuuucuaaaacuugaggg

SEQ ID NO: 177159 - RNA, 31 nt, Homo sapiens
cacauucugcuuuuuuacugaggcccuaaau

SEQ ID NO: 177160 - RNA, 46 nt, Homo sapiens
uauauucacuguuguaaauuuagacaaugcagacaagcaacaagaa

SEQ ID NO: 177161 - RNA, 41 nt, Homo sapiens
caagcaauaggaguagguggccacuaauuacugcagaauuu

SEQ ID NO: 177162 - RNA, 51 nt, Homo sapiens
uagugagcaauuuuuaugguuucucuccccugacuuccuccuugccuccag

SEQ ID NO: 177163 - RNA, 48 nt, Homo sapiens
uccugguacaaggaagaucauauaguaggugcuacauaaagcuaugca

SEQ ID NO: 177164 - RNA, 22 nt, Homo sapiens
ggagugaucacugguggggacu

SEQ ID NO: 177165 - RNA, 41 nt, Homo sapiens
uauccacuuauggagguuuugaauauuuuuuuuagcuuugg

SEQ ID NO: 177166 - RNA, 88 nt, Homo sapiens
gcaggagagaccaaugcagaaaaugugaaggagcuggggauuaggggugagggccaugguaccugugugccuguuugggucucagaga

SEQ ID NO: 177167 - RNA, 45 nt, Homo sapiens
caggacuggcuacauaauuugcagagccucaguguaaaaugaaaa

SEQ ID NO: 177168 - RNA, 50 nt, Homo sapiens
ugugugacaguguucccuacccucaaaggcagggcccuguggcaggugau

SEQ ID NO: 177169 - RNA, 41 nt, Homo sapiens
agguaguuuuguugcaaaguggaguugagacauuagccggu

SEQ ID NO: 177170 - RNA, 41 nt, Homo sapiens
gagaaucaugagaucuuguuuugccaucuuacauuugagau

SEQ ID NO: 177171 - RNA, 36 nt, Homo sapiens
guaguggucacauucaggcuguguuuaggaaauagg

SEQ ID NO: 177172 - RNA, 91 nt, Homo sapiens
cuggaauguggugcacaagggagaaaguggcaugaggagaggucacagguaggagaaagguaaaugccgcaaagcuuugugagccggggug

SEQ ID NO: 177173 - RNA, 88 nt, Homo sapiens
gggcuggaagaagcagccauacacagguguuugcucauucaccagugccuggcuuuguccuggcacuagaucccucagagucggcccu

SEQ ID NO: 177174 - RNA, 41 nt, Homo sapiens
acaaauuagguacgagaugaacccuuuugguuuuaggagau

SEQ ID NO: 177175 - RNA, 75 nt, Homo sapiens
uuacaguaucaaauggcugggagagggagggaaagaaggagagagagagagagaauaugagggaaugagaaugaa

SEQ ID NO: 177176 - RNA, 84 nt, Homo sapiens
cuucacuauuuugguauugugcaagucaucuuaccucucuggaucucaguugucucaucuguaaaaaggagauaaaaauuauuu

SEQ ID NO: 177177 - RNA, 60 nt, Homo sapiens
ugaugugcuggaaacagauaaacacuucagagaaaagcuccagaaagcagacauagagga

SEQ ID NO: 177178 - RNA, 50 nt, Homo sapiens
uggaggccugaguggccaaaagaugagguuuggaaagaaucacagucucg

SEQ ID NO: 177179 - RNA, 44 nt, Homo sapiens
acuggauuuaguaagucaccaugugaggacaaaacuugaugaac

SEQ ID NO: 177180 - RNA, 45 nt, Homo sapiens
ggaccaccaagcucuucuaaaacaauuugaucaccuaaaccaccu

SEQ ID NO: 177181 - RNA, 60 nt, Homo sapiens
uuugauaauaguuccuuucuucuucuuuuuuuuuuuuaaaucaacuuacauauuacuugc

SEQ ID NO: 177182 - RNA, 61 nt, Homo sapiens
acacuaugacaagacucgucaugaagaauuuaaaaaauaugaaaugaugaaggaacaugaa

SEQ ID NO: 177183 - RNA, 71 nt, Homo sapiens
aggagagaauauuuaaaaacauugaaugaagaaaagagaaaagaagaagagucuaaauuugaagaaaugaa

SEQ ID NO: 177184 - RNA, 46 nt, Homo sapiens
uggagaaaguauaugacccuaaaaaugaagaggaugauaugguaga

SEQ ID NO: 177185 - RNA, 63 nt, Homo sapiens
aacagucaccuaaccacucagaucagcugacugaaacuuaaugguuuugugggcauuagguau

SEQ ID NO: 177186 - RNA, 46 nt, Homo sapiens
uguuuuagaaaacaauuuucauuuacuuuguugugcuuugucaaag

SEQ ID NO: 177187 - RNA, 47 nt, Homo sapiens
caccaggucauacagcagauggaacaaaaaaaauuacaacaaggaau

SEQ ID NO: 177188 - RNA, 46 nt, Homo sapiens
uuccuuuuucucugcucaauaaauauuuuaaaagcauauuugaaau

SEQ ID NO: 177189 - RNA, 45 nt, Homo sapiens
auagcauaauauuagggugugaccuccuguaucuaaacucacugg

SEQ ID NO: 177190 - RNA, 114 nt, Homo sapiens
ccuucucuuuccgugguguguccuuuuuaggcugggucucugcaaacuuuuuagcaucaaacugggccaucuucucacacaguuucaguucccccaagacagcccggaacuggg

SEQ ID NO: 177191 - RNA, 78 nt, Homo sapiens
caacugugaugucagccaaugucacucguucgcccaccagaaaaguccucgucuucaaguaagcauccagcagcccca

SEQ ID NO: 177192 - RNA, 83 nt, Homo sapiens
acaucagagaagggagaggaauacccugugugacuucucagcuccccgaauuaguuguggugaggaagaaaugaagccauggg

SEQ ID NO: 177193 - RNA, 43 nt, Homo sapiens
ccugugguagacccaugggcaaaguaagguaacugaggcagaa

SEQ ID NO: 177194 - RNA, 37 nt, Homo sapiens
auacauauucuacugauuaacuacuuuugcaguuuua

SEQ ID NO: 177195 - RNA, 48 nt, Homo sapiens
uuguagcauauguuugauuuuuuuuuauuauuucauaagaaaacuacg

SEQ ID NO: 177196 - RNA, 52 nt, Homo sapiens
uagucaauauucauuucaguagaagauaaucuuaucuaauuuuugagaccag

SEQ ID NO: 177197 - RNA, 57 nt, Homo sapiens
auccuuaaaggcuuuuuaauagcagacuuccaaaagauugcauuuaggauuucuagc

SEQ ID NO: 177198 - RNA, 54 nt, Homo sapiens
gccaaaucauuaugcuaccuaccauuuauuggagccaaaaauucuaggcgcuag

SEQ ID NO: 177199 - RNA, 69 nt, Homo sapiens
cuguccggcguuuccuguuuuguuauguuuuugugcuuggcugacuaccuuguucccauucuagcgccu

SEQ ID NO: 177200 - RNA, 47 nt, Homo sapiens
gcaaggauggggagaagugaugcugauggcugauaaaguccuccgau

SEQ ID NO: 177201 - RNA, 27 nt, Homo sapiens
uaauaagcagggauccgaaggaacugc

SEQ ID NO: 177202 - RNA, 44 nt, Homo sapiens
ucccccuaaaacuuggacaaggguggagggucaaagggcuacug

SEQ ID NO: 177203 - RNA, 47 nt, Homo sapiens
cgcgcccuccucgccccgucgcgcaccguccccaggaaagguaaggg

SEQ ID NO: 177204 - RNA, 41 nt, Homo sapiens
gcuuccuugaggcguaagcucggucuguccaaugaggagcg

SEQ ID NO: 177205 - RNA, 49 nt, Homo sapiens
gauauauacuguaaucugguuuuugaaguaucuacuauucuggaauauu

SEQ ID NO: 177206 - RNA, 40 nt, Homo sapiens
acaacuuuauuuuuuuauaccuacauagcacaugacuggg

SEQ ID NO: 177207 - RNA, 33 nt, Homo sapiens
aagaaaaaaaaaaaaguuaacacagccauagau

SEQ ID NO: 177208 - RNA, 67 nt, Homo sapiens
agguuuggguuaggaaacauguuuuuagugcuauuuccaaccaggggucgcaaacucagcagccugu

SEQ ID NO: 177209 - RNA, 114 nt, Homo sapiens
agaauucgagugaaccaagagaaauccaaagaccuggggaaggaggacuuaagaugaaagugaagcaagagagggaaggggaaaugaagugaaaauggcgugagggugugagag

SEQ ID NO: 177210 - RNA, 57 nt, Homo sapiens
aguuccacaguaacaacagcaaaaagaaaaaauuaguuguccagccagugcuggagg

SEQ ID NO: 177211 - RNA, 70 nt, Homo sapiens
gaaagagaaacagcugcaaauguugugcugucucuuugagguugucuuggggacaguuccccgcaaaggu

SEQ ID NO: 177212 - RNA, 45 nt, Homo sapiens
aaaucccaauuuguaacacuuggacuggcugcauuuccaaucagg

SEQ ID NO: 177213 - RNA, 70 nt, Homo sapiens
ucugcuugccugauuggaaaugcagccaguccaaguguuacaaauugggauuuuuuuguuuucuaaauaa

SEQ ID NO: 177214 - RNA, 45 nt, Homo sapiens
guuauaaauuugggagaacaaggaagaauuccaggaccggcuccu

SEQ ID NO: 177215 - RNA, 42 nt, Homo sapiens
ucugugcuugaagaucaguuacucccuggucgugggcagagg

SEQ ID NO: 177216 - RNA, 44 nt, Homo sapiens
gguucuuccuuguccaggcagucuuacgugguccaagagaccug

SEQ ID NO: 177217 - RNA, 81 nt, Homo sapiens
gucaacauccauucauuaaacuaccuacuaccagccagagaugucuggaaccaaaguagcaaccaaauacauauucaagac

SEQ ID NO: 177218 - RNA, 34 nt, Homo sapiens
uugguuagagaagcuuccagagaaaauagcacuu

SEQ ID NO: 177219 - RNA, 61 nt, Homo sapiens
cugacagcacccccaccugaccaaaugcuccuaaagccuuucccacuggguggggguggga

SEQ ID NO: 177220 - RNA, 45 nt, Homo sapiens
ggaguuggugcaguuccuuagggacugccugcugcgacgccauac

SEQ ID NO: 177221 - RNA, 46 nt, Homo sapiens
ccucgagacacuuccgagagccgggccucagcauccugcuggagag

SEQ ID NO: 177222 - RNA, 56 nt, Homo sapiens
agacuuauuccuuggccucaaggagcugacaguauaauggggcagacgcacaguag

SEQ ID NO: 177223 - RNA, 48 nt, Homo sapiens
auuuccauagccuauuggaagccagcagccugacaacguaacagaguu

SEQ ID NO: 177224 - RNA, 72 nt, Homo sapiens
aguugaagaucugguuguuggaagcugggcgcccagugcuuuuuuuuuuuuuuuuuuuuagcccagaugccg

SEQ ID NO: 177225 - RNA, 44 nt, Homo sapiens
uugccaagagacuguagcagccagcugccccccguggagcaagg

SEQ ID NO: 177226 - RNA, 42 nt, Homo sapiens
aaaauguggcugggaagacuguuucauccucuggggguagaa

SEQ ID NO: 177227 - RNA, 60 nt, Homo sapiens
cuccccugccacacacacagacacguaauaccagaccaaccucaauccccgcaaacuaaa

SEQ ID NO: 177228 - RNA, 37 nt, Homo sapiens
gccuccacacccuauauccuuccacugagugagaccu

SEQ ID NO: 177229 - RNA, 39 nt, Homo sapiens
gacuucuuuugaaucaucccaaauguguguccaccaaaa

SEQ ID NO: 177230 - RNA, 92 nt, Homo sapiens
ccagcggcugggucuucgucaucuuccacgccaucccugagauccacugcacccuucugccagcccugcaggagaacacgcccaacuacuuc

SEQ ID NO: 177231 - RNA, 42 nt, Homo sapiens
ggucacccuggggcuggcccucuucacucugugcggcaaguu

SEQ ID NO: 177232 - RNA, 56 nt, Homo sapiens
aacaagagagaccaugucccugcccugccacgucuugcaauggaggaagugaggau

SEQ ID NO: 177233 - RNA, 56 nt, Homo sapiens
cagaagcuuggucgccaucuugguguuggcauccuccacauagguuuucuguugcg

SEQ ID NO: 177234 - RNA, 61 nt, Homo sapiens
ggugggagauggcagagcugagaccugggcuggggacgaaugacggggagggguggggagg

SEQ ID NO: 177235 - RNA, 52 nt, Homo sapiens
ccugugugaguuggguccaggaaaccaugucugcccuucugauaagggaaga

SEQ ID NO: 177236 - RNA, 60 nt, Homo sapiens
caauguaucguucuuaaccccaccuccuguaaggggcuuugcuaugcuucagcugguugu

SEQ ID NO: 177237 - RNA, 126 nt, Homo sapiens
gggacuuacaaguuccuuucaaguuugaguacuugaugcucagcaaagauuucaagcuucugcaguagcucugggccaaugcuugacucuuucaugaccacaagaaaugcaguuuuucugcaaagg

SEQ ID NO: 177238 - RNA, 67 nt, Homo sapiens
aaacaaauaucaaaguguauuuaauaguuaaauuugugcccuuucccuucuugcugcacccauguug

SEQ ID NO: 177239 - RNA, 76 nt, Homo sapiens
ugccauuucuugcacaaauuuagguuuuuuuuuuguuuuuuuuuguuuuuuuuuuuuuuuuuuugguaggggaggg

SEQ ID NO: 177240 - RNA, 70 nt, Homo sapiens
gggagggaguccaaguccaaugccgaggagucuuccuugcaaagauuggaagaacuguucaggcgcuaca

SEQ ID NO: 177241 - RNA, 41 nt, Homo sapiens
guggcaagccagguggagauauccucgucaacgggaccaag

SEQ ID NO: 177242 - RNA, 41 nt, Homo sapiens
uggcacacaucauagcagagaacaguagugagaccagugau

SEQ ID NO: 177243 - RNA, 33 nt, Homo sapiens
ucuggaccuguuacugacccuccagagaucaaa

SEQ ID NO: 177244 - RNA, 40 nt, Homo sapiens
cagcaaaaaauauuucaaguaugggucagugaaaugauau

SEQ ID NO: 177245 - RNA, 76 nt, Homo sapiens
uuauuguguggaucuuuucugucccucuuccucuuccugucugcuaugcauuagcagucaaccuccaucgugggga

SEQ ID NO: 177246 - RNA, 41 nt, Homo sapiens
auugauaaguaucuguagaaggaauaauagucacugauacu

SEQ ID NO: 177247 - RNA, 47 nt, Homo sapiens
uauucuggcuuuugcuguauuugaggugaaaauuagcuugugaagug

SEQ ID NO: 177248 - RNA, 43 nt, Homo sapiens
aaaaaagguuuaucaguguuugucuuguagauuguugcugcaa

SEQ ID NO: 177249 - RNA, 35 nt, Homo sapiens
cuuagggcuuuauuuugacaaaucggaaguuggua

SEQ ID NO: 177250 - RNA, 341 nt, Homo sapiens
guaaucagauuuugcuacuguuuugguguacagaugcucuuugauuuacagugggguuaccuuuuauaaccccaucauaaguugaaaauauuguuaguaaaaaaaugcauuuaauauaccucaccuaccgaacaucauagcuuagccuagccuaccuuaaacaugccaagaaccugcauguuuggcauguuuggcaaaugcaucuaaugagccuauuuuauaauaaaauauugaauaucucauguaauuuauugagugaauacuggaagugaaaaacagaaugguuguguaaguacuugaaguagucugggacugucuaugugcugaaguaaggacauuua

SEQ ID NO: 177251 - RNA, 75 nt, Homo sapiens
uuuggagacugguggcucuuuucuaauuuuugaaagggggcggguggguaggaggggacuugaacacaaggagaa

SEQ ID NO: 177252 - RNA, 79 nt, Homo sapiens
cuccacuucauuuucauuucaaugguuuauuguaacucaaauaugaaaauauccuguaggcugaaguuucaucagccag

SEQ ID NO: 177253 - RNA, 83 nt, Homo sapiens
ggggcaaugaaggggacgagguagauccugguacugaauuacuaauucugauuugauugcaaacagaaugucuuuuaguuagc

SEQ ID NO: 177254 - RNA, 49 nt, Homo sapiens
cagugacuaguguguucuuugagugaauuggcucuuugagccaggcagu

SEQ ID NO: 177255 - RNA, 86 nt, Homo sapiens
ggugggagguaguggaaagaggauggguugggugaguaauagccagagcuuagugaacacgggggagaguuggagauaaggucaga

SEQ ID NO: 177256 - RNA, 22 nt, Homo sapiens
ugucuuucagcauuuugucagg

SEQ ID NO: 177257 - RNA, 693 nt, Homo sapiens
uaaaaauuauugaggcaucugaagagauguuauuuaugugguuaauuguauuaauagcacuuugggaggccaaggagggaagaucacuugaggccagggguuuaagaccaaccuaggcaacauggcaagaccacaucucuacaaaaaauacaaaaauuagccaacugugguggugcgugccuguagucccagcuacucaggaggcugagaugggaggaucauuugggcccaggaguucaaggcugcagugagcugugaucacaccauugcacuccagccugggcaacagagcaagacccugucucaaaaaacaaaugaaaugagcugaaauauaaaauaaauaacuaacaugacauaaaacuauauacaauaaaauaaauuaaaauaaacauaacauaaauuacauuaaaucaaauuaaauauuagcuggugcaugcuuguggucccagcuacucaagaggcugaggagggaggauggccugagccugggagguugggggugcagugagcuaugauuguaccacugcacuccagccugggugacagagcuagacucugucuggaaaaaaaaaaaaaaagaauauuaauaauuauuucuuuuuaaaaaauuuucuuccucauuguuucuuguucugaaauaauuauucuaugagaaaucauagcauaaauuuuaaaaauaucuauucauuuaaa

SEQ ID NO: 177258 - RNA, 42 nt, Homo sapiens
acuauauuuuccaaaacaaaaugaaauuugugagugguauua

SEQ ID NO: 177259 - RNA, 38 nt, Homo sapiens
gaaaaggaaaggcuucuuucuuaguuuuuuguuaucag

SEQ ID NO: 177260 - RNA, 72 nt, Homo sapiens
acuguacugaucuuguggaaauuaguauuugagcguguuccaucagcauacagcuggacucuuggaaggcca

SEQ ID NO: 177261 - RNA, 48 nt, Homo sapiens
aguaaucauuuuugaauuccucaaagcccaaaggaaacaaaauuggug

SEQ ID NO: 177262 - RNA, 46 nt, Homo sapiens
ugcugcauauuuacugccuugaacuggaacaccaccaggaccugua

SEQ ID NO: 177263 - RNA, 52 nt, Homo sapiens
aaguugguugacuuuggugacaucacuuugucucucuugaccacuauaaaag

SEQ ID NO: 177264 - RNA, 44 nt, Homo sapiens
cuaauccaaaagaaaugucauuaaccaauacuccaaguccuuga

SEQ ID NO: 177265 - RNA, 56 nt, Homo sapiens
uccugaaaaggaccaguggagggaagagcuauacuucuggagaaguaggccuggag

SEQ ID NO: 177266 - RNA, 45 nt, Homo sapiens
uuaaggagaucuuuaguugcaucaagaaaacuaagcaggaaauag

SEQ ID NO: 177267 - RNA, 46 nt, Homo sapiens
agggcugcagccaaggaccugacuggagugaacgcccagucugagc

SEQ ID NO: 177268 - RNA, 41 nt, Homo sapiens
gcacgaaguggacacgcaguacagcgcccugaaggugaagu

SEQ ID NO: 177269 - RNA, 42 nt, Homo sapiens
ggagugacaucgugaagggccacgaggagaccugcaucagga

SEQ ID NO: 177270 - RNA, 42 nt, Homo sapiens
cagcugggggccacaggugccuaccgagcacgggcgcuggaa

SEQ ID NO: 177271 - RNA, 45 nt, Homo sapiens
ugaaaaaaacagugacaauguugcaggcccagcugagccuggagc

SEQ ID NO: 177272 - RNA, 24 nt, Homo sapiens
uugaauauuauuguauuguuuuga

SEQ ID NO: 177273 - RNA, 51 nt, Homo sapiens
ggaacaaacucaucugagcgaaugaaaaauagugcagagaacuggugaaaa

SEQ ID NO: 177274 - RNA, 45 nt, Homo sapiens
cuagaucuucaacuugcugcugagcuugggaagacauuacuggau

SEQ ID NO: 177275 - RNA, 46 nt, Homo sapiens
gguaaugauggugcuugcuuugaaacaugccccugagaacaaggug

SEQ ID NO: 177276 - RNA, 44 nt, Homo sapiens
ccagccgagaugcuggcggaaaaccugguagaggaguuugagau

SEQ ID NO: 177277 - RNA, 45 nt, Homo sapiens
ugguuaagauaaaacacaagucaaacuuauucgaguuguccacag

SEQ ID NO: 177278 - RNA, 81 nt, Homo sapiens
gcuuuaggaugaaguucucaucuucaaauuucuccccauagauggacuugccaccagugccauuauggcgugugaagucac

SEQ ID NO: 177279 - RNA, 65 nt, Homo sapiens
uuugggaccuugucugcaaacagcucaaaggagacgcggcccaagggcucgccgucgacggcaau

SEQ ID NO: 177280 - RNA, 39 nt, Homo sapiens
aguaaugggcauccaaguauccuucagaagacugcugua

SEQ ID NO: 177281 - RNA, 39 nt, Homo sapiens
ggggagaaucaaggaaggcuucauucagagaggacauuu

SEQ ID NO: 177282 - RNA, 54 nt, Homo sapiens
gcccggcaagccacaagaauggggcaauaaggggagcagguggaggggccucgg

SEQ ID NO: 177283 - RNA, 33 nt, Homo sapiens
cagggucacgcucuucugccaaggcgccucagg

SEQ ID NO: 177284 - RNA, 38 nt, Homo sapiens
ggcauuucaggaaagagauucacaugcguaaggaaggg

SEQ ID NO: 177285 - RNA, 50 nt, Homo sapiens
ugcugcaaaauucuugacaacacaguauuaccuccagaaacugugguucc

SEQ ID NO: 177286 - RNA, 44 nt, Homo sapiens
gccucaugucuugaaucugcuugagcucuaagaugaaccugggg

SEQ ID NO: 177287 - RNA, 70 nt, Homo sapiens
uccucaaaauacuuccagaagaacaaccagaugggaaggaccuugguugggacucuuuccaguucacuug

SEQ ID NO: 177288 - RNA, 64 nt, Homo sapiens
uaacaagugcuuuccaagccacuacuaggugccaagcacuuccuagguccuggggauacagugg

SEQ ID NO: 177289 - RNA, 50 nt, Homo sapiens
auaaacggcaguuuauuaggcacuuuuauuaggaagugauacaccuugag

SEQ ID NO: 177290 - RNA, 41 nt, Homo sapiens
gagcggugcggaggcucugcucggaucgaggucugcagcgc

SEQ ID NO: 177291 - RNA, 48 nt, Homo sapiens
uggacccacgcagccggcggcgcuaugugcggggccgcuuuuugggca

SEQ ID NO: 177292 - RNA, 74 nt, Homo sapiens
gccuaagucucugcugcucaagccgcaccagagggagaagauguccauggaaauauccauucaccgcagccucg

SEQ ID NO: 177293 - RNA, 60 nt, Homo sapiens
cccaccagcacgucguaggauuccacggcuuuuucgaggacaacgacuucguguucgugg

SEQ ID NO: 177294 - RNA, 45 nt, Homo sapiens
guuauucaucgagaccucaagcugggcaaccuuuuccugaaugaa

SEQ ID NO: 177295 - RNA, 46 nt, Homo sapiens
ggggauuuuggacuggcaaccaaagucgaauaugacggggagagga

SEQ ID NO: 177296 - RNA, 42 nt, Homo sapiens
agguauaccuuguuagugggcaaaccaccuuuugagacuucu

SEQ ID NO: 177297 - RNA, 54 nt, Homo sapiens
agcacaucaaccccguggccgccucccucauccagaagaugcuucagacagauc

SEQ ID NO: 177298 - RNA, 42 nt, Homo sapiens
caccugccugaccauuccaccaagguuuucgauugcucccag

SEQ ID NO: 177299 - RNA, 28 nt, Homo sapiens
uacggccuugguagguuucuuccagaac

SEQ ID NO: 177300 - RNA, 55 nt, Homo sapiens
cugcuucaaaagggagggggguugcgcgucaggaggaccggcucacagggaggcu

SEQ ID NO: 177301 - RNA, 26 nt, Homo sapiens
aggcgggccgagaggcggggcggcug

SEQ ID NO: 177302 - RNA, 48 nt, Homo sapiens
acagacaagaagcacaggacaggcugcacuggggccaaacacagacuc

SEQ ID NO: 177303 - RNA, 55 nt, Homo sapiens
cuucaggaacaucucagcauccacccagucugucaccaaagccacccacccgaag

SEQ ID NO: 177304 - RNA, 43 nt, Homo sapiens
caucagucccagguuccuaucccugaucucagcugguguaggg

SEQ ID NO: 177305 - RNA, 36 nt, Homo sapiens
caauuaguauugcuuagaacagaaaacuagacuuuu

SEQ ID NO: 177306 - RNA, 46 nt, Homo sapiens
uagcaucuggccaaaaucagccccaggcagcugcuggcucccacca

SEQ ID NO: 177307 - RNA, 44 nt, Homo sapiens
aaagcagcucugggggugggacuguccccucuuccgcgggcaua

SEQ ID NO: 177308 - RNA, 48 nt, Homo sapiens
gcggugauggaaggagacuuggugaagaaggaaagguaugauuugacc

SEQ ID NO: 177309 - RNA, 64 nt, Homo sapiens
cucauuccacacuggaaacgacucugacucggggacccuggagaggaagcggccugcuagcaug

SEQ ID NO: 177310 - RNA, 57 nt, Homo sapiens
uggugaaggccugaguuggcugugucagggaauuaguauuucauccugcuggcaaua

SEQ ID NO: 177311 - RNA, 51 nt, Homo sapiens
gaaaaauacacauauuuauguguguguauauaugauauuguaggaggggua

SEQ ID NO: 177312 - RNA, 45 nt, Homo sapiens
uguagacguaagcagauacauucguguguacauacuugccugugu

SEQ ID NO: 177313 - RNA, 40 nt, Homo sapiens
aucaagucacccucaaggcggugggcagguucugucucag

SEQ ID NO: 177314 - RNA, 37 nt, Homo sapiens
ucuuguccucuagcuagaaggcuuugcauggcuagaa

SEQ ID NO: 177315 - RNA, 59 nt, Homo sapiens
ugcuguuuaggaaaaaagagcaaaacauacugcaguuuucaaaggaccagcaaccaccc

SEQ ID NO: 177316 - RNA, 76 nt, Homo sapiens
uucccaaggguauuuucccuagagaaauacaucaggaagccauggagagcggggaugggacaggaaagagguuagg

SEQ ID NO: 177317 - RNA, 46 nt, Homo sapiens; identical to SEQ ID NO: 102922

SEQ ID NO: 177318 - RNA, 42 nt, Homo sapiens
ggccucauaacaugcuuccugcaugggaagaggcaagaauag

SEQ ID NO: 177319 - RNA, 43 nt, Homo sapiens
uuaggugaggcuuccuggaggagguggugucugcccuauaaag

SEQ ID NO: 177320 - RNA, 41 nt, Homo sapiens
ugggauaaaguccacacucuuuagaugacuuaagcccuuuc

SEQ ID NO: 177321 - RNA, 38 nt, Homo sapiens
aauacacauuuuuggcauuccuuccuguaaaaagcggc

SEQ ID NO: 177322 - RNA, 57 nt, Homo sapiens
ugcuccuaaaucucccauugccugccagcccugaguccuggggcuaugggcuuggau

SEQ ID NO: 177323 - RNA, 49 nt, Homo sapiens
ccucuggggacacaguugccuccaguugagaagcacuaguuuaaauuua

SEQ ID NO: 177324 - RNA, 43 nt, Homo sapiens
uagggaggcgucaugagacagugaggacauacagugugacaca

SEQ ID NO: 177325 - RNA, 52 nt, Homo sapiens
gugguucccaagugcuuuugaguacaggaacugggcugccucuucaccaggg

SEQ ID NO: 177326 - RNA, 41 nt, Homo sapiens
accaaugguguuuuuggggagaugaugucuugaguagagga

SEQ ID NO: 177327 - RNA, 38 nt, Homo sapiens
ccuuuccccagaaauggacuggagucagcgcacccaaa

SEQ ID NO: 177328 - RNA, 41 nt, Homo sapiens
gaaggaaugaguucgcaugaugcaguuuguuuacgaugggu

SEQ ID NO: 177329 - RNA, 46 nt, Homo sapiens
ggcccgccugucucucagcgccgccgggcucccgagaccugcaggg

SEQ ID NO: 177330 - RNA, 96 nt, Homo sapiens
auaauaguguuucuaaaacuuuaaggggauagggaagagguaauagacaccugaagcauuucuaagaccaguuggacuccuuuggccugcugucga

SEQ ID NO: 177331 - RNA, 44 nt, Homo sapiens
auauuccuucauucaagaaauauuugagugccugugcuacuuga

SEQ ID NO: 177332 - RNA, 46 nt, Homo sapiens
auccuccgugagacucgguuuuaugaagcgcuucaagccugucauc

SEQ ID NO: 177333 - RNA, 46 nt, Homo sapiens
ugcaaggagugcaggaaaaacauggagagagcagcagcaguggggu

SEQ ID NO: 177334 - RNA, 47 nt, Homo sapiens
gcccaaagggaccucuaccgggauuucaggaaggagaauguugggaa

SEQ ID NO: 177335 - RNA, 43 nt, Homo sapiens
cauuuggcgcaaacuauccacuuguuccuugauuucaguucuu

SEQ ID NO: 177336 - RNA, 319 nt, Homo sapiens
cucccgucaagaguauaaaaguguauuucccccuuaguccuuuacuuauacuuacuuuaaauauacuuauacuccccacaagaguauaaaaguauauuucccccuauuccuuuacuuauacuuacuuuaaauauaauuacuuuacuuaccuuaaauauacuccccacaagaguauauuucccccuuauuccuuuacuuauacuuacuuuaaauauacuuacuuuacuuacuguaaauacacuuauaguccucacaaguguauaaguauauuucccccuuauuccuuuuccugaaaagaugggacccagucuucugagua

SEQ ID NO: 177337 - RNA, 52 nt, Homo sapiens
auacccuagaucaggaagugacaaccacacggcuuccugcugggucccaggu

SEQ ID NO: 177338 - RNA, 42 nt, Homo sapiens
gaaugggaaaggcaugugggcagggauguauugcagaaagac

SEQ ID NO: 177339 - RNA, 45 nt, Homo sapiens
gauugaaacccuuacaauggaggagagagugccucuauaacacua

SEQ ID NO: 177340 - RNA, 60 nt, Homo sapiens
gaauugauccuaagaagaccacaaugugagagguguauaagaaauuugauuugggccaag

SEQ ID NO: 177341 - RNA, 55 nt, Homo sapiens
ccacaaggcuguuugcaaggcuaagugcuauuuauggagguaccuauaugcugaa

SEQ ID NO: 177342 - RNA, 43 nt, Homo sapiens
gcucacuguaagcagcucaucugugacccuagcuauguaaaag

SEQ ID NO: 177343 - RNA, 58 nt, Homo sapiens
acacaagagaaguauauugccauaguuaccacaacuguggaaaccaaggagccugaga

SEQ ID NO: 177344 - RNA, 37 nt, Homo sapiens
ucuuggagccaacuagaugggaauuuguuaguaucag

SEQ ID NO: 177345 - RNA, 93 nt, Homo sapiens
aaaaacaucuauaagaagauuacaggauucgaguuugacuuugaggaaaugaagcgcaagaaaaaugacaucuaugggaaagacuaacaccag

SEQ ID NO: 177346 - RNA, 47 nt, Homo sapiens
auaaugcauauuaugugaaaucaauauuguaaggccugcuuuuguaa

SEQ ID NO: 177347 - RNA, 45 nt, Homo sapiens
gcuccuguucccugugagcugccugguccugcugcagguggcaag

SEQ ID NO: 177348 - RNA, 55 nt, Homo sapiens
ccuuuaauuuggccaagaacaaguugucaaguuugugugagauaaaggugcacuu

SEQ ID NO: 177349 - RNA, 50 nt, Homo sapiens
cgcggggugcgugugccaccugcucauggaugacguggucagugcggaua

SEQ ID NO: 177350 - RNA, 45 nt, Homo sapiens
auuaccuguauaaucaucucaccuaugcagucaacauuuggagug

SEQ ID NO: 177351 - RNA, 46 nt, Homo sapiens
ugucauccuggccgucugccuguugugcuaugucagcaucaccaag

SEQ ID NO: 177352 - RNA, 43 nt, Homo sapiens
uaaucagccugaucucugaugccaaauaaguauuggugauaac

SEQ ID NO: 177353 - RNA, 47 nt, Homo sapiens
auuaagaaagaauggugggaucagauucccaacccagcccgcagccg

SEQ ID NO: 177354 - RNA, 46 nt, Homo sapiens
aauugucuuaccaagcucuugcccuguuuucuggagcacaacauga

SEQ ID NO: 177355 - RNA, 47 nt, Homo sapiens
agcguggugcgauguguggaguuguuugaggccccgguggaguguga

SEQ ID NO: 177356 - RNA, 45 nt, Homo sapiens
gccucuccaccuggagccaaguccuccugccagcccgacccagag

SEQ ID NO: 177357 - RNA, 57 nt, Homo sapiens
aaacacccaugcccagcuguauggcugggggcuccucguaugcauggaacccccaga

SEQ ID NO: 177358 - RNA, 38 nt, Homo sapiens
acagcaggcauaaggcaccaguuacccugcauguuggc

SEQ ID NO: 177359 - RNA, 48 nt, Homo sapiens
uggcucauggggcagaauugccaaggacagcucacgacagugccaccu

SEQ ID NO: 177360 - RNA, 59 nt, Homo sapiens
gccaggaaauaggaggcaucugugcagacuuugggaagaggcaggcuuugaauggaguu

SEQ ID NO: 177361 - RNA, 42 nt, Homo sapiens
augguguggaugccaaccagaaaagugugcuggggcggaauu

SEQ ID NO: 177362 - RNA, 60 nt, Homo sapiens
auuccaaagcaguuuaaaaauacuuugcuuagcccccaggcagaggcuuaaccuccaggu

SEQ ID NO: 177363 - RNA, 45 nt, Homo sapiens
gcaggcacucagcauaauaagacccggaauaaguauagauuuaau

SEQ ID NO: 177364 - RNA, 46 nt, Homo sapiens
cuccccagcaucaucgcccugugcauggagcaaguguaucccauca

SEQ ID NO: 177365 - RNA, 46 nt, Homo sapiens
ugauuauccaccagacacucagcgucuuagaagauauuguggagaa

SEQ ID NO: 177366 - RNA, 126 nt, Homo sapiens
gagggcaccaggaugugauugcaggaugugaccuggugcuaggggcauggauugucacggauucuccugcaaguccugcucuaaguagcuucucagaggacucagaagccaccagcugaacaaugc

SEQ ID NO: 177367 - RNA, 114 nt, Homo sapiens
gguugagaagugccaggcaagugcauuuucuuagaauccucaaaggaggcucaagcuagaaguuuaaaaaccaccuaacaggagggagggcaggaagguuugaagaggguacca

SEQ ID NO: 177368 - RNA, 64 nt, Homo sapiens
ggcacugacacagacucagugauucucaucgugcccauucuaaggcaggcagucagugugcuga

SEQ ID NO: 177369 - RNA, 69 nt, Homo sapiens
cagugguaauugaaccaaguauuugauaggcaugcugaagggaaagcaguaggagagacuggccugagu

SEQ ID NO: 177370 - RNA, 47 nt, Homo sapiens
cucaucucuacuaccauggaugcaaucacaccucuaaucagcaccaa

SEQ ID NO: 177371 - RNA, 38 nt, Homo sapiens
ucuuaccuccuaugaaaaugaguugaacgcuaauauau

SEQ ID NO: 177372 - RNA, 55 nt, Homo sapiens
uuguuucuugugcccucucugcacacaauacaugaugaugaugaugaugauuauu

SEQ ID NO: 177373 - RNA, 47 nt, Homo sapiens
aucuuuaugcauaucucagauuauuuccuuggcauaaaauugaaagu

SEQ ID NO: 177374 - RNA, 46 nt, Homo sapiens
agcccaaagccaagacaccugaugcuucgacuggcccagcagccgc

SEQ ID NO: 177375 - RNA, 71 nt, Homo sapiens
uuggugaugaccagugugagucucgccuccuaagagacaggagagaacugaaguagggggagggagcaggu

SEQ ID NO: 177376 - RNA, 44 nt, Homo sapiens
aagugaucaagugucaacaguuucauauuguucaaacucacagu

SEQ ID NO: 177377 - RNA, 57 nt, Homo sapiens
uuuggggggaaaucuaagccuugaccagacagaagaaaguguggguggaucugaaca

SEQ ID NO: 177378 - RNA, 49 nt, Homo sapiens
guuauugacuuauauuacuuaauucucuccaucguccugugagguguaa

SEQ ID NO: 177379 - RNA, 50 nt, Homo sapiens
ugccugcuugggguuuaggguuaguuugcuuuguuauuuuguugauaaca

SEQ ID NO: 177380 - RNA, 45 nt, Homo sapiens
aaaaagccucuaauuaguuuccuuauguccuuucaaccagcaggu

SEQ ID NO: 177381 - RNA, 45 nt, Homo sapiens
aaguuuauuugggauuacaacaguuuauagucacuucagggucag

SEQ ID NO: 177382 - RNA, 30 nt, Homo sapiens
ucuuuccccucuauguaauuuuuaaaaaca

SEQ ID NO: 177383 - RNA, 58 nt, Homo sapiens
caucuguccucuggucugaaguagauuuucuuuccuaggagaauuguggaaauauuuu

SEQ ID NO: 177384 - RNA, 51 nt, Homo sapiens
caauugccaguuaagauuuuaggucuaauuuaggguuacauuugcauagaa

SEQ ID NO: 177385 - RNA, 39 nt, Homo sapiens
uguauauaagcauuuaaugcuguaaauuuccuucuaagc

SEQ ID NO: 177386 - RNA, 43 nt, Homo sapiens
ccccuuaguggucuaagacaguagacuacaaagaacauguguu

SEQ ID NO: 177387 - RNA, 50 nt, Homo sapiens
gaugguuuuuguaauuguggaauaaguuccagguugcuauggugucaggu

SEQ ID NO: 177388 - RNA, 35 nt, Homo sapiens
cauuuguaaaaugaggaugaaaauaauaguuguug

SEQ ID NO: 177389 - RNA, 43 nt, Homo sapiens
gagauuacaaacuaggugaucuagcccuaaguacuuuaucaua

SEQ ID NO: 177390 - RNA, 17 nt, Homo sapiens
guuccuaggaacuuggg

SEQ ID NO: 177391 - RNA, 46 nt, Homo sapiens
auuuuggccucccggaaagaaaaccagccuucuagacuugccagau

SEQ ID NO: 177392 - RNA, 42 nt, Homo sapiens
ugcaccuuccuaaagaacagucagcuggguggugacuuugaa

SEQ ID NO: 177393 - RNA, 52 nt, Homo sapiens
aauugggcaguuuuguaaaauauuucuaaaauuaaaaaauugguacauaaga

SEQ ID NO: 177394 - RNA, 45 nt, Homo sapiens
caucucuucaguuggauuccucugucugccagcaucaccccaucc

SEQ ID NO: 177395 - RNA, 44 nt, Homo sapiens
gaugcuggauagcuuaaaagccuuucuuauuuucaggugacuua

SEQ ID NO: 177396 - RNA, 56 nt, Homo sapiens
uggcccuucuuccugcaccgccuugugaagguuccugcauccauuccuuguacuug

SEQ ID NO: 177397 - RNA, 55 nt, Homo sapiens
gaagccauagcaguggaugagucacucuagcagugagagugaaaugagaggagaa

SEQ ID NO: 177398 - RNA, 46 nt, Homo sapiens
uccccugugacaaccccccuugggcugaucauguugaagacaacuu

SEQ ID NO: 177399 - RNA, 97 nt, Homo sapiens
agucuguaugggugcaguuccugaguguucugcucuucccuaaaguuuauauauuuuuuuagcuuaaguaaaaaaaaaaaaaaagugugucagggaa

SEQ ID NO: 177400 - RNA, 53 nt, Homo sapiens
cugcaugaucugaauuuaagucaguguuagaaauaggcccaauuuguagaaaa

SEQ ID NO: 177401 - RNA, 73 nt, Homo sapiens
aggcaaacagcuggggccaaauucucagaauaaggaaugugaauuguaaccccuacccacagagagcugaggg

SEQ ID NO: 177402 - RNA, 53 nt, Homo sapiens
aggguaaggguuaugugcacccuccuccuacccucaauucauuugugucauag

SEQ ID NO: 177403 - RNA, 52 nt, Homo sapiens
uaucgcauucacuuuauauuuauaagacauauuguaucuuugugagguggag

SEQ ID NO: 177404 - RNA, 46 nt, Homo sapiens
uacuuucucuccagcacuaggaaugacuauguaaugauguacaguu

SEQ ID NO: 177405 - RNA, 42 nt, Homo sapiens
auuuuuucacgauuguacaaccaaugaaagaaaacgugagau

SEQ ID NO: 177406 - RNA, 66 nt, Homo sapiens
auaaucacaacugcugcuggcucuugauuaugucugggguagaauuauaccagugaugacucaaaa

SEQ ID NO: 177407 - RNA, 57 nt, Homo sapiens
uacaugcaugugcugguugcucagccuccucaucaacacuuauuauugucagucguu

SEQ ID NO: 177408 - RNA, 44 nt, Homo sapiens
gguuguguuuugguuucuuucacucuacauuguguuugugagau

SEQ ID NO: 177409 - RNA, 36 nt, Homo sapiens
cugagccaagcuuaauucgucauccugcccaaggau

SEQ ID NO: 177410 - RNA, 42 nt, Homo sapiens
ccuggaaaccagguaaaagcaauuauaguaacguaggcagga

SEQ ID NO: 177411 - RNA, 32 nt, Homo sapiens
cugauuacaagacaaagacacaagauguaaau

SEQ ID NO: 177412 - RNA, 394 nt, Homo sapiens
aauagaggaauaaagugagauuuccacuucaauaugcugugcuuuuuuuuuuuuuuuuuaaaggaagugucagcugggcgcgguggcucgugccucuaaucccagcacuuuuggaggcugaggcaggcggaucgcuugagcccuggaguuuaagaccagccugggcaacauggcgaaaccccagcucuacaaaaaauacaaaaaucagcuggaugugguggugugcagcuguggucccagcuacuugggaggcugagguagaaggauagcuugagcccgggagauagaguuugugccacuguacuccagccugggcgacagagcaagaccugugccuccagaaaacaaaaggaaaaggaaaauaucuacgggcugggaugcaaaagagcaguag

SEQ ID NO: 177413 - RNA, 29 nt, Homo sapiens
gauugcccugcugacugcuagacugugga

SEQ ID NO: 177414 - RNA, 63 nt, Homo sapiens
ugguaguuuuagauuaaagcagaaaagugcuuuuuaaugacuaaaauuauguuuagaugcagc

SEQ ID NO: 177415 - RNA, 55 nt, Homo sapiens
caguuucauacucauucauuaccugaugucauccaaugccagguaaagccagcuc

SEQ ID NO: 177416 - RNA, 94 nt, Homo sapiens
ucucuccccugcuuacccuuaagagaagccuguccuuagcuguguccuaccuuccuuuuguggcuagcaccauucuuugucccuaggucuggag

SEQ ID NO: 177417 - RNA, 48 nt, Homo sapiens
guugcauugucaaauguaucugucuaagccaaggaagaugugauagca

SEQ ID NO: 177418 - RNA, 44 nt, Homo sapiens
uagcccagcacccuuguauugagguuucauuuuaauuggcaguc

SEQ ID NO: 177419 - RNA, 39 nt, Homo sapiens
acaguuuagugaaauuaagaacauucacauuguugugca

SEQ ID NO: 177420 - RNA, 47 nt, Homo sapiens
caguuaagcucucaguuccaauuuccucaacuaugaaauuuggggau

SEQ ID NO: 177421 - RNA, 46 nt, Homo sapiens
agagccgagauagcuuccugaaacgugugaaggaaaaugaucagaa

SEQ ID NO: 177422 - RNA, 38 nt, Homo sapiens
uuuguguucgucauuuuggcgaauuacuggaagauggc

SEQ ID NO: 177423 - RNA, 46 nt, Homo sapiens
gcggcagccucucagaugagcacacuggccacgggcacgcgggugg

SEQ ID NO: 177424 - RNA, 52 nt, Homo sapiens
ggaugggguggggcagguuaacucaggcaaggagggguauaaaauggcaugg

SEQ ID NO: 177425 - RNA, 68 nt, Homo sapiens
agauuccccaacccugcuagccuuguaaacuccugagccuucaccguggacacuuaaauaccuauuaa

SEQ ID NO: 177426 - RNA, 83 nt, Homo sapiens
gagggacugggaggaccuggggccguuggauuuugagguugggguccauggcaaaugaagccagggagcugcaguauuggggg

SEQ ID NO: 177427 - RNA, 68 nt, Homo sapiens
guccucgggcguuaggguguuggaggcagggagaggcagggcuccgggacuuucugcagacuggggug

SEQ ID NO: 177428 - RNA, 42 nt, Homo sapiens
gagguugagguggagcccccggagcccccggggccggucgcg

SEQ ID NO: 177429 - RNA, 44 nt, Homo sapiens
gggcgcaugaugagcggguacagagaccaaugaaaaggcgggaa

SEQ ID NO: 177430 - RNA, 42 nt, Homo sapiens
cuauaggcuggaggggcggugccucuuaccgaggccugaggu

SEQ ID NO: 177431 - RNA, 45 nt, Homo sapiens
ggagagagaauuggcagaacacugugaccaguuuguuggacgggg

SEQ ID NO: 177432 - RNA, 42 nt, Homo sapiens
guaccccacaggacagccagaguguggagccaggggccaugg

SEQ ID NO: 177433 - RNA, 43 nt, Homo sapiens
ggguggggacgugcaaguuucagacuccgacuaacuacgcggg

SEQ ID NO: 177434 - RNA, 76 nt, Homo sapiens
auacucgcgccccgguaaccggggagccgggaccaggagcccgagcgcacagaagaagaagggcgccugcggcugg

SEQ ID NO: 177435 - RNA, 44 nt, Homo sapiens
cccaaaguguuccugggccgccaucgcccucccugaccacucac

SEQ ID NO: 177436 - RNA, 45 nt, Homo sapiens
gccuccacggccaggccgcggcacaagagaggcaaugccggggcu

SEQ ID NO: 177437 - RNA, 45 nt, Homo sapiens
agcguggucuucccgugguccacauggccgaugguacccacauuc

SEQ ID NO: 177438 - RNA, 46 nt, Homo sapiens
guggggcuaaguucaagaaguacgaggagauugacaaugccccgga

SEQ ID NO: 177439 - RNA, 45 nt, Homo sapiens
agugcuauacuccacaugagccgcauugauggugauaccccgagc

SEQ ID NO: 177440 - RNA, 46 nt, Homo sapiens
acugccgcccgccacuacgcccacacagacugcccgggucaugcag

SEQ ID NO: 177441 - RNA, 45 nt, Homo sapiens
ggccccaugccccagacccgagagcacuuauuacuggccagacag

SEQ ID NO: 177442 - RNA, 50 nt, Homo sapiens
guggugguguaugugaacaaggcugacgcuguccaggacucugagauggu

SEQ ID NO: 177443 - RNA, 29 nt, Homo sapiens
ccguggcaccguggugacagguacacuag

SEQ ID NO: 177444 - RNA, 45 nt, Homo sapiens
ccggagauaaccucggggcccugguccgaggcuugaagcgggagg

SEQ ID NO: 177445 - RNA, 44 nt, Homo sapiens
gccugucggauuauccugcccccagagaagguacgguggguggg

SEQ ID NO: 177446 - RNA, 64 nt, Homo sapiens
cccggggaggaccugaaguucaaccuaaucuugcggcagccaaugaucuuagagaaaggccagc

SEQ ID NO: 177447 - RNA, 42 nt, Homo sapiens
gcugagcccgcgagucacaccgcagggcccugacagcggaaa

SEQ ID NO: 177448 - RNA, 55 nt, Homo sapiens
accuagggagccgcgagaccucccugggccucagcccccgguacaguggagccaa

SEQ ID NO: 177449 - RNA, 47 nt, Homo sapiens
uaguacuuaaaaaaguaccuuugagucagggaguucuauucuacucu

SEQ ID NO: 177450 - RNA, 45 nt, Homo sapiens
cuccgggaagcuggggcuccugacauggagagagggaugucagag

SEQ ID NO: 177451 - RNA, 43 nt, Homo sapiens
ucagggucagcugggugcaccacgacaaggcucgcgguuguug

SEQ ID NO: 177452 - RNA, 63 nt, Homo sapiens
aagcugucuugggagcagcaggaaggcaggcagcucugggagcauaaagugugaugcccacuu

SEQ ID NO: 177453 - RNA, 43 nt, Homo sapiens
agaggcaggugcagggggcugggcaggccgggggcgugagggu

SEQ ID NO: 177454 - RNA, 40 nt, Homo sapiens
gugagcgagcgggggaaccaggcaggcagacagguccugg

SEQ ID NO: 177455 - RNA, 45 nt, Homo sapiens
ggagcacauggccaucaacgugugccccgggcccauccggcccau

SEQ ID NO: 177456 - RNA, 28 nt, Homo sapiens
ggggaccaggaccugaagggggcggcgg

SEQ ID NO: 177457 - RNA, 34 nt, Homo sapiens
ccauaccgacccaugcugccuuuccucucucucc

SEQ ID NO: 177458 - RNA, 58 nt, Homo sapiens
gacagggaacuugcuccgucauccuaggagauggagauguagggagaguacucccuca

SEQ ID NO: 177459 - RNA, 46 nt, Homo sapiens
ucuuacaggccuaaagaucccuccuggcugugagcugguggucggc

SEQ ID NO: 177460 - RNA, 42 nt, Homo sapiens
accgcugcccaggggagcuaggaggaagcggggagagagagc

SEQ ID NO: 177461 - RNA, 41 nt, Homo sapiens
aggaccgcagggucggggcuagugaggagcgagggcaagga

SEQ ID NO: 177462 - RNA, 73 nt, Homo sapiens
aaaaaaaaaggaaaagaaagcaccaacuccccggggaggggcugcagacagcagggggagaggacuggaagga

SEQ ID NO: 177463 - RNA, 46 nt, Homo sapiens
gacuucaacacaaccgaggggacagguuuguguggggucaggucug

SEQ ID NO: 177464 - RNA, 33 nt, Homo sapiens
gcucacaggcacccccuccgcccccgagaggga

SEQ ID NO: 177465 - RNA, 50 nt, Homo sapiens
aggggcguggggggugucacaggagaguuaaagcuuggugggcuggggag

SEQ ID NO: 177466 - RNA, 42 nt, Homo sapiens; identical to SEQ ID NO: 103128

SEQ ID NO: 177467 - RNA, 45 nt, Homo sapiens
caggggcaauguuggcaauaaggauacugugggcugagccaccca

SEQ ID NO: 177468 - RNA, 41 nt, Homo sapiens
gagaggugugcagagacaaacgagagauagagacaggccag

SEQ ID NO: 177469 - RNA, 24 nt, Homo sapiens
acagagaagcaagagggaccagaa

SEQ ID NO: 177470 - RNA, 42 nt, Homo sapiens
aagcuaggcuuacuuauaaugcuccacccuacagaaauggga

SEQ ID NO: 177471 - RNA, 61 nt, Homo sapiens
agcaugccucgugaguucucaucuggguuccggaagggcacagugcuugcguugguggagg

SEQ ID NO: 177472 - RNA, 46 nt, Homo sapiens
ggugccuggagggugaggguugaacaaaggggcccauggaccaguc

SEQ ID NO: 177473 - RNA, 27 nt, Homo sapiens
acccauggcugcgaaggugucccgaag

SEQ ID NO: 177474 - RNA, 46 nt, Homo sapiens
cgaacauggucaggaagacggugaaguugaugggaccgcuggcuuc

SEQ ID NO: 177475 - RNA, 62 nt, Homo sapiens
uaagauugugguaaugggcgguaagauugcauuuucacagcaaaugugggcggagagggcaa

SEQ ID NO: 177476 - RNA, 42 nt, Homo sapiens
gagcugcugaccacgcagugugaccgcuucucccaggaggag

SEQ ID NO: 177477 - RNA, 45 nt, Homo sapiens
ccgcccacgucgggggggaaggccgcccacauguucuugaucugg

SEQ ID NO: 177478 - RNA, 42 nt, Homo sapiens
guucucaugguucagcccaggccuuugauaaaaaugaguuga

SEQ ID NO: 177479 - RNA, 62 nt, Homo sapiens
gccuagacuggagauguuaauugagaagcugucaaccuauagaugguuuauaaagccuugag

SEQ ID NO: 177480 - RNA, 48 nt, Homo sapiens
agccuucuuuggaaauuucuuacaaucaacucuugagaaccauccgug

SEQ ID NO: 177481 - RNA, 73 nt, Homo sapiens
uggguuagcuuagauugguagcugcugaaacucucguugagucaggagcggguaaaagguagguggggugggg

SEQ ID NO: 177482 - RNA, 59 nt, Homo sapiens
agaagauaaggggccagggagcuagaggaaccuuuagggaggauaguggagaagccgca

SEQ ID NO: 177483 - RNA, 42 nt, Homo sapiens
ccuuggaugaugagcuacccccaagaaggggucauaucagau

SEQ ID NO: 177484 - RNA, 58 nt, Homo sapiens
ccgggggccccaucugcccugacugcggcuguaccuucccugaucaucaggcccugga

SEQ ID NO: 177485 - RNA, 30 nt, Homo sapiens
ccgcuuaaccaaagcccaugucugcacuag

SEQ ID NO: 177486 - RNA, 37 nt, Homo sapiens
aggaagaugucagcaaagcucuccagcuuggagcgga

SEQ ID NO: 177487 - RNA, 41 nt, Homo sapiens
gccaccccuuuaaggaguccaggguccuucuaacagcaggc

SEQ ID NO: 177488 - RNA, 41 nt, Homo sapiens
acgaagcugacgaccaaggccuggcgggcggcggcggcgac

SEQ ID NO: 177489 - RNA, 45 nt, Homo sapiens
cuucagcccccagagcgacuggaacaucggcugaagcauucuggg

SEQ ID NO: 177490 - RNA, 27 nt, Homo sapiens
uucagagaggcgucaaaggaauauagu

SEQ ID NO: 177491 - RNA, 25 nt, Homo sapiens
cgaggaagggcaggaaccacaauua

SEQ ID NO: 177492 - RNA, 45 nt, Homo sapiens
caugaggaagccgcuugugcugccugggggaugggaggagaguug

SEQ ID NO: 177493 - RNA, 62 nt, Homo sapiens
agacgugaggacccggcguauuuagagaauggugagagcacugggacccgggugggcagugg

SEQ ID NO: 177494 - RNA, 48 nt, Homo sapiens
cccuugagugagaaacauggcuuagguugagucaggauuagguuuuug

SEQ ID NO: 177495 - RNA, 41 nt, Homo sapiens
cauccaucucuaucugucuaggcugauuguugcuacgagaa

SEQ ID NO: 177496 - RNA, 38 nt, Homo sapiens
uuaccaacgcugguggaccaaauaaaucuguaagcgag

SEQ ID NO: 177497 - RNA, 57 nt, Homo sapiens
ggcucgggcccaguuggcuuuggggcaccugagccucagcagacagcagggcuugag

SEQ ID NO: 177498 - RNA, 42 nt, Homo sapiens; identical to SEQ ID NO: 103181

SEQ ID NO: 177499 - RNA, 45 nt, Homo sapiens; identical to SEQ ID NO: 103182

SEQ ID NO: 177500 - RNA, 42 nt, Homo sapiens
ggaaugaugaguagggauauuuuguggcgaggcugggcccag

SEQ ID NO: 177501 - RNA, 46 nt, Homo sapiens
cacggcagcucccggggcccacggacccuuccugagccccagcacc

SEQ ID NO: 177502 - RNA, 29 nt, Homo sapiens
agccaacaaggucuucaggcuugcugcgg

SEQ ID NO: 177503 - RNA, 46 nt, Homo sapiens
guucuccaggggcagcaggggcugaggguggggcaggggcagggug

SEQ ID NO: 177504 - RNA, 41 nt, Homo sapiens
ugccgccgccgcugccgccgccgcagcagccacugggcccc

SEQ ID NO: 177505 - RNA, 42 nt, Homo sapiens
cauagaagcgggguggccuugccaggcgugggggugcugcca

SEQ ID NO: 177506 - RNA, 46 nt, Homo sapiens
gcuuggcuccuccaccaccaccugcugcggccccgggaaccccuca

SEQ ID NO: 177507 - RNA, 30 nt, Homo sapiens
ccuacacuccaugugaugcuuggucuugug

SEQ ID NO: 177508 - RNA, 39 nt, Homo sapiens
gggggccauggggccuccugagguacaccuuugccccug

SEQ ID NO: 177509 - RNA, 46 nt, Homo sapiens
ccuccucccccagcccucggagggcaugaggacuugggugguaggu

SEQ ID NO: 177510 - RNA, 47 nt, Homo sapiens
ggaagggggguuccauguacauauuuaucaccccuuucacauagccc

SEQ ID NO: 177511 - RNA, 38 nt, Homo sapiens
cccacagagaggccagaggcuaggaacacagcaccagu

SEQ ID NO: 177512 - RNA, 41 nt, Homo sapiens
uccuagccucuggccucucuguggggaaaggggacugcagg

SEQ ID NO: 177513 - RNA, 48 nt, Homo sapiens
ccagcaggagaugaccaacagggggcaggaccuggggaccugggcugg

SEQ ID NO: 177514 - RNA, 49 nt, Homo sapiens
aggacccacacaccccacccugguccaacccaccccacacacacucaaa

SEQ ID NO: 177515 - RNA, 42 nt, Homo sapiens
ccagcccgggaagcccgucuguccgcagcaugucagggccag

SEQ ID NO: 177516 - RNA, 46 nt, Homo sapiens
cugcgcucgacccggcugcguccagggucucuaguccccccacuag

SEQ ID NO: 177517 - RNA, 57 nt, Homo sapiens
ucacagauauccuuuuccucucauuucuuuucccucgguuccuagacguuccucgga

SEQ ID NO: 177518 - RNA, 43 nt, Homo sapiens
gaagcagggggagaaccuaaccaagaaccugcccccacaggcg

SEQ ID NO: 177519 - RNA, 44 nt, Homo sapiens
uuggaaggauccugguuggaaggauggggacucucucaaggggc

SEQ ID NO: 177520 - RNA, 44 nt, Homo sapiens
cccacccccaucuccccuacccuagcccacccuagggccucuac

SEQ ID NO: 177521 - RNA, 39 nt, Homo sapiens
ggucuagcgcaggcucaccugagggggcaggcagaggag

SEQ ID NO: 177522 - RNA, 36 nt, Homo sapiens
agugggcgcccaacggauggccacucuuuaguggaa

SEQ ID NO: 177523 - RNA, 49 nt, Homo sapiens
ucgaugagggugacuagggagagaggaagagaggcagagagacagagau

SEQ ID NO: 177524 - RNA, 44 nt, Homo sapiens
uuggggaaaauguugggggucacuuggucuugcucuugccuuua

SEQ ID NO: 177525 - RNA, 44 nt, Homo sapiens
gggaggcugaaaggagugcaccugugcugaggggaggggcgguu

SEQ ID NO: 177526 - RNA, 46 nt, Homo sapiens
uaccuggggugugaagacguauuuauagagcuugaaguggcggaag

SEQ ID NO: 177527 - RNA, 62 nt, Homo sapiens
uccaagcaucugcucccucauuguucccaguacuccgagcuccaggauaaagugacaucggc

SEQ ID NO: 177528 - RNA, 90 nt, Homo sapiens
ccuuaguuugagaugcugaaugcagaguuagaggaaaaccaggaacuggccaacagccguauggcagagcuggagaaacugcaggccgaa

SEQ ID NO: 177529 - RNA, 47 nt, Homo sapiens
guguuguguguccaaaacaguguugugucacugguggucauguugcu

SEQ ID NO: 177530 - RNA, 47 nt, Homo sapiens
aagccagaagcagaugcucucaaaaacaggccuaaggaaucuguucc

SEQ ID NO: 177531 - RNA, 25 nt, Homo sapiens
uguucugaaaggggcugggggcugu

SEQ ID NO: 177532 - RNA, 53 nt, Homo sapiens
aaggucaccucgugcucucagagacaggggugagccagauauggagcccugcu

SEQ ID NO: 177533 - RNA, 46 nt, Homo sapiens
agggggaaggaacaaggucccgcgggacugagcaagucccuucuua

SEQ ID NO: 177534 - RNA, 46 nt, Homo sapiens
ugccagcuucaaaggcaggucagcugggugggggcugcaucaacag

SEQ ID NO: 177535 - RNA, 49 nt, Homo sapiens
ccgaggcugggccaggcucugggagaaaccaggacuaagccuggcccag

SEQ ID NO: 177536 - RNA, 59 nt, Homo sapiens
ccugacccacugcccuagccccacgcuaugcaccaaacuuguucuccccguccuggucc

SEQ ID NO: 177537 - RNA, 45 nt, Homo sapiens
cugcggaccccaacacccccacgagccgccagaggcuccgucccu

SEQ ID NO: 177538 - RNA, 42 nt, Homo sapiens
uccccaguuugacaauagucugccgaauuguccggaccuggg

SEQ ID NO: 177539 - RNA, 101 nt, Homo sapiens
aagaaccccagggcaaggcuaagaggcacugagcccucaacccaagccaggcugaccucaucugcuuugcuuuggcaugugagccuugccuaagggggcau

SEQ ID NO: 177540 - RNA, 46 nt, Homo sapiens
ucgcaccagcuggcaguacugggccucguccgccugguccuugauc

SEQ ID NO: 177541 - RNA, 42 nt, Homo sapiens
ccuuguccucaugcagcgccaggugaugcguggccaacaugc

SEQ ID NO: 177542 - RNA, 41 nt, Homo sapiens
gguccagaucuuugugagcgauuccuccaccacggucugag

SEQ ID NO: 177543 - RNA, 42 nt, Homo sapiens
gagcgcaagaucacucgcaaccaaaagcgcaagcaugaugag

SEQ ID NO: 177544 - RNA, 105 nt, Homo sapiens
aggaaauggcacagcugggacuagaacucaggccuccggcacugguagccucuuuugucuccuaguagcugugucuuaguagaaaaaaugacuugaaguucagug

SEQ ID NO: 177545 - RNA, 46 nt, Homo sapiens
uucuccagguagaaggagcuguuugugcagaagcaugaaggccgcu

SEQ ID NO: 177546 - RNA, 46 nt, Homo sapiens
uccuaacccuguucaucuggcaaaagguccaaacuuggacaucagg

SEQ ID NO: 177547 - RNA, 38 nt, Homo sapiens
ccccgaccagggucagugccaguggcggcagccccccg

SEQ ID NO: 177548 - RNA, 47 nt, Homo sapiens
cugugucacacccaagcugguggaggagcaccucaaaagugcccagu

SEQ ID NO: 177549 - RNA, 43 nt, Homo sapiens
ggguggggggcugcugugugucgggggcggugggggaguguca

SEQ ID NO: 177550 - RNA, 39 nt, Homo sapiens
uauggccagagcagcuauucuucuuauggccagagccag

SEQ ID NO: 177551 - RNA, 52 nt, Homo sapiens
ggagccuguguuggguacagagaauggacuccacuaaaagugaaaggaaauu

SEQ ID NO: 177552 - RNA, 43 nt, Homo sapiens
gcaaagcuauaaucccccucagggcuauggacagcagaaccag

SEQ ID NO: 177553 - RNA, 42 nt, Homo sapiens
uggcgguuauggcaaucaagaccagagugguggagguggcag

SEQ ID NO: 177554 - RNA, 47 nt, Homo sapiens
uauucuuguugucuagggaucugugagggcuuugauuugggggcagu

SEQ ID NO: 177555 - RNA, 50 nt, Homo sapiens
auuaauauccuaggcaagaaacauggaagugaagacuucuuucucugcaa

SEQ ID NO: 177556 - RNA, 38 nt, Homo sapiens
uuggaaaugguaaguaugcagaggugggugggggcaau

SEQ ID NO: 177557 - RNA, 47 nt, Homo sapiens
aaauugcacacgugugugugacaugcucaaaggucagacaaggggug

SEQ ID NO: 177558 - RNA, 57 nt, Homo sapiens
ucaaugaaugcaauucuauguauauggacuuaacugagaugggcaaauagaaacuag

SEQ ID NO: 177559 - RNA, 96 nt, Homo sapiens
ggcucaugggaaauaaccaggucuuaaacagcacaaacugaauucguggaccaggaaggucuuaaacagcacaaacugaauucauggaaaaaugac

SEQ ID NO: 177560 - RNA, 50 nt, Homo sapiens
uacaauauuuauauauggcgaauucagauaaacauuggucaaagaugguc

SEQ ID NO: 177561 - RNA, 45 nt, Homo sapiens
auuugcugaaguguggaguugucucuguggagacucaaguuacag

SEQ ID NO: 177562 - RNA, 57 nt, Homo sapiens
ccuggauguucuuugaaacuauuauaaaaaggaaacugaaaaaaauggggauagaga

SEQ ID NO: 177563 - RNA, 45 nt, Homo sapiens
gggugagaauguuacaauugagucuguggcugauuacuucaagca

SEQ ID NO: 177564 - RNA, 46 nt, Homo sapiens
gggacagcccaugauuaauuuguacacagacagggaaacuggcaag

SEQ ID NO: 177565 - RNA, 54 nt, Homo sapiens
uacucgccgggcagacuuuaaucggggugguggcaauggucguggaggccgagg

SEQ ID NO: 177566 - RNA, 96 nt, Homo sapiens
gggccguggaggcuauggaggugguggcagugguggugguggccgaggaggauuucccaguggaggugguggcgguggaggacagcagcgagcugg

SEQ ID NO: 177567 - RNA, 101 nt, Homo sapiens
caccugugagaauaugaacuucucuuggaggaaugaaugcaaccaguguaaggccccuaaaccagauggcccaggagggggaccagguggcucucacaugg

SEQ ID NO: 177568 - RNA, 67 nt, Homo sapiens
gaauccuuaauuuuucagcggggaggcucggggaacauaggggaaugggaauaugauagaucuuguu

SEQ ID NO: 177569 - RNA, 90 nt, Homo sapiens
ucuuuuguccuaggggguaacuacggggaugaucgucgugguggcagaggaggcuaugaucgaggcggcuaccggggccgcggcggggac

SEQ ID NO: 177570 - RNA, 57 nt, Homo sapiens
caagauggauuccagguaagacuuuaaaucagaauaaaaaaguagagcaguugaaca

SEQ ID NO: 177571 - RNA, 46 nt, Homo sapiens
uuguaaccuuccaauuccugaucacccaaggguuuuuuugugucgg

SEQ ID NO: 177572 - RNA, 45 nt, Homo sapiens
ccgccgaggagcucaagaaguucaagcugaagcugcugucggugc

SEQ ID NO: 177573 - RNA, 42 nt, Homo sapiens
ccgacagcagcuucagcuugaacuucuugagcuccucggcgg

SEQ ID NO: 177574 - RNA, 67 nt, Homo sapiens
ccccggagccgacuuccuccuggucggcggcugcagcggggugagcggcggcagcggccggggaucc

SEQ ID NO: 177575 - RNA, 52 nt, Homo sapiens
ugcuggagggcaacggaccggggcggggagucgggagaccagagugggagga

SEQ ID NO: 177576 - RNA, 47 nt, Homo sapiens
aaagagucagagugauuaauggggucauagcagauagggcuuuguaa

SEQ ID NO: 177577 - RNA, 74 nt, Homo sapiens
accuuggucagccauaaacuuggggaaugagugggugacaggcuggggaggggcugccagcaaggaggaaggag

SEQ ID NO: 177578 - RNA, 45 nt, Homo sapiens
cagccuaagaucuccaaccagaccugugagucccgugggcuggag

SEQ ID NO: 177579 - RNA, 104 nt, Homo sapiens
acagcugggcaaacugaaguugagccaggugugaucuuguggcccaagcccagugagcagagaugccaagaggauuaggggagagaaagcuggccugcaauugg

SEQ ID NO: 177580 - RNA, 46 nt, Homo sapiens
guggggguuggcauggccuggggacugcuggugagggguuggagug

SEQ ID NO: 177581 - RNA, 56 nt, Homo sapiens
gagaucuggagucaggucaguggggaaaucagaauuugggaaccaggaggccugag

SEQ ID NO: 177582 - RNA, 53 nt, Homo sapiens
aggucacgaucauguuaccauaucaagcugaaaaugucaccacuaucuggaga

SEQ ID NO: 177583 - RNA, 36 nt, Homo sapiens
aagccguacuccugccccgagugugaccaucgcuuc

SEQ ID NO: 177584 - RNA, 62 nt, Homo sapiens
aaagugcgggguccugaccgcgccgcagacggggagcccucgcucggucagaggaagaagag

SEQ ID NO: 177585 - RNA, 51 nt, Homo sapiens
gagaugugguccgcgucgagcuucucacgccuaccucgggaagcgcuggaa

SEQ ID NO: 177586 - RNA, 41 nt, Homo sapiens
ggccuguggcauagcccucggagaucagccacgaccugcgg

SEQ ID NO: 177587 - RNA, 42 nt, Homo sapiens
ccccaaggcuccucgauggcggcggcggggcugcggcccgga

SEQ ID NO: 177588 - RNA, 51 nt, Homo sapiens
ggggcaaggagacggguggguaugggaacucacccagcucucggugccggc

SEQ ID NO: 177589 - RNA, 56 nt, Homo sapiens
gaggcugggguucacaggucagcgugcugguggggagcagucaggacagugcugaa

SEQ ID NO: 177590 - RNA, 42 nt, Homo sapiens
uccagcgggcacagugggcagccagccggggccggcccaggc

SEQ ID NO: 177591 - RNA, 46 nt, Homo sapiens
cggacacgggcggugccagguagcuagagacugccuggauguaauc

SEQ ID NO: 177592 - RNA, 45 nt, Homo sapiens
cgcccugcgaaggaaacaggucagccugcugaggaugugcaagcc

SEQ ID NO: 177593 - RNA, 41 nt, Homo sapiens
gcucccccagcuuugucagcucaggucugucuacacccaga

SEQ ID NO: 177594 - RNA, 43 nt, Homo sapiens
acccuacauggcugcccugugcccucgggauaaaccccaagcc

SEQ ID NO: 177595 - RNA, 44 nt, Homo sapiens
cuggcccuaaagucucuugcacaccagcucgucacugccugccc

SEQ ID NO: 177596 - RNA, 31 nt, Homo sapiens
ggaggcccaagcccagggcaggaaccuggag

SEQ ID NO: 177597 - RNA, 50 nt, Homo sapiens
ugaaugaaugaauaaaugaauggaugguuuaaaaauucauacagugggag

SEQ ID NO: 177598 - RNA, 42 nt, Homo sapiens
ccagagcacacuugaacugaauguuccaggucugagccucag

SEQ ID NO: 177599 - RNA, 184 nt, Homo sapiens
ugggagcagagcccccccgggacucaggggucucaccguccaucagagaggguccccuugccugcauggcagcugaugaacugaggauguuuuucuuuuggaaauuguauuuuguacagaauacacguccgcugauguccuguacacugagaccuaacaggcacuuguagggucgugucuggag

SEQ ID NO: 177600 - RNA, 46 nt, Homo sapiens
cuucaugugaccuugggccacauuccaguuccuaccucugccacau

SEQ ID NO: 177601 - RNA, 86 nt, Homo sapiens
uuacccggccagcagcccagcccuccuuccaccaagcccagaagacgcacuacccagcgcagcagggggaguaccagacccaccag

SEQ ID NO: 177602 - RNA, 44 nt, Homo sapiens
uguagacaacuuugaaggcaagaagacugacaaaaaguaccuga

SEQ ID NO: 177603 - RNA, 28 nt, Homo sapiens
uuguagcucuggacuggagggguagaug

SEQ ID NO: 177604 - RNA, 41 nt, Homo sapiens
aggaauaucuguauguuggaugacuuuaaugcuacauuuua

SEQ ID NO: 177605 - RNA, 43 nt, Homo sapiens
gggcggggggcaccccgggccagggcggggagaggagggggcg

SEQ ID NO: 177606 - RNA, 110 nt, Homo sapiens
accucauaggcacucgguuuaaagccuuugucuuugacuuuaauaccacagcacaauuaaauuguauuguaauguauaauuuugagauuuuugugugacuugauguugug

SEQ ID NO: 177607 - RNA, 49 nt, Homo sapiens
cagagcagucccugcccucagagcgcugacaguccaguuucuuguaaga

SEQ ID NO: 177608 - RNA, 44 nt, Homo sapiens
ggccccacugcuuucuuaggaaggccuacuaguugcuuugccag

SEQ ID NO: 177609 - RNA, 47 nt, Homo sapiens
guucaaggaaauguguaucaaacuuugcauuuauaagauagcaccug

SEQ ID NO: 177610 - RNA, 50 nt, Homo sapiens
uuuuguguuggugauugucuuuuuagagccguaauauccuuugucuuuag

SEQ ID NO: 177611 - RNA, 46 nt, Homo sapiens
cuacugaucuacuucuugccuggaaucccauuuguuugggguuggu

SEQ ID NO: 177612 - RNA, 44 nt, Homo sapiens
aucucaaaggagaguaguaggaauaaagcuggagaggcaggcag

SEQ ID NO: 177613 - RNA, 33 nt, Homo sapiens
ucuggaaaaucuaauuuuccuuugcuagauucu

SEQ ID NO: 177614 - RNA, 23 nt, Homo sapiens
cuguauuugguagguuuuuaaaa

SEQ ID NO: 177615 - RNA, 46 nt, Homo sapiens
agucacaucuuagcacagugaauaaaucacugcaaucaguuaggag

SEQ ID NO: 177616 - RNA, 119 nt, Homo sapiens
guggucagcccccuuuauauguacuucuccuccuugccauucuuuggucccaaaauaggugauugauaggcagugagaauaccugugauguaggauauuuugaaagaagggagaggugg

SEQ ID NO: 177617 - RNA, 58 nt, Homo sapiens
uccucagggaugccuccuccucuccucucccugcccccgauuaaagcucuugcccugg

SEQ ID NO: 177618 - RNA, 46 nt, Homo sapiens
agagauuuucaggcaaaaggaaaaugauuccagaugggagcaugga

SEQ ID NO: 177619 - RNA, 85 nt, Homo sapiens
uauuaugacucuccucuuucagaucuuccaugguggcuuauucuaauucggcagaaagcauuggugggcaaacucccaggagacc

SEQ ID NO: 177620 - RNA, 45 nt, Homo sapiens
gauguggacuuuuggauuauccccaugauccaagguuuugugcag

SEQ ID NO: 177621 - RNA, 44 nt, Homo sapiens
cacgauuucuaguggcucucauuucacgccgaaguaggcacaga

SEQ ID NO: 177622 - RNA, 22 nt, Homo sapiens
aucuaggaaauaguuuuuauuu

SEQ ID NO: 177623 - RNA, 43 nt, Homo sapiens
aguuuauucaaaaggauguacaacccaaaagagagcuggacaa

SEQ ID NO: 177624 - RNA, 44 nt, Homo sapiens
ugguggucccauugcugucaccagugauugguucaggcacggac

SEQ ID NO: 177625 - RNA, 70 nt, Homo sapiens
ucuuagagguacuuugucucaguuuucaggcauuucaaaauuaucagagacggaaaaugauucugaguac

SEQ ID NO: 177626 - RNA, 63 nt, Homo sapiens
aaggacauaauguuuuugacuggggaucauguuuggcugauguaaauauuaaugccaaaauag

SEQ ID NO: 177627 - RNA, 68 nt, Homo sapiens
uagaaucgaucuguguguucccggucuuggcaucucauuaugucauuugcuguauuuuuugauauauu

SEQ ID NO: 177628 - RNA, 36 nt, Homo sapiens
gaacacuaccuggauucuaauucuuguuuucaucau

SEQ ID NO: 177629 - RNA, 36 nt, Homo sapiens
ccugcgcacuucuuugguuacaaggguaugaugaau

SEQ ID NO: 177630 - RNA, 45 nt, Homo sapiens
cauauugacuggcuuugccaagccuauggauauuuacugccacag

SEQ ID NO: 177631 - RNA, 37 nt, Homo sapiens
uuuauuuaaaaauaugaaauuuucaccucuuggggua

SEQ ID NO: 177632 - RNA, 75 nt, Homo sapiens
acuugucacacaguaaaccugauacaucagaggugaauaccagcaccuauuagguuucauuuugcuguuuucagg

SEQ ID NO: 177633 - RNA, 41 nt, Homo sapiens
uaaacucuacagaaauuaguucgaaagagaucuuugaaaaa

SEQ ID NO: 177634 - RNA, 50 nt, Homo sapiens
aucuaucucugaauaagaggaguccuuuaaacggaaugaauguggcuuuu

SEQ ID NO: 177635 - RNA, 40 nt, Homo sapiens
ucaugucuuuuuuuauuccucuguuacuccauuauugucu

SEQ ID NO: 177636 - RNA, 31 nt, Homo sapiens
agguggauuaugacuucagcuaccaucagau

SEQ ID NO: 177637 - RNA, 45 nt, Homo sapiens
caacacaucaacccauuauugccugccugccuuaacaaagaggag

SEQ ID NO: 177638 - RNA, 561 nt, Homo sapiens
uguaguuuaguuuagagguuguauuaggggucucuaaagggucagaacugauaggauagaugaauauaugaaggggaguuuauuaggagaaugacucacaugaucacaagguaaaaucccacaauaggcuggggagcaaggaagccagccugagucccaaaaucucaaaaguagggaagccaccaguguaggcuucaguccguggcugaaggccuaagagcuccuggugaaccacugguguagguccaagaguccaaaagcugaagaacuuggagucugauguuugagggcaggaagcauccagcaugagagaaagguggaggcggaagacucagccagucugcucuuuacaugccugccuuuaugcuggcagcugauuagaugcugcccacccagacugagggugggucugccucucccagcccgcugacucaaauguuaaucuccuuuggcaacacccucacagacacauccaggaacaauaauuuucauccuucaauccagucagauugacaaaguauuaaccaucacagagguuaagagcacagacaggcaggcagc

SEQ ID NO: 177639 - RNA, 46 nt, Homo sapiens
cucgagucagucccucaacauccuacacuccuagucgccacaagag

SEQ ID NO: 177640 - RNA, 45 nt, Homo sapiens
acccugaguuuuacaugggaguuuaugaaacgguuaaccaaaaca

SEQ ID NO: 177641 - RNA, 45 nt, Homo sapiens
gaguacacucggugggagaagagcggggcucugaaguggccccag

SEQ ID NO: 177642 - RNA, 68 nt, Homo sapiens
uaaaaugccauuccuccucccccuggagagguaggauagggcaggugauaggaggccagagcccgggg

SEQ ID NO: 177643 - RNA, 21 nt, Homo sapiens
ccccagcccucucucguuggg

SEQ ID NO: 177644 - RNA, 42 nt, Homo sapiens
cuggagcaacucaaagccuaguguaguguagggcugaccuag

SEQ ID NO: 177645 - RNA, 50 nt, Homo sapiens
agacaagguugccuccaguugccgucagugcagcccucacuaaagaaaag

SEQ ID NO: 177646 - RNA, 60 nt, Homo sapiens
ccuguaaggcuggagaaacaggccuuguucccuuagucucucuaaucaaaaugagguugc

SEQ ID NO: 177647 - RNA, 51 nt, Homo sapiens
uguuugucggcuuguccuucuaacacucgugucucaggcgagcagccuggg

SEQ ID NO: 177648 - RNA, 46 nt, Homo sapiens
cucaguggacugaggcuggaacugggccuuccaguggccaggccag

SEQ ID NO: 177649 - RNA, 45 nt, Homo sapiens
gaucgugacaaaugcccacguggugaccaacaagcaccgggucaa

SEQ ID NO: 177650 - RNA, 61 nt, Homo sapiens
ugucacucauccucaugaaggaagcgccugggagccuggaaugcacaucgcacugccccag

SEQ ID NO: 177651 - RNA, 45 nt, Homo sapiens
ggacacagucacgucuugaugugaugucuggaauggugguggccg

SEQ ID NO: 177652 - RNA, 47 nt, Homo sapiens
gcccaggcccagaguaaacacacugcgcugagcucgcuggugugcug

SEQ ID NO: 177653 - RNA, 46 nt, Homo sapiens
agagcugcggccgggagaguucguggucgccaucggaagcccguuu

SEQ ID NO: 177654 - RNA, 88 nt, Homo sapiens
cacagucaccaccgggaucgugagcaccacccagcgaggcggcaaagagcuggggcuccgcaacucagacauggacuacauccagacc

SEQ ID NO: 177655 - RNA, 52 nt, Homo sapiens
cccaucugauaagauuaaaaaguuccucacggagucccaugaccgacaggcc

SEQ ID NO: 177656 - RNA, 46 nt, Homo sapiens
gguggucucaaggaaaacgacgucauaaucagcaucaauggacagu

SEQ ID NO: 177657 - RNA, 64 nt, Homo sapiens
guccgcagggguaaugaagauaucaugaucacagugauucccgaagaaauugacccauaggcag

SEQ ID NO: 177658 - RNA, 48 nt, Homo sapiens
aguggagacucccuggccaacagaauccuucuugauaguuugcaggca

SEQ ID NO: 177659 - RNA, 55 nt, Homo sapiens
uccuccuuuaacugagucaucaucuuaguccaacuaaugcagucgauacaaugcg

SEQ ID NO: 177660 - RNA, 69 nt, Homo sapiens
aggaaucucuuuggaauugggagcacgaugacucugaguuugagcuauuaaaguacuucuuacacauug

SEQ ID NO: 177661 - RNA, 94 nt, Homo sapiens
augcagcaaaaaagggaguugucaaggcugaaaaaagcaagaaaaagaaggaagaggaggaagaugaggaagaugaagaggaugaggaggagga

SEQ ID NO: 177662 - RNA, 32 nt, Homo sapiens
ugucuggggcaguuacuugggucuuggaugcu

SEQ ID NO: 177663 - RNA, 45 nt, Homo sapiens
gaguuguaacuuuuauuacaguuuuuucuaauguauccuugacag

SEQ ID NO: 177664 - RNA, 42 nt, Homo sapiens
cagucagcuggauggauuuagaaagggaagaugcuuagaagg

SEQ ID NO: 177665 - RNA, 56 nt, Homo sapiens
aggcagagcuugaugcacaaauggauuccuggucuccuugguccacaggaugggaa

SEQ ID NO: 177666 - RNA, 32 nt, Homo sapiens
auauuucauucccgagaaacuaaaagaaucug

SEQ ID NO: 177667 - RNA, 32 nt, Homo sapiens
uuauauuacuuggaucagggaaaaaaaugcag

SEQ ID NO: 177668 - RNA, 50 nt, Homo sapiens
uacuuuuuuggauuuuaucaucuuuucccuuuuaguaauagaguaauaca

SEQ ID NO: 177669 - RNA, 46 nt, Homo sapiens
agaguucacacuauaaaugguguauggacuuggcaggcaggaacau

SEQ ID NO: 177670 - RNA, 46 nt, Homo sapiens; identical to SEQ ID NO: 103449

SEQ ID NO: 177671 - RNA, 69 nt, Homo sapiens
aucaucccagaccuaauaacauugaagcaauagaauuggcagagacugaagaggcuucuucaauaauaa

SEQ ID NO: 177672 - RNA, 140 nt, Homo sapiens
caguagaguaaaugauagcaacuuagguauagccagguauagcugggguagagucaguggagauggggaaagggagauuuauuugaaaaagacugaaguagaauuggcaaaacuuggaagaauugauacugggcugagau

SEQ ID NO: 177673 - RNA, 56 nt, Homo sapiens
aagccagauuuuugguuuggacaucuggguuggcuaacaguaucauuuuuccugga

SEQ ID NO: 177674 - RNA, 46 nt, Homo sapiens
uucugguuauauuuuuaaaaagcacuuaaugaaagcagaauuggug

SEQ ID NO: 177675 - RNA, 46 nt, Homo sapiens
uuagaggggccauugugagucauugagcuccugagacagucugagg

SEQ ID NO: 177676 - RNA, 52 nt, Homo sapiens
gcuguauuccgugggacguguagaacaacccuggaacagcgugggagaggug

SEQ ID NO: 177677 - RNA, 43 nt, Homo sapiens
cauggacccuaaguuaagaacucccagccuacggagaugguug

SEQ ID NO: 177678 - RNA, 41 nt, Homo sapiens
gauuacagugaucacacagacauccuuacaguauugggggg

SEQ ID NO: 177679 - RNA, 45 nt, Homo sapiens
ugugauaauaaagcauccuuaguuaucugaaucucugguuccuga

SEQ ID NO: 177680 - RNA, 42 nt, Homo sapiens
ugcucagggaguggcuggacugcugugugacggaggggggag

SEQ ID NO: 177681 - RNA, 47 nt, Homo sapiens
uggaccacacacaccuuauggagauaaugccucugcugcgugaggag

SEQ ID NO: 177682 - RNA, 41 nt, Homo sapiens
cuccaugugagcuuguguuaauagacacuuuuaugguagag

SEQ ID NO: 177683 - RNA, 45 nt, Homo sapiens
gauacagcaaauccugcaggguguagacccucugcacgcccaggg

SEQ ID NO: 177684 - RNA, 59 nt, Homo sapiens
cugaugccagagguucaagaaaaucuuuggcggcugggacaauuuucauuccucgggca

SEQ ID NO: 177685 - RNA, 32 nt, Homo sapiens
ccuuucuccuuggugaaacccacccucuaccc

SEQ ID NO: 177686 - RNA, 45 nt, Homo sapiens
cagcuccaugggcaccguguaugccguggaguaggcuguucuggg

SEQ ID NO: 177687 - RNA, 55 nt, Homo sapiens
aaaaaacaaacaaaaacaaaacaaguccugauuuuauaaugcaucuguacaaaga

SEQ ID NO: 177688 - RNA, 42 nt, Homo sapiens
caucuacuuauaggacagacaauuccauaugggcagcugcag

SEQ ID NO: 177689 - RNA, 50 nt, Homo sapiens
guuugcugugagacaaguaugaucuuaagauauacaacuuuuuuuccugg

SEQ ID NO: 177690 - RNA, 45 nt, Homo sapiens
ccugcagacaguucucccuguucuggaaucuuccggucggcccca

SEQ ID NO: 177691 - RNA, 58 nt, Homo sapiens
uuuauuucuccgcaagccacauacguguuuuaccccacacgucaugaggccuguggca

SEQ ID NO: 177692 - RNA, 67 nt, Homo sapiens
ccaaacacgucgacucgugcgaaaggccucaugcacgauccuuucuugcuguggcaaaaccguuaag

SEQ ID NO: 177693 - RNA, 554 nt, Homo sapiens
ucauuaauuguaacaaaugcaucauaccggcugggcacggguggcucaggccuguagucccagcacuuugggaggccgaggcaggcggaucacaaagucaggagaucuacaccacccuggcuaacaaggugaaacccggucucuacuaaaaauacaaaaaauuagccaggugugguggcacgugccugcaggcccagauacuugggaggcugaggcaggagaaucccuugaacuggggaggcagauguugcagugagccgagaucgugccacugcacuccagccugagugacagagagagacucugucucaaacaaacaaacaaaaaacaaauguaucguacuaauguaagauguuaauuauagggaaaggccaggugggguggcucaugccuguaaucccagagcuuugggaggcugagccggcaggauagcuugaguccagaaacuacagacuucagcgagcuaugauggggccacuacauuccagccugggugacagugagacucaauuucuaaaaaaugauaaugauaauaauaauaauaaugauuacca

SEQ ID NO: 177694 - RNA, 123 nt, Homo sapiens
cacauccagaugcucccgagccgugugccagggcugccacgaccucguaucugugccccacucacccaugcaaccaccgccugcugagaggggaaacagaggcagcgaggggcaggcucccug

SEQ ID NO: 177695 - RNA, 45 nt, Homo sapiens
caggacuggacacauaaaauggccagcaucucugcgugcugcccc

SEQ ID NO: 177696 - RNA, 48 nt, Homo sapiens
guuuauauacauaaagaaaagccacauuuucaagacacauguaaugag

SEQ ID NO: 177697 - RNA, 42 nt, Homo sapiens
cacuucgucaccucaaacugccuguucuguggcaaccccaag

SEQ ID NO: 177698 - RNA, 46 nt, Homo sapiens
caagcugcgacaccaauacaucagcaggagaaaugaggcggauugc

SEQ ID NO: 177699 - RNA, 48 nt, Homo sapiens
auacacuacuaguauuugccauccagcugaccaagggaauggccuaau

SEQ ID NO: 177700 - RNA, 46 nt, Homo sapiens
uuaaagaguugcuauaacucauucaagugagauaaaaaccauccag

SEQ ID NO: 177701 - RNA, 39 nt, Homo sapiens
acaccugacucaagcauuuccccucgcugggguauaaag

SEQ ID NO: 177702 - RNA, 46 nt, Homo sapiens
ggcaucucccacaugcuaagccuuuggcugugugcauuuacugcug

SEQ ID NO: 177703 - RNA, 46 nt, Homo sapiens
cauucagucgaccaagaagacuuuauuuuuaacagcauggggccag

SEQ ID NO: 177704 - RNA, 61 nt, Homo sapiens
agcacguccuucuuucuccccuucucccgcccccaccccugugaaaacaccaggcccgagg

SEQ ID NO: 177705 - RNA, 57 nt, Homo sapiens
cucucugggaaccaaagcuaguccccucaaggcucugcuaggagugugacaggugag

SEQ ID NO: 177706 - RNA, 33 nt, Homo sapiens
aaucaucaacauugcuuagcuuuaaagcugcuu

SEQ ID NO: 177707 - RNA, 54 nt, Homo sapiens
uugggaaucucugaagacaacagucuggucuauucugccauugucuuaguaagg

SEQ ID NO: 177708 - RNA, 49 nt, Homo sapiens
cuagucuuuugaaaugacuguuuuugccuuggaaauaauaagccaccau

SEQ ID NO: 177709 - RNA, 52 nt, Homo sapiens
caaccaguucccuccaaggauggugaccugcacauacaacaucaaggcaccg

SEQ ID NO: 177710 - RNA, 68 nt, Homo sapiens
aaaucuucuuucaaccauuuuucaugccaaauguucaauaacuagacucgaguguguggguguguguu

SEQ ID NO: 177711 - RNA, 54 nt, Homo sapiens
cccacccaagcuucguaguauuaaagguaucugcugucccuuggggcaggguag

SEQ ID NO: 177712 - RNA, 44 nt, Homo sapiens
auuucacgcacaugaccuacuauucacaccuggagccccacagg

SEQ ID NO: 177713 - RNA, 57 nt, Homo sapiens
cuuacaacacacccucuccuuacccucauuuuacagauucagaaaccgaagcccuuu

SEQ ID NO: 177714 - RNA, 52 nt, Homo sapiens
cacccucuuccagguggagugaaguggaaggagaccuguuuaaaaacugcag

SEQ ID NO: 177715 - RNA, 57 nt, Homo sapiens
aaccaaggauuuccagaauacacaugugcucacaaguguacacacguguucacaaaa

SEQ ID NO: 177716 - RNA, 55 nt, Homo sapiens
uacagcaaaauauacucuuuauugauugcccuccuagugugacuucuauuccgua

SEQ ID NO: 177717 - RNA, 62 nt, Homo sapiens
cagcugggcaucuacgcugagccucuauccaguccgcagggcagauagagcaauccagagug

SEQ ID NO: 177718 - RNA, 38 nt, Homo sapiens
uuuuaaauuccaucuuggaaaaagaaaagccccauuag

SEQ ID NO: 177719 - RNA, 47 nt, Homo sapiens
uaucuuucugaacaggaaaaagaauuaaacccaaaccaccuagucag

SEQ ID NO: 177720 - RNA, 47 nt, Homo sapiens
ucgaacccaaacaccuaguagagaaagcuaucuuuuuugaaagggug

SEQ ID NO: 177721 - RNA, 38 nt, Homo sapiens
gccgcggagggcugggaggaggaggaaccgcggcggcc

SEQ ID NO: 177722 - RNA, 41 nt, Homo sapiens
uuguccccgcggcgcgucgcgcgcucggccugggucgccgg

SEQ ID NO: 177723 - RNA, 41 nt, Homo sapiens
gcucccgguucggucccucgcuccucgggccgccgccggcu

SEQ ID NO: 177724 - RNA, 42 nt, Homo sapiens
ccaacuuggaucgggggagggaacguccuggaugccgagcgc

SEQ ID NO: 177725 - RNA, 24 nt, Homo sapiens
cacacaagcgcggcgggcgggagg

SEQ ID NO: 177726 - RNA, 40 nt, Homo sapiens
auuguuaucugggguuggggagugcgacaggaagcagaga

SEQ ID NO: 177727 - RNA, 39 nt, Homo sapiens
cuuugaaaagaccaccguuuaguucaucaugugaguaug

SEQ ID NO: 177728 - RNA, 42 nt, Homo sapiens
uugaaagaguuuuaucaaagacucauugaucagaaguggcag

SEQ ID NO: 177729 - RNA, 43 nt, Homo sapiens
agucagguuaguacuuaaaugcuaauucuagaaacucacauag

SEQ ID NO: 177730 - RNA, 43 nt, Homo sapiens
uucgcaauagaauuuacaagagcuauuauagguggggagauca

SEQ ID NO: 177731 - RNA, 46 nt, Homo sapiens
ggcagcgauauagugaagcucuaugaccucacuacucuuugugaag

SEQ ID NO: 177732 - RNA, 78 nt, Homo sapiens
ucccugugcuauauaggacaguacuuuuuucgugacucuuguggucaugucuguuguauuggacaugucucugcccug

SEQ ID NO: 177733 - RNA, 36 nt, Homo sapiens
ccugguggaguucucgcuggaucguguaggagccac

SEQ ID NO: 177734 - RNA, 58 nt, Homo sapiens
ggccuuagaacucccaagugagagucuuuuaacacggccauuucacuccaguguauuu

SEQ ID NO: 177735 - RNA, 43 nt, Homo sapiens
ugagaaauuuauugugucauagaucuggagacuggaaguucaa

SEQ ID NO: 177736 - RNA, 45 nt, Homo sapiens
cccuuacaaucucauuuaaucuuaauuacgucuuuaaaggaccug

SEQ ID NO: 177737 - RNA, 40 nt, Homo sapiens
uccuggguaaaaguugaauaaacucaaauguguaaaauua

SEQ ID NO: 177738 - RNA, 46 nt, Homo sapiens
ucuagauuuauauuaaagaaaugaacguuuuguauuuaaaacuuua

SEQ ID NO: 177739 - RNA, 44 nt, Homo sapiens
gacugaggagagggugcaggaugugacccagagcccaaggacag

SEQ ID NO: 177740 - RNA, 42 nt, Homo sapiens
caacacacacauagacacacagaaacggggaagaaaauugcc

SEQ ID NO: 177741 - RNA, 29 nt, Homo sapiens
cucaguaaguguuggggggauggguggaa

SEQ ID NO: 177742 - RNA, 33 nt, Homo sapiens
gacacaggggcuggggugccugggagugggagg

SEQ ID NO: 177743 - RNA, 79 nt, Homo sapiens
cucuuccucgucgcgcuggacugggggauccggcggcugcggaaccccacuuuccacggcacgccgcuuagaccuggac

SEQ ID NO: 177744 - RNA, 28 nt, Homo sapiens
agagccuucaagaaacugagggcccaag

SEQ ID NO: 177745 - RNA, 96 nt, Homo sapiens
cagaauuagugcugagaaaugucuggauaacaggauuuacugaugggcuggauauaggaugaggaaagggaggaauuaaaguuaagccccagguuu

SEQ ID NO: 177746 - RNA, 46 nt, Homo sapiens
ugaguaguugaacuugagaauugccuucuaaaccaaauaaguaacc

SEQ ID NO: 177747 - RNA, 44 nt, Homo sapiens
cccaaaggucgcugccuccuccaugccugccauguugccugaaa

SEQ ID NO: 177748 - RNA, 41 nt, Homo sapiens
uuguccuuugggaaauacacgacuaggauacagccacauau

SEQ ID NO: 177749 - RNA, 47 nt, Homo sapiens
ggacuccauaaauuuuuggauggacucaccaacaucacacagaugaa

SEQ ID NO: 177750 - RNA, 42 nt, Homo sapiens
guuuguaaaugagauacuucaguuguauauuuauuuuguaaa

SEQ ID NO: 177751 - RNA, 23 nt, Homo sapiens
agauccuauguuuggaagcacag

SEQ ID NO: 177752 - RNA, 66 nt, Homo sapiens
ccagauuaacuguucaccugucgaaggacaucugaguuuggcugugacaaauacagcugcugucaa

SEQ ID NO: 177753 - RNA, 49 nt, Homo sapiens
acaagauuuguuuucaaguccuccuaacgucauaaguguuuuccugaca

SEQ ID NO: 177754 - RNA, 44 nt, Homo sapiens
gggagagauuucaucauagcaaaaugucaugaacugccuggaga

SEQ ID NO: 177755 - RNA, 39 nt, Homo sapiens
ccacguuuuuaaaaacugguuuagaaaauucucacuggg

SEQ ID NO: 177756 - RNA, 52 nt, Homo sapiens
gccucagagugugaccuuacuuggaaauggggucaucacagauguaauucgu

SEQ ID NO: 177757 - RNA, 38 nt, Homo sapiens
ugaggauggaggcagaagugggcguuacacggccgcaa

SEQ ID NO: 177758 - RNA, 50 nt, Homo sapiens
uuuuugguuuagcaaguuugauuuucuuuuuuucuaugauccuuuccagg

SEQ ID NO: 177759 - RNA, 43 nt, Homo sapiens
uaagacguuaaucuuugucaguuucagaaaagaaaggacauau

SEQ ID NO: 177760 - RNA, 47 nt, Homo sapiens
ccaaaggguauauuuccugcuucauauauucaucuuaaagaagcgau

SEQ ID NO: 177761 - RNA, 26 nt, Homo sapiens
gugggauggcuaaaucaaacuaugug

SEQ ID NO: 177762 - RNA, 42 nt, Homo sapiens
uugaauggcgaucacaaauucuuucuggaacucugccucagg

SEQ ID NO: 177763 - RNA, 46 nt, Homo sapiens
uguuguucuagaauucuagauuuggaccuggugguuagagaugaag

SEQ ID NO: 177764 - RNA, 46 nt, Homo sapiens
cagaacauagauauuaacagacaagccaaguuugcugcaaccccuu

SEQ ID NO: 177765 - RNA, 40 nt, Homo sapiens
uaccuaaagacauagacagauuacauaauuugcgagccgu

SEQ ID NO: 177766 - RNA, 49 nt, Homo sapiens
ccucggaagcaaagaccugaaaagggagaaaaucaguuuugucugucag

SEQ ID NO: 177767 - RNA, 45 nt, Homo sapiens
aggaaacugaccucgggguugcggcgaccuuuuggaguggcuggu

SEQ ID NO: 177768 - RNA, 48 nt, Homo sapiens
ugauggauguaacagauauaauaaauggaaaaguagaugaugaagaua

SEQ ID NO: 177769 - RNA, 46 nt, Homo sapiens
auuuauucuaguagcuauuuguauuuucaaagcacaauacuuccaa

SEQ ID NO: 177770 - RNA, 37 nt, Homo sapiens
gcugaaggguuuaggaggcggguaguaauuggguggc

SEQ ID NO: 177771 - RNA, 52 nt, Homo sapiens
uauuucaaggaacggugcccccgggacuugcuagugguugugccugcaaggg

SEQ ID NO: 177772 - RNA, 80 nt, Homo sapiens
agccagcuaggaucaugcgguggccucccugcugcgauuccauccccacugugcucuguucuccugccuacccauucccu

SEQ ID NO: 177773 - RNA, 45 nt, Homo sapiens
gguuuguggguaacauugaaauuacuuccuggagauauccaucag

SEQ ID NO: 177774 - RNA, 44 nt, Homo sapiens
agcuguggcucgaaaaacaggguuuccggagauaaucaugccug

SEQ ID NO: 177775 - RNA, 67 nt, Homo sapiens
agauuuugauaaaggaagcaaaacaacagcgaagaacguggaggucacggugucuguguacgaugag

SEQ ID NO: 177776 - RNA, 54 nt, Homo sapiens
cuugaauauuugaaaaccaggccagggguuggcucuggaauacagauguuugau

SEQ ID NO: 177777 - RNA, 365 nt, Homo sapiens
auauagacccuuccagguuggggcuaagaagaaaaacggcaacuuuucuuuuuuugagacggagucucauucugucacccagacuggagugcaguggugcaaucucggcucacugcaaccuccacuuccuggguucaagcgauucucuugccucagcuuccugaguagcugggauuacaggcauguaccaugaugccuggcuaauguuuuugguauuuuuaguagaguugggguuuuaucauguuggccaggcuggucucgaacuccugaccucaagugauccacccuccucggccucccagacugcugggauuacaggcaugagccaccaugcccggcccaaaaacagcaacguuuaaaaguag

SEQ ID NO: 177778 - RNA, 46 nt, Homo sapiens
uuuugcagaggcauuuugucuuuggaaaaaucauauaggggacuag

SEQ ID NO: 177779 - RNA, 32 nt, Homo sapiens
aggcucauuucccaccggaaccuauuccuugg

SEQ ID NO: 177780 - RNA, 46 nt, Homo sapiens
cuccuuccagaucuccacgcucgugugcuccaccaaacugacucag

SEQ ID NO: 177781 - RNA, 50 nt, Homo sapiens
cccauaaggcauucauugcaucgggcugugaugauuuaucaaugcauaga

SEQ ID NO: 177782 - RNA, 365 nt, Homo sapiens
uucacacuucuacucuggucuaaggguuauucuuuuauuuuuauuuuuauuuuuuaagacaaggucucagucucgcucuguugcccaggcuggagugcaguggugugaucucaacucacuccagccuuguccuccuaggcucaggcgauccucccaccucagcuucccauguagcugggaccacaggugugcagcaucacgcuuggcuaauuuuauuuuuauuuuuuauagagaugaggucucacuuuauugcccaggcuauucccaaacuccuggguucaggcaaaccucccgccucggucucccagagugcugggauuacaggcacgagccacugugcccagcuguauuacucuuaaagggag

SEQ ID NO: 177783 - RNA, 45 nt, Homo sapiens
gacacguuggaugcccucuucaacaucaugauggagaacucagag

SEQ ID NO: 177784 - RNA, 45 nt, Homo sapiens
gaguauaguagucauuguguuuuuaaaacuaaauguuuuugggga

SEQ ID NO: 177785 - RNA, 43 nt, Homo sapiens
caggauaucuuuauauggcaaaaagucccaaaagaaaaacaac

SEQ ID NO: 177786 - RNA, 38 nt, Homo sapiens
ugacaagguauaucggggcauuggaaguaguuuagggg

SEQ ID NO: 177787 - RNA, 49 nt, Homo sapiens
gaaaagacugugaaguugaaacagaaguagagcuucauaaugcagaaaa

SEQ ID NO: 177788 - RNA, 59 nt, Homo sapiens
ugggaggagagcagacuuuaaauaugucccaggaaacguuuuauugagaaacaugucaa

SEQ ID NO: 177789 - RNA, 45 nt, Homo sapiens
uucagagucacccagccugaaagggacuuagaaucccaugguugc

SEQ ID NO: 177790 - RNA, 50 nt, Homo sapiens
aagcaacuguagagaagcagcaggagcuuguuuaaggggugggaggugug

SEQ ID NO: 177791 - RNA, 61 nt, Homo sapiens
gauacuguggaacuggaccguuuuccugucugucgacuucugaauuuuaaguguuuuucag

SEQ ID NO: 177792 - RNA, 47 nt, Homo sapiens
uaaauugacauuugggauugagugaaccgaagcauuggugguagaga

SEQ ID NO: 177793 - RNA, 44 nt, Homo sapiens
ccacggacuuuguccuccuucccacuuucgucccucacccccag

SEQ ID NO: 177794 - RNA, 27 nt, Homo sapiens
acacuugaaacucugacaaauaaccaa

SEQ ID NO: 177795 - RNA, 50 nt, Homo sapiens
cucagggggcacaaccccuucucugagggugucaucaugacauuuuugau

SEQ ID NO: 177796 - RNA, 23 nt, Homo sapiens
uucuauggagaauugccucuuca

SEQ ID NO: 177797 - RNA, 53 nt, Homo sapiens
gcccaggcgaaugcuugucacgugccgugugugaccuccuucucagugugcuu

SEQ ID NO: 177798 - RNA, 223 nt, Homo sapiens
uuuuuaauuuauuuuuuaagagauaggggucucacucuguugcccaggcuguagugcaguggcgcgaucauagcucacugcagcuucaaacuccuggccucaagcaccccucccgccucugccuucaaagcacuggaauuaccgacgugcgccaccgcucccaccccagggaugcacagucguuuaaaccccagacauucaauagcacaguccucaacuacuu

SEQ ID NO: 177799 - RNA, 67 nt, Homo sapiens
ccacugagcggugaaacggaauaaaaaaugauuauccuuccuguacuuuaugucuaccauaggucac

SEQ ID NO: 177800 - RNA, 50 nt, Homo sapiens
gagaaggguaauugacauguaaugcagguaauagaucauugagaaaugaa

SEQ ID NO: 177801 - RNA, 49 nt, Homo sapiens
cuacagugaauaagcuuuguaccacagcaaguaaaauccuccgaaaauu

SEQ ID NO: 177802 - RNA, 42 nt, Homo sapiens
uacuuaucauuuuguccucacuuaguuuguuuuggaugggag

SEQ ID NO: 177803 - RNA, 52 nt, Homo sapiens
gcuauuaggaaauauugaagucagauuucuacacuauuaucauugugauuug

SEQ ID NO: 177804 - RNA, 46 nt, Homo sapiens
gauuuacauucuuuuaauggguccuuuaaaaauguaaucgagugag

SEQ ID NO: 177805 - RNA, 48 nt, Homo sapiens
augaaauccgggccucaguuccgugauguggugcacuagaaggacaug

SEQ ID NO: 177806 - RNA, 37 nt, Homo sapiens
uuaugugagugccaugggcaacaccagcauuguccag

SEQ ID NO: 177807 - RNA, 44 nt, Homo sapiens
ugaugagaauuuucuggaccaggcuggaguugccuuggcuguuu

SEQ ID NO: 177808 - RNA, 83 nt, Homo sapiens
uuagguuauugauguaaaaccugcaguggaagaacauuuggaucacaaauuauaaauuuucugucuugcagauuaauugcuac

SEQ ID NO: 177809 - RNA, 119 nt, Homo sapiens
uugauguagccaagucauagaguccauauuuguauuuucauaaguccagaauaacacacuuaccuauuuaaagaauuccaacugaguguggacaaaaacccugacagguauaaauugug

SEQ ID NO: 177810 - RNA, 75 nt, Homo sapiens
aaaaguucuagucuucauuuuucuccccauaugaacuccuuugggugcuaaugauaagcauguucauuguagaua

SEQ ID NO: 177811 - RNA, 46 nt, Homo sapiens
aagggccugggguccucuugcucucucccccuaccccaagccugca

SEQ ID NO: 177812 - RNA, 53 nt, Homo sapiens
auaaacauguucuaagaaacauacauugcccagggccaucagcgggauucaaa

SEQ ID NO: 177813 - RNA, 46 nt, Homo sapiens
gggucagcauuuucuuccauaugccaagggggugccugaacaugag

SEQ ID NO: 177814 - RNA, 29 nt, Homo sapiens
uccgguuuaauuuucuuuauauagugaaa

SEQ ID NO: 177815 - RNA, 81 nt, Homo sapiens
ucccccauccugcagguccugcuagucuuggcuucaagugcacacgucgcuucucugugcauauaccuggauacaucccag

SEQ ID NO: 177816 - RNA, 41 nt, Homo sapiens
cauccacaacaaguggcagcuuugagaagguuucaguucuu

SEQ ID NO: 177817 - RNA, 47 nt, Homo sapiens
cauaagugaaaaaauaucauuaaaauauuugaauuuuguucaaggag

SEQ ID NO: 177818 - RNA, 41 nt, Homo sapiens
agggaaacuucguggcuugcaugacagcuauuuuacgacaa

SEQ ID NO: 177819 - RNA, 42 nt, Homo sapiens
aauaauucucuagucauccucaguaaaacuaugauacaacuu

SEQ ID NO: 177820 - RNA, 46 nt, Homo sapiens
gaauugcuuucuuggcugcuuaaauucuguucaccaccuuggccuu

SEQ ID NO: 177821 - RNA, 31 nt, Homo sapiens
auagccacuuguuuuguucagguuagcucag

SEQ ID NO: 177822 - RNA, 46 nt, Homo sapiens
ucaggauuuccuaauggaaacauucaucauguuuaagaaccucauu

SEQ ID NO: 177823 - RNA, 55 nt, Homo sapiens
acacacauauauaaauguaucuguguucuagauaagauccuugggucagguaucu

SEQ ID NO: 177824 - RNA, 39 nt, Homo sapiens
cuggggggcagugucucuagggaagagaagccgacccag

SEQ ID NO: 177825 - RNA, 70 nt, Homo sapiens
agguggugguuggaugauggaaaaaaacccaugugacuucugcuuuccuacugcagaaugaagucaggua

SEQ ID NO: 177826 - RNA, 28 nt, Homo sapiens
cuuauuaaaugggaacaucaauacugcu

SEQ ID NO: 177827 - RNA, 44 nt, Homo sapiens
acccgcagguuggcagcucauccucuuccaccugcugugaaagg

SEQ ID NO: 177828 - RNA, 70 nt, Homo sapiens
augugugaugagagaaguggggacgcaucgucauggggaccaucuugauggagggagggagaaaagagag

SEQ ID NO: 177829 - RNA, 46 nt, Homo sapiens
acuaggagacugauuuaucuccuguuaugucuuauuaagugacauu

SEQ ID NO: 177830 - RNA, 43 nt, Homo sapiens
aggagaggcacacgguucucuaagagugugugaggagacgagu

SEQ ID NO: 177831 - RNA, 48 nt, Homo sapiens
aucgcauuucaucuuaaagcaacccaugagguggaggaaccaugauca

SEQ ID NO: 177832 - RNA, 34 nt, Homo sapiens
gacaagagcauggaagaaauaaaggggucauuaa

SEQ ID NO: 177833 - RNA, 54 nt, Homo sapiens
aagaggucagagcuggggaaggcaggugggggcuguaaacccaacagcagugug

SEQ ID NO: 177834 - RNA, 46 nt, Homo sapiens
uucuuuccuuccucuauccucccuucucucgcucucucucuagcuc

SEQ ID NO: 177835 - RNA, 42 nt, Homo sapiens
cucucuauagacacugaggcuucuaaucuccuucuucucaag

SEQ ID NO: 177836 - RNA, 41 nt, Homo sapiens
ugaacaaaaaauuucuggaucaagccaacuuugagcuacag

SEQ ID NO: 177837 - RNA, 55 nt, Homo sapiens
cuguugcuuuccuuacucaagagucccugcaacuggagaauuuuucaagugccaa

SEQ ID NO: 177838 - RNA, 33 nt, Homo sapiens
guacaugcuaggccgaucccacugugagcauuu

SEQ ID NO: 177839 - RNA, 44 nt, Homo sapiens
gacagauuggcuuugaaaucagagacaugugguacaaccuuggu

SEQ ID NO: 177840 - RNA, 46 nt, Homo sapiens
ugaaaguggcuccauuucaauuugugcuacgugccaugauaacaau

SEQ ID NO: 177841 - RNA, 21 nt, Homo sapiens
cuccagauaggccaagucaag

SEQ ID NO: 177842 - RNA, 70 nt, Homo sapiens
caaggucaacacaagauaaaguucauuccagaaauggugggcccaauauuagaaaugacauuaauucccg

SEQ ID NO: 177843 - RNA, 43 nt, Homo sapiens
ucuucuuugauaugaugcagugugaauuccauucgacccgaag

SEQ ID NO: 177844 - RNA, 62 nt, Homo sapiens
ugcugccuaacuccucugccauaagcccaguuaccucaccuuauuagucacgucagcagggg

SEQ ID NO: 177845 - RNA, 50 nt, Homo sapiens
cuuaaguuuuuuuuauagcuuuuauagcagaugugcaaacccuacuggag

SEQ ID NO: 177846 - RNA, 60 nt, Homo sapiens
uuggcuuuucuaacguugcccggaguuucugcucuugugcucgugcucuucagccgcagu

SEQ ID NO: 177847 - RNA, 42 nt, Homo sapiens
guuaggcaagaggaaugcucuauacauaaagauaugaaugug

SEQ ID NO: 177848 - RNA, 49 nt, Homo sapiens
ugagaucaucaccaagcuggaucaugaagucgaaggaggcagaggagac

SEQ ID NO: 177849 - RNA, 46 nt, Homo sapiens
aggcuuuuggauuauagaaccaucaugcacgacgagaacaaagaaa

SEQ ID NO: 177850 - RNA, 61 nt, Homo sapiens
augcagauuuaauuagaugucauagcaggugaucacugagcauuauaaacucccaucacuu

SEQ ID NO: 177851 - RNA, 28 nt, Homo sapiens
ucuucguaguagcugcauugauaaaacc

SEQ ID NO: 177852 - RNA, 44 nt, Homo sapiens
agaagguaauugaguaugacucuuuucccaauaacugcugugaa

SEQ ID NO: 177853 - RNA, 54 nt, Homo sapiens
uugacgguggagggggcccggccagcuggucucccuggauccuagcucuguagg

SEQ ID NO: 177854 - RNA, 58 nt, Homo sapiens
guuuuaugcacagcucuauucucagggccuggcacacaguaagugugcaaaaaccugu

SEQ ID NO: 177855 - RNA, 43 nt, Homo sapiens
ucacaggaaagguaaaagaaucaguuuucuaguaacuucauua

SEQ ID NO: 177856 - RNA, 27 nt, Homo sapiens
aucuguaucaaucauauuuuccagcaa

SEQ ID NO: 177857 - RNA, 46 nt, Homo sapiens
gcagucugaggcugugauccuuucggaaacgguaacccgacagggu

SEQ ID NO: 177858 - RNA, 46 nt, Homo sapiens
guuuaauuuacuugcagccugagugcaugcucaggugacacgcugg

SEQ ID NO: 177859 - RNA, 41 nt, Homo sapiens
gagaggauuauaugucucaacaucacuuuaauugcacaagg

SEQ ID NO: 177860 - RNA, 46 nt, Homo sapiens
uuuugguaguuuucucaucagucgugggcuugucagugccuggugu

SEQ ID NO: 177861 - RNA, 48 nt, Homo sapiens
cuggaguucccauaaaugcuuucaugucuuucucaucaccuccugcug

SEQ ID NO: 177862 - RNA, 84 nt, Homo sapiens
aggcuauuuugguaguuuucucaugagucgugggcuugucagugcauauuggugucuggaagagcucuuucaagccagccaagu

SEQ ID NO: 177863 - RNA, 78 nt, Homo sapiens
ugguaguuuugucaucaguuguugauuccucaguguggucuggugucuggaagagcucuuugaagccggccaggucuu

SEQ ID NO: 177864 - RNA, 45 nt, Homo sapiens
uugcagauuccuuaaacgcuuugaugcucuuuccaucuccugcug

SEQ ID NO: 177865 - RNA, 47 nt, Homo sapiens
uacuucugugauuuugucaucggucauugauuccucagugugaccug

SEQ ID NO: 177866 - RNA, 1048 nt, Homo sapiens
guacagaacuugaggaagaggcccaacggggugagguggguaccacgcggggaggaggaggaggcggcggggacgacagacacauccgcguccgggucgcugucacaaauaucuccucagacguagauuuuucucuugacacacuguacaccuuccacugcccaacuuggagaacagcguucuuugcaaauguuuaaccaggacaugcccugagcugugucgucucggggugugcuccagagauacagaaacagaucacuaacucgcguuuuuuauuaaaaccaauuaauugugaaaugcauaucgaucguuaagaguuuguauaauuuagaaaaguauagucaagacgauaaaaagcacccauaauucucccauccggaaaugaucaguguuaacauuuuuuuuccuugcagagccacccaagaaugcacugguauuaauauugaauacucuuuccaaucuguuuuuuuucgucucucucucucagauugugaacaacuuucuauguacuuuuauucccuguucuuuucaacucauuaugacauugugggcauucacccauauuguggaauauuuuucagaaagccuuaauggcugcauaauauuccaccagauguguguauuguaauuuguuaacaaauccccuauuuugggacauguaggugauuuuguaaauuuuuacuaucaaauaaggcugcaguggauauucucuuaaauuuaucuuuagcugcacuuuccaugaugagaauaucuuagaaaugagauuuccaggccaagauaaugccaaauggcuuuacaggaaaguggcaaaguguaccacuucaccaccagcgcacccuucuuccagcaucugcggugcucguugagcccugucuuaugcuuauaggcuuuuccagccggcuugccuacccaccccucaaaucccacccuugcacuaauguugcaauccgcauaccugagaggguuccuccuuaucucugaauuaugccauuucucucucucccccucucuuuuuuuuuugguuuugcucagugcuguggccuugcug

SEQ ID NO: 177867 - RNA, 872 nt, Homo sapiens
ggaugaggaugcagacauguaagugucagucuguuuggcugugagcaguuggggcuggacuccagucagaguccaagauauuuagucaacagaugacauuucuagaauuuucuagaagaugucaaaguuggccccucucuuucuacuucccagcuuaagaacuuugaaaaccucuuaaaaggucuuuucaggccgggcacgguagcucucaccuguagucccagcacuuugggaggccgaggcagguggaucaucugagguggggaguucgagaccagacugaccaacauggagaaaccccgucccuacugaaaauacaaaauuagcugggugugguagugggcaccuguaaucccagcuacucgggaggcugaggcaggagaauugcuugaaccugggaggcagagcuugcggcgagccaagaucucgccauugcacuccagccugggcaacaagagugaaacuccgucuccaaaauauaaaaaauaaaaacuuguuuucaaaggugguuucaugacuaguaauauuuccccaaaacauugcagggauaaaacaugggcuugcccacuuuuuauuuugccaacaaagcuauuggcaaacuaucaucuuucugucuucaaagaaccuuguacaucauaacaccaauagauuagugggacauaaccucauagguuggugcuucuuuagaaaauuucuaacuugaugaaaaaacucaaguuauuuuuuuucucguuucuccauggacugucacuggucugcgggccaguguuggggaccacugauuuagaggacaccugguguguguuucccaccccucccugaggccucuggguuucucacuucaggaugaaguacauugagacagagcuaaa

SEQ ID NO: 177868 - RNA, 46 nt, Homo sapiens
uccaaccagaugcugaguggcauuccugagguggaccugggcaucg

SEQ ID NO: 177869 - RNA, 47 nt, Homo sapiens
gcuuccaggggacgagugagagcugcaggugccuagauggcugcagg

SEQ ID NO: 177870 - RNA, 28 nt, Homo sapiens
gagcauugaggccacuguugcaggccug

SEQ ID NO: 177871 - RNA, 77 nt, Homo sapiens
ugaggcacggcggaugcugcgggucuuauaaggccuuuaacgcucgaggggaaguuccuagaauaaugggcgaagaa

SEQ ID NO: 177872 - RNA, 60 nt, Homo sapiens
gagguugcuuccauggugccacuucugaaauaagaacuguuccuuggaaggaaugcacag

SEQ ID NO: 177873 - RNA, 46 nt, Homo sapiens
auaaguacaucuuaaaauugaugaaaguuuaaugaauggcuagcaa

SEQ ID NO: 177874 - RNA, 27 nt, Homo sapiens
gucuaacuugugacaguuccucuugcc

SEQ ID NO: 177875 - RNA, 43 nt, Homo sapiens
uacagcaucagagcaggcuguggaggcagggccaggcucacug

SEQ ID NO: 177876 - RNA, 37 nt, Homo sapiens
aaaaguugaucuucaccuaaaacaguguguuugucag

SEQ ID NO: 177877 - RNA, 44 nt, Homo sapiens
gccagucacaaaaggacaaguacuauauggguccacagacauga

SEQ ID NO: 177878 - RNA, 45 nt, Homo sapiens
acaaagauuggguauuguuuacauauaauuuuguaauaauuccua

SEQ ID NO: 177879 - RNA, 34 nt, Homo sapiens
gacugacacgugcuuggggcucauuugauggcuc

SEQ ID NO: 177880 - RNA, 29 nt, Homo sapiens
ccaaacccucacugugaccccacgggaaa

SEQ ID NO: 177881 - RNA, 62 nt, Homo sapiens
ucccacagaaguuuucccccaguucccuaccaugauggguuguggcuuugucacccgcagug

SEQ ID NO: 177882 - RNA, 39 nt, Homo sapiens
uuugauuuuaaaggacagccacaguccugccagcuccau

SEQ ID NO: 177883 - RNA, 38 nt, Homo sapiens
aguuguuggcaucaaugugcguuuaccaauaagagaaa

SEQ ID NO: 177884 - RNA, 50 nt, Homo sapiens
aggacaaacauguuuuuaagacuuaacccauuauaguaggaaaauacaag

SEQ ID NO: 177885 - RNA, 112 nt, Homo sapiens
cucauuuuaaaccuuuaacuggcaagugguccugaucuucccucuggacagcugcgggaagagguuucccgguuuaccuuggcccccguaacaccacaucaucccacgugug

SEQ ID NO: 177886 - RNA, 35 nt, Homo sapiens
cuggaauauuugcaucgaccaggaugcuguuucug

SEQ ID NO: 177887 - RNA, 45 nt, Homo sapiens
uuuugacugaaaaaaauugacuauucaucgauucuugaccugcga

SEQ ID NO: 177888 - RNA, 46 nt, Homo sapiens
cuauagacauuaauuuaaaaauucuauaagggccugagggccuggg

SEQ ID NO: 177889 - RNA, 48 nt, Homo sapiens
ucggcugugaaauggcaucaauacacuuaagaguaacaagucgaauag

SEQ ID NO: 177890 - RNA, 76 nt, Homo sapiens
uucuuuguucaugcccgugacacacguuccucccuguggugaccuggcguccauccugagcuuucgugguguccac

SEQ ID NO: 177891 - RNA, 53 nt, Homo sapiens
uacucuuaaccagaaucucccaaccugggguccgugguggucuucgggggggu

SEQ ID NO: 177892 - RNA, 45 nt, Homo sapiens
caugaaaacucagaccauucccauuuuaccauccuuucuucacca

SEQ ID NO: 177893 - RNA, 45 nt, Homo sapiens
cucuacgacgcucaucaucugaaggggcugccggggccuuuggag

SEQ ID NO: 177894 - RNA, 89 nt, Homo sapiens
uaacuucuuggaagugcaguccgggccagcagaaauggucauaguaggccaugguggaaggagaaucagaaccacgcguaaauccucag

SEQ ID NO: 177895 - RNA, 42 nt, Homo sapiens
cuccugggcagguccgggcucaguggcuugaacaggugaugc

SEQ ID NO: 177896 - RNA, 42 nt, Homo sapiens
uuuuuuuguuauuuuguguauuuuacucucuuucuacuuucu

SEQ ID NO: 177897 - RNA, 42 nt, Homo sapiens
gaugauaaugaucauaguaaccaaaaaaagcauuugacaaau

SEQ ID NO: 177898 - RNA, 25 nt, Homo sapiens
gcuacuuuuaaaccuuagacauuug

SEQ ID NO: 177899 - RNA, 34 nt, Homo sapiens
ugucuguuacuuccaaaggacucucacaguguaa

SEQ ID NO: 177900 - RNA, 43 nt, Homo sapiens
acaaguuuuccaaaauuauuuuugacaacccaucacuagagaa

SEQ ID NO: 177901 - RNA, 56 nt, Homo sapiens
gccaaauaaaagaccuuuuaucccaacuggguacacucuaaagucucgacaugauu

SEQ ID NO: 177902 - RNA, 39 nt, Homo sapiens
cguuuggagcuugagaagaacuauuucaccagccaagag

SEQ ID NO: 177903 - RNA, 45 nt, Homo sapiens
uauuuuaggcuaacguugcuccaagaagcaguauuugccuguaag

SEQ ID NO: 177904 - RNA, 46 nt, Homo sapiens
ccuuuaaugaaagauuuuauuuuuuauucagcauuggugcauugag

SEQ ID NO: 177905 - RNA, 63 nt, Homo sapiens
uuguuaugcuccaaagcccugagacagauccaugucacaaggacaccuuucucaugguucaac

SEQ ID NO: 177906 - RNA, 31 nt, Homo sapiens
agucccaggagugggaaggccugggggaaaa

SEQ ID NO: 177907 - RNA, 29 nt, Homo sapiens
agcuugggauucagccaggacagagccug

SEQ ID NO: 177908 - RNA, 53 nt, Homo sapiens
gcacuggaugcagaguuuggaucugauucugaguauguggugaugacucgggg

SEQ ID NO: 177909 - RNA, 46 nt, Homo sapiens
gccaguuuagaggcucuggagguuguucagaaguggcaacaaaagg

SEQ ID NO: 177910 - RNA, 53 nt, Homo sapiens
agggccugcuggugucugcugugugucauggggggaggcaagguuuuccucac

SEQ ID NO: 177911 - RNA, 49 nt, Homo sapiens
gggcuaauaccugaguucacuaaccaagucagacaggcgaacauaugaa

SEQ ID NO: 177912 - RNA, 40 nt, Homo sapiens
guuucuuacuuuaugaacaaguauaauauuuaagggcaga

SEQ ID NO: 177913 - RNA, 41 nt, Homo sapiens
ggcauggcugcguuccaguaaagcuucauuugcaaaagcag

SEQ ID NO: 177914 - RNA, 60 nt, Homo sapiens
augauguguggcaucuggggaaggagcacauuucugcagcuuuuuuggugaagauggaga

SEQ ID NO: 177915 - RNA, 35 nt, Homo sapiens
gauccucuucauugcuggaggcuauggugggcaga

SEQ ID NO: 177916 - RNA, 47 nt, Homo sapiens
cauccggugacuaggggcuccuacaauguguccuucccugccuuagg

SEQ ID NO: 177917 - RNA, 71 nt, Homo sapiens
gucccuccuugugguccauuucugggcaccaugggcuccacagugugcacagaugaacgaaguuauggcag

SEQ ID NO: 177918 - RNA, 84 nt, Homo sapiens
aaaugucaagguggcugugggcuggaguuuuggagagcacaggcagacaaauuaguucccuguggguaacugugguuuuaaggc

SEQ ID NO: 177919 - RNA, 46 nt, Homo sapiens
uguaucauguuacugguuuagguaacacauuguucuuagcugcuau

SEQ ID NO: 177920 - RNA, 41 nt, Homo sapiens
aauaggaguacaccuuugucauuuaauuaauuguuugauau

SEQ ID NO: 177921 - RNA, 83 nt, Homo sapiens
ggagggagagagagaaagagggagaaagacaggauuugcuuuuuugcuuuuccucugcauuuuuuuuuccuaguucuuuucag

SEQ ID NO: 177922 - RNA, 49 nt, Homo sapiens
uuuaggacuucagaugcccuugauguucuggagaacucuuuugccuuaa

SEQ ID NO: 177923 - RNA, 93 nt, Homo sapiens
uggaggcaguugugguaguucucagccuucagcaggaauuguaagaggucauuugcuucccagaagaauuguuacuccacuggaaaucagcag

SEQ ID NO: 177924 - RNA, 70 nt, Homo sapiens
uacugaaggaagggcccuuuugugauccuugcugaaugcccagugcguagugggcacuccauagauguua

SEQ ID NO: 177925 - RNA, 46 nt, Homo sapiens
uagauggugcacaugccccagaguugaccaaaaaaguucagcgaca

SEQ ID NO: 177926 - RNA, 82 nt, Homo sapiens
ugugcgguggccacuaaaugggaacuuaccacuucaguugaauggauuguauucagcaccuucauucagaucucagguacag

SEQ ID NO: 177927 - RNA, 99 nt, Homo sapiens
uuucaguuaacaaagcuuuuagcaaagcaaaagguauuugaggcauagucagauauuccuucugcagugagagucauccagccgggcucuuacuuuuga

SEQ ID NO: 177928 - RNA, 44 nt, Homo sapiens
aauugccuaaagcuaaaauaaagcuucuucucagccaguuacag

SEQ ID NO: 177929 - RNA, 47 nt, Homo sapiens
uuuuaugguuugauuuuauuuaaaaacaauugcugacacugcuaagu

SEQ ID NO: 177930 - RNA, 141 nt, Homo sapiens
gcuauaguguaguaaaaaaauuacauuacauacuuuagggaauguaaauaguuuuaaaaaagaaacugucaaguuaugacaugagaugagaaagaauaccgucaaucuauugaugguucauauauaacaacagagaagaua

SEQ ID NO: 177931 - RNA, 53 nt, Homo sapiens
caugccuucuugauuucuaauuuauccuacuuagagauagugaagauugagaa

SEQ ID NO: 177932 - RNA, 61 nt, Homo sapiens
acccauggccucaucaugugucaccuugguggguggagggagcaggugucagauucagauu

SEQ ID NO: 177933 - RNA, 94 nt, Homo sapiens
aauacacacaccacuuuuuuuuuuuuuuucaguagucacaguugugucaaaaaguuaagucauaucugagugugugauaugguucaaggucaaa

SEQ ID NO: 177934 - RNA, 58 nt, Homo sapiens
cuaccuauccucagcucuauguuucuggagagcucauaggaggacuugauauaauuaa

SEQ ID NO: 177935 - RNA, 41 nt, Homo sapiens
ggugugaaacauguauuuguuuuaucaaggaucucacuugg

SEQ ID NO: 177936 - RNA, 71 nt, Homo sapiens
aggaaaaggaagucugugggucacgugugccuggguugauguguagauggguucguacuugaagaggggau

SEQ ID NO: 177937 - RNA, 46 nt, Homo sapiens
aauguggauucagcaaacaaauucuggaaauacuaaauaguacugg

SEQ ID NO: 177938 - RNA, 55 nt, Homo sapiens
ucuaacuguagcuucaaauaaauuacuuucaaguaaucuuugauauacuucaaag

SEQ ID NO: 177939 - RNA, 42 nt, Homo sapiens
cuuuuuugcaguguugaauaugaaacauucgauauauuggag

SEQ ID NO: 177940 - RNA, 45 nt, Homo sapiens
cuguaugugaaaggggagcuggugggaggauuggauauugugaag

SEQ ID NO: 177941 - RNA, 91 nt, Homo sapiens
cccucccucccucccucccucuuucucucucucucucucucuauauauauauauauagucuuauuuuuguaagacacaaagaauacucaaa

SEQ ID NO: 177942 - RNA, 46 nt, Homo sapiens
uaggaacugaaagaaaauggugaauugcugccuauacugagaggag

SEQ ID NO: 177943 - RNA, 74 nt, Homo sapiens
aagaugcugguacugucugguggcgauaaggaaagggaaacagaagucaguaauucagacaagaauaaacagga

SEQ ID NO: 177944 - RNA, 34 nt, Homo sapiens
cugcugcugucucuucagcucaggcuguuuuucu

SEQ ID NO: 177945 - RNA, 52 nt, Homo sapiens
guggaacggugccccauggaacagguggugcugccccaggggcuuggggagg

SEQ ID NO: 177946 - RNA, 45 nt, Homo sapiens
ccaggugggggacaugaugguccggaaggaggaaagggugcuggg

SEQ ID NO: 177947 - RNA, 42 nt, Homo sapiens
uccaaggguuggagccuggccagccuugaggagguuggccag

SEQ ID NO: 177948 - RNA, 38 nt, Homo sapiens
cauuuuggaucaaaacaucuugguucaaauuaggaccc

SEQ ID NO: 177949 - RNA, 42 nt, Homo sapiens
gucagaggugagagcucaggcgugaggaauagcaucacacau

SEQ ID NO: 177950 - RNA, 41 nt, Homo sapiens
accguuccagcaacacucaaacuugucaaagaugcagucgu

SEQ ID NO: 177951 - RNA, 23 nt, Homo sapiens
gauggcgcuguucaaaacaagag

SEQ ID NO: 177952 - RNA, 68 nt, Homo sapiens
auuacuguauuuacauaugguuuaaaaucagacgucaugauagcuucuuaaugaaaccaggacugguc

SEQ ID NO: 177953 - RNA, 74 nt, Homo sapiens
uugaacacaaaggagaggauuaaauucaccaaugcagagugauaaagaggaaaagauacugaguaggugccuuc

SEQ ID NO: 177954 - RNA, 43 nt, Homo sapiens
ugguucguuaguggauuacuucugagcuugcaacauagcucac

SEQ ID NO: 177955 - RNA, 46 nt, Homo sapiens
uccaucucugcugcucucucauuugcuggccaucggauugggguag

SEQ ID NO: 177956 - RNA, 41 nt, Homo sapiens
ucagcaugaggaacacgagcgucaugaagaaagggggcaua

SEQ ID NO: 177957 - RNA, 46 nt, Homo sapiens
ugaaagaaggaaagaaguugaaagcaucuugaagaaaaacucagau

SEQ ID NO: 177958 - RNA, 46 nt, Homo sapiens
cuauggguaucuguuucagaagcucuguugguaucuuguggugucu

SEQ ID NO: 177959 - RNA, 48 nt, Homo sapiens
uggaagggaagacgcguacgcugacuggcuagagccccucaucacgga

SEQ ID NO: 177960 - RNA, 43 nt, Homo sapiens
gguuagcaguacuucugagugacuccaagguagaguggccgac

SEQ ID NO: 177961 - RNA, 45 nt, Homo sapiens
gccuacugaugacuugaacauggcuccccacagacuaagucccag

SEQ ID NO: 177962 - RNA, 49 nt, Homo sapiens
ccauuauaaauagaaaccgaggcuggaacgcugcccccguucccauuau

SEQ ID NO: 177963 - RNA, 88 nt, Homo sapiens
gaaggagggcuagugaacaucagaguacuuggcaauacugucuggucagaugagcggcuucaggaaugguguggucuguacaucucag

SEQ ID NO: 177964 - RNA, 38 nt, Homo sapiens
guagauagaauggaauugaaucguuggacaccccggug

SEQ ID NO: 177965 - RNA, 63 nt, Homo sapiens
acauggcgccagagggcaacugcggcgaucggaguccgcgccgggcugcgggaugugcuucag

SEQ ID NO: 177966 - RNA, 48 nt, Homo sapiens
gcguccaggugggguccgcgucgcggucgcgggcggugggcagcgggg

SEQ ID NO: 177967 - RNA, 89 nt, Homo sapiens
ucggggcggccgggcggcgagucggggucuucgcgggccggggguggcggcggggacccggggccgcggacgggcgcgcgguccucggg

SEQ ID NO: 177968 - RNA, 38 nt, Homo sapiens
cgccgcccggccgccccgaggacugcgcgcccccuccg

SEQ ID NO: 177969 - RNA, 42 nt, Homo sapiens
gcugguucaaggucagcagcuggucgcgcagcgggcccagga

SEQ ID NO: 177970 - RNA, 48 nt, Homo sapiens
cagugagucccggcugcggccagucuccccucuccaggccgaggcccc

SEQ ID NO: 177971 - RNA, 46 nt, Homo sapiens
aagugacgucauuuuguggcuucagauugaccgcagccuggcagag

SEQ ID NO: 177972 - RNA, 32 nt, Homo sapiens
aggucaucaagccaacguucgcacccccagug

SEQ ID NO: 177973 - RNA, 43 nt, Homo sapiens
guguccagcccacccuucccaguuccugucuacacccggcagg

SEQ ID NO: 177974 - RNA, 69 nt, Homo sapiens
cuccagccccauccaggggcccccaagagcugguccccaccacccacccgggccagcccgcccgacacc

SEQ ID NO: 177975 - RNA, 45 nt, Homo sapiens
gaacguggcucccaagaccacaauggggcgcuccaacccccuguu

SEQ ID NO: 177976 - RNA, 45 nt, Homo sapiens
ucaucgucuaccgcaaagcccggagccgcauccugagcaggugag

SEQ ID NO: 177977 - RNA, 42 nt, Homo sapiens
cccacacuggcccagcagugccaggccuucugggggccaggu

SEQ ID NO: 177978 - RNA, 44 nt, Homo sapiens
gcucccagaccugggcccuggccagggcucuaggggccggcagu

SEQ ID NO: 177979 - RNA, 60 nt, Homo sapiens
cccggaccacuggcacuccuucaccagccagguggaagaggugcaccugggcaguguggc

SEQ ID NO: 177980 - RNA, 49 nt, Homo sapiens
ggugcggggucaggcgggggggugcggggucaggcggaguggggugcgg

SEQ ID NO: 177981 - RNA, 64 nt, Homo sapiens
agagggguguggguuggggucaggugggggaugcggggucaggugggaggggggugcggucugg

SEQ ID NO: 177982 - RNA, 37 nt, Homo sapiens
cuggguucccugaacucuggguccuguaguugcuucu

SEQ ID NO: 177983 - RNA, 61 nt, Homo sapiens
ugaggggugcccugcccugcccugaggccggggguuuucuggaggaagugaauacauaaua

SEQ ID NO: 177984 - RNA, 70 nt, Homo sapiens
aggccugaaaagagaaacggugcccagcccaugggagccagggaguguguggggcgugggcagugcuggg

SEQ ID NO: 177985 - RNA, 44 nt, Homo sapiens
ugcugguccucaacaagauggacuuggcggaucuuacagagcag

SEQ ID NO: 177986 - RNA, 46 nt, Homo sapiens
aaaugucauuuuuaccaacuguguaaaggaugaaaaugucaagcag

SEQ ID NO: 177987 - RNA, 37 nt, Homo sapiens
auaggagguuucuguuuuccuaacggauaugugaaag

SEQ ID NO: 177988 - RNA, 25 nt, Homo sapiens
agcugugauguccaaaauucaggug

SEQ ID NO: 177989 - RNA, 45 nt, Homo sapiens
acaacguagagcgcgugcugaagaguguggcugugaagcugggga

SEQ ID NO: 177990 - RNA, 46 nt, Homo sapiens
guucucccggagcuuccugcucaggccucuugagaaauggaugcug

SEQ ID NO: 177991 - RNA, 38 nt, Homo sapiens
ccucuagcaucagggacuuaggccugggggaggcgcug

SEQ ID NO: 177992 - RNA, 42 nt, Homo sapiens
uucugcaccugaagguugugcaccuggauuggggguguagaa

SEQ ID NO: 177993 - RNA, 43 nt, Homo sapiens
ccguacccgccccagccucccggccuuacccgccacgggccuc

SEQ ID NO: 177994 - RNA, 42 nt, Homo sapiens
uucuucagagcuuccuugaccucucgguuucuuaggcaauaa

SEQ ID NO: 177995 - RNA, 57 nt, Homo sapiens
aaauuugggguccucuuccgugaugauaaaugugccaaccucuuugaagcauuggua

SEQ ID NO: 177996 - RNA, 50 nt, Homo sapiens
ggaacucuuaaagcugcaaaacgaaggaagauuguaacauauccaggaga

SEQ ID NO: 177997 - RNA, 46 nt, Homo sapiens
gcuguagccagagaccgggcuuauguaggcguagaagacagcggug

SEQ ID NO: 177998 - RNA, 45 nt, Homo sapiens
ggcaugauggaagaggugcagauaauguccauaguagccaaguug

SEQ ID NO: 177999 - RNA, 44 nt, Homo sapiens
uccgccaggacaaucaugacaccguugacguagguggagcugca

SEQ ID NO: 178000 - RNA, 46 nt, Homo sapiens
cacggcuguggccagcccgcugcagaacaccuugcucaucaugcug

SEQ ID NO: 178001 - RNA, 46 nt, Homo sapiens
ccgccaggacaaucaugacaccguugacguagguggagcugcagga

SEQ ID NO: 178002 - RNA, 56 nt, Homo sapiens
auauuccacauguguguauguggaauauauacauauauuccacauguguguaugug

SEQ ID NO: 178003 - RNA, 49 nt, Homo sapiens
uuacauuggaaagaaacccuacaacuguaaugaauaugaaaaaaauugu

SEQ ID NO: 178004 - RNA, 51 nt, Homo sapiens
uuauauauuacauuuguaaacuaucuucaucuaagucuagcaaguggagua

SEQ ID NO: 178005 - RNA, 42 nt, Homo sapiens
gcacagacucacggcagaugcagaacagggugagggccacca

SEQ ID NO: 178006 - RNA, 46 nt, Homo sapiens
agggagcgugaagcgcuuuuccacaauggcaagguccggacaagac

SEQ ID NO: 178007 - RNA, 56 nt, Homo sapiens
ccgaacccauugugggugcuugcccauccccaccuugauguguacacaggacaugu

SEQ ID NO: 178008 - RNA, 58 nt, Homo sapiens
uuaacggggcgcagcgucugguggcgcuuuaagggggcgcggccugaggcagaacugg

SEQ ID NO: 178009 - RNA, 36 nt, Homo sapiens
uccacggcuucugcaaccgcccggggcuccauggcg

SEQ ID NO: 178010 - RNA, 43 nt, Homo sapiens
cgccugaggccggggggcgggcacggaggggguggggcagggu

SEQ ID NO: 178011 - RNA, 44 nt, Homo sapiens
gggguaaaggggcagggacggguggccccaggaagaagggccug

SEQ ID NO: 178012 - RNA, 45 nt, Homo sapiens
gacacagaugugaagaggguggcugccgaguucuuguuuguccug

SEQ ID NO: 178013 - RNA, 42 nt, Homo sapiens
gaggccggcccgagggccaguacucagaggaugaggacacag

SEQ ID NO: 178014 - RNA, 22 nt, Homo sapiens
aauaaagaagaguuuuggacaa

SEQ ID NO: 178015 - RNA, 49 nt, Homo sapiens
caaauaggaugauggcugcccccacacaauaaaugguaacauaggagac

SEQ ID NO: 178016 - RNA, 46 nt, Homo sapiens
auuuuucagguggagccuuuugccagcuugaccgaggccgugcgga

SEQ ID NO: 178017 - RNA, 42 nt, Homo sapiens
gccuagaacguucuucccuauccuuacuuguaaauccuuagu

SEQ ID NO: 178018 - RNA, 52 nt, Homo sapiens
gguggacaugagucuggaguccaggaaggcccagaggcaggagcuggggugc

SEQ ID NO: 178019 - RNA, 46 nt, Homo sapiens
gccccagagguucuugcugcaugugguugauuuccccauggcagau

SEQ ID NO: 178020 - RNA, 36 nt, Homo sapiens
auaugauguccaagauuugcuuuuaaaggcuccaau

SEQ ID NO: 178021 - RNA, 917 nt, Homo sapiens
ucuaccaagcaauucuuuuggaauuuaugauauuuauauccucauuuuaacuugguaucuguagaauagaagauauguuccuggauauuagauauaaauuuuugagacagggucuuggcucuguugcccaggcuagagugcaguggcaugaucauagcucacuauagccugaacucuugggccgaagugauccuuuugccucagccucuggaauagcugggacuacgggcaugcacuaccaugccuggcuaauuaaaaaaauuuuuuaagacaagucucacuauguugcugaggcuggucucaaacuccuggccucaagugauccuccugccuuggccuuccaaagcacugggauuacaggcaugagccacugcacccagccugguauuagguguaauuuuuuuuuuuuuuuuugagacagaaucucgcucucuuacccaaacuggagugcgguggcacgaccucagcucacugcaacuuccaccucccggguucaagcgauucuccugucucagccuccccgaguagcuggcacuacaggugccugccaccacaucuggcuaauuuuuguauuuuuaguagagguacgguuucaccaugauggccaggccggucuugaacuccuagccucaaaugaucugcccaccucggccucccaaagugcugggauuacaggugugggccacugugcccggcuggauauaauuuuauuugagcuuuuaucaaaugguuuuucguacugaguuuugacaggcuuuguuuuaaccgugauuuggcuccagcuaggugccccuuugcuccccugccuuauucugguugauggcgcauguaggugauacgggcaugaaaaccaggcuugaggacaucacaaccccaaggggcugugccuccuuccaggaguccugccaagcccagaa

SEQ ID NO: 178022 - RNA, 30 nt, Homo sapiens
gcggcucuacacgcagaacaucgaugggcu

SEQ ID NO: 178023 - RNA, 144 nt, Homo sapiens
ucuucuuuucgagguauuuugggcaaggacaagcacuucuugcguguucguugucgacaccucgcccacucuuucucaccuugccguguuuccuuugcggcaugucugggaguuuacgugcguuccaacaccggggccuccguc

SEQ ID NO: 178024 - RNA, 45 nt, Homo sapiens
cgcucagaaaguauuaacuaucaccgccauccggguugaaaaagg

SEQ ID NO: 178025 - RNA, 46 nt, Homo sapiens
acacucggaaagccagcacguggggcagcgugcgaugcgcauagau

SEQ ID NO: 178026 - RNA, 45 nt, Homo sapiens
cugcaccaaaacucggccacagcccugaccacgucccagccacca

SEQ ID NO: 178027 - RNA, 65 nt, Homo sapiens
cagggcagcagcaaagcgcaggcuggagguggagguaggugggggaggcugcaaccccuacacuu

SEQ ID NO: 178028 - RNA, 43 nt, Homo sapiens
uuccaggcagcuucgggggugacauuuguauccggccagccga

SEQ ID NO: 178029 - RNA, 46 nt, Homo sapiens
ccccggggucugacugguucagccuuaggugcccauguuggggcug

SEQ ID NO: 178030 - RNA, 37 nt, Homo sapiens
cacugggaugacgaugagcagaauggucaugaggaug

SEQ ID NO: 178031 - RNA, 44 nt, Homo sapiens
uucacggaguaggcgaaugcuaugaagcccaggcagcagggguu

SEQ ID NO: 178032 - RNA, 42 nt, Homo sapiens
cacgguggacgucgggggagcaggguuguggggcgcccccag

SEQ ID NO: 178033 - RNA, 36 nt, Homo sapiens
uggacagugugauucaugguguccagcgaagaccag

SEQ ID NO: 178034 - RNA, 42 nt, Homo sapiens
gaauggaaguuggaguacgugggauacaggucaugggcagag

SEQ ID NO: 178035 - RNA, 37 nt, Homo sapiens
ucaugaggaugcccagaaucagggcccagauguucag

SEQ ID NO: 178036 - RNA, 42 nt, Homo sapiens
accuucacggaguaggcgaaugcuaugaagcccaggcagcag

SEQ ID NO: 178037 - RNA, 46 nt, Homo sapiens
ugcuccuccuugagcaucucauaguuggggggcuggccacuguuga

SEQ ID NO: 178038 - RNA, 44 nt, Homo sapiens
ccccugcccgcuuagcagggccucaguuucccugugugcugggg

SEQ ID NO: 178039 - RNA, 31 nt, Homo sapiens
cuuccuguaccgggacgccuggacccacaca

SEQ ID NO: 178040 - RNA, 51 nt, Homo sapiens
gaaugugccggccggucagugugugggguggccaagcaucugcuugggcua

SEQ ID NO: 178041 - RNA, 38 nt, Homo sapiens
cacugaacuucacccaucagacacccccauggcgggag

SEQ ID NO: 178042 - RNA, 46 nt, Homo sapiens
gcgccuacgcccccaccuacguggucaaggacuucccgaucgccag

SEQ ID NO: 178043 - RNA, 48 nt, Homo sapiens
ggccccgcccaggagcggcccccagucccccgccccagcagcccccgc

SEQ ID NO: 178044 - RNA, 43 nt, Homo sapiens
ggggacucgcguuucagcgucguccugguggauuucgagagcg

SEQ ID NO: 178045 - RNA, 55 nt, Homo sapiens
cccuggaagcccaccccaccccacacuccucuccccucuccccagcugccucaag

SEQ ID NO: 178046 - RNA, 23 nt, Homo sapiens
gaugugaagaugugcuuggcccg

SEQ ID NO: 178047 - RNA, 68 nt, Homo sapiens
ggcccugggagcacuuuaaggagggugcggggugggcucccgggugaguuguggauucugggcucugg

SEQ ID NO: 178048 - RNA, 59 nt, Homo sapiens
aggucuugagcuuggcgaggaugcggcuggcagaggggagggacucaggugcagggacc

SEQ ID NO: 178049 - RNA, 52 nt, Homo sapiens
agcggccggaccgagcucccgacgccgggucgggcggagggcggcgcuguag

SEQ ID NO: 178050 - RNA, 53 nt, Homo sapiens
acucccgacagcugcgacccugggcuggcccuuugccgaugcuccucugugag

SEQ ID NO: 178051 - RNA, 37 nt, Homo sapiens
ugacaaaaacuuaacauacuggaauugaaagauuuuu

SEQ ID NO: 178052 - RNA, 77 nt, Homo sapiens
cccaccccacgcucacccugagaccucacugggggcccugccagugcugucgacuccaagaaugcugccagccgggg

SEQ ID NO: 178053 - RNA, 48 nt, Homo sapiens
gccuggaggcgucuacacuggcuccacauccacuucccccgcagcucg

SEQ ID NO: 178054 - RNA, 32 nt, Homo sapiens
cacacagaccaccccggaggacacguggauga

SEQ ID NO: 178055 - RNA, 41 nt, Homo sapiens
uacuggucugaggagauggaggaccggcugcaggcccugga

SEQ ID NO: 178056 - RNA, 57 nt, Homo sapiens
gaggagugagcgacuccagggaagcugcugggcucagcuccgaccuucagaaugcau

SEQ ID NO: 178057 - RNA, 46 nt, Homo sapiens
cugacgggggccggcugcgggguccuguccagcacacuacgcaccc

SEQ ID NO: 178058 - RNA, 29 nt, Homo sapiens
ucaaccugcgcagcaacgagcugggcgau

SEQ ID NO: 178059 - RNA, 94 nt, Homo sapiens
auucccccaaagaagcggccucccgggaaggagcgcccuggcggagaagacucgaacggcucccacagccgggcguugggggaaaggugggcgg

SEQ ID NO: 178060 - RNA, 40 nt, Homo sapiens
gcuuaauccuccuccuuguggucuccagccccagccccac

SEQ ID NO: 178061 - RNA, 46 nt, Homo sapiens
gggucacguaaguuuugcgacaaacccagcuccgggccacuggcau

SEQ ID NO: 178062 - RNA, 44 nt, Homo sapiens
cugucagcugggaggcccaaggagaagagccugguccuggugaa

SEQ ID NO: 178063 - RNA, 44 nt, Homo sapiens
acacccgagcugcacguuccuauacggccccccagacccagcug

SEQ ID NO: 178064 - RNA, 42 nt, Homo sapiens
cagcaccgugcggcccuuguacaugauggucacguccagcgc

SEQ ID NO: 178065 - RNA, 41 nt, Homo sapiens
guacgggugggcaguagagacgacccccagccccgggcccc

SEQ ID NO: 178066 - RNA, 45 nt, Homo sapiens
cagugggaacggugguccccuccuaauucuccagcuccccaaucc

SEQ ID NO: 178067 - RNA, 33 nt, Homo sapiens
gagguggcccgccccccgaggcugagacugcgg

SEQ ID NO: 178068 - RNA, 45 nt, Homo sapiens
ugggugccagagccgccgggacgggaaguuucgucucgcggggaa

SEQ ID NO: 178069 - RNA, 84 nt, Homo sapiens
gcugugcuagcugcuaggugguccucgggaauuccaggcuggguuuucuagggaggacugguugucacguguggucacuguuga

SEQ ID NO: 178070 - RNA, 41 nt, Homo sapiens
agcucgucagggcccccggcuucgcccgccugccgcucgug

SEQ ID NO: 178071 - RNA, 31 nt, Homo sapiens
acaagccagcgcucuacacagcacccuuugu

SEQ ID NO: 178072 - RNA, 47 nt, Homo sapiens
uuggugacagacccugaugugcuggugcuguguccccaaaaccgggg

SEQ ID NO: 178073 - RNA, 73 nt, Homo sapiens
accccacacaaaccuauuuauugaaucugcuggacccaagcggcucuccagcccuuccguccuuccccagccg

SEQ ID NO: 178074 - RNA, 47 nt, Homo sapiens
gggacgcagggagggccagagcguguccccugcccaguucgcacaga

SEQ ID NO: 178075 - RNA, 30 nt, Homo sapiens
auuccccugaagguggagcaccacccaacc

SEQ ID NO: 178076 - RNA, 70 nt, Homo sapiens
ggagggacuagaguggagaugaagggcccagcgcagcccggagagcuguggccagucugcacccgaagag

SEQ ID NO: 178077 - RNA, 33 nt, Homo sapiens
gacuggagauaggcucccaggaggaaggggguu

SEQ ID NO: 178078 - RNA, 42 nt, Homo sapiens
gggugagggugcuucugggcucuggugccugggucaggagug

SEQ ID NO: 178079 - RNA, 41 nt, Homo sapiens
ugcccucuuccucugaacuuuguccugggagggagggggcu

SEQ ID NO: 178080 - RNA, 81 nt, Homo sapiens
agcugcgggucaccaacaccagcauccaguucaaccugcgcaaccucuaccgccucuccaaggcccucuucccgccggagc

SEQ ID NO: 178081 - RNA, 45 nt, Homo sapiens
caacguggccuucccgcccgaagcucugcgcaugcgcgcacccgc

SEQ ID NO: 178082 - RNA, 45 nt, Homo sapiens
caugcacugagaggggagguuuccacaccccuccccugggccgcu

SEQ ID NO: 178083 - RNA, 46 nt, Homo sapiens
gaagaauuauuuauuuucgccaaagcacauguaauaaaugcugcag

SEQ ID NO: 178084 - RNA, 42 nt, Homo sapiens
gaaggacagguggcucugguuagggggcggggcgucccugca

SEQ ID NO: 178085 - RNA, 44 nt, Homo sapiens
cgggucaggcccagccuagcgucagcugcgauucccugggaggg

SEQ ID NO: 178086 - RNA, 52 nt, Homo sapiens
cuugggccagaccuguaaccugugaccugacauguccuugccccucuagccu

SEQ ID NO: 178087 - RNA, 45 nt, Homo sapiens
ccaggaugggugaguucaacgagaagaagacaacauguggcaccg

SEQ ID NO: 178088 - RNA, 24 nt, Homo sapiens
acccccaccccucccgggccacca

SEQ ID NO: 178089 - RNA, 42 nt, Homo sapiens
uggccuggcugucauggcagugggcaucuggacgcuggcccu

SEQ ID NO: 178090 - RNA, 46 nt, Homo sapiens
cuggggucuugggcugcugcgccaccuucaaggagcgucggaaccu

SEQ ID NO: 178091 - RNA, 41 nt, Homo sapiens
cccaguacuucauccugcuccucaucaucuuucugcuggag

SEQ ID NO: 178092 - RNA, 46 nt, Homo sapiens
acaccaugaccaagcgcuaccaccagccgggccaugaggcugugac

SEQ ID NO: 178093 - RNA, 38 nt, Homo sapiens
cugccuguacaggagucucaagcuggagcacuacugac

SEQ ID NO: 178094 - RNA, 33 nt, Homo sapiens
gcagcuucaagugccuuuugcugcgcaccaaug

SEQ ID NO: 178095 - RNA, 63 nt, Homo sapiens
gggccuuccugguuuuguucacugcuguacccagaugccuacaaccaucccugccacauacag

SEQ ID NO: 178096 - RNA, 53 nt, Homo sapiens
uccgcuggcugccuccugucagcugggcaggcggggcccacaguaccugcccc

SEQ ID NO: 178097 - RNA, 140 nt, Homo sapiens
agugagcaggugugaaauacaggccuccacuccguuugcugugacgggucugcugcaguccucagucggggguccugggcaccaugugacuccccauccucccaugaggggucccugcccuggaugaguccuagcugggg

SEQ ID NO: 178098 - RNA, 76 nt, Homo sapiens
gacuacuucuacgaccugcucuaggugggcauugcggccuccgcgguggacguguucuuuucuaagccauggagug

SEQ ID NO: 178099 - RNA, 43 nt, Homo sapiens
ugccccucggccuggaggacaucccuggguguuggggggacag

SEQ ID NO: 178100 - RNA, 32 nt, Homo sapiens
ggccccccaaggacccagccccuguguguguc

SEQ ID NO: 178101 - RNA, 49 nt, Homo sapiens
cacccacucucggacuuucaccuuccccugcccucucuguggcccuucc

SEQ ID NO: 178102 - RNA, 27 nt, Homo sapiens
cucgcccgggcacagccucgcccgggc

SEQ ID NO: 178103 - RNA, 56 nt, Homo sapiens
gggugggagggcaggaggcaguagggggauugcugagccggaguggccacugcagg

SEQ ID NO: 178104 - RNA, 47 nt, Homo sapiens
acggccaggacccgugguguggaccgccauggcggccucuggggaau

SEQ ID NO: 178105 - RNA, 46 nt, Homo sapiens
uggacuuacgaugauuuccggaacgucuuagacagugaggaugaga

SEQ ID NO: 178106 - RNA, 87 nt, Homo sapiens
uucccugacacugagagaaccguggggaggugauggaaugucagccagugucagggccuggcgggucuggccaucccucagcucgga

SEQ ID NO: 178107 - RNA, 55 nt, Homo sapiens
agguggcagcaggcugcugcccuugguucugauucugggauguaucacugaggag

SEQ ID NO: 178108 - RNA, 61 nt, Homo sapiens
gguggaaggggccugagugcgcagacaagggauguggccggcgggugaggagugugugagc

SEQ ID NO: 178109 - RNA, 14 nt, Homo sapiens
ggguggagggcgag

SEQ ID NO: 178110 - RNA, 50 nt, Homo sapiens
cgccgggcgggugcgugagagagagcaagugugugagggggcgugugaga

SEQ ID NO: 178111 - RNA, 51 nt, Homo sapiens
aguuauuaaaacugaaauuucccauuuuggagaaagcucuguuguuaugug

SEQ ID NO: 178112 - RNA, 61 nt, Homo sapiens
ggacccgucggggaacgcagacucuguccaguuuguguugcacuugcugaggaaaccccac

SEQ ID NO: 178113 - RNA, 42 nt, Homo sapiens
cugcucguccgugccugcaaccaguugggccaguuucugcag

SEQ ID NO: 178114 - RNA, 44 nt, Homo sapiens
ugaggcugucaagacgcacaucgagacggucaucaacgcccuga

SEQ ID NO: 178115 - RNA, 43 nt, Homo sapiens
gacccggucgugguaccgcgagugggggugccugugagagcag

SEQ ID NO: 178116 - RNA, 47 nt, Homo sapiens
cucaggccugugguccugaugaugcuggguguggagaguggggucgg

SEQ ID NO: 178117 - RNA, 46 nt, Homo sapiens
agggcguggaugggcaggaccaguuauagaacuccaacguacagcu

SEQ ID NO: 178118 - RNA, 30 nt, Homo sapiens
ggcgucggcuuggagggcguggacgauggc

SEQ ID NO: 178119 - RNA, 42 nt, Homo sapiens
agccagcaggaagcuggggccugaaaaccccacuccugugcg

SEQ ID NO: 178120 - RNA, 44 nt, Homo sapiens
ggaugcaaaugcuggcaucaaaguuggggcaggugauguuggag

SEQ ID NO: 178121 - RNA, 39 nt, Homo sapiens
uaugcuuuauuuccuguuugaaggcuuacuguagaagug

SEQ ID NO: 178122 - RNA, 30 nt, Homo sapiens
cagggagcuucucuucucaacaggccuugc

SEQ ID NO: 178123 - RNA, 43 nt, Homo sapiens
ggccuggcucaccuggccacuguccagccagccuugugacaga

SEQ ID NO: 178124 - RNA, 41 nt, Homo sapiens
uccugucccugggacgugcgucucuccuucucaugccguuc

SEQ ID NO: 178125 - RNA, 46 nt, Homo sapiens
ccucuccccugguagaaaccccagggccuagggcaggugcgggagg

SEQ ID NO: 178126 - RNA, 40 nt, Homo sapiens
auaagacggggacucgaggcgggcccacgauggugcggcu

SEQ ID NO: 178127 - RNA, 56 nt, Homo sapiens
gaauaaggucauccacugcacggugcccccaggcguggacucuuucuaucucgaga

SEQ ID NO: 178128 - RNA, 53 nt, Homo sapiens
uacgcgguguacgagacgcccacggcacacaauggcgccaagaauccccgcug

SEQ ID NO: 178129 - RNA, 42 nt, Homo sapiens
ggacuuccuccgcaucacgcccacacagcagcagcggcaggu

SEQ ID NO: 178130 - RNA, 26 nt, Homo sapiens
agcagucccacugucuuuaacggaca

SEQ ID NO: 178131 - RNA, 74 nt, Homo sapiens
cuuguuaguguugaacucaguaugugcaucuuguacauggaagcaaaauucuagaaaaauauccauuauguauc

SEQ ID NO: 178132 - RNA, 49 nt, Homo sapiens
aaaaaguccuuuuucacgaugcuccaaggucccugcccucgcgcagccc

SEQ ID NO: 178133 - RNA, 45 nt, Homo sapiens
gccaccgugcaaaaccucaguuucuucauuugcaaaugagaggau

SEQ ID NO: 178134 - RNA, 50 nt, Homo sapiens
aaugguccccuagauggaugcgggcccugcucccugauggccccccaggu

SEQ ID NO: 178135 - RNA, 103 nt, Homo sapiens
agggcccggugcccagauggaggcggccccgagcucugacucccgaauggaggagggccccgcacccuaauggucccccagguggaggcgggcccugaacccu

SEQ ID NO: 178136 - RNA, 67 nt, Homo sapiens
aggcuugagcucaccgccgugccggggcagagcuuuggggaggcagccccgggggagggggccugcg

SEQ ID NO: 178137 - RNA, 43 nt, Homo sapiens
cugcagggcucgaggagagagcaggugcgcaggcgccgggcga

SEQ ID NO: 178138 - RNA, 42 nt, Homo sapiens
acccccaccuccuccuugcucacggcugauggauaccuagcg

SEQ ID NO: 178139 - RNA, 23 nt, Homo sapiens
uuaguucaucuguucacucguaa

SEQ ID NO: 178140 - RNA, 43 nt, Homo sapiens
agacgcagacggccccggccguguccuguggcccccugucgga

SEQ ID NO: 178141 - RNA, 49 nt, Homo sapiens
aguggcuaugucagugccaaaggagacuccgaggaaggaagugaccagg

SEQ ID NO: 178142 - RNA, 40 nt, Homo sapiens
caggucagggacagaaugugugccugugagugcguccuga

SEQ ID NO: 178143 - RNA, 41 nt, Homo sapiens
cgacuuccaguucaaggagcugguggugcugccccgcgaga

SEQ ID NO: 178144 - RNA, 42 nt, Homo sapiens
uccaaagccaagccuaauggcaagaagcccgcugcggaggag

SEQ ID NO: 178145 - RNA, 26 nt, Homo sapiens
agccggucacugccgagauuggggcu

SEQ ID NO: 178146 - RNA, 33 nt, Homo sapiens
ccguaucaguugaauagacgaaggggcagggag

SEQ ID NO: 178147 - RNA, 90 nt, Homo sapiens
ugggcagccagugacaggaugucaucccgcgccacugaguuguaggcagguggagaggagaagcuugagcugcggugguuucuguggagg

SEQ ID NO: 178148 - RNA, 47 nt, Homo sapiens
cccucccuuuguauuuggagacaauguguuguaauaaagcuuaaagu

SEQ ID NO: 178149 - RNA, 33 nt, Homo sapiens
gcuguggcuccugugggggcuccaagggaggcu

SEQ ID NO: 178150 - RNA, 28 nt, Homo sapiens
uccugcuccagcuguggcaaagggggcu

SEQ ID NO: 178151 - RNA, 43 nt, Homo sapiens
ccuccagagcagccacagcagcccaugguucugguggguugag

SEQ ID NO: 178152 - RNA, 58 nt, Homo sapiens
gccacagcagcccaugguucugguggauugaggguggagcagguagaggagcagguga

SEQ ID NO: 178153 - RNA, 67 nt, Homo sapiens
cuggagccacagcccccacagccggagccacagcccccacagccggagccacagcccccacagccag

SEQ ID NO: 178154 - RNA, 49 nt, Homo sapiens
agcagcccaugguucugguggauugaggguggagcagguagaggagcag

SEQ ID NO: 178155 - RNA, 51 nt, Homo sapiens
ugagagccccagcugacauggaaauacaguuguuggccuccggccuccccu

SEQ ID NO: 178156 - RNA, 48 nt, Homo sapiens
ggagugagaggggacaaaacccaccuuguuggagccugcaggguggug

SEQ ID NO: 178157 - RNA, 44 nt, Homo sapiens
ccucugcccagcuugggcccagcugggcucugccacccuaccug

SEQ ID NO: 178158 - RNA, 51 nt, Homo sapiens
cagaucuguuucgugcauuggaagaccccacccaagcuuggcagccgagcu

SEQ ID NO: 178159 - RNA, 41 nt, Homo sapiens
aucugugcucuggaucagcucuacccccaccaaacagaugg

SEQ ID NO: 178160 - RNA, 43 nt, Homo sapiens
ccagagcaggaggccccuggcccagcggccccucccacacaca

SEQ ID NO: 178161 - RNA, 46 nt, Homo sapiens
ggccaggggccuccugcucugggacucuccucuguuucugugcugg

SEQ ID NO: 178162 - RNA, 110 nt, Homo sapiens
ccgccacccagcgggccacucuggauccugggcgacgucuucaucggccgcuacuacacuguguuugaccgugacaacaacagggugggcuucgccgaggcugcccgccu

SEQ ID NO: 178163 - RNA, 46 nt, Homo sapiens
gucaaacacaguguaguagcggccgaugaagacgucgcccaggauc

SEQ ID NO: 178164 - RNA, 56 nt, Homo sapiens
acccugcccgcgaucacacugaagcugggaggcaaaggcuacaagcuguccccaga

SEQ ID NO: 178165 - RNA, 46 nt, Homo sapiens
cuuguagccuuugccucccagcuucagugugaucgcgggcagggug

SEQ ID NO: 178166 - RNA, 64 nt, Homo sapiens
ccgguggaugaggugcgcgagcugcagaaggccaucggggccgugccgcugauucagggcgagg

SEQ ID NO: 178167 - RNA, 98 nt, Homo sapiens
gcagcucgcgcaccucauccaccgggcccaccaugagggaagugccuguguccacaauggccucacagcccuccuugcacagggucagcccgcuggcc

SEQ ID NO: 178168 - RNA, 56 nt, Homo sapiens
ugugcaaggagggcugugaggccauuguggacacaggcacuucccucauggugggc

SEQ ID NO: 178169 - RNA, 61 nt, Homo sapiens
ccugccaguaggccuugcgggugacauucagguaggacagagaacccuuguaauacuugga

SEQ ID NO: 178170 - RNA, 45 nt, Homo sapiens
gagcugaugcuggguggcacagacuccaaguauuacaaggguucu

SEQ ID NO: 178171 - RNA, 63 nt, Homo sapiens
caggcaggagggagggucugagggcuucugaaagcauguuuggugaggagaggagggguggga

SEQ ID NO: 178172 - RNA, 52 nt, Homo sapiens
ccuaaccuuggaucgcuuccggcagaauuccggcuguagggcuggcugggcc

SEQ ID NO: 178173 - RNA, 48 nt, Homo sapiens
ggggugggcagcgugucagccggcggccuccugcccugagcugcgccu

SEQ ID NO: 178174 - RNA, 53 nt, Homo sapiens
ggggauccccggggaggugaccuugggugcguauggguccccggcaccacgcu

SEQ ID NO: 178175 - RNA, 45 nt, Homo sapiens
aagauguucugguccaccagcuucugcugcaucagguugucgaag

SEQ ID NO: 178176 - RNA, 80 nt, Homo sapiens
gcagccaggcaucaccuucaucgcagccaaguucgauggcauccugggcauggccuacccccgcaucuccgucaacaacg

SEQ ID NO: 178177 - RNA, 46 nt, Homo sapiens
guacaacagcgacaaguccagcaccuacgugaagaaugguaccucg

SEQ ID NO: 178178 - RNA, 76 nt, Homo sapiens
cgcccccccagugcuucacagucgucuucgacacgggcuccuccaaccuguggguccccuccauccacugcaaacu

SEQ ID NO: 178179 - RNA, 55 nt, Homo sapiens
ggcucuguggaggaccugauugccaaaggccccgucucaaaguacucccaggcgg

SEQ ID NO: 178180 - RNA, 22 nt, Homo sapiens
augggaacuccuagggucucga

SEQ ID NO: 178181 - RNA, 57 nt, Homo sapiens
uccuaagcccaugguggaugccugaagcgaggagaccccaagacguguccuggacug

SEQ ID NO: 178182 - RNA, 64 nt, Homo sapiens
gccgccaggcuuggggcccagcaggccucagggcagggcacccaaagcugcccuugaccugcgg

SEQ ID NO: 178183 - RNA, 46 nt, Homo sapiens
gaaaaaccccgcugccaaaggccuccuagcgggcagcuguacucug

SEQ ID NO: 178184 - RNA, 25 nt, Homo sapiens
cucucuggugacgcugggggaugcc

SEQ ID NO: 178185 - RNA, 48 nt, Homo sapiens
acaaaugagcagaugaacaaaaaauagauggauggacagaagaacauc

SEQ ID NO: 178186 - RNA, 46 nt, Homo sapiens
aaugaauguauugauggaaggacacaugagauggaauuauguaugg

SEQ ID NO: 178187 - RNA, 118 nt, Homo sapiens
aggaggggacgggacaaagaggaaccagcgaaggguccaggccugcgaugauggugagggagguggcagguugacgaggggcuggacaagaacggccgacgaaggagaagaacagagg

SEQ ID NO: 178188 - RNA, 50 nt, Homo sapiens
ugggaggcggcgaugggcagaauaggccccugugccuggggcaggggcac

SEQ ID NO: 178189 - RNA, 49 nt, Homo sapiens
ggagccggccugcagacccucgugccaggagccgaagggagggaccagg

SEQ ID NO: 178190 - RNA, 109 nt, Homo sapiens
ggcaggcagagggucacagggacaaggagaacaccagacagagagaagggacaggggaggggugacagccagcgagagaccgagggccagggcagagcgccaaggaagu

SEQ ID NO: 178191 - RNA, 29 nt, Homo sapiens
gaggcuugagggucggcugcuacccauga

SEQ ID NO: 178192 - RNA, 38 nt, Homo sapiens
acuucagggaugugagguacaucugggcauggcuagcu

SEQ ID NO: 178193 - RNA, 52 nt, Homo sapiens
ggacagcggagagcccccccagugcaggaguccugagggggagcaagaggac

SEQ ID NO: 178194 - RNA, 63 nt, Homo sapiens
aaggaggggccaggcccagaggacacuguccaggacaaccugggggccgcaggggcugaggag

SEQ ID NO: 178195 - RNA, 62 nt, Homo sapiens
aagaggucugucugucugucugucugcuuucugggcucagaucuuagguuuaaccaaguggg

SEQ ID NO: 178196 - RNA, 84 nt, Homo sapiens
caggaucuggcucugccaucaggaagcacaggcagcaaaacugcugacugcuccugacgccgauggccaagccagccugaccgc

SEQ ID NO: 178197 - RNA, 41 nt, Homo sapiens
accaugcugcacccguguccgcacagcagccacgggcacgu

SEQ ID NO: 178198 - RNA, 47 nt, Homo sapiens
uaacuugcuaaugauuacuaagugcuccaaagcuaagaggcagaaag

SEQ ID NO: 178199 - RNA, 47 nt, Homo sapiens
gcugagaguucagaauauguccgugucagccaagccccagcccaggc

SEQ ID NO: 178200 - RNA, 25 nt, Homo sapiens
gcccccgcccugggugcacccauuu

SEQ ID NO: 178201 - RNA, 142 nt, Homo sapiens
gugcagggcccggccgcccuccaucugggccgggugacugggcgccggcugugugcccgaggccucacccugcccucgccuagucuggaagcuccgaccgacaucacggagcagccuucaagcauuccauuacgccccaucu

SEQ ID NO: 178202 - RNA, 35 nt, Homo sapiens
agacggccuugagucucaguacgagugugcgugag

SEQ ID NO: 178203 - RNA, 51 nt, Homo sapiens
agccuccacgacucuguuucccccgucccuucugaauuuaauuugcacuaa

SEQ ID NO: 178204 - RNA, 46 nt, Homo sapiens
ucagaaaaaaggaaagacaggaaagcucagaaacaaagagacagaa

SEQ ID NO: 178205 - RNA, 59 nt, Homo sapiens
ccucaucagcccaacaucaaagacaccaucggaacagcagcgcccgcagcacccacccc

SEQ ID NO: 178206 - RNA, 27 nt, Homo sapiens
uccugagucagguagugcagugguugu

SEQ ID NO: 178207 - RNA, 30 nt, Homo sapiens
aagccccucaccuuucauguuguggguucu

SEQ ID NO: 178208 - RNA, 49 nt, Homo sapiens
uguucuguagaagacagaggucggggcagugagaugguggcccggcggg

SEQ ID NO: 178209 - RNA, 44 nt, Homo sapiens
ggucuccagcugggguggacgugcccaccagcugccgaaggcca

SEQ ID NO: 178210 - RNA, 42 nt, Homo sapiens
cccguggccaaggcgggccucgcgggcggcgacggagccggg

SEQ ID NO: 178211 - RNA, 47 nt, Homo sapiens
accgcucagccccuggggcuggcuuggcagacaguacagcauccagg

SEQ ID NO: 178212 - RNA, 105 nt, Homo sapiens
ggggcagcuccggcacggcuuucucaggccuaugccggagccucgagggcuggagagcgggaagacaggcagugcucggggaguugcagcaggacgucaccagga

SEQ ID NO: 178213 - RNA, 39 nt, Homo sapiens
uacuaaaugaauugcggugggugagguggcagcugggga

SEQ ID NO: 178214 - RNA, 50 nt, Homo sapiens
cagcacguggggugguaccccaggccugggucagacagggacauggcagg

SEQ ID NO: 178215 - RNA, 55 nt, Homo sapiens
gagccgagacugcgcaaggcugggggguuaugggcccguuccaggcagaaagagc

SEQ ID NO: 178216 - RNA, 127 nt, Homo sapiens
uaacucuccugcccccauccugccccucugcugggagggugucugcuucuccccgccagcccucgauccccuaaaccuccuucuuucagaaggcuggggaagcgaggccuggggagggaagggacuc

SEQ ID NO: 178217 - RNA, 69 nt, Homo sapiens
cagacacccucccagcagaggggcaggaugggggcaggagaguuagcaaaggugacaucuucucggggg

SEQ ID NO: 178218 - RNA, 48 nt, Homo sapiens
aucccagggccugggcaacggagguguagcuggcagcagcgggcaggu

SEQ ID NO: 178219 - RNA, 47 nt, Homo sapiens
guccucaccugcccgcugcugccagcuacaccuccguugcccaggcc

SEQ ID NO: 178220 - RNA, 87 nt, Homo sapiens
uggggacgaugggccugagcuagggcuggaaagaagggggagccaggcauucaucccggucacuuuugguuacaggacguggcagcu

SEQ ID NO: 178221 - RNA, 47 nt, Homo sapiens
cacguccuguaaccaaaagugaccgggaugaaugccuggcucccccu

SEQ ID NO: 178222 - RNA, 138 nt, Homo sapiens
gagcaccuuggacaucuggagucuggcaggagugaugacggguggaggggcuagcucgaggcagggcugguggggccugaggccagugaggaguguggaguaggcgcccaggcaucgugcagacagggcgacaucagc

SEQ ID NO: 178223 - RNA, 46 nt, Homo sapiens
gucaucacuccugccagacuccagauguccaaggugcuccuuggcu

SEQ ID NO: 178224 - RNA, 46 nt, Homo sapiens
aucccaugcuuggguuuugucuuuaaccuuguaacgcuugcaaucc

SEQ ID NO: 178225 - RNA, 47 nt, Homo sapiens
ggcaagcgcccugugagugggccauucggaacauuggacagaagccc

SEQ ID NO: 178226 - RNA, 42 nt, Homo sapiens
ggcagggacucggccucugggagguuuaccucgcccccacuu

SEQ ID NO: 178227 - RNA, 45 nt, Homo sapiens
gggaguagggaggucaggcgggucugagcccacagagcaggagag

SEQ ID NO: 178228 - RNA, 45 nt, Homo sapiens
cgccugaccucccuacuccccggccucaccccaccuugcccccaa

SEQ ID NO: 178229 - RNA, 42 nt, Homo sapiens
uccugagggcggagggggggguugggcagggucuccucaggu

SEQ ID NO: 178230 - RNA, 47 nt, Homo sapiens
gccuucuccacuccccucugacuucuccaagggggcucaguggccag

SEQ ID NO: 178231 - RNA, 41 nt, Homo sapiens
ggauuuuguuuuucaucugucccuguugcuuggguugaguu

SEQ ID NO: 178232 - RNA, 63 nt, Homo sapiens
aaauguggaguccucgggggccgugcacugaugcggggagugugggaagucuggcgguuggag

SEQ ID NO: 178233 - RNA, 39 nt, Homo sapiens
caacuacgauaucuguauggaucaggccaaagucccgcu

SEQ ID NO: 178234 - RNA, 654 nt, Homo sapiens
uccccgcagcuacacacacacaacacacagcacacgcaugaacacagcacacacacgagcacagcacacacacaaacgcacagcacacacagcacacagaugagcacacagcacacacacaaacgcacagcacacacacgcacacacaugcacacacagcacacaaacgcacggcacacacacgcacacacaugcacacacagcacacacacaaacgcacagcacacacaaacgcacagcacacacgcacacacagcacacacacgagcacacagcacacaaacgcacagcacacgcacacacaugcacacacagcacacacacuagcacacagcacacacacaaagacacagcacacacaugcacacacagcacacacacgcgaacacagcacacacgaacacagcacacacagcacacacacaaacacagcacacacaugcacacagcacacgcacacacagcacacacaugaacacagcacacagcacacacaugcacacacagcacacacgcaugcacagcacacaugaacacagcacacacacaaacacacagcacacacaugcacacacagcacacacacucaugcgcagcacauacaugaacacagcucacagcacacaaacacgcagcacacacguugcacacgca

SEQ ID NO: 178235 - RNA, 54 nt, Homo sapiens
caugaaaaccaaaauccaugcaaaugaaauguaauuggcacgacccucaccccc

SEQ ID NO: 178236 - RNA, 51 nt, Homo sapiens
cauguacaaaaucgauuggcuuuaaacacccuucacauacccuccccccaa

SEQ ID NO: 178237 - RNA, 48 nt, Homo sapiens
gguuccacgucccccuggggcuucuccugacccaguccccgugccccg

SEQ ID NO: 178238 - RNA, 45 nt, Homo sapiens
ccccgcccacgggggcgcccccccagagauggccagcaaucggaa

SEQ ID NO: 178239 - RNA, 45 nt, Homo sapiens
ugaccuggcccuccuggagacguacugugcuacccccgccaaguc

SEQ ID NO: 178240 - RNA, 41 nt, Homo sapiens
uuucacguucacucugucucucccacuaucucugccccccu

SEQ ID NO: 178241 - RNA, 62 nt, Homo sapiens
gcucuuucucccgcaaccuucccuucgcucccucccgucccccccagcuccuagccuccgac

SEQ ID NO: 178242 - RNA, 48 nt, Homo sapiens
ccgccccccagucaccgccucccccggccccucgacguggcgcccuuc

SEQ ID NO: 178243 - RNA, 42 nt, Homo sapiens
uccccgccgccuccucuucaucuaccucaacuccccccaucc

SEQ ID NO: 178244 - RNA, 60 nt, Homo sapiens
aggugugccccacacaggcuucucccuagcagagcagcagugcccacaaacccaccccag

SEQ ID NO: 178245 - RNA, 43 nt, Homo sapiens
agcgcgauuugcaaugcaaagucaccccgccuccagcacccca

SEQ ID NO: 178246 - RNA, 45 nt, Homo sapiens
ucuucgcgcccccgccccucggcccgccaggcccccuugccggcc

SEQ ID NO: 178247 - RNA, 57 nt, Homo sapiens
ccggcccgcccgccgcccaggaccggcccgcgccccgcaggccgcccgccgcccgcg

SEQ ID NO: 178248 - RNA, 30 nt, Homo sapiens
cuuacccagaagacgaaauugaagacgaag

SEQ ID NO: 178249 - RNA, 45 nt, Homo sapiens
aguacccggccgccccucagcuaaggaggggccugcgcggguccc

SEQ ID NO: 178250 - RNA, 29 nt, Homo sapiens
cccagugcggaugauuauuuggaggggga

SEQ ID NO: 178251 - RNA, 47 nt, Homo sapiens
gagcuuugcucauagagucaauaaggcuuagaguccaggcgccugug

SEQ ID NO: 178252 - RNA, 46 nt, Homo sapiens
augcuggugucucccaggcaucagggguggugggcaccagugcccc

SEQ ID NO: 178253 - RNA, 57 nt, Homo sapiens
guccuccuggucccgagggaagugacuccucacaucccccagcuggcggggccagag

SEQ ID NO: 178254 - RNA, 134 nt, Homo sapiens
gccccguccccaaccuccacacccaggccuggcacugccccuucuuggugggcagagagugagggguuggccugcagggacccaggcuggaggggccguucaccuccggcccccagcgucccuuccuggaagca

SEQ ID NO: 178255 - RNA, 44 nt, Homo sapiens
guuuagcgaggauggcagccuacuucccccgcccaggccccaga

SEQ ID NO: 178256 - RNA, 21 nt, Homo sapiens
ccauaggagggcaggaggcac

SEQ ID NO: 178257 - RNA, 48 nt, Homo sapiens
aggcgugauccuggguguggcccuguggcuccgccaugacccgcagac

SEQ ID NO: 178258 - RNA, 46 nt, Homo sapiens
gcgcgggcuugucucccagcuccagauacaggagguugguggucug

SEQ ID NO: 178259 - RNA, 44 nt, Homo sapiens
caacaaaugcucccagagccccaccagcaccagcccugccaggg

SEQ ID NO: 178260 - RNA, 46 nt, Homo sapiens
ggucagagggccggugcugggguccagauggugucaacagggaugg

SEQ ID NO: 178261 - RNA, 49 nt, Homo sapiens
cgggaccugcauuugaaccuggcugcuguguggggaggaucaaguugga

SEQ ID NO: 178262 - RNA, 43 nt, Homo sapiens
ugagguggccgccggcaucuggggcuuugucaacaaggaccag

SEQ ID NO: 178263 - RNA, 101 nt, Homo sapiens
cgccaaggaugugaagcaguucuaugaccaggcccuacagcaggccgugguggaugaugacgccaacaacgccaaggcuguggugaagaccuuccacgaga

SEQ ID NO: 178264 - RNA, 46 nt, Homo sapiens
ccugcuguagggccuggucauagaacugcuucacauccuuggcgau

SEQ ID NO: 178265 - RNA, 42 nt, Homo sapiens
acaaauuguucuugagcacugagguggucaaagcagucagug

SEQ ID NO: 178266 - RNA, 47 nt, Homo sapiens
caagaacaauuugugucccucgggcagcaacaucaucagcaaccucu

SEQ ID NO: 178267 - RNA, 47 nt, Homo sapiens
gcacagugugucccaggcauuucgcguuuauguuaaaacggguggaa

SEQ ID NO: 178268 - RNA, 67 nt, Homo sapiens
cagaucuucgagaugauccugagcauggugcugugcuguggcauccggaacagcuccguguacugag

SEQ ID NO: 178269 - RNA, 115 nt, Homo sapiens
gccccgcagcucuggccacagggaccucugcagugcccccuaagugacccggacacuuccgagggggccaucaccgccuguguauauaacguuuccgguauuacucugcuacacg

SEQ ID NO: 178270 - RNA, 36 nt, Homo sapiens
cugaacuuuccuguuaccuuuucagggcugacguca

SEQ ID NO: 178271 - RNA, 115 nt, Homo sapiens
guguaugaguggagacgggccugggucuuggggacuggagggcagggguccuucugcccuggggucccagggugcucugccugcucagccaggccucuccugggagccacucgcc

SEQ ID NO: 178272 - RNA, 32 nt, Homo sapiens
cugcacagcucaccuuguucccuccugccccg

SEQ ID NO: 178273 - RNA, 92 nt, Homo sapiens
uucaugcaccuguccuuucuaacacgucgccuucaacuguaaucacaacauccugacuccgucauuuaauaaagaaggaacaucaggcaugc

SEQ ID NO: 178274 - RNA, 46 nt, Homo sapiens
gaccucagcuugcccgguggugcugaaguggaagcacuguccccga

SEQ ID NO: 178275 - RNA, 42 nt, Homo sapiens
ccuccuucaaccaggaucccuccagcuguggggaggggaggg

SEQ ID NO: 178276 - RNA, 135 nt, Homo sapiens
cuggccacugccauccugcugccuucccaguggggcuggucagggggcagccuggccacugccuagcuggaaugggaggaagccugcagguggcaccgguggcccuggcugcaguucugggcagcauccucccaa

SEQ ID NO: 178277 - RNA, 50 nt, Homo sapiens
ggaaagcuaagagcccccgcccccagggaaccugcacucucugggugagg

SEQ ID NO: 178278 - RNA, 48 nt, Homo sapiens
cugccacacagaggcacugcccacccccccaacuccugucccccaggc

SEQ ID NO: 178279 - RNA, 41 nt, Homo sapiens
augcauacacacacacacccauaggugcacacacacccaga

SEQ ID NO: 178280 - RNA, 44 nt, Homo sapiens
agugccagaaagcagcaugaaaccagcccagaucugccugugca

SEQ ID NO: 178281 - RNA, 46 nt, Homo sapiens
caggcuccgagagccucugucucccuggggugggcuccaggcaggu

SEQ ID NO: 178282 - RNA, 71 nt, Homo sapiens
ucacugucuuagcuagaacugggauagggggaaaaggggguggagcgggggacauuauuuuuaucugccag

SEQ ID NO: 178283 - RNA, 26 nt, Homo sapiens
ugcgcacagaggcccuggaaggcuga

SEQ ID NO: 178284 - RNA, 52 nt, Homo sapiens
ugguccugugggcuccauuccaaugcuaauggacucuuaaggggcccaggaa

SEQ ID NO: 178285 - RNA, 46 nt, Homo sapiens
ucaagacaaaauuacacaggaagaaaaaaauguuuuuaaucuaauu

SEQ ID NO: 178286 - RNA, 30 nt, Homo sapiens
cugcccccacuaguuuucagggcagagggc

SEQ ID NO: 178287 - RNA, 98 nt, Homo sapiens
ccuaaggauacagccaucccauggggccaauggauagagagcaagggaaagggagaacaaaagagggaacgggaagggagaaggggagugcaagaggg

SEQ ID NO: 178288 - RNA, 47 nt, Homo sapiens
cccuccccuguacggcugcagggcuuaugugugccuggcgcucagca

SEQ ID NO: 178289 - RNA, 44 nt, Homo sapiens
cccccugcccuuccccuccugauugauuaaaauccggccuaauc

SEQ ID NO: 178290 - RNA, 59 nt, Homo sapiens
gcuuucuguucccaagaaauucuggucucacuuccucugccuucucaucgagccccaga

SEQ ID NO: 178291 - RNA, 46 nt, Homo sapiens
guugccagaauaugucccuccaccuggccuggagcugcccaugagg

SEQ ID NO: 178292 - RNA, 52 nt, Homo sapiens
uuuuuaaaaaaauaaaauucaaaucccccuaucgagcaggaccacugacuag

SEQ ID NO: 178293 - RNA, 46 nt, Homo sapiens
uucagggcagaacaaaacaauuuuguuuucuaggaaagugggaggu

SEQ ID NO: 178294 - RNA, 43 nt, Homo sapiens
cacaaaaugcaaaggacuccuacaaaucaauaggaaaaauaua

SEQ ID NO: 178295 - RNA, 47 nt, Homo sapiens
aaucucaaggcuucugugugagaacuuuggcaagcugauucuaacug

SEQ ID NO: 178296 - RNA, 52 nt, Homo sapiens
ucuguaaauaaaaaaugugagguaacaagagaaaacagaaccuguauacaau

SEQ ID NO: 178297 - RNA, 97 nt, Homo sapiens
gccagguuucuagcugucagagaaaaagcuauaaauaaguugugggggagggggcaaggaugaacucuggucagaaaugucaguaugaacucauggu

SEQ ID NO: 178298 - RNA, 34 nt, Homo sapiens
cguguuacaaacaaaugacauagcagugaaagga

SEQ ID NO: 178299 - RNA, 24 nt, Homo sapiens
augucuguaauguauagaaaauuc

SEQ ID NO: 178300 - RNA, 54 nt, Homo sapiens
gggaugucacugugacucuguuccugucacucuguaacauaagcucauuucauu

SEQ ID NO: 178301 - RNA, 36 nt, Homo sapiens
gaggccuaacgugcuguccccacacuuucuccucag

SEQ ID NO: 178302 - RNA, 47 nt, Homo sapiens
uggccaggguuccauggggaaaugcuaaaaaacaaagucgucucuuu

SEQ ID NO: 178303 - RNA, 46 nt, Homo sapiens
augucuuggcgugagauucugcaggguccaggagaaaguugaagac

SEQ ID NO: 178304 - RNA, 80 nt, Homo sapiens
ugggccauccaccuagacagugcggcccucuccccauagcagcagcccuaggccagccgcuucuuccucacgugcucaga

SEQ ID NO: 178305 - RNA, 54 nt, Homo sapiens
cugcacacaugggucccagggacugaagaugccucaagcugcgcacuugagacc

SEQ ID NO: 178306 - RNA, 38 nt, Homo sapiens
aggcugccagacaucaaauugagugagggacauuggac

SEQ ID NO: 178307 - RNA, 48 nt, Homo sapiens
acugggcuugagugcagaccgggccaggguagggagacaagcccaaca

SEQ ID NO: 178308 - RNA, 34 nt, Homo sapiens
uagggaaggauaucucaauugaagcucuucagag

SEQ ID NO: 178309 - RNA, 48 nt, Homo sapiens
uccagcccuucugaaggggacugguuggaucuguugcggggaggagac

SEQ ID NO: 178310 - RNA, 43 nt, Homo sapiens
cacugggcugggauuggagcaacuuuaacgaguuaaguucaga

SEQ ID NO: 178311 - RNA, 41 nt, Homo sapiens
cuccccagaaggcagguguuggccaggcaguggaugcacgg

SEQ ID NO: 178312 - RNA, 43 nt, Homo sapiens
ugcuguccucugaaaugcuuaucuaggcaucgaucuugguuuc

SEQ ID NO: 178313 - RNA, 48 nt, Homo sapiens
aauccacugaaaacggagaccaaaauuuuacaauagagauauuugauu

SEQ ID NO: 178314 - RNA, 49 nt, Homo sapiens
cucugucaaaaucccgauaaagcaaggauuuaaauguaaaaaaugaaau

SEQ ID NO: 178315 - RNA, 74 nt, Homo sapiens
cacagauaagugcaucauaaaguuacauaauuaaaauaacugagcucuggccuaucaacaggcccaucagcagu

SEQ ID NO: 178316 - RNA, 52 nt, Homo sapiens
auggaauggccaucaugagguauagcaauacauuuaaguaacacugugucac

SEQ ID NO: 178317 - RNA, 56 nt, Homo sapiens
augcaaggauacacacaauaaccugggugaaucuucagggaauugugcugagugaa

SEQ ID NO: 178318 - RNA, 79 nt, Homo sapiens
uacugaaagaauauuugaugagcugggacaucuccugcagauccacggcucccuagcuuugugacccugggcccuagac

SEQ ID NO: 178319 - RNA, 54 nt, Homo sapiens
ucacugcauuucauggugcccagauuucccugcauuucuagaaugucaacagag

SEQ ID NO: 178320 - RNA, 34 nt, Homo sapiens
uguauccccacccccaccagguccccugccugac

SEQ ID NO: 178321 - RNA, 45 nt, Homo sapiens
ugcaaaggacagcugccccugcagcuacucacucugcccuggccc

SEQ ID NO: 178322 - RNA, 46 nt, Homo sapiens
gaauaggcugagaugaaaaaacaaagaggcugucaacaucagagac

SEQ ID NO: 178323 - RNA, 59 nt, Homo sapiens
auucucugauugcuggcaguggauggccacuggccugcaaauggcccuaguggaauguc

SEQ ID NO: 178324 - RNA, 63 nt, Homo sapiens
uggagagacauuuggggggucagggccucacagguggucuggaagcccuuggugcugagggaa

SEQ ID NO: 178325 - RNA, 115 nt, Homo sapiens
gcagguggugaggaagcggguguaucggaaaugaccccagaacuucugacuugugccacugaaaggaugggugacacugaaaggacaggggccuucaguagagugggcuauaaaa

SEQ ID NO: 178326 - RNA, 101 nt, Homo sapiens
ccuaucaggacaguggcaauagggauggagggaagcagggaaccucuagaacuauggaugggugaaguaagccuggcuuggugaugggcuugaggugaugg

SEQ ID NO: 178327 - RNA, 24 nt, Homo sapiens
cugaaaaacucccuuggggaaagu

SEQ ID NO: 178328 - RNA, 76 nt, Homo sapiens
caggguuaguggacaaaggggagaaagacuaacuaauguugaaggaccguuugcacccugaggggagugcugaggc

SEQ ID NO: 178329 - RNA, 42 nt, Homo sapiens
gaauuaugucuaacaggcaggggaaugaucauugccucaugu

SEQ ID NO: 178330 - RNA, 44 nt, Homo sapiens
ugacuugugguccucucagaaaagggucugacuggaacgcagag

SEQ ID NO: 178331 - RNA, 47 nt, Homo sapiens
ugcuuggccagacucggcccccacccagggucugguuggcuucaggg

SEQ ID NO: 178332 - RNA, 45 nt, Homo sapiens
cuaauuguagcaauuagcauuagagaauggggacucgaugggggg

SEQ ID NO: 178333 - RNA, 62 nt, Homo sapiens
ggcugggcgaagcucuuguuugcaauuuaaauguggccucauuuauggaagaaucccugcuc

SEQ ID NO: 178334 - RNA, 42 nt, Homo sapiens
uucuaguuccuuagacaucuacuuauuuguuggcugccuauc

SEQ ID NO: 178335 - RNA, 73 nt, Homo sapiens
aaggaacaagccucccugugugcugcagguggggacggagacaggcacagacguucugaagagcuggccaaca

SEQ ID NO: 178336 - RNA, 79 nt, Homo sapiens
cuuuuacacucaugaauguaacuuugccaugacucauuacaagauauuugaaacaauuaaagcugaggagggaacaaca

SEQ ID NO: 178337 - RNA, 69 nt, Homo sapiens
agcaaaagguaguugccauuuguuuaauaggagaaaaaaugaauaaucuccagggccaggguggccgug

SEQ ID NO: 178338 - RNA, 120 nt, Homo sapiens
ucaguggggacuguucagaagaugauguuggaaagccagcccuaaaauggaggaauaggaauauggauuccuaacugagccccuaggaaaaguagacuccaaauggacuaaauauuugaa

SEQ ID NO: 178339 - RNA, 53 nt, Homo sapiens
aacaaagacgacgacuuuuauggaaaaaauuuuaaaacucuauuggaggauau

SEQ ID NO: 178340 - RNA, 49 nt, Homo sapiens
cuuuaugccaauagcaacugacuaaaaaaaagcauaauagagauuagga

SEQ ID NO: 178341 - RNA, 76 nt, Homo sapiens
cauggaaaaaaaaaauuaaggaacuuaacaacuaaagagagauuucagauuucagagagguuuuggauauaagauc

SEQ ID NO: 178342 - RNA, 54 nt, Homo sapiens
ucauccuggccauacccuaauacaagaaaaagaaauggggaugugaggaucagg

SEQ ID NO: 178343 - RNA, 47 nt, Homo sapiens
cugagucaggaauuagggggcgaaguaaagguugcagucugaguugg

SEQ ID NO: 178344 - RNA, 37 nt, Homo sapiens
ggcucugaguuaagagauugggauugggguuagaggu

SEQ ID NO: 178345 - RNA, 55 nt, Homo sapiens
cacauccuggcugggaguuugccugaguugggaucugaguaguuggggucccagu

SEQ ID NO: 178346 - RNA, 42 nt, Homo sapiens
caugcugaggagcccccggggagaacagaaccgcggcgagag

SEQ ID NO: 178347 - RNA, 49 nt, Homo sapiens
acccggggcuuuucggcgcgguucuccccggggguucuucggcgcgguu

SEQ ID NO: 178348 - RNA, 45 nt, Homo sapiens
accuccagggagcuccucagcaagauccugccagggcgccccuca

SEQ ID NO: 178349 - RNA, 47 nt, Homo sapiens
ccugucauuggccgaaagagucucguuuugaugccacccgggcucag

SEQ ID NO: 178350 - RNA, 47 nt, Homo sapiens
uguggguucuaauugugggccuggauggggacauaucuuacaaguag

SEQ ID NO: 178351 - RNA, 39 nt, Homo sapiens
gcugccuggggguggggugggggcacaguccccaaaagg

SEQ ID NO: 178352 - RNA, 44 nt, Homo sapiens
cugcaaacaggggcugugucccucacaccaaggccguguggcag

SEQ ID NO: 178353 - RNA, 43 nt, Homo sapiens
gagcucagcuucucugggccacugcccgggacccacccuuggc

SEQ ID NO: 178354 - RNA, 29 nt, Homo sapiens
cccuuuuggaaaccuacugcuggcccagg

SEQ ID NO: 178355 - RNA, 45 nt, Homo sapiens
cgaggugccaggaagagccuugggaagccacagagaagucagggc

SEQ ID NO: 178356 - RNA, 35 nt, Homo sapiens
ccguggggaaaggccacaagccaagggaggugggg

SEQ ID NO: 178357 - RNA, 43 nt, Homo sapiens
agagccaccccugccucaggcaagauggggcuggggcccaugg

SEQ ID NO: 178358 - RNA, 66 nt, Homo sapiens
agaggagagcgugugcauguuucggggguggugcgccuggcagggcaggggaacagcgggcgcgaa

SEQ ID NO: 178359 - RNA, 41 nt, Homo sapiens
aauuuuauugcucugugagucagaguuugccagcccacaag

SEQ ID NO: 178360 - RNA, 365 nt, Homo sapiens
aaaauaaaaaaaaugacggcaagaggcugggcauggugccucaugccuauaaucccagcacuuugggaggccgaggcggauggaucacuugaggccaggaguucgagaucagccuggccagcauggugaaaccccaccucuaccaaaaauacaaaaauuagcuaggugugguggcgcacaccuguagucccagcuacucaggaggcugaggugagacaaucgcuugaacccgggagguggaguuugcagugagccgagaucgcaccacugcacuccagccugggugacagaaugagacuccaucucaaaaaacaaaacaaaacaaaacaaaaaccaaauaguagugagggagaagaggcagccga

SEQ ID NO: 178361 - RNA, 45 nt, Homo sapiens
gggccuacaggucugaggcugccugcacagagccaccaggaagga

SEQ ID NO: 178362 - RNA, 46 nt, Homo sapiens
cuuguucccaggccccagcaggcugcuggacggcugcugugcacgu

SEQ ID NO: 178363 - RNA, 35 nt, Homo sapiens
cagguccccuccccgggagggaggggaggcucggg

SEQ ID NO: 178364 - RNA, 49 nt, Homo sapiens
agugcgggaggggacgccgggccugcagggguggcggagggacccggga

SEQ ID NO: 178365 - RNA, 26 nt, Homo sapiens
agcuucaucagcacuguggcugccau

SEQ ID NO: 178366 - RNA, 58 nt, Homo sapiens
gggguccaugggcauagcagggugggagcuggugggcccgagguggggaugagagggg

SEQ ID NO: 178367 - RNA, 45 nt, Homo sapiens
ggcuuuucauaagcgaauuaaaauagcacacaaacagcacagggc

SEQ ID NO: 178368 - RNA, 38 nt, Homo sapiens
gcagggaagguggccacuggaguaucgugaugggggaa

SEQ ID NO: 178369 - RNA, 69 nt, Homo sapiens
ggccauggcacaaccccagggugccacucacacaggcacagaggccuugaggcggaagcccccaggagg

SEQ ID NO: 178370 - RNA, 44 nt, Homo sapiens
aggggcuggagguguugucaggacuuggugaccaggcgcagggu

SEQ ID NO: 178371 - RNA, 44 nt, Homo sapiens
ucuccuuggaauuuaaguugcagcccaaggggauaucaugucuc

SEQ ID NO: 178372 - RNA, 23 nt, Homo sapiens
gggcaggugggcaggggaagcca

SEQ ID NO: 178373 - RNA, 44 nt, Homo sapiens
aggacagcgagaagaaggggaaaggagaggaggagagggcggag

SEQ ID NO: 178374 - RNA, 42 nt, Homo sapiens
ggcccggccgcgauuagcauaauguaguauuuucaguuucaa

SEQ ID NO: 178375 - RNA, 44 nt, Homo sapiens
aguuacaucuuugcuacuugguuagcaagaaacacugggcucag

SEQ ID NO: 178376 - RNA, 40 nt, Homo sapiens
gucaucaucuucuauggccuccccagugaaguacagcaca

SEQ ID NO: 178377 - RNA, 631 nt, Homo sapiens
gauuucaaauuaaucccagaguuuuaggaaacagaaauggauuuuuuuuuuuuaagagacagggucuuauucuaucacccagguuggagggcaguggugcaaucacagcucacuccagccucaagcuccugggccccagcgacccuggaacuacacagugcaccaccauguccagcuaauuuauuauuuuaucuuuugagacggagucuugcucugucgcccaauggaauacgguggugcaaucucagcucacugcaaccuccuccucucggguucaagugauucuccugcuugagccuccugaguagcugagauuacaggcgcugccaccguguccaacuaauuuuuuuuuuuuuugguauuuuaagcagaaacgggguuucaccauguugaccagacuggucuugaacuccugaccucuggugauccacccaccuuggccucccacagugcugguauuacgggcgugaaccaccauguucggcuggcuaauuuauuugguuuuaauuuuuuguggagaugggguugugcuauguugcccaggcuggucucaaacuccuggacucgugcaguccucccaccucagccucccaaagcauuaagaucacuggcauacccaguccacacacag

SEQ ID NO: 178378 - RNA, 52 nt, Homo sapiens
agcugucaggaacacacaauccaugagaaaaauccauuacaaaugcaugcag

SEQ ID NO: 178379 - RNA, 69 nt, Homo sapiens
uaaagacguguuucaggacaaaucaaagagcaggaaaacauuuuucagucuuauuugcgcuuuuuuuuu

SEQ ID NO: 178380 - RNA, 48 nt, Homo sapiens
gugucagaugcuagauccauaucagaaaggaaucuaaacccaaccuaa

SEQ ID NO: 178381 - RNA, 30 nt, Homo sapiens
ugaacuacagcucccagcaugcuccgggcc

SEQ ID NO: 178382 - RNA, 30 nt, Homo sapiens
cgcgcgcaagcgaggccaggggaagguggg

SEQ ID NO: 178383 - RNA, 49 nt, Homo sapiens
ugugcauguggguggucuggauuaacaccagucagugugggaacuaggg

SEQ ID NO: 178384 - RNA, 34 nt, Homo sapiens
guaaguuuuggcugggaagaaacuaagcuuguau

SEQ ID NO: 178385 - RNA, 45 nt, Homo sapiens
auuuuacaugagcccugaacaaggacaccugcaaacgugcucuaa

SEQ ID NO: 178386 - RNA, 52 nt, Homo sapiens
cauggcuugugaccaguacagcugcgcccugacuggcccugugguggacauc

SEQ ID NO: 178387 - RNA, 54 nt, Homo sapiens
aucuguaaacuggagagagcccagcacuuggcagguguccaguaccuaaucacg

SEQ ID NO: 178388 - RNA, 52 nt, Homo sapiens
cuguggccuuucagguguaggcaggugggcucugcuucccgauucccuguga

SEQ ID NO: 178389 - RNA, 45 nt, Homo sapiens
cuccaaagguuucggcggcaaauacgguaucgacaaggacaaagu

SEQ ID NO: 178390 - RNA, 45 nt, Homo sapiens
cagugguuuuggcggcaaguauggcgugcaggccgaccgaguaga

SEQ ID NO: 178391 - RNA, 53 nt, Homo sapiens
ccugguggcugaccugguacaagagguucagcaggcccgugaccuccagaaca

SEQ ID NO: 178392 - RNA, 50 nt, Homo sapiens
cgggaaaggugggggaagaagggggaagggugggcgagagagagaaagag

SEQ ID NO: 178393 - RNA, 46 nt, Homo sapiens
uggauggauggauggauagguggauggauggauggguggaugggug

SEQ ID NO: 178394 - RNA, 25 nt, Homo sapiens
agguguauggauggaugggugagug

SEQ ID NO: 178395 - RNA, 40 nt, Homo sapiens
gccggccucuggcuggccguggccgggcgcccccucgccu

SEQ ID NO: 178396 - RNA, 45 nt, Homo sapiens
caguucuggccuggagggauuugggaagggcaaauggucccugga

SEQ ID NO: 178397 - RNA, 43 nt, Homo sapiens
uggccucagggggaauucucaaguugucccagggcuggagugg

SEQ ID NO: 178398 - RNA, 44 nt, Homo sapiens
ccacuccagcccugggacaacuugagaauucccccugaggccag

SEQ ID NO: 178399 - RNA, 48 nt, Homo sapiens
agauggaagcaggugacaccgggacagcaaguuauucucaggacagca

SEQ ID NO: 178400 - RNA, 57 nt, Homo sapiens
gucaaccugcacuucuuguucaaaaaucaggaaaagaaaagauuugaagaccccaag

SEQ ID NO: 178401 - RNA, 49 nt, Homo sapiens
gagauguacauaucaaaauaaauuacucauaaauaucauguuggaaaac

SEQ ID NO: 178402 - RNA, 48 nt, Homo sapiens
auuuugauauguacaucucuuauuuucuuacauuauuuaugcccccaa

SEQ ID NO: 178403 - RNA, 42 nt, Homo sapiens
aaggaaaugaaaugcaugaaacuuuugcugaaagacagcuaa

SEQ ID NO: 178404 - RNA, 27 nt, Homo sapiens
acccuugggcuugcuccgaggggaggg

SEQ ID NO: 178405 - RNA, 45 nt, Homo sapiens
ugcgccucggucaucuuccccgccugguacuggcgccggcggccc

SEQ ID NO: 178406 - RNA, 43 nt, Homo sapiens
uugcccccaggugguggggccccuccuugcccuaggcugguug

SEQ ID NO: 178407 - RNA, 95 nt, Homo sapiens
uaaggcauuaucagugagcaaaugugaaggaaauggugucuggaagaaaguucugguucacaugccuuguagcuaagucuuucugcaaacaaccu

SEQ ID NO: 178408 - RNA, 46 nt, Homo sapiens
gggccuuuggccgccuuggguaguugaccugccuuuucugacuccg

SEQ ID NO: 178409 - RNA, 44 nt, Homo sapiens
gaccucgcaucagucccuccacccacccugcccauggguuucac

SEQ ID NO: 178410 - RNA, 39 nt, Homo sapiens
ggccggcgcgggcgcggcgggccgggcaggggcgagggg

SEQ ID NO: 178411 - RNA, 41 nt, Homo sapiens
ggucuggguugaggaccgccguccaggaacucggcucuguu

SEQ ID NO: 178412 - RNA, 34 nt, Homo sapiens
agcuuguggcuaggggcagacugggagguagagg

SEQ ID NO: 178413 - RNA, 193 nt, Homo sapiens
guuuuauuuauuuauuuauguuugagauggggucuugguauguugcccaggcuggacucaaacuccugggcucaaaugauccucccaccucagccucccaaaguauggugauuacaggcaugagccaccaugcccggccaguauaccuguuuucccuauuggcuagaagguccugcauuuuaacuucuagcug

SEQ ID NO: 178414 - RNA, 29 nt, Homo sapiens
cgcagcuucuggggcaagaccugcaaggg

SEQ ID NO: 178415 - RNA, 42 nt, Homo sapiens
ccccguaccccugauucucgauccuaacagcgacacccucag

SEQ ID NO: 178416 - RNA, 46 nt, Homo sapiens
cuggacucucgccgguagggagggcugggcugacagugccacgagu

SEQ ID NO: 178417 - RNA, 28 nt, Homo sapiens
agccggggacccgccucaucuccuggcc

SEQ ID NO: 178418 - RNA, 45 nt, Homo sapiens
ggaacuacguuucccggcaugcacugcgggccgccgggccucagg

SEQ ID NO: 178419 - RNA, 65 nt, Homo sapiens
ggggcgaagguggcggagagggauggguuccaggacguccuggcgcccggggaaggcucggcggg

SEQ ID NO: 178420 - RNA, 41 nt, Homo sapiens
gccguucgucccucaggugcuuggcgugaugaucggggccg

SEQ ID NO: 178421 - RNA, 76 nt, Homo sapiens
cguggauaccucugucuccgccaccucccggccacgcaugaggaagaaacugaagaugcucaacauugccaagaag

SEQ ID NO: 178422 - RNA, 42 nt, Homo sapiens
uccagaaagagacgcccacgcugcagcggaaggagcccccgc

SEQ ID NO: 178423 - RNA, 29 nt, Homo sapiens
uggcacuacaaagucuggcuuagacaggg

SEQ ID NO: 178424 - RNA, 42 nt, Homo sapiens
gacugcaccuuccugcggaucuccaaguccgacuucuaugag

SEQ ID NO: 178425 - RNA, 46 nt, Homo sapiens
uucuaaggacagugagcugagacuugacaacuaagauggggccaga

SEQ ID NO: 178426 - RNA, 89 nt, Homo sapiens
agccagcaaccuggcaacuguggcaauccugccugugugugcugagguccccaugguggccuucacgcuggagcugcagcacgcccugc

SEQ ID NO: 178427 - RNA, 60 nt, Homo sapiens
aaauucuuucagaccugaguucaaguucuuggcuuccaaccacggagccugcgucuuacc

SEQ ID NO: 178428 - RNA, 41 nt, Homo sapiens
cuagcauccaagaguuccggcugucaggguggcuggcccag

SEQ ID NO: 178429 - RNA, 42 nt, Homo sapiens
cagcuggagcagaugcuggagaacacggcugugcgcgcccuu

SEQ ID NO: 178430 - RNA, 42 nt, Homo sapiens
ggcacagcgacuucucccgcuuggcgagggugcucacgggga

SEQ ID NO: 178431 - RNA, 42 nt, Homo sapiens
ucccggcaggggcugcucgcacaucggaguacuaaaggcauu

SEQ ID NO: 178432 - RNA, 46 nt, Homo sapiens
caggugcuugccuucccaagcucuggcuucacugacuuggcagaga

SEQ ID NO: 178433 - RNA, 79 nt, Homo sapiens
uugucugacagaguaugaggaggacgccggacccgacugcucgagggaugaaggggggucccccgagggcgcaagcccc

SEQ ID NO: 178434 - RNA, 37 nt, Homo sapiens
guggccccguggggguagcucacucccccuccugcug

SEQ ID NO: 178435 - RNA, 36 nt, Homo sapiens
agcagcgggcccggcuggggcgcgagcgcggcgcag

SEQ ID NO: 178436 - RNA, 57 nt, Homo sapiens
ggugcugcgggccgcguucgggggcgcagguaccggggcucgggggaccggggucgg

SEQ ID NO: 178437 - RNA, 47 nt, Homo sapiens
auggggccauaagucgcagcugccaggcgcuggagggggcuauggag

SEQ ID NO: 178438 - RNA, 40 nt, Homo sapiens
gcccgcuugccugagagcccgagccacccuaauggggagg

SEQ ID NO: 178439 - RNA, 43 nt, Homo sapiens
gugagggcguaaagaaagggagggagggugauuucucacugcc

SEQ ID NO: 178440 - RNA, 68 nt, Homo sapiens
cgggguaggguggccugggguggggguggggcauguccauuuacaaggagacgccugugggaggaagg

SEQ ID NO: 178441 - RNA, 63 nt, Homo sapiens
gacuggugggaggagcuagguuugauggacagagcuuaagggacagagccaagacugaugaua

SEQ ID NO: 178442 - RNA, 41 nt, Homo sapiens
gagccagggcuggggggaagagcuaggcuuaaugaacagag

SEQ ID NO: 178443 - RNA, 46 nt, Homo sapiens
cccuuggcccugaccagcuuggagcacaagcugcuuuucugggugg

SEQ ID NO: 178444 - RNA, 42 nt, Homo sapiens
gccucuccagcagccccugcagacggggcggccccggcgcag

SEQ ID NO: 178445 - RNA, 42 nt, Homo sapiens
cacagaggugugcuugaaggaccccaugucuguggcggacag

SEQ ID NO: 178446 - RNA, 44 nt, Homo sapiens
ccaaugaccuugcagagguuguccccagaugcuggcugacccca

SEQ ID NO: 178447 - RNA, 43 nt, Homo sapiens
gagcucgcugcagcgggacaugcagaggcucacggaccagcag

SEQ ID NO: 178448 - RNA, 49 nt, Homo sapiens
ccacccggcgcagcccugggcccgggcccagccagucaccccgcagccc

SEQ ID NO: 178449 - RNA, 40 nt, Homo sapiens
uggggagggguggagaaacagggaggagucauggauagac

SEQ ID NO: 178450 - RNA, 46 nt, Homo sapiens
ggaggcgcggcggcgcaagcaguggcaggagguggagaaggaacag

SEQ ID NO: 178451 - RNA, 81 nt, Homo sapiens
cugggugaggacccuugggggacggggccugcccagugcccuuuccggggcucacugggugaggcccccauggguaagggg

SEQ ID NO: 178452 - RNA, 45 nt, Homo sapiens
cucuucaccccgagguuauugugggccucguuggccacaguggac

SEQ ID NO: 178453 - RNA, 45 nt, Homo sapiens
guucgcggcuuccaggcaggcggcuuggggacaugagaccugacg

SEQ ID NO: 178454 - RNA, 42 nt, Homo sapiens
uccccaagccgccugccuggaagccgcgaacgggacugggaa

SEQ ID NO: 178455 - RNA, 52 nt, Homo sapiens
uguuggacuuggcgcuggguucuuuguacagccguggaccuagagggugagg

SEQ ID NO: 178456 - RNA, 46 nt, Homo sapiens
ggcgggcaaggugaacgaaccgcagaagaaucgcauucuggaggug

SEQ ID NO: 178457 - RNA, 48 nt, Homo sapiens
uucucaauuuccugggcaggagugcuggaaauggucagcuggccaagu

SEQ ID NO: 178458 - RNA, 65 nt, Homo sapiens
gaucaaguuagaaguuggccccaugccaaacgcugguuagggccaguaacaacagccacacagac

SEQ ID NO: 178459 - RNA, 37 nt, Homo sapiens
uccccccuccccacccccuccccaauacagcuacguu

SEQ ID NO: 178460 - RNA, 47 nt, Homo sapiens
aggucaaccccgaggagauccagcugggcgaggacgaggacgaggac

SEQ ID NO: 178461 - RNA, 42 nt, Homo sapiens
ggcagaguggcauggacgacaugaagcugcuggaacagcggg

SEQ ID NO: 178462 - RNA, 54 nt, Homo sapiens
cugcccaggggccaggucagacacuagggggugggagcagggggucagcgccac

SEQ ID NO: 178463 - RNA, 42 nt, Homo sapiens
ggcauauuuuggggggcagccguccagagccuguucaaacag

SEQ ID NO: 178464 - RNA, 86 nt, Homo sapiens
uacgaccgcauccuggaccugcguaucgcaacaccccagaucgucaucaacuaugccauguuccuggaggagcacaaguacuucga

SEQ ID NO: 178465 - RNA, 85 nt, Homo sapiens
gagagagcugaguggacauuagcgguaggggcgggacacaucucaggugaggcagcccugggaggcucagcugggggccagcagg

SEQ ID NO: 178466 - RNA, 45 nt, Homo sapiens
ugacagcuacgcccaguucgaggagagcaugaucgcugcaaagau

SEQ ID NO: 178467 - RNA, 44 nt, Homo sapiens
caggcagugggugugagcgcaggaagcgcagauacaggggccaa

SEQ ID NO: 178468 - RNA, 29 nt, Homo sapiens
aagaucuggucaucugggccuggggugga

SEQ ID NO: 178469 - RNA, 40 nt, Homo sapiens
ccugaggccuccaagugggaguccuagccccuccccugau

SEQ ID NO: 178470 - RNA, 46 nt, Homo sapiens
ugggcacggagauguagguguugaugagcggcucgcgcucgaugau

SEQ ID NO: 178471 - RNA, 43 nt, Homo sapiens
ccccagccuggggcagggcuguggcucaagguacugaguggau

SEQ ID NO: 178472 - RNA, 41 nt, Homo sapiens
ggacuugggccuggguuccugggaccuggggauguaggggc

SEQ ID NO: 178473 - RNA, 73 nt, Homo sapiens
cuggggagguagaaguugaagccuggguuccuggguccuggggagguggggucaggggccuagacuccugggu

SEQ ID NO: 178474 - RNA, 45 nt, Homo sapiens
acugacaguggagagaaccccagaagaggaaaagcuccaucgaga

SEQ ID NO: 178475 - RNA, 46 nt, Homo sapiens
acucaccacuguccaaagacuccuuuuuugcuuguugggacucaaa

SEQ ID NO: 178476 - RNA, 26 nt, Homo sapiens
uccuacacaacaaacaaauuuccauc

SEQ ID NO: 178477 - RNA, 46 nt, Homo sapiens
cuuccugucugggaaaaagaccauagcucaaaaggaaggccgaggg

SEQ ID NO: 178478 - RNA, 51 nt, Homo sapiens
ugauacucgucuaucgccuccaccagcuggccccaagagucgaagucggcg

SEQ ID NO: 178479 - RNA, 50 nt, Homo sapiens
uaauucugaauucacagaagaacaaaagaaaaccauaggcaaaauugcaa

SEQ ID NO: 178480 - RNA, 46 nt, Homo sapiens
gccuaaaaaaagguuuaccagcaccaaguguuuugcuuucauggag

SEQ ID NO: 178481 - RNA, 49 nt, Homo sapiens
cucaguagaaaccaucauagcucuguguagcauauucacccuucaacag

SEQ ID NO: 178482 - RNA, 54 nt, Homo sapiens
ccuauauaaaaaaaauagaauaucuuuccagauuuugcauacuccucacuguaa

SEQ ID NO: 178483 - RNA, 28 nt, Homo sapiens
agcuuacuauaauuuacuuuugacuuaa

SEQ ID NO: 178484 - RNA, 29 nt, Homo sapiens
gccuggggcauggcuucuggccaacuggg

SEQ ID NO: 178485 - RNA, 31 nt, Homo sapiens
ucuuuauggcgcccccagcaguugccagggc

SEQ ID NO: 178486 - RNA, 23 nt, Homo sapiens
gcauaucugccccugcccccacc

SEQ ID NO: 178487 - RNA, 44 nt, Homo sapiens
auaucacaggucaggcuuguccuaagcacaugacagguuuaagc

SEQ ID NO: 178488 - RNA, 44 nt, Homo sapiens
ucgggcucugcaucuaucaguucgaguacaugcugcaggugagc

SEQ ID NO: 178489 - RNA, 68 nt, Homo sapiens
augccucguccugguuccucacacuguuccugaccaccuucccacuccccgucgccacccgggucuuu

SEQ ID NO: 178490 - RNA, 58 nt, Homo sapiens
gcccugcugcaggugaaccaggcagagcugaugcagcuggacauggaggggauguccc

SEQ ID NO: 178491 - RNA, 46 nt, Homo sapiens
caguacuuccagagagugaucccccaccaguucgacagcugcccgg

SEQ ID NO: 178492 - RNA, 47 nt, Homo sapiens
ggcuggagaaggaguacgcagccaugaagagcaaggagauggaggag

SEQ ID NO: 178493 - RNA, 40 nt, Homo sapiens
ugccccgcugggccgcccagcgucauggggaagcaaucaa

SEQ ID NO: 178494 - RNA, 36 nt, Homo sapiens
cccagcuccugcaaggauggcugugcuuggugcugu

SEQ ID NO: 178495 - RNA, 45 nt, Homo sapiens
uucggacggagaaccggcuccugaaacagcggauugaaacccuag

SEQ ID NO: 178496 - RNA, 45 nt, Homo sapiens
cacgggcgcaggaggcggaggagaacuacgucaucaagcgggagc

SEQ ID NO: 178497 - RNA, 62 nt, Homo sapiens
aggaacagcucgcugcccgacgagaacaauguggcgcagcugcaggaggagcugaaggcgcu

SEQ ID NO: 178498 - RNA, 46 nt, Homo sapiens
uuuccccccaaucccccgaccccagagcaaggaggaggugauggcu

SEQ ID NO: 178499 - RNA, 31 nt, Homo sapiens
caaggaccagaucgaggagcugaaggccgag

SEQ ID NO: 178500 - RNA, 40 nt, Homo sapiens
caugcccagcgcgcccggagucaggaggccgcagccgcgg

SEQ ID NO: 178501 - RNA, 32 nt, Homo sapiens
ucgagggguaaaagcauaaagaucagaccaac

SEQ ID NO: 178502 - RNA, 46 nt, Homo sapiens
gcucuagggagcuaagacuaauccacccagcggggcuccagggcag

SEQ ID NO: 178503 - RNA, 42 nt, Homo sapiens
gcgcgccugggcgagcugccacugggggcgcugcaggcgagc

SEQ ID NO: 178504 - RNA, 42 nt, Homo sapiens
cuccucuggcgugcucguggcgcugcugcuguggccggccag

SEQ ID NO: 178505 - RNA, 45 nt, Homo sapiens
ccaucuggagacuccaccuuguccagccccaugcccucugcaagc

SEQ ID NO: 178506 - RNA, 31 nt, Homo sapiens
gguucuccagaggggguguggucagggaagc

SEQ ID NO: 178507 - RNA, 43 nt, Homo sapiens
acagcaggagagagagaagucugcagagggggugaggcaggaa

SEQ ID NO: 178508 - RNA, 52 nt, Homo sapiens
aguagaggccggccgagaaggugagaucaaagaagcuuggguuugccuaggg

SEQ ID NO: 178509 - RNA, 45 nt, Homo sapiens
caaagccagaggagagggaggugccugcagagacggugaggucag

SEQ ID NO: 178510 - RNA, 67 nt, Homo sapiens
ccccgcccucucuccagaccauucccccaauacaggucccacauucucugaccucaccgucucugca

SEQ ID NO: 178511 - RNA, 30 nt, Homo sapiens
cagagagacuguggucaaaggagagggaga

SEQ ID NO: 178512 - RNA, 51 nt, Homo sapiens
agugcggccaggggaaaagccgaauuccccagagauguugccggagaaaca

SEQ ID NO: 178513 - RNA, 45 nt, Homo sapiens
cuccucuacaaggcccuguuucuccggcaacaucucuggggaauu

SEQ ID NO: 178514 - RNA, 55 nt, Homo sapiens
gaagagagggcaacgcuggauuagcuuggguggggggcauacucugcagagggga

SEQ ID NO: 178515 - RNA, 59 nt, Homo sapiens
acugacagguaaggcucgacgaguggggcguggccggcagggugggcggggccugacuu

SEQ ID NO: 178516 - RNA, 45 nt, Homo sapiens
caccugugacucggccuucuccccgcagccuccaggcccccagcc

SEQ ID NO: 178517 - RNA, 54 nt, Homo sapiens
ucuggagggaugcgacauccugagcccguggcagucccccgcucucgaggcugg

SEQ ID NO: 178518 - RNA, 41 nt, Homo sapiens
cgccccgcccccggacgacucggccccgccucgccgcaggc

SEQ ID NO: 178519 - RNA, 314 nt, Homo sapiens
gagaaugagggcuguaauccuagcacuuugggaggccaaggcgaguggaucacuuuaggucaggaguucgagaccagccuggccaacguggugaaacccugucucuacuaaaaauacaaaauuagccgggcaugguggugggcaccuguaaucccagcuacucgggaggcugaggcaggagaaucgcuugaacccggaagauggagguugcagugagccgagaucgcgccauuguacuccagccugggugacagagugagccucugucucaaaaauaaauuaauuuaaaaaagagagaaaaugagggggauggg

SEQ ID NO: 178520 - RNA, 45 nt, Homo sapiens
uagggcccuggugguccauggagagucgaaacacuugcccaggau

SEQ ID NO: 178521 - RNA, 42 nt, Homo sapiens
ucccgcacggaacggaaggaguacuccuugaggggccggugg

SEQ ID NO: 178522 - RNA, 46 nt, Homo sapiens
ggaagacggcgaagcgcuuggaguagagggagucguacugaucgau

SEQ ID NO: 178523 - RNA, 42 nt, Homo sapiens
uucucgggaccggagccaggcuggaggcggggcugggguggg

SEQ ID NO: 178524 - RNA, 49 nt, Homo sapiens
guggcguggggcugaguggcggggcguuagugggugagccugggcgggg

SEQ ID NO: 178525 - RNA, 46 nt, Homo sapiens
ggccguuuugggaguaaggcgugggaggggcgugggcgggaugagg

SEQ ID NO: 178526 - RNA, 46 nt, Homo sapiens
ggcuggucccuccacugaagaagacuuugcuguggacuuugagaag

SEQ ID NO: 178527 - RNA, 64 nt, Homo sapiens
ggagagccugccccgcagggaccagagcccaaggacgggcucaacacucagucaaggugggguu

SEQ ID NO: 178528 - RNA, 65 nt, Homo sapiens
gggaggagggacaaggggguccccacuuccagggacgcacaauagcagagccacuuacacgcugg

SEQ ID NO: 178529 - RNA, 44 nt, Homo sapiens
gacagggcggauaaaggcacgagguggggcuccggccaggccag

SEQ ID NO: 178530 - RNA, 46 nt, Homo sapiens
gcuccggggcgggauccugagcgcaguccuggccccgcggcgcccc

SEQ ID NO: 178531 - RNA, 42 nt, Homo sapiens
uuuuacugacuucgugaaggcucuacugagacagacacagag

SEQ ID NO: 178532 - RNA, 67 nt, Homo sapiens
caaagggcuaucuucuagaaaaggaaacagcuaugcuuggugagguacccacgggcagaggucacag

SEQ ID NO: 178533 - RNA, 46 nt, Homo sapiens
agggcgaagggugaucagcucccucccaggucccgcgcaucgccgc

SEQ ID NO: 178534 - RNA, 44 nt, Homo sapiens
gcuuucuaaggagcccaagcaagggucgcgaaggccaagggucu

SEQ ID NO: 178535 - RNA, 45 nt, Homo sapiens
cacccguggacagcggcaccagccacuccgcagggccgccgccgc

SEQ ID NO: 178536 - RNA, 25 nt, Homo sapiens
ugagggagcagaggguggcuuccag

SEQ ID NO: 178537 - RNA, 34 nt, Homo sapiens
caugcaagggugcgaguaucugggcggcugugug

SEQ ID NO: 178538 - RNA, 54 nt, Homo sapiens
ugcagagagccaugaagcuccuggaugcucgaaauaagguuuuugcaaagcucc

SEQ ID NO: 178539 - RNA, 2768 nt, Homo sapiens
auugcugcuggccuuucccuauaaaaagguauuaaguaugcaugguaacuuuucuugaacucucaauuuccaacaaauaauucuacuuguaaauucugcauacuauucuacagauacuagaaaauccaaggaaauuuauuguggauuugagauuaguuaaagggaguucaaaauaguugaguauaauuuuuuauuaaaauguuuucauuuacuuagaauuuuaaauauuuuuuuaauuuuugggguuaugugguagguauauauauuuauaggguccaugagagguuuuaauacuggcaugaaauggguaauaagcacaucgugcagaaugggguguccauucccucaagcauuuauccuuugaguuacaauccaauuacauucuaaguuauuuuaaaauguacaauuauuauugacuauagucacccucuugugcuaucaaguaauaggucuuauucauucuauuuuuuuuguauccauuaagcaucuccaccuacuugccauuuuuauaucucuguacccaaggcuuucucauccuauuuuuuuaaguggaaaaaugagcuaaugaaaaguaaaagaagagguuuuauuuaaaagauuguauaauuguauaaaguauuugagauauuaugaggacaggauccuucuuaauugauuuaggaauagaauucuacuaguagacaauccauaaauuaaaagucauuugggaaaauaaggggcacauaggugaagggacuauauauuugugaugaaaucugcaugcaaaaacuucugucauacaaauuuuaagagaaucaaagauacucaguuaaaaagaaaccagucaugaaaaugccuucuuaucaugcuaaaaaguuuagcuauacaaaugguuaaaagaagcuaucaguuuuuauugcuucuguuuuuucaacaaauauuuauuggauuuauuaggugcuaaguuuaccaaauuauuuaaaaccauauauauuuuuuaccagaauuauuccaacucauuuauacuuaguauacuacuuuaauaaaccuaguuuagaggaaagaacccuggaggccugagagcuaaccuuccuuguuauuaacuagcaguaugaccuuaggcagccaaaucccugcuccaugacuguucccucauuauaaaaccaaaagaacuggcagucucuaagcauccuucccacuguaaaagggaggguauucuaguucuauucaauuaaguuauguguguauaguauuauacagcauagugguuaagaguuaggccuccaccaggagaauggcgugaacccgggagguggagcuugcagugagccgagaucacgccacugcacuccagccugggcgacagagugagacuccaucucaaaaaaaaaaaaaaaaaaauuacuagcugcagcacuauagucacauuacuuaacuucucugugccuuaguuuccucacuuguaagacagggauaauaacaguuccuauuuuauagagcuuauaugaggauaagaugagaaacgcaaguaaaguacuuaaaacagugcuggacacaauaaaugauuuuuaaaaauuagcuauuauuacaacaggcagagugggcuaggcgccuguaaucccagcacuuugggaggccgaggcagguggaucgcuugagcucaggaguucaagaccagccugggcaauugggcaacauggugaaaccccaucucuacaaaaaaaaaaaaaaaaaaaaaaucaacaaaauuagcugggugugguggcacaugccuauaguuccagcuacuugcggggaugagguggggggaucauuugaggccuggaggucgaggcugcggugagccaugaucaugccacagcacuccagccugggcgacagagugagacccugucucaaaaaaauaaguaauaauaauaggcagagugccuagcacacagcagguucaccagugaagagcuguaccaaggaaaugacacauaagcuaucuuggaagaugcaaaggagccagcuaggcaggguagggguagaggcagcagggagagggcauuucagucaggauggauagcaaauagcaaaacuuagaggugggaagaggaguaggagaggccauccaagacgcaacuccugcagaugaggcaaucgccauauccugcaguccuaagaaagcagugaaggcuucuuaacuguauuccaagugcaaaaggccacaggaaaguggcauggccagauuuaugcuucuaaacuguugcuguguggagaacagaucagaacuaccaaugguaguuuggccauaaacugaaaaaagccaaugcucacaauuaacaacuguaagcaaauucuuaaaaguuacuuguauuauuuaaugcccaaccaccguuuaaagagggacuguaccuuauuauaaauuaauuaaggagacaguaugugguauauuacagcaaggacaaaaaugaggggucacugugugaaauguaaauacauguuucaugugcuaacagccuucacugugaauaugaauauaagaauuuaaacagcuucccaauguucuucccugaaaguggauguuagccuaaaaugagucaucaagcuguagccacaauagucccacucacuuacauaauccagaaaacacugcacuuaaugacauuauauguuacuuuuguauuuaaucuagcagaaucagagguaaauuaauugccaacucuagaaauuuguuuuuacucagaccuuucccauucaaagccuaggaacauaccuuaugugcucccagucgacaccuucaaaaa

SEQ ID NO: 178540 - RNA, 88 nt, Homo sapiens
uacugugggaguggcaugaguccugugggaguggccuggguauugugggagaggccugagcucuaugggaguggccugggugcugugg

SEQ ID NO: 178541 - RNA, 39 nt, Homo sapiens
ugugggaguggccugaacacugugggaguggcuugggug

SEQ ID NO: 178542 - RNA, 24 nt, Homo sapiens
cuguuggcauuguuguaaacaaac

SEQ ID NO: 178543 - RNA, 46 nt, Homo sapiens
uaugauaagaagaaacaagaauaauuaaugcagcaauaucauaaau

SEQ ID NO: 178544 - RNA, 46 nt, Homo sapiens
aauguguggugcauuaaaugucaccaguggggucaugucaacacag

SEQ ID NO: 178545 - RNA, 42 nt, Homo sapiens
gagaaacaguggguuugcacugaaccgaaauguacuggggag

SEQ ID NO: 178546 - RNA, 34 nt, Homo sapiens
aagaaaaagauagaaaaaagaaaaaguuucagaa

SEQ ID NO: 178547 - RNA, 46 nt, Homo sapiens
ccugguggauuacuccaagaaccuggugacggaggacgugaugcgg

SEQ ID NO: 178548 - RNA, 1778 nt, Homo sapiens
ccgcccgggagcggauguucaauggugagaagaucaacuacaccgaggugagcaggccccacauacccucuggggccuccuuccuucccuuugggguuuaucugacuguuagccgcaucacccugugucuucaccccuucucuugggcaaugcuuuugcuuaaugaggggccugaaggccuuuuuccuccugcuuguagcagggcuuuggggugugccuuccacaagauugguuuggugagcuccuuggaaugguucccagugucugccugggaggagcauaucucauacccacagggagaguuucucaaggcugacauuuucuuggagaaguuaacucuaauauauccucaaugcaaguuuuaguagcgacaagaagaaucuuagaucaccaaagacuucagccuacucaagcaguaggagucaauaggaagcaguggugaggccaggccugggggccccuguuccugacucaguaugggagcccagccuggagguauaauggacacugagcacccagacucuguccucaugaugucauuauccuccucuuacaugugaggagucugagguucagaggucacaucacuuaucuaagaugucauagcuguaagaggcagaauggagauucacacucaaccugucuugcauugugggucuaagcugagagaggaugcaaucaaggaaggcuuucuggaggagugcauuugccaauaaaauguggcgcaggaguggggucuggcagggugagggugggguggcaugaagcccuccaccuuagcaagccucucacugggucggaaucccaagaugauccuuuuccugcccaccuggggucguuagaccuucccucaaggacuccucugcugacuucaggccauuucacucacguggcugggccagccgccuggcacccgucacagacuucaagucugguuugguuccuggcaguugguaguuaucgggcugcuuggugagggaagcuugaguugcaugccuugcugcaaauccaaggagcugaggacacugccuaaaacgugccagcaaacaccauggacacacauugggaggaugagguuacuucaggcuucaugagcacucaucuucggaaagcguuuauuuauuuauuuauuuugagauggagucuugcucugucgcccaggcuggagugcaguggugcgaucuuggcucacugcaaccucugucuaauggguucaggcgauucucugccucagauuccugaguagcuggaacuacaggugugugccacccccaccuggcugauuuuuguauuuuuaguagagacaggaugucaccauguuggccaggcuggucucgaauucaugaccucaaguuauccaccugccauggccucccagaguuccgggauuacaggcgugagccauggcgcccggccucugaaagcauuuauugcuuguuucugacauguauuguugccauucucugccuuugcucacuguuccucuuuucucucacuguucaugcccugagcaucucuggcaggccuucggggccuguccuaggcauauauggguccccuccucuccuccugacugucugcagcacauaaguccuuggggagcuccuacuccucuaagcauacaguggguucuuggaacaagguuauggugcuaacagagaccucagggccugccugucuaguggauagagggccgagcuauggcaccaugcccagcugggagcauggcugccugggguuggggggggcagucuuuauauccugaccguaauccccag

SEQ ID NO: 178549 - RNA, 2528 nt, Homo sapiens
ccaggagaccaucacgaaugcagagacggcgaaggagugguuucuccaggcggccaaggaugugagugggcuauagggccuuccucgugguuagccucugggcugggaagagcagggugggccccugagugaccaagucuggccguguuucuccugaaguuggaagugaaggcggccuugccggugccugccuuugcuagaugagaugauuguucaucuuggcuuugucagacccagccuugcagaugugacagaaccugcucucgcuggcugacagcccuugcauggcccuuucucugcaggcccuuggcgcugcaggaacucuuggccacaccuauuuuauaggggagggacgucccugagccccguaugcuuguaagaugggaugagcaggcggccugugacccgucugcuuucuugaccuugaccucgaugugggccuucuccaacagucucagaaccaaggacugggaaucucagucccaugcagggccuugguuccucuagugaugggaagugacuacccuuugucucccugggcuggcugugguaacuuggcucugucucuuguagccuucugcaguggcgaagcacuuuguugcccugucuacuaacacaguaagugcccccgugguccccuguacugccuuccugggagugcccagcauguccaggucauggccucucagagacgcgguucguaggucugguggaucuuggcuuggcugaugguauggaagguuugguugccugugggcugcaagccuuccuugccuuuuccgcauuuacccauucaaccucugcagcuuugaggagggaggcuuggagucagugggaucacgauaaccccuucuuccgucucccaggccugacugauacacagaacccuucauacacaugaccuuccuaggccuuugugcccagcaucuccccaaaugugacaugcuagguagggguagaggaugcauuccauuuuucacuuaaggacauaaagccccaaugaagggaggugacauuuugcccccuacuuagugugugugguuuuguuuuuuuuuuuuuuuuuuuuuuuuuuaagacagucucacucuguugcccaggcuggagugcaguggcgugaucuuggcucacugcaaccucugccuuccagguucaagcgauucuccugccuuagccucccgaguagcugggauuacaggugcacgccaccaugcccagcuauuuucguauuuuuaguagagacgggguuucaccacguuggccaggcuggucucugacuccugaccuuaagugaucugcccaccucagccucccaaagugcugggauuacaggugugugccaccauguccagcuuauuuuuugagacaaggucacucugucacucaggcuagagugcagugguacgaucuuggcucacugcaaccucugccuucuggguucaaguaauuuuuaugccucagccugcugauucugggauuacaggcgcccacuaccacguccagguaauuuuuguauuuuugguagagacagguuuucuccaugguggccaggcuggucucgaauucuugaccucaagugaucugcccaccucggccuaccaaaguguugggauuauaggcaugagccacuguacccggcccacuuagugacuguaugaguaggugaugccaggauuagaaccugggucuccugucuccaaguucucacagucugccuggccucgagguugugcaggcucagcagggcaugacagagugagggaugcuccaggagugacagcagcagucagccagugggcacugugcugugucagagcuggggacuacacccacaucucccucccacccccuccaccaucauccccacaucucugccuccagugccuacccagcugcagcaggacgccauaaggcuggcuaaccauagcacuguugccugccugcaacugacuggucaguagggcuucuccuccuauguggaauagguaaggaauugcuggcccugucugcccuggggaccagaauaccugauggcuccucagagcuuccuggugcagucacccucccacacaugggaagggcuggguggcuguucagccuguguuuguuugccuggccugguagguggccccugcccacacuugggucccaguccuagguucgguucccagauguccagggguaucaugcucuggugucccaggcaggccugggugagagcuguugcagagcagugugugggccagguccucacacgggguuacagcugcccucagcagggggcuuugcaggcacaacgucacuggcgugcuggucauggacugaucugguguccagcuuggggugggcagauccugggcccugcccucgacucacaggcugcuccagcccugccccaucccuggcucuggggaaggugaggcucagcucacggagcacagcucccugccucccggagcuccuguucccaucccgcuagcaaaugcuucuuugcauuucucucccuuuguuuuuuuuuuuguagaccaaag

SEQ ID NO: 178550 - RNA, 36 nt, Homo sapiens
cccucagcaccuuguccugucucuccuagugggugg

SEQ ID NO: 178551 - RNA, 45 nt, Homo sapiens
gauggccgaccacagcgaguagcguccucccacccacuaggagag

SEQ ID NO: 178552 - RNA, 191 nt, Homo sapiens
gcucucgggggcucacuggauggugagugcugaggcugguucucugccaagugcuggccagaggcgcguguguugguccuggucccccgcuuucucccccacuguccugucccuccccuccccgugcagcugcucagcucccacucauccugcuccuguuucaggaccagcacuuccgcacgacgccccug

SEQ ID NO: 178553 - RNA, 45 nt, Homo sapiens
gcagggccagcaagacgggggcguucuucuccaggggcgucgugc

SEQ ID NO: 178554 - RNA, 45 nt, Homo sapiens
guacgcagcaaagcggugcagguacuggucauagggcagcauggc

SEQ ID NO: 178555 - RNA, 2283 nt, Homo sapiens
ccgcuuugcugcguacuuccagcagguaccagcugccaagccaggccuuggagucagcaagauuuguggggggucugggaggucuaggaaccuggguuucagcuccuccaggagcucuuugccccauugcccuugggccuggccaagguccaucugugcuccuugucucaggaugaaucuuuguaacugagguugguuccauuugagugucaucugaguuugaucaccaugggaggggcaugacuggugaucauggugcccuggcuagggagguccuggcuugacucaggggauguuucucagcuggggucacuucuuucuugcacaucacuaugcaugccuaccauagugucugaggacguaggaucuagcccugguaugaggcccuaggucuguuaguaucuggggaggaaggaucugguacagguaugaggaccugggucuguccaugucugaggaggugggauuuggccauaggguggggcugcaagcuggaaucccuuauagccugcacugccuuuaucccuccagaaaagcaaguguguaucuagucugugguggccucuuuggacuacauggcccucuucucccuugggaucuccagagccccccgagaggcuuagcaggcccucuccuagucacauuaugucccagaaagcuuuuccacaccugucccugcuuuuuuuuuuuugaacagauucucacucuguuucccaggcaggagugcaguggcgcgaucucggcucauugcaaccuccgcuuccugaguucaagcaauuccugugccucagccucccgaguagcugggauugcaggcaugcaccaccuugccuggcuaauuuuuguauuuuuaguggaaacgggguuucacuauguugcccaggcugguuucgaacuccuggccucaagcgauccaccugccuuggccucccaaagugcugggauuacaggcaugagccaccaugcccaacccuauccuugcuuuuguuuaguacaaagccagucccuguccagcagcucuugaguugcucugggcagguacagaaggcuucaccaacaccuggaagcaaauccugugacugaaggagaggccaagguuccccaaaucccagcugccuuggugaggguugccaugaccagggcccagguggguacccaaagccuagcauuuaguuguggugacagcccucaaaggcuguacucuuagccaggcaugguggcugaugccugcaaucccagcaccuugggaggcagaggcuggggggaauugcuugagcccaggaguucaagaccagccugggcaacguagugaggcccggucucuacaaaaaaaacccacaaaaacuaacaguagccaggcaugguggugcggcaccuauagucccagcuacuugggaggcugaggcaagaggcuugcuugagcccaagaggucgaggcuucagugagcaaugauucuaccacuguacuccagccugagugacagagugagacucugucucuuugggaaaaaaagaagcugugcacucuggaccccagccugcucucccuuaagaaaugagcugauuuugugaccgauuuugucuuuagggagguccuugccugaccuccagacccaccuuuuccugggcaugaguccuuccugcacaguggcuuaagcaggaaagguugggaggcuguguccucacugguguggggaggaaggggaucgugccuguggacacgugugcagguccaccucacggugucagggcagggugggucugccuggagcaucugggcaggacuuuggcauggugcaggaaggagcaggauuugcguacagugugugaaggaucaagacuugcaggaagaggguuggguuuuuuuucuuucuuuuccuuucuuuuccuuuuuuuuuuuuuuucuuuuuuuuugaguuggaguuuugcucuuguugcccagucuggagugcaguggcaugaucucggcucaccacaaccuccgccucccggguucaagcgauucuccugccucagccucccaagcagcugggauuacaggcaugcgccaucacaccuggcuaauuuuguauuuuuaguagagacaggguuucuccauguuaaucaggcuggucucaaacuuccaaccucaggugauccgccugccuuggccucccaaagugcuggaauuacaggcuugagccacugcgcucagccucuuucuuucuuuuuaaauguucuuucauuuugccaagaacuggguuucuguuccuuuuccagggcgacauggaguccaaugggaaa

SEQ ID NO: 178556 - RNA, 195 nt, Homo sapiens
ccgggaugaggaagucacaggguaucaucuuggugccugugaagggcacuguggucacccacaugaccccagcccaugggagcuagccauauggccuagaggagggcacugaccuaagugagauaucucuucuggaagauccuuucccucccccaacaucacccuucccaggccacaggggccuaccuuggugga

SEQ ID NO: 178557 - RNA, 196 nt, Homo sapiens
aauggccagcaugcuuuuuaccagcucauccaccaagguaggccccuguggccugggaagggugauguugggggagggaaaggaucuuccagaagagauaucucacuuaggucagugcccuccucuaggccauauggcuagcucccaugggcuggggucaugugggugaccacagugcccuucacaggcaccaaga

SEQ ID NO: 178558 - RNA, 2594 nt, Homo sapiens
ucugucugggccaagaaguuggccaggaggaucugaugagcgagacaucaguuaugcuugagagcacugucugggcuucaggcagagggacaagaccgccugguacuucucagcaggggucagucccagccugggucacucgcuguacagcucaguuggagcgagggggacacauccgaugacaccacaaggcagggaacagugauaacugcucuuuaagaacuacacaccaguggccaggcgcgguggcucacgccuguaaucccgacacuuugggaggccgaggcggauggaccacgaggucaggagcucgagaccagccugaccaacauggugaaacccgucucuacuaaaaauaccaaaaaaaaauuuagcugggcaugguggcgcaugccugucaucaggcaggaggcugaggcaggagaaucaccugaaccugggaggcagagggugcagugagccaagaucacgccacugcacuccagccugggcgacagaccuagacuccaucucaaaaaaaaaaaaagaacuacacaccacuugcuagggguccugcucacaauuuuaccaacaucuaucuuuuaagauccuaagaagguagcugggcgugguggugugcaacuguaauuccagcuacuccggaggcuuaagcacgagaaucacuugaacccaggaggcugagguugcagugagucaaggucacacuacugcacuccagccggggcaacaaagugaaacggugucucgaaaaaaaaauaauacuaagauccuaaggaggaaaggcaucaucgcccuguucuaguagagccuuggguuccacaaguccacagugcuggaucacagaacuauagacaggaacaaucagaauucaauccagcucacugacucccaagauugugcuaccguaacccugugcugcucugcacaccugagacaaagcacaguaaauucucugaaggaguucgagggcagcuugggcaacauacugagacuccaucucuacaaaaaauaaaaauaaaaaaaucagcugggugugguggcgugugccuguucccagcuacucaggaggcugagguaggaggauugcuugagcccaggagggugaggcugcagagagccugauugugccacugcaccccagccugggcaacagagcaagacucugucucuuuaaaaaaaaaaaaaaacuuagccaggcauguuguacaucuguggucccagcuacucaggaggcugagauaaaaggauugcuugagcccaggaguucaaggcuguagugagcuaugauugggccagugcacuccagccucagcaacagagugacaugcuaucucuaaaauaaaauaaauaaauaaaauaaacaaaaggggagauuuuccuggauuaucuaguagccccaaucuaaucacacuggcccuuaaaaguaaaagagggccaggcacgguagcucaugccuguaaucccaaaacuuugggaggccgaggcaggagaaucacuugagcccaggaguuggagaccagccuaggcaacauagugaaaucuggccucuacaaaaaguuuaacaguuagccaggcuguuagugccuguaagugccuguaagugccuguuagugccuguaagucucagcuauuugaggggccgaggcaggaagacugcuugagccugggacguugagaauacagugaacugugaucaugccacuguaaguccagccuagacaacacagcaugacacugucacuuagggaacaaaagcaaaauguagaagaggaagguaaacaagucagagagaugcaacagaaguggcaagacagaaucaaagcuucagagaaggauuuaaccugccauugcugguucugcagugaagaggcccacaagcuagaggaugcaggugaccucugagaaucugagaacgaccuucagcccacagcaaggaagcuggacuucaguuccacaaccauagagaaaugaauucugccaaccaccugacaagcaggucaaaggcuuuuccccuaaggucuccagaaagaaacacaguccugaugacaccuugauuucagccugcaagacucuaagcagagacacaucagggccugcuggauauuugagcuucagaaacucuucagauagcccaggaagguggcucaugccuauaaucccagcacuuagggaggccgaggcagguagauuacuugaggucaugaguucaagaccagccuggccaacauagugaaacccccccuuuaccaaaacuacaaaaauuagcuggccaugguggugagugccaguagucccagcuacuugggaggcugaggcauaagaaucacuugaggccgggaggggaagguugcagugagccaagaucgugccacugcacuccagccugggcgacagagcaagacucuguccccccuccccaccccacaaaagaagaguguuguuuuaagccuccauguuuguuaucauuuguuacggcaggaauagaaaacuaacgugauugccaaccaaugcaccagguuuucagaggucugggugcaaugugagccagaccccccagauggggccagaugggggcucuuaccuugugaugcaga

SEQ ID NO: 178559 - RNA, 268 nt, Homo sapiens
aggaccuugagaggcugcugccacauaaggucagcacuucugcauuuggcuuuggggugcaugcuggaguuggaggugugaagcuauggcaccaggcaggggcuuggggcgugccuggcuuguccuacagaaugggagggccuguccucacagaccugcacgucucagccucuggggcagggugugcuucccuucaagggguuuagggaucaggacucucuuggagacauuccuugguguuuucugcaggucuuugaaggaaaucgcc

SEQ ID NO: 178560 - RNA, 132 nt, Homo sapiens
gaacgaagaucuugugcucauacauggcugcagaagugacagacagggcacaucagggcuccacaagcccauuccaaccuaccccaagccaggaccuuuccccuacucacucaccgaccaaggcuccaagca

SEQ ID NO: 178561 - RNA, 154 nt, Homo sapiens
uucaugcuuggagccuuggucggugagugaguaggggaaagguccuggcuugggguagguuggaaugggcuuguggagcccugaugugcccugucugucacuucugcagccauguaugagcacaagaucuucguucagggcaucaucugggaca

SEQ ID NO: 178562 - RNA, 46 nt, Homo sapiens
uugguagaagcgucgugagaggucacuugagcacugccaucaagcu

SEQ ID NO: 178563 - RNA, 50 nt, Homo sapiens
cgacgcuucuaccaaugggcucaucaacuucaucaagcagcagcgcgagg

SEQ ID NO: 178564 - RNA, 66 nt, Homo sapiens
cccuccuccccggagccggcacugcauguuccuggacaccacccagagcacccucugguugugggc

SEQ ID NO: 178565 - RNA, 89 nt, Homo sapiens
uuggaccacgagcccuuagcagggaaggcuggucucccccagccuaacccccagccccuccaugucuaugcucccucuguguuagaauu

SEQ ID NO: 178566 - RNA, 37 nt, Homo sapiens
gugaguguguaaguguaugugugggcaucuauggggc

SEQ ID NO: 178567 - RNA, 45 nt, Homo sapiens; identical to SEQ ID NO: 104875

SEQ ID NO: 178568 - RNA, 45 nt, Homo sapiens
uaauguguaaugaggaaaucagagauaaguuuggaggaacuuuga

SEQ ID NO: 178569 - RNA, 44 nt, Homo sapiens
ggagcuccgggcuagaccguggcgccggcagcggccccugggcu

SEQ ID NO: 178570 - RNA, 48 nt, Homo sapiens
cuauugacugucauaacaucuggguaugaaguuguuuuuacaucucag

SEQ ID NO: 178571 - RNA, 66 nt, Homo sapiens
uagugcaacaacugauugugagauuaugauuguuuaucacaaaacaguuuaguuaaugugacuuuu

SEQ ID NO: 178572 - RNA, 45 nt, Homo sapiens
ugcccacuggcauuccacaugaaaacauuuucaucagaaccaaag

SEQ ID NO: 178573 - RNA, 42 nt, Homo sapiens
aaaguuaaccuuuugcugguugauuaucgaggauauggaaaa

SEQ ID NO: 178574 - RNA, 46 nt, Homo sapiens
gacucuacuuagauucugaagcuguguuagacuacgugaugacuag

SEQ ID NO: 178575 - RNA, 46 nt, Homo sapiens
acaguucaucaaagaagucguaaagagccauucuccugaagaaaug

SEQ ID NO: 178576 - RNA, 41 nt, Homo sapiens
caaaaguuucuuguugcuaaagugguguaaucuguuacaca

SEQ ID NO: 178577 - RNA, 74 nt, Homo sapiens
aauagcacuggucauauacugauguauaugguuaucuggguuauaucuauuuuuauguaaacucuauuuuguuu

SEQ ID NO: 178578 - RNA, 51 nt, Homo sapiens
ggccaccaucgugaaaggugaggaggcccuuugccuuggcgucuggcggga

SEQ ID NO: 178579 - RNA, 57 nt, Homo sapiens
cgagaccuucuccuccaccacgacggucacccccguguccccguccuucgcccacaa

SEQ ID NO: 178580 - RNA, 46 nt, Homo sapiens
ccugucccccgaggccuccuccccguauccgccguugcccccgcgu

SEQ ID NO: 178581 - RNA, 42 nt, Homo sapiens
gacuacaugaaccucgacuucagcucccccaagucuccuaag

SEQ ID NO: 178582 - RNA, 46 nt, Homo sapiens
gggacagcgaccaguacgugcucaugagcucccccguggggcgcau

SEQ ID NO: 178583 - RNA, 46 nt, Homo sapiens
cccugcaccccggcggggagccgcucaggggcguucccggcugcug

SEQ ID NO: 178584 - RNA, 45 nt, Homo sapiens
ugcccaugacgcccggcgcggcccucgcgggcagugggagcggca

SEQ ID NO: 178585 - RNA, 39 nt, Homo sapiens
gccgcaaccgccgcggcucgaguacuacgagagcgagaa

SEQ ID NO: 178586 - RNA, 22 nt, Homo sapiens
cagcagcaacaccagcagcagc

SEQ ID NO: 178587 - RNA, 44 nt, Homo sapiens
auuaaaugagaaauaugcaagacgaagugcacacggcaucucuu

SEQ ID NO: 178588 - RNA, 48 nt, Homo sapiens
uuaacauagguuuuuaaagacuaggauauugaaugugaaacauccguu

SEQ ID NO: 178589 - RNA, 35 nt, Homo sapiens
aaaucacaauuuuccuguggaauaaagauggucca

SEQ ID NO: 178590 - RNA, 46 nt, Homo sapiens
uaacuaacacacccugcuucauugaccucuacuugcugaaggagaa

SEQ ID NO: 178591 - RNA, 36 nt, Homo sapiens
cuucuucuucuuuuuguuaacagcaacgaacccuag

SEQ ID NO: 178592 - RNA, 46 nt, Homo sapiens
cugcaauuacuacgcaaacgcuuacagcuuuuggcucgccaccaua

SEQ ID NO: 178593 - RNA, 60 nt, Homo sapiens
ugcagaaggcucuggccaagcccuggcgucccccggcuccugccuggaggaguuuagaag

SEQ ID NO: 178594 - RNA, 53 nt, Homo sapiens
cugccauggugauggccgugcacagccagaccauucagaucccaccgugcccc

SEQ ID NO: 178595 - RNA, 38 nt, Homo sapiens
ucugcaauauuaacaacgugugcaacuuugcaucacga

SEQ ID NO: 178596 - RNA, 47 nt, Homo sapiens
gauuuccgaagaagucuguuucuuagaagaaauagaaucaaauagaa

SEQ ID NO: 178597 - RNA, 42 nt, Homo sapiens
gguauugguggcucuccaggaaucacaggcucuaagggugau

SEQ ID NO: 178598 - RNA, 45 nt, Homo sapiens
auggggccuccagggcuuccugggauugauggaguuaaaggugac

SEQ ID NO: 178599 - RNA, 41 nt, Homo sapiens
guuaccgggauccccaggccaugccacggaggggcccaaag

SEQ ID NO: 178600 - RNA, 49 nt, Homo sapiens
aaaggggagccaggcagugauggaaucccggggucagcaggagagaagg

SEQ ID NO: 178601 - RNA, 48 nt, Homo sapiens
aaaggccucccaggauuggauggcaucccuggugucaaaggagaagca

SEQ ID NO: 178602 - RNA, 46 nt, Homo sapiens
agaucaagggauagcggguuucccaggaagcccuggagagaaggga

SEQ ID NO: 178603 - RNA, 58 nt, Homo sapiens
aagggcaggcaggcccaccuggcauaggcaucccagggcugcgaggugaaaagguaac

SEQ ID NO: 178604 - RNA, 62 nt, Homo sapiens
uggcaucccuggcccacaagguucaccuggcuuaccuggagacaaaggugcaaaaggagaga

SEQ ID NO: 178605 - RNA, 46 nt, Homo sapiens
uggaaccccaggugcuccaggacuuccgggaccaaaaggaucuguu

SEQ ID NO: 178606 - RNA, 45 nt, Homo sapiens
agacccugggaccccaggagugccuggaaaggacgggcaggcagg

SEQ ID NO: 178607 - RNA, 57 nt, Homo sapiens
ggucucccuggcaagccuggcuccauggauaagguggacaugggcagcaugaagggc

SEQ ID NO: 178608 - RNA, 44 nt, Homo sapiens
agccccuaccgaguauauuugauauguauuuguugaacgaacga

SEQ ID NO: 178609 - RNA, 46 nt, Homo sapiens
aagguuugccaggucuucccggcauuccuggcacacccggggagaa

SEQ ID NO: 178610 - RNA, 46 nt, Homo sapiens
gaggcuuucccggaaccccaggaaggccaggccugccaggagagaa

SEQ ID NO: 178611 - RNA, 46 nt, Homo sapiens
gaacacaggcagaggcucugcucuccgggcacucguggugcugggu

SEQ ID NO: 178612 - RNA, 47 nt, Homo sapiens
ggagagcguggccccccuggaggaguuggauucccaggcagucgugg

SEQ ID NO: 178613 - RNA, 45 nt, Homo sapiens
caaaggugacaaaggagacccaggcuuuccaggacagcccggcau

SEQ ID NO: 178614 - RNA, 50 nt, Homo sapiens
cccucaagguacaccagggcugauaggccagccaggagccaagggggagc

SEQ ID NO: 178615 - RNA, 54 nt, Homo sapiens
uugaauuuggcuagaggcuaaaagagauauccauaaacgagcacacaggagagu

SEQ ID NO: 178616 - RNA, 44 nt, Homo sapiens
cggauaucgggggccucccgggccacagggacccccgggagaaa

SEQ ID NO: 178617 - RNA, 50 nt, Homo sapiens
cuccuggaauuccagggcagccaggauuuauaggcgaaauuggagagaaa

SEQ ID NO: 178618 - RNA, 45 nt, Homo sapiens
gcaaaucuuuacgaaagggaguucucauggaugaggccacuguug

SEQ ID NO: 178619 - RNA, 45 nt, Homo sapiens
aaaaggugaccgaggauuuccugguacaucucugccaggaccaag

SEQ ID NO: 178620 - RNA, 46 nt, Homo sapiens
gaaaagggugaagcagguccuccuggcccaccuggaauugugagua

SEQ ID NO: 178621 - RNA, 44 nt, Homo sapiens
ccuggugaacccggguacccaggacucauaggccgccagggccc

SEQ ID NO: 178622 - RNA, 48 nt, Homo sapiens
aucauaaaacaauucuccuuccaugcggaaaaucgcagauucacagaa

SEQ ID NO: 178623 - RNA, 56 nt, Homo sapiens
ggccuccaggaguaccaggacaagcucaaguucaagaaaaaggagacuucgccacc

SEQ ID NO: 178624 - RNA, 46 nt, Homo sapiens
uccacagggacaaaugggcuuaaguuuucaaggaccaaaaggugac

SEQ ID NO: 178625 - RNA, 45 nt, Homo sapiens
gugagauacuuggccaugugcccgggaugcuguugaaaggugaaa

SEQ ID NO: 178626 - RNA, 42 nt, Homo sapiens
ccagggggagagagggccgcucgggccuccuggcuugccugg

SEQ ID NO: 178627 - RNA, 46 nt, Homo sapiens
cggcccgccaggccccccagguauuccaggaugcaauggcacaaag

SEQ ID NO: 178628 - RNA, 45 nt, Homo sapiens
uacuggagaaccaggacuaccuggaacaaaagggacaagagugag

SEQ ID NO: 178629 - RNA, 70 nt, Homo sapiens
aaggcgacggggguccuguccugcccaguaaccuuucacuaccucuuaaaguuuuuaggauucguaugug

SEQ ID NO: 178630 - RNA, 47 nt, Homo sapiens
uggcugugcuggcucuggcuguggcaaaugugacugccauggaguga

SEQ ID NO: 178631 - RNA, 49 nt, Homo sapiens
uuaguacccuucuugauuucuuaguauggguuuuacaauuggugucguc

SEQ ID NO: 178632 - RNA, 39 nt, Homo sapiens
agugaccuuuaacuuacucaacuugcaagacguggguca

SEQ ID NO: 178633 - RNA, 46 nt, Homo sapiens
uugguuagguaagugccccccaaaagugcaugcaaagccaaguagg

SEQ ID NO: 178634 - RNA, 24 nt, Homo sapiens
ccucuuccaggaauggauuucuug

SEQ ID NO: 178635 - RNA, 49 nt, Homo sapiens
auuugcaguguaacgucuaacauguugaacucuuuacauauucugugaa

SEQ ID NO: 178636 - RNA, 24 nt, Homo sapiens
aaacuauugcugugagaacacuca

SEQ ID NO: 178637 - RNA, 46 nt, Homo sapiens
gcauugguggaccgagccuccuuuguuaugguauggguacuggaga

SEQ ID NO: 178638 - RNA, 46 nt, Homo sapiens
gaaaggggccgcccgagcccccggggccggcgcccagagagcccag

SEQ ID NO: 178639 - RNA, 48 nt, Homo sapiens
aagggccaaugcguucgggcagcagccccugaagccgagcccgaggug

SEQ ID NO: 178640 - RNA, 46 nt, Homo sapiens
ugccucccucauccugcgcuaaacucgcuuugucugucgccucuag

SEQ ID NO: 178641 - RNA, 33 nt, Homo sapiens
cuggggacagugaccgugggguuccucgcccag

SEQ ID NO: 178642 - RNA, 41 nt, Homo sapiens
ugcucuccaacaagagugauuuguuaucugcuucucaccug

SEQ ID NO: 178643 - RNA, 48 nt, Homo sapiens
aguacuucgguggaugcauccaucugguauucucaaccaccccaugaa

SEQ ID NO: 178644 - RNA, 37 nt, Homo sapiens
auaaaaucgugugauagugccaggccauugcaaagga

SEQ ID NO: 178645 - RNA, 69 nt, Homo sapiens
ggaaggaagaagguucauccuggcgguuuaugacauugccagaauggcuugaauccuugagggugggug

SEQ ID NO: 178646 - RNA, 42 nt, Homo sapiens
aagcugccaggcgugauucacuuggcagcguaccuccaggag

SEQ ID NO: 178647 - RNA, 60 nt, Homo sapiens
uuguuuccuggcauucagguugucauuuaaaccuauuuuuuuaguguccuaaauauaagg

SEQ ID NO: 178648 - RNA, 39 nt, Homo sapiens
ggagggacucucccucugccugguggcacaggauccuag

SEQ ID NO: 178649 - RNA, 82 nt, Homo sapiens
uugcagggugugaagaaguuugaugugccguguggaggaagagauugcagugggggcugccagugcuacccugagaaaggug

SEQ ID NO: 178650 - RNA, 44 nt, Homo sapiens
gaugccccagcagcaggggcugcaauggggccagggugacucuu

SEQ ID NO: 178651 - RNA, 26 nt, Homo sapiens
gcaguuaccauacugaacauccaauc

SEQ ID NO: 178652 - RNA, 43 nt, Homo sapiens
ugauuccuguuaaauuguggaaaggugcagcuacaguugcuga

SEQ ID NO: 178653 - RNA, 39 nt, Homo sapiens
augacauccuaaugccuccguccuccagcaucuguggag

SEQ ID NO: 178654 - RNA, 47 nt, Homo sapiens
gcucugucccacugcuccaccccugacucugcuaaccucaugccgau

SEQ ID NO: 178655 - RNA, 48 nt, Homo sapiens
aggagccucaggucaacaauguguucucgaccugcuugaauuugcauc

SEQ ID NO: 178656 - RNA, 41 nt, Homo sapiens
uggaggauucugacuagccuggagcgagaacucacagugau

SEQ ID NO: 178657 - RNA, 57 nt, Homo sapiens
gaacaagucacucuuccuucuacggagcacugccugggaagugacugccacugccau

SEQ ID NO: 178658 - RNA, 26 nt, Homo sapiens
ggagggaaguaagccguaugagcacu

SEQ ID NO: 178659 - RNA, 54 nt, Homo sapiens
ggguggguaugagggcaggagaaagaaucagcucuguguuugggggcugugaga

SEQ ID NO: 178660 - RNA, 67 nt, Homo sapiens
ccuuggacaggccuugaaggucuggaacacacugcggaagggagggaggguccgcccuggggaaugg

SEQ ID NO: 178661 - RNA, 30 nt, Homo sapiens
gaaauauuuuucucaaggauguuggaggaa

SEQ ID NO: 178662 - RNA, 76 nt, Homo sapiens
aucucaucagaagcucaggauggacuguuuagaagugaugccaucuugacacuuacuagaauggcuauagcccaaa

SEQ ID NO: 178663 - RNA, 44 nt, Homo sapiens
aguagccaaaagguagagacaccccagauguccacgaacaaaug

SEQ ID NO: 178664 - RNA, 81 nt, Homo sapiens
caccaggauuacaaggauucccgggacugcagggacguaaaggagacaagggugaaaggggagcccccggaguaacgggac

SEQ ID NO: 178665 - RNA, 47 nt, Homo sapiens
ugggcccaggggaaggccgggcuacgauggcugcaacggaacccagg

SEQ ID NO: 178666 - RNA, 44 nt, Homo sapiens
ggcagaaaggugagccuuaugcacugccuaaagaggagcgcgac

SEQ ID NO: 178667 - RNA, 66 nt, Homo sapiens
uuccaucagacacccuccaccccaucaucgcgcccacaggagucaccuuccacccagaucaguaca

SEQ ID NO: 178668 - RNA, 41 nt, Homo sapiens
agggugaaaaaggcagugagggggaaccaggaauaagagua

SEQ ID NO: 178669 - RNA, 73 nt, Homo sapiens
acuguauuuuaagaagucaguucuagaauuucuuccucuuggcaucauaaacacuggcuaaucaucuucugag

SEQ ID NO: 178670 - RNA, 44 nt, Homo sapiens
caggguuacccuggcuugaguggugaaaaaggaucaccaggaca

SEQ ID NO: 178671 - RNA, 44 nt, Homo sapiens
ccggagacccagggcccccuggacuaccugccuacuccccucac

SEQ ID NO: 178672 - RNA, 45 nt, Homo sapiens
caggagacccgggccucccaggucccccuggccucuccaucggag

SEQ ID NO: 178673 - RNA, 85 nt, Homo sapiens
ggagaccccggcaucccugcgcucuacgggggcccaccuggaccugauggaaagcgagggccuccaggaccccccgggcucccug

SEQ ID NO: 178674 - RNA, 107 nt, Homo sapiens
ucuaggcuuccuguuugggcugaaaggagcaaaaggaagagcaggcuucccugggcuucccggcuccccuggagcccgcggaccaaagggguggaaagguaagaaca

SEQ ID NO: 178675 - RNA, 41 nt, Homo sapiens
ugccaggacccaagggcuucgcaggcaucaacggggagccg

SEQ ID NO: 178676 - RNA, 53 nt, Homo sapiens
ggugcucccggacccaaaggagcaaaaggagauuccagaacaaucacaaccaa

SEQ ID NO: 178677 - RNA, 77 nt, Homo sapiens
gugagcggggacagcccggcgucccaggugugcccgggaugaaaggugacgauggcagcccaggccgcgaugggcuc

SEQ ID NO: 178678 - RNA, 46 nt, Homo sapiens
aggagaaaugggccccccaggacugggccuucccggccucaaaggc

SEQ ID NO: 178679 - RNA, 43 nt, Homo sapiens
uuccugggcccuccuggccccgcagggaccccaggacaaauag

SEQ ID NO: 178680 - RNA, 34 nt, Homo sapiens
aagggcucgagcugaggaaugccuucugaggacc

SEQ ID NO: 178681 - RNA, 42 nt, Homo sapiens
ucccuggagaaguccugggagcucagcccgggccacggggag

SEQ ID NO: 178682 - RNA, 45 nt, Homo sapiens
cccuggauuuaaaggaauugauggaaugccugggacccccgggcu

SEQ ID NO: 178683 - RNA, 34 nt, Homo sapiens
cuucucacuugaguuacauugccgaaauguuacg

SEQ ID NO: 178684 - RNA, 46 nt, Homo sapiens
ggacucaaagggagacccggguuuccagggagcaaaggcgaggcug

SEQ ID NO: 178685 - RNA, 45 nt, Homo sapiens
accaccuccugucauccugccaggaaugaaagacauuaaaggaga

SEQ ID NO: 178686 - RNA, 46 nt, Homo sapiens
gaaucccugggcugccugggaggcccggccacaucaaaggagucaa

SEQ ID NO: 178687 - RNA, 46 nt, Homo sapiens
gugacaucggggacacuauaaauuuaccaggaagaccaggccugaa

SEQ ID NO: 178688 - RNA, 46 nt, Homo sapiens
ugguugcaggucugaagggauucuuuggagagaagggaacagaagg

SEQ ID NO: 178689 - RNA, 42 nt, Homo sapiens
ggcgugacuggaguccaaggcccuccuggacuuaaaggacaa

SEQ ID NO: 178690 - RNA, 46 nt, Homo sapiens
cgcagguuuuccgggacuccgugggauccgcggcuuacacggcuug

SEQ ID NO: 178691 - RNA, 46 nt, Homo sapiens
acauccacggagacccaggcuucccaggcccuccuggggaaagagg

SEQ ID NO: 178692 - RNA, 51 nt, Homo sapiens
aggccaacacccuuccaggcccugugggagucccaggacagaaaggagacc

SEQ ID NO: 178693 - RNA, 59 nt, Homo sapiens
gagagggacacggggagugcguguauaacggggacagauuucaguuuaggaugagaaag

SEQ ID NO: 178694 - RNA, 46 nt, Homo sapiens
ccaccagggccaccagguucugcugcucuuccuggaagcaaaggug

SEQ ID NO: 178695 - RNA, 42 nt, Homo sapiens
ggugggcgacagaggccccaagggacccaagggagacccagg

SEQ ID NO: 178696 - RNA, 42 nt, Homo sapiens
gaagauugccguccaaccagggacaguggguccccaggggag

SEQ ID NO: 178697 - RNA, 45 nt, Homo sapiens
aacaaacucuggaguggauacagccugcuguacuucgagggccag

SEQ ID NO: 178698 - RNA, 46 nt, Homo sapiens
ccuggcgcgguucagcaccaugcccuuccuguacugcaacccuggu

SEQ ID NO: 178699 - RNA, 46 nt, Homo sapiens
uucugugugugaggccccggccaucgccaucgcgguccacagucag

SEQ ID NO: 178700 - RNA, 46 nt, Homo sapiens
cagcacacggcggcgggagacgaaggcgguggccaaucacuggugu

SEQ ID NO: 178701 - RNA, 46 nt, Homo sapiens
cacuacuacgccaacaaguacagcuucuggcugaccaccauucccg

SEQ ID NO: 178702 - RNA, 33 nt, Homo sapiens
ucuuaacuuauuaccucaggugccaacccaaaa

SEQ ID NO: 178703 - RNA, 29 nt, Homo sapiens
acagaaagccaggagcagcccuggccccc

SEQ ID NO: 178704 - RNA, 26 nt, Homo sapiens
uggguuuggcaaaacucaggcagaag

SEQ ID NO: 178705 - RNA, 51 nt, Homo sapiens
cugggggugagcuguacucuucugacugcccccuccuguguaacgacuaca

SEQ ID NO: 178706 - RNA, 55 nt, Homo sapiens
ugaaucucaaaggauaucauguuccuacggguacgugaaaacugaaaauaccuaa

SEQ ID NO: 178707 - RNA, 48 nt, Homo sapiens
gggcgcgggggcgcuggggguucuuacgggaagaugaggaagcccgac

SEQ ID NO: 178708 - RNA, 46 nt, Homo sapiens
gaaguugugucagaaaaagaggaagagucuucuguuagaaacagaa

SEQ ID NO: 178709 - RNA, 26 nt, Homo sapiens
aucaaaagagccaaugagguaagugg

SEQ ID NO: 178710 - RNA, 41 nt, Homo sapiens
acuuugacagcccaaucacgaugaagaggaggcggggagac

SEQ ID NO: 178711 - RNA, 44 nt, Homo sapiens
gguagaagagaggagcggagcgggcagcgggaaggggcgcgcuc

SEQ ID NO: 178712 - RNA, 45 nt, Homo sapiens
auuucgcgucgaucucccgcaucagcgagacauuucucugcaagu

SEQ ID NO: 178713 - RNA, 42 nt, Homo sapiens
cugugauguccuucguggaauguccuuaucauuccccugcgg

SEQ ID NO: 178714 - RNA, 45 nt, Homo sapiens
ugaaggagcuagacgagugcuacgagcgcuucagucgcgagacag

SEQ ID NO: 178715 - RNA, 45 nt, Homo sapiens
uggaucuucucgucgcccagcuccuggcugcggaucagcgcgcgc

SEQ ID NO: 178716 - RNA, 44 nt, Homo sapiens
cagccaggagcugggcgacgagaagauccagaucgugagccaga

SEQ ID NO: 178717 - RNA, 50 nt, Homo sapiens
ggcugacaagcccaacagcaagcgcucacggcggcagcgcaacaacgaga

SEQ ID NO: 178718 - RNA, 98 nt, Homo sapiens
guccagcaaccacgaccacgacgacggcgccucgggcacacccaaggagaagaaggccaagaccuccaagaagaagaagcgcuccaaggccaaggcgg

SEQ ID NO: 178719 - RNA, 45 nt, Homo sapiens
cucaaucauaaacccaagggcaagugguacugucccaagugccgg

SEQ ID NO: 178720 - RNA, 46 nt, Homo sapiens
gcuuuguccauggucuucucguucuccccccggcacuugggacagu

SEQ ID NO: 178721 - RNA, 43 nt, Homo sapiens
caacacuuaagucucagacugauuucuugcgggaggaggggga

SEQ ID NO: 178722 - RNA, 68 nt, Homo sapiens
auuugucuuaaaaauuuauacaccagcaauuuagacaaagccuuaagcaaauuuuguauuauuguucu

SEQ ID NO: 178723 - RNA, 48 nt, Homo sapiens
augaagaucacugccuugggcuucauggaaaacaggcccagccugggg

SEQ ID NO: 178724 - RNA, 88 nt, Homo sapiens
uacugacacacacaugauuuuccuaucuuaccaggcaaauacuacuguuaacguuuuaauaguaagucuacuuaugcacauugauuuu

SEQ ID NO: 178725 - RNA, 52 nt, Homo sapiens
uuccuuaauucacuucauuuaccuuuuuuuccauuuucgcuugagaacuaga

SEQ ID NO: 178726 - RNA, 51 nt, Homo sapiens
gccggucucucuguauucugccacugcucucauguggcauuuggcagaagu

SEQ ID NO: 178727 - RNA, 57 nt, Homo sapiens
uggacugagaagaagcgacucugcguugugcuguuggcccaggccugcaugccugag

SEQ ID NO: 178728 - RNA, 51 nt, Homo sapiens
ucuagauuuaauaacaugcuuugcuuugguagugaagaacauugagauaaa

SEQ ID NO: 178729 - RNA, 33 nt, Homo sapiens
uauguauauuguuucccaaacccacaugaaaaa

SEQ ID NO: 178730 - RNA, 40 nt, Homo sapiens
uaguaaaugugguucugacucagcccagucacuccagcau

SEQ ID NO: 178731 - RNA, 42 nt, Homo sapiens
cacgaauggcgacacagaagacgaugcugacaaaaugcacgu

SEQ ID NO: 178732 - RNA, 37 nt, Homo sapiens
uuucuaacgcuuucuguauuuugguguaauuauuuua

SEQ ID NO: 178733 - RNA, 41 nt, Homo sapiens
acauucuuaaacacgagaagccguucagacacauggagcug

SEQ ID NO: 178734 - RNA, 57 nt, Homo sapiens
uguauauucuuuggcccagaaauaauucuaaguaucugaguuaaccagaaauacaca

SEQ ID NO: 178735 - RNA, 25 nt, Homo sapiens
uuuuguuucuccuggcuagugggug

SEQ ID NO: 178736 - RNA, 71 nt, Homo sapiens
uauuuccuaaucauauuagugugggaacaaaucgaaagagaugcuuggaagacucagaagacuuuggagua

SEQ ID NO: 178737 - RNA, 34 nt, Homo sapiens; identical to SEQ ID NO: 105099

SEQ ID NO: 178738 - RNA, 47 nt, Homo sapiens
uuagauucuucagacuaacauaaaacaugauuuugagaaguuaaaua

SEQ ID NO: 178739 - RNA, 48 nt, Homo sapiens
ugccaaaaauacaauacuccugcagguuuucccaagcaaggccaaaac

SEQ ID NO: 178740 - RNA, 52 nt, Homo sapiens
guagcuugcugaacagguauggaagcugucuuugcuguuaaguacuucuccc

SEQ ID NO: 178741 - RNA, 47 nt, Homo sapiens
uauugucaguccuuauaaauaagaaaauauuauuugucccuaauucu

SEQ ID NO: 178742 - RNA, 44 nt, Homo sapiens
guuaacaaaugaaaauagaauuuaaagaccugaacuucuuuuau

SEQ ID NO: 178743 - RNA, 33 nt, Homo sapiens
gauauaaauuuuagugaaaguucuuugggggag

SEQ ID NO: 178744 - RNA, 45 nt, Homo sapiens
cagauagagaugcuuuagauuugcaugcuuugcuuaccuaauuua

SEQ ID NO: 178745 - RNA, 45 nt, Homo sapiens
ugucuauguauuuuuaauccaaauguugccugcaaauaugugauc

SEQ ID NO: 178746 - RNA, 73 nt, Homo sapiens
uuacuaauguauuugagauacagcauaccaaauuuuaaaguaaccagaaucgugaguugaugguuuuuagucc

SEQ ID NO: 178747 - RNA, 44 nt, Homo sapiens
uagaaacucuuuaaaaauaguuucuuccuauuauuaacugaaga

SEQ ID NO: 178748 - RNA, 64 nt, Homo sapiens
uuauagguagugcuuucaaauaaaaccaguguuugcuaaauccaaaugucuuucucccuugcua

SEQ ID NO: 178749 - RNA, 71 nt, Homo sapiens
uaauauuucaguuacaaaaucuaccagaauuaugacucugaauucauauuuucugauuuuagguccucuga

SEQ ID NO: 178750 - RNA, 27 nt, Homo sapiens
uuuaccauagagcccugucuagaaacc

SEQ ID NO: 178751 - RNA, 33 nt, Homo sapiens
acauguauuuuaacuuaauuauuuuuaucuuaa

SEQ ID NO: 178752 - RNA, 46 nt, Homo sapiens
aggcagauuuguagguccguuuuaauacugcauuauacggaugcca

SEQ ID NO: 178753 - RNA, 52 nt, Homo sapiens
gauaauauaaauuuuuccuuuuccugugaauagauuaaaagcugccuuauau

SEQ ID NO: 178754 - RNA, 53 nt, Homo sapiens
aaugguacuaggucuauuuuauucccuguaacgcugcucauaugguaaagugu

SEQ ID NO: 178755 - RNA, 68 nt, Homo sapiens
gcaaaaguccuaaaacuuuguuuucaaaauuaguaauguaauuuugccuuuuagaacaguugguguua

SEQ ID NO: 178756 - RNA, 52 nt, Homo sapiens
cacgucgaguaagugucuuucguuuauucuuuccagcuaaagauguaguuga

SEQ ID NO: 178757 - RNA, 46 nt, Homo sapiens
cccccuuuucaaagugucuuauggcaguucaguauuuucaguagau

SEQ ID NO: 178758 - RNA, 98 nt, Homo sapiens
guuauagcugguaauuaaaggagccuggccuugagcccagguuuccuggcuuucuacucauagcugccuuagccucauuuccacagauaauuaugaaa

SEQ ID NO: 178759 - RNA, 42 nt, Homo sapiens
ugagagcgggagccacacucaacgucuccaccacacgguacg

SEQ ID NO: 178760 - RNA, 72 nt, Homo sapiens
uucuaucuaccgucuuuuucauaaggacaagggaauauguuaucuuaaauguccuuuaaaauuugcauggca

SEQ ID NO: 178761 - RNA, 76 nt, Homo sapiens
ccuuuaacguuuuuguuuagaauagucugugcaacaaacaguuuugauagaagucuuggaacagcgcaguccaaua

SEQ ID NO: 178762 - RNA, 52 nt, Homo sapiens
cuuguucccuaacugcauugugauuggagugagggaaaaugagcaguccagg

SEQ ID NO: 178763 - RNA, 27 nt, Homo sapiens
uuugcaaaauucuacgucacaaauuga

SEQ ID NO: 178764 - RNA, 45 nt, Homo sapiens
cacucuauaguggggaaguagcaaauauuucaauucagugagcaa

SEQ ID NO: 178765 - RNA, 46 nt, Homo sapiens
auauauauauauauauauauauauauauauauauguauguauguau

SEQ ID NO: 178766 - RNA, 47 nt, Homo sapiens
cuugccuauuuuuucauuguaaauauuuauauacuacugaccaagau

SEQ ID NO: 178767 - RNA, 46 nt, Homo sapiens
uuguaucagcauaacuugacuggaauucuagaaaccgcugucagag

SEQ ID NO: 178768 - RNA, 65 nt, Homo sapiens
aagacauuucuagauagauaaaacuugagagaguuccuagaagcauacggacuaccaaaauugau

SEQ ID NO: 178769 - RNA, 49 nt, Homo sapiens
uuuauaauaaaagugcaaaauaucaauaaagagauagaaauuguaaaaa

SEQ ID NO: 178770 - RNA, 35 nt, Homo sapiens
agcacucuuguugcuuagaauauguauaaggcuaa

SEQ ID NO: 178771 - RNA, 48 nt, Homo sapiens
uaagaaauacauaagcacugccauaaauaucacauuggccuuggaaaa

SEQ ID NO: 178772 - RNA, 37 nt, Homo sapiens
agggugaggggcaccacacucaaaaccuuugucagua

SEQ ID NO: 178773 - RNA, 60 nt, Homo sapiens
agucaucaucgcagauucugcugcuuugccaugauuacuuugcaaacucacuuuggugcu

SEQ ID NO: 178774 - RNA, 43 nt, Homo sapiens
auuucuuuaugauuugaaguguuacaaaauugaagcuauauag

SEQ ID NO: 178775 - RNA, 52 nt, Homo sapiens
gauuauggauaaacccccccaguauugcaccaguacuaaauccaagcucugg

SEQ ID NO: 178776 - RNA, 45 nt, Homo sapiens
uuacuacuaugccaggccucagacccuuccccugagcuaccaaga

SEQ ID NO: 178777 - RNA, 51 nt, Homo sapiens
ugagggugugacccagaguacuucaccuagacauagugcuuuugccuguuc

SEQ ID NO: 178778 - RNA, 46 nt, Homo sapiens
ugugcgggugauuggcagcaacuucgccccaacuguugaaagagau

SEQ ID NO: 178779 - RNA, 388 nt, Homo sapiens
cugugucuaaaagugggcucucagauccugacaggguccucucugaauaaauaauuuauuuauuuauuuauuugagauggagucuugcucugucaccuaggcuggagugcaguggcaugaucugggcucacugcaaccucugccuccuucaagugauucuccugcaucagccccccaaguaguugggauuacagguguaugccagcacuccuggcuaauuuuuguguuuuuaguagagaugggguuucaccauguggccaggcuggucuccaacuccugaccucaagugaucugcaccccaccccccugccgcuuggccucccaaagugcugggauuacaggcacgagccacugcgcccggcccucucugaauaaauuaugucaugaa

SEQ ID NO: 178780 - RNA, 99 nt, Homo sapiens
accuuaaugucaguguuuuccuuauaccagugguuccagaguuuuuuuuucuagggauaaaccacacauucauacauucccauuguuauaauuggauuu

SEQ ID NO: 178781 - RNA, 58 nt, Homo sapiens
gccauguuaauuagcaauaaguacuguggcgaaaaaguaggguaaaggaauagagagg

SEQ ID NO: 178782 - RNA, 59 nt, Homo sapiens
aaaugguacaggaugccauuucuugcuccuuguuuuggccagguugguggggcagagag

SEQ ID NO: 178783 - RNA, 46 nt, Homo sapiens
ugguuaucuaagugaguauuuuaaaaugaguuuggcuccgguuaga

SEQ ID NO: 178784 - RNA, 45 nt, Homo sapiens
uucauucgcugcggaaucuuccucauccuggagaagcugaagauc

SEQ ID NO: 178785 - RNA, 45 nt, Homo sapiens
agucagaagaacaaaaggaugauucugaucuauuugcuuccagua

SEQ ID NO: 178786 - RNA, 39 nt, Homo sapiens
uguuuugugauuaaugguugccuuuaagauauucaaaca

SEQ ID NO: 178787 - RNA, 48 nt, Homo sapiens
aaauacacauucuaagagucaagguaagaguguuccuaauuuggugca

SEQ ID NO: 178788 - RNA, 40 nt, Homo sapiens
uaguccuagugacucuuaccaggccagucaccaucuccag

SEQ ID NO: 178789 - RNA, 54 nt, Homo sapiens
gacuugaaggugucuggcagugaaggaaggagaggaugaagggaggcuggagag

SEQ ID NO: 178790 - RNA, 46 nt, Homo sapiens
uagauaguguuuuauuuuuaaagaagauuaacacgugcuggcagga

SEQ ID NO: 178791 - RNA, 64 nt, Homo sapiens
cuguuuagaacccauauuauuagugauaaaaugguucagaguaaaaccauugauggaauccuac

SEQ ID NO: 178792 - RNA, 77 nt, Homo sapiens
ugcugaucgagcgcgagaggagcggcgaggccguggaccggagccuguugcggagccuccugggcaugcugucugac

SEQ ID NO: 178793 - RNA, 43 nt, Homo sapiens
uuggaagagacuaauugcuuauaugcugccgaaggccaaaggu

SEQ ID NO: 178794 - RNA, 51 nt, Homo sapiens
uaucuuaaccauguaaguaaacgcuuagaggaagagggagacagaguaauc

SEQ ID NO: 178795 - RNA, 45 nt, Homo sapiens
uguggagaaacagcuauuaggagaacauuuaacagcaauucugca

SEQ ID NO: 178796 - RNA, 51 nt, Homo sapiens
gcucgaccacuuacuggaugagaacagagugccggaccucgcacagaugua

SEQ ID NO: 178797 - RNA, 47 nt, Homo sapiens
aguccuuugagacguucaucaacaagagacccaacaagccugcagaa

SEQ ID NO: 178798 - RNA, 53 nt, Homo sapiens
uacuauauguuuaugcucacagcaaagcauguggauucaaaguuaagagcagg

SEQ ID NO: 178799 - RNA, 45 nt, Homo sapiens
gucuuugaagcauuuuauaaaaaagauuuggcaaaaagacuccuu

SEQ ID NO: 178800 - RNA, 29 nt, Homo sapiens
cuuaauaagacauuuucacggauuaauga

SEQ ID NO: 178801 - RNA, 42 nt, Homo sapiens
cuuccagacacuggugcuccucauguucaacgagggagaugg

SEQ ID NO: 178802 - RNA, 44 nt, Homo sapiens
gauaagacauagacuugguagcaugauugguuuacuguuguuga

SEQ ID NO: 178803 - RNA, 66 nt, Homo sapiens
auuuuuaauggagaguucaagcacaaguuguuuagaauaaagaucaaucaaauucagaugaaggaa

SEQ ID NO: 178804 - RNA, 45 nt, Homo sapiens
agguuagcaccacugagagaguguuucaggauagacaauaucaga

SEQ ID NO: 178805 - RNA, 87 nt, Homo sapiens
gagaauugaaucucugauagacagagacuauauggagagagacaaagacaauccgaaucaguaccacuacguggccugacgcaucug

SEQ ID NO: 178806 - RNA, 70 nt, Homo sapiens
gccggguacggugcggggagcgggggcgcgggcggcgguugggccgcggacugccgggcgcugcgguggc

SEQ ID NO: 178807 - RNA, 46 nt, Homo sapiens
gggccacucuuggugucguaguucacugagaaggcagcagagaagu

SEQ ID NO: 178808 - RNA, 46 nt, Homo sapiens
uaucuauaucugcccugaugucaguuauagauuccacagucuugau

SEQ ID NO: 178809 - RNA, 46 nt, Homo sapiens
ccucuggcgucaggaagaauuguauucaacuggauuccuuguagga

SEQ ID NO: 178810 - RNA, 25 nt, Homo sapiens
cuugaugaccagauuccgcgccagc

SEQ ID NO: 178811 - RNA, 23 nt, Homo sapiens
ucacagguguccauguccuggga

SEQ ID NO: 178812 - RNA, 46 nt, Homo sapiens
uucuugcagcgcgccuccccgcaggccuccgagucugcgcacucgu

SEQ ID NO: 178813 - RNA, 44 nt, Homo sapiens
caggaacaguggaagcuacccggcuuguuguggcagaucuggag

SEQ ID NO: 178814 - RNA, 43 nt, Homo sapiens
gagaacaacaauauaaaaaggaaaacaagauaaggagaagguc

SEQ ID NO: 178815 - RNA, 45 nt, Homo sapiens
cgcggcugcacagcuccuccacgcacucccucuccagguggcccu

SEQ ID NO: 178816 - RNA, 52 nt, Homo sapiens
gcagcagcagcagcagcugcggcgcgcggcgcagggcggcgggcccgggcga

SEQ ID NO: 178817 - RNA, 35 nt, Homo sapiens
gccggggacgcgcggucagagcgcccgggaggccg

SEQ ID NO: 178818 - RNA, 47 nt, Homo sapiens
acuucguccuccgguugcgggggcggugcgggcaaaccucgcgagga

SEQ ID NO: 178819 - RNA, 42 nt, Homo sapiens
gcacuuuucugguaaaauaucauuuugccuagcccaccagca

SEQ ID NO: 178820 - RNA, 45 nt, Homo sapiens
ggagguucaggagaagaaacagaggcagguuuugaaggcucagga

SEQ ID NO: 178821 - RNA, 44 nt, Homo sapiens
aacuggugacucuggagaugaggcugaagguggccccaauguuu

SEQ ID NO: 178822 - RNA, 42 nt, Homo sapiens
cucaggagaugcagggggagacuuccaggagcugggugagac

SEQ ID NO: 178823 - RNA, 41 nt, Homo sapiens
agguuucugaggcucaauaaaaaaggaagacuuccagagau

SEQ ID NO: 178824 - RNA, 65 nt, Homo sapiens
gggccuuauugaacacugucaauaaggaacacuggucuguguaccccagacuaggggucacugca

SEQ ID NO: 178825 - RNA, 41 nt, Homo sapiens
caucuuggaauaauaggguaucaguggaggcggauggugcc

SEQ ID NO: 178826 - RNA, 62 nt, Homo sapiens
cgucagcaucugcaggcaguuuuaaaagacagauuaagggaaggaaggagggaaggaaggaa

SEQ ID NO: 178827 - RNA, 51 nt, Homo sapiens
gaaaagauucuggaacuagguaguggugaugguugcacaacacugccauug

SEQ ID NO: 178828 - RNA, 50 nt, Homo sapiens
uauagcuaguaaacaacucuaucaaauucucuguuuccucaccaacacac

SEQ ID NO: 178829 - RNA, 26 nt, Homo sapiens
cuccacugagagagcacaaaauuagc

SEQ ID NO: 178830 - RNA, 43 nt, Homo sapiens
ggcuccgcggcccccugcgccugggccccggcggccugaaggu

SEQ ID NO: 178831 - RNA, 52 nt, Homo sapiens
cagcaccauccuuccaagguccaccgugaucaacauccacagcgagaccucc

SEQ ID NO: 178832 - RNA, 607 nt, Homo sapiens
cugggggagaggagauggugaggggaccaggaucccccagcugagagccgcgugcuauggcuccgucuccuccccgcccugagaucagggaccaccuccuccccuuccucacccgggcucagacucuccaggagccucggggcucauccuccuucugccuuggccccagcacaggcuguucuccccaccauggggugaagucaccugugaguucccuucucacuuucugggagagccugggugccagucuggaaggugaggguguaauuucuuacugggcuauagggagaauugcucugggcuaauggauagccagggacagacucugagccagccagccagccuccuggagccuccuccuagaccugcacugggcagauuccccaaagccacacacacacacagaucacacagacaaagcuacugacgugagcacacacggggcagaggugcacacaaacucacagucacagggacacacaaguccccaccccaggcagcaugugggcagguggagccccaggcucaccggcacccccuggauuuccgccagggccauacgcaccuucacggaguaggcgaaugcuaugaagcccagacagcacca

SEQ ID NO: 178833 - RNA, 609 nt, Homo sapiens
gcugucugggcuucauagcauucgccuacuccgugaaggugcguauggcccuggcggaaauccagggggugccggugagccuggggcuccaccugcccacaugcugccugggguggggacuugugugucccugugacugugaguuugugugcaccucugccccgugugugcucacgucaguagcuuugucugugugaucuguguguguguguggcuuuggggaaucugcccagugcaggucuaggaggaggcuccaggaggcuggcuggcuggcucagagucugucccuggcuauccauuagcccagagcaauucucccuauagcccaguaagaaauuacacccucaccuuccagacuggcacccaggcucucccagaaagugagaagggaacucacaggugacuucaccccaugguggggagaacagccugugcuggggccaaggcagaaggaggaugagccccgaggcuccuggagagucugagcccgggugaggaaggggaggagguggucccugaucucagggcggggaggagacggagccauagcacgcggcucucagcugggggauccugguccccucaccaucuccucucccccagucuagg

SEQ ID NO: 178834 - RNA, 27 nt, Homo sapiens
ugcuuauuuuucucaaacuguggcaca

SEQ ID NO: 178835 - RNA, 42 nt, Homo sapiens
aggacuggagaucuccuggauggaguuggauuaagacagaag

SEQ ID NO: 178836 - RNA, 95 nt, Homo sapiens
uacaugcugugguucuagguccgcacaugcucuuuguggucugcucugugaaucagauuuaauuuccuguuguaagauggguggugaccuuggaa

SEQ ID NO: 178837 - RNA, 56 nt, Homo sapiens
uggaguuuaaaaugacuucugaaaccuagugugcuaaucuauacaaaccaauauag

SEQ ID NO: 178838 - RNA, 109 nt, Homo sapiens
uagagucccuggcucacugccuuuucuccugauuugaugaaucagauuccaguucuuuugaccaagcugcacauccuugaaaagucaggugcccucugugugccucagu

SEQ ID NO: 178839 - RNA, 38 nt, Homo sapiens
ggcaccugcucugcacagggcuggucgcagccagagaa

SEQ ID NO: 178840 - RNA, 47 nt, Homo sapiens
caugggaggggauucucccgugaacacuggugucacacacagucagu

SEQ ID NO: 178841 - RNA, 42 nt, Homo sapiens
uuagaacaauauuuaucaauauuggagcucucccugucugcu

SEQ ID NO: 178842 - RNA, 51 nt, Homo sapiens
uguuuuuauuuuuauuuuugagagcaaaaggccuucuauuaucuugcacua

SEQ ID NO: 178843 - RNA, 35 nt, Homo sapiens
uggcugaagucaucgcauuuccaaacgcccaagcc

SEQ ID NO: 178844 - RNA, 45 nt, Homo sapiens
aagagcaccaugcucugguagacgcaguagagccggucguccagc

SEQ ID NO: 178845 - RNA, 70 nt, Homo sapiens
agggcacgcguuuagcaguuucuggccuuugguccaaagagguggucauguuggaacagaucggagacgu

SEQ ID NO: 178846 - RNA, 58 nt, Homo sapiens
acauguuuacuuagaauuggagaagggagcuuauaagucaucuagucuacucccuuuu

SEQ ID NO: 178847 - RNA, 50 nt, Homo sapiens
uuuggcagaagugcagaaagaauguagaagugucauaaaagggaguagac

SEQ ID NO: 178848 - RNA, 47 nt, Homo sapiens
cauuuuauuaugguuucuuaacuagagguugauguuagugguuggac

SEQ ID NO: 178849 - RNA, 61 nt, Homo sapiens
caauucuccaagguuuuauguuguuucuucuguuucucuguaggcaccagaaaucaaaacc

SEQ ID NO: 178850 - RNA, 46 nt, Homo sapiens
gcugagauaguucacaaauuaaagaaaugaacaaagaacugaggaa

SEQ ID NO: 178851 - RNA, 51 nt, Homo sapiens
caggaggaguaguuacuauuauuacacucauuuuacaggcaaagaaauagg

SEQ ID NO: 178852 - RNA, 56 nt, Homo sapiens
auugugaaaaagugacuagucaaaggagaagaggauuucagcucccagggguggua

SEQ ID NO: 178853 - RNA, 37 nt, Homo sapiens
cacugcccauguucccaacaggccuccaggguuacug

SEQ ID NO: 178854 - RNA, 42 nt, Homo sapiens
uggucuucaaaacagugcaguauauacuuuaggugaagauac

SEQ ID NO: 178855 - RNA, 45 nt, Homo sapiens
ccuccaaaaaaaucccacuucuuauguuuucaaaccuguagcuac

SEQ ID NO: 178856 - RNA, 35 nt, Homo sapiens
cuucuuuuacuuucuauaccucaucuaugguauaa

SEQ ID NO: 178857 - RNA, 45 nt, Homo sapiens
agcgcacauguccuagcgcauucugccugauggccaagaugucag

SEQ ID NO: 178858 - RNA, 65 nt, Homo sapiens
aaggaccuaguuguuuacagcaaucuuucugauggcugaaaaaccugccuaccuguacauagagg

SEQ ID NO: 178859 - RNA, 52 nt, Homo sapiens
augaguuauuaaccugagaaauaaucguuuuauuuauaaaugacugaguuga

SEQ ID NO: 178860 - RNA, 45 nt, Homo sapiens
gcuacuguuuucuguuaaauugucaguaaauauuuuaaucaagga

SEQ ID NO: 178861 - RNA, 42 nt, Homo sapiens
uuuaugauguuacggugguuuaugaagggaaagacgauggag

SEQ ID NO: 178862 - RNA, 46 nt, Homo sapiens
caaauuaaguaucaagaagacuuuaccaucaauguugaucuuaagu

SEQ ID NO: 178863 - RNA, 41 nt, Homo sapiens
gaacccuacuuggcugccuguggguuacuauuaaagcauag

SEQ ID NO: 178864 - RNA, 49 nt, Homo sapiens
auuucacuuuuucuguuauuuucaauuuauuacaacuugacagcuccaa

SEQ ID NO: 178865 - RNA, 73 nt, Homo sapiens
ccaguuggaucaugauaagcaaaaugaaagaaauaaugauuaagggaaaauuaagugacuguguuacacugcu

SEQ ID NO: 178866 - RNA, 42 nt, Homo sapiens
ggauaagacaacaggcugacaaaccaagcuggccauuuggua

SEQ ID NO: 178867 - RNA, 60 nt, Homo sapiens
agaggagccgcuggagcccaaaagggagcuaagucaccaugcagcuguuggugugugggu

SEQ ID NO: 178868 - RNA, 68 nt, Homo sapiens
uggccgacauuagccccauccuaggcacaggcccauguagaggcuucugccccagugcaggcuucccu

SEQ ID NO: 178869 - RNA, 45 nt, Homo sapiens
gacagcagaguuccacguuguacuucagcgccacugcagaagugg

SEQ ID NO: 178870 - RNA, 42 nt, Homo sapiens
uuagagaacagcucugcguuugaaggugucccuaaagcagag

SEQ ID NO: 178871 - RNA, 46 nt, Homo sapiens
ucaacaggacuaccugcagagaaaggccuugucugcccagcaagag

SEQ ID NO: 178872 - RNA, 46 nt, Homo sapiens
uccucagucaucaccacuggcugugggugaaacuugcccuaaaaac

SEQ ID NO: 178873 - RNA, 49 nt, Homo sapiens
cauggaaauuccuugauaugggguuuuugaugaaucugauuaaccucug

SEQ ID NO: 178874 - RNA, 48 nt, Homo sapiens
aagcagugccguuccccugaaaagacagggcccuuccuuccauggcgg

SEQ ID NO: 178875 - RNA, 58 nt, Homo sapiens
ggacuuuucccugaguucgcgggcguccccgcaggucccgcugcuuccgaggcgcgcc

SEQ ID NO: 178876 - RNA, 88 nt, Homo sapiens
ugaucagcccaucuuugaucagcuuccggaucugcugacgggaguuggcauuggugauuucauuggucucauuggggucuaaccagau

SEQ ID NO: 178877 - RNA, 42 nt, Homo sapiens
agaauggcagaagagccgcgucaguccacagccacccagcaa

SEQ ID NO: 178878 - RNA, 60 nt, Homo sapiens
ccgggccuucggcgccgggcagcugcagcggccgcgggcucucgcgcuccugcugcccgg

SEQ ID NO: 178879 - RNA, 1969 nt, Homo sapiens
guaggcugaggcuugugggacuguggcuauagcaggaaguaaaguaacagugaggugagugugagugccucaugguauaggagggaaggcacucccugucacuagaagggcaggcaggagccacagcaugcaauggcaggcuggaugggauguauucuaaggucauuuucacaccugagaugguuucagugggaagcauggucaaauaggccagaaggugggaaggcaacuuaucucuccagcuuccaagucuaagugacagagacaaccuucaggacagcggugcugaggcucacaggggcaaaauuauucccugcaacagggccauguugucuagguagucugugggaaggaagagaugcccccuggccuaucaacaacaacucugucugugaaguaaaagcggccacagccagugaguaaagacucuaagccacuggccagaacaaaagugcugggaagaagagaacugacuaggaguccucucuuugcuaggccccaagagaauuuuauaagcuuccccaagacauguggucuggaggucggugcuuggccuaaugaccacucuccuacuucacucagaaaacccaagcguagugauggagaacacaggcuggggaauaauacaacacaccugacuuccaauccccacuuggccaucaagggcuaguaauuaaccucugcaagucucagcagcuucaucuguaaaauggggauuauaaaaggaccuaucucagagucacugugaggguuagaugagaugaugaacaggcaauucagcugacccuugaauaaaauggcuuugaacuguguggguccacuuauacacaggacuuuaaaaaaccgaaugcagaacaaaaauacaguauuagcaggaugugaaaccugcauacacggaaggccaacuuuucauauauguagguccugcagggccaacuacaggacuugaguaugcaaagauucugguaugcacagaggucccagaaccaacaccugccaccagccccgccauguauaacacaggaaaacuguacuuggcagucucuaacaaagcaaagguuuaaaugaugacaguucuuagcuauuucaauguugcucagauucuauuaaccacuaaguuuagaaaacagaggcuagggggcuggggacaguggcucacaccuauaaucccagcacuuugggaggccgaggcgggcagaucaccugaggucaguucaagcccagccuggccaacaugguaaaaccucgucucuaaaauauacaaaaauuagccaggcaugauggugggugccuguaaucccagcuacucaggaggcugaggcgggagaaucacuugaaccugggagguggagguugcaguaagcugagauuacaccauugcacuccagccugggugacagagugagaauugcuugaaccugggaggcggagguugcagugagccgagaucacaccauugcacuccagccugggugacugagcgagacuccaucucaaaaaaaaaaaaaaaaaacaacaaaaaacacugagaggccgggcacgguggcucaugccuguaaucccagcacuuugggaggcugaggcaggcagaucacuugaggucaggaguucgagaccagccuggccaacauggugaaaccuugucucuacuaaaaauacacaauuagccggucaugguggugagcgccuguaaucacagcuacucgggaggcugggggaggagaaucacuugaacccaggagguggagguugcagugagcugagauuguaccauggcacuccaaccugggcaaaaagagugaaacucuguuggggggaaaaaaaagaaagaaugaaaacugagaaagguaagagcugaggcucucuggaagcuugaggagcuaaauguguguaugucaagagacuucaaaccugccuauucuuccacacagacucaccugaacacucuugugggcuaucucuccaggug

SEQ ID NO: 178880 - RNA, 36 nt, Homo sapiens
uugaucucugguugccaggcugggguggggggggcc

SEQ ID NO: 178881 - RNA, 29 nt, Homo sapiens
caaagaugagugaaaugucagugguaagg

SEQ ID NO: 178882 - RNA, 173 nt, Homo sapiens
guuggccagggcauccguaggaacugcagaggcagagagaggagucaggaagcagggaaaggccuguggcauccaccccaggauagcccccaguccaagggcccuagauccucucacccaugucaggaucucaggugucugcuucucaccuugcuggaaccgagguggcccag

SEQ ID NO: 178883 - RNA, 42 nt, Homo sapiens
gacucugggacagugguugguagagagcgggcgaugguggag

SEQ ID NO: 178884 - RNA, 41 nt, Homo sapiens
cuuguccauuuggcaucuucccggacaggcuggccgguggg

SEQ ID NO: 178885 - RNA, 45 nt, Homo sapiens
auuuacugagcaugcauugugugccaggaauuggggucagcacug

SEQ ID NO: 178886 - RNA, 44 nt, Homo sapiens
augcagcugucaccccuuccaccaacuguacgguggucuugcug

SEQ ID NO: 178887 - RNA, 46 nt, Homo sapiens
agccacgcuuggagcgcuguagcaccugccccuccuugcccuucuc

SEQ ID NO: 178888 - RNA, 52 nt, Homo sapiens
auuaauaaguagauacacugaauacaaaaagcaaagcuaugauaaagggucc

SEQ ID NO: 178889 - RNA, 45 nt, Homo sapiens
ucaucugaaagauaacuguacauuuuacucaaaugcuagugggua

SEQ ID NO: 178890 - RNA, 44 nt, Homo sapiens
ucauggcugaaaucucuuuuuccucucuggcacacagcccaucu

SEQ ID NO: 178891 - RNA, 45 nt, Homo sapiens
aauguguugucgugaaauuauggcuaacacauuucugaugaauaa

SEQ ID NO: 178892 - RNA, 54 nt, Homo sapiens
uuccagaguacacacaucauucuucacuucauccuuuuccucuaacaauaaauu

SEQ ID NO: 178893 - RNA, 46 nt, Homo sapiens
cauuccucugcugggcauuuuuuacaucuacuguauuagugagaaa

SEQ ID NO: 178894 - RNA, 53 nt, Homo sapiens
aucuggggcauggcauguugggcuucagaguggggagagaggagcuggaagaa

SEQ ID NO: 178895 - RNA, 44 nt, Homo sapiens
agaaugcuguucccuacuggcaugaaaauugcaucuucccaccu

SEQ ID NO: 178896 - RNA, 45 nt, Homo sapiens
agaguauaauaaaugauaauuaacgauaaauugcuuucaggaaag

SEQ ID NO: 178897 - RNA, 45 nt, Homo sapiens
uuuccauaaguggggucaucugcaucugaagcugucaccuggauu

SEQ ID NO: 178898 - RNA, 48 nt, Homo sapiens
ugcauauuucaugcaauacauuaaaguguaaauauuaauuuuuaaaag

SEQ ID NO: 178899 - RNA, 65 nt, Homo sapiens
caugacuaaacucauacuuuuugacuuccagcacaaucuucuguaagucuauugcuacauacaau

SEQ ID NO: 178900 - RNA, 46 nt, Homo sapiens
uucaaguaauaacccuauucuucucagauauaaacacccuaaagac

SEQ ID NO: 178901 - RNA, 46 nt, Homo sapiens
aauaucccaugcccucagcaagaaucauuucaacaugguaauuaca

SEQ ID NO: 178902 - RNA, 49 nt, Homo sapiens
cuggaucaccacgugguacuccuccuuggccucccuguccauguugggu

SEQ ID NO: 178903 - RNA, 50 nt, Homo sapiens
ugacaucggucagugugaucgucacuuugguugucccugagaguccgccc

SEQ ID NO: 178904 - RNA, 92 nt, Homo sapiens
aauuauuguuauuauuuuuauuguuuuaaaccacuaaguuuuccagcaauuuguuacacaguaauugauaacugauucagggacuguuauau

SEQ ID NO: 178905 - RNA, 47 nt, Homo sapiens
ccuggugcccuuggggaucacacuuuccaaaaccagcccacgcagaa

SEQ ID NO: 178906 - RNA, 50 nt, Homo sapiens
ugcuuuuccuucaacaugacuuugacaggucuuccauugaaagguggggu

SEQ ID NO: 178907 - RNA, 44 nt, Homo sapiens
gacuuugccacauuucuagggcaacuuaugcacuuuuuacggaa

SEQ ID NO: 178908 - RNA, 46 nt, Homo sapiens
uaugagccucaggcuuauugaggaugcugaacuugugcccggccag

SEQ ID NO: 178909 - RNA, 38 nt, Homo sapiens
ugugguaggagaagacauucuuuagaaaaaggaaucua

SEQ ID NO: 178910 - RNA, 48 nt, Homo sapiens
guguaugagugugauugaacacgcaugcuuguguuaauaauguguggg

SEQ ID NO: 178911 - RNA, 47 nt, Homo sapiens
cacucugaugucacugcaaugaaaaaggaaaauaaaguaggguaaaa

SEQ ID NO: 178912 - RNA, 36 nt, Homo sapiens
cuccaaggcucacuuaugguauugcgaagagcccag

SEQ ID NO: 178913 - RNA, 64 nt, Homo sapiens
guggauguggggaggaggaucccacauggccugcuugucaaaagaauguguucuacgaagggug

SEQ ID NO: 178914 - RNA, 45 nt, Homo sapiens
auaaauuucucaaaggauuugaaauugaacuuucuauugacugaa

SEQ ID NO: 178915 - RNA, 45 nt, Homo sapiens
cacaagguugaaacuuuuucuggugucuauaagaagcucacgggc

SEQ ID NO: 178916 - RNA, 26 nt, Homo sapiens
gcuuauuuuuuguacggcuuuuucga

SEQ ID NO: 178917 - RNA, 32 nt, Homo sapiens
uuuguuuugcucccugccauauccacagcccu

SEQ ID NO: 178918 - RNA, 62 nt, Homo sapiens
gugaggcaccgcguggggcggggcugcgggcgggcucccagcugcugggcccucaucggcug

SEQ ID NO: 178919 - RNA, 94 nt, Homo sapiens
ggcggccgccggagcgcuuuggaaggcgcacggggcgaagauggcggcggagcgacaggaggcgcugagggaguucguggcggugacgggcgcc

SEQ ID NO: 178920 - RNA, 45 nt, Homo sapiens
agaaagaagcgggcccgguccuccucggcgcccgucaccgccacg

SEQ ID NO: 178921 - RNA, 46 nt, Homo sapiens
acuugcagguagcgccgcgcggcgggcugugucgggugggccgggg

SEQ ID NO: 178922 - RNA, 51 nt, Homo sapiens
gugggggaacgcgggccagccccagccaguucugccgugccaguuucaccc

SEQ ID NO: 178923 - RNA, 87 nt, Homo sapiens
gcgcaagguuggagcuucuucaccuugcguaguuaacuuaucuguaaaaugggagucucguggaaauugcuguguaguucauuggca

SEQ ID NO: 178924 - RNA, 42 nt, Homo sapiens
ucacuaaauacuugcuaagaagacuuaagcuucacgaggcag

SEQ ID NO: 178925 - RNA, 44 nt, Homo sapiens
gcaaauucuuugcccucugugcuuccaauuccucauccauaaaa

SEQ ID NO: 178926 - RNA, 42 nt, Homo sapiens
uagaaacuuuuuauuucugcccagcauaggggcuucccauug

SEQ ID NO: 178927 - RNA, 67 nt, Homo sapiens
uaugcugggcagaaauaaaaaguuucuaccugaaagaccuaaaagcacacaguguugugaccaacag

SEQ ID NO: 178928 - RNA, 38 nt, Homo sapiens
uugcacaaacacaagaaagcauugaggucacagagaug

SEQ ID NO: 178929 - RNA, 58 nt, Homo sapiens
uccaucccugcuagugugcuuaggcccucacucuuaagcgcuuccaguacagcccgga

SEQ ID NO: 178930 - RNA, 63 nt, Homo sapiens
uaaaaugagaugauaagaguacuaauagcauagaguucuugaggauuaaacaaauuaacguau

SEQ ID NO: 178931 - RNA, 45 nt, Homo sapiens
cacagacaggaaaacuagauuacuggacauuacacaaugaguuag

SEQ ID NO: 178932 - RNA, 43 nt, Homo sapiens
guuuuaugcuucagaugaggguuuuuaguaccugagaccaaca

SEQ ID NO: 178933 - RNA, 74 nt, Homo sapiens
uuggauguacaauggaaucacacagagaacuucaaaaauacugauuccuggguuuaaauugguuuagaguaagg

SEQ ID NO: 178934 - RNA, 42 nt, Homo sapiens
accaugucaacuuuauauucuauugacuccugugacaaggaa

SEQ ID NO: 178935 - RNA, 50 nt, Homo sapiens
ucaaauuucacaaaaguacagugucauccaaaggaaaggcaauauucacu

SEQ ID NO: 178936 - RNA, 86 nt, Homo sapiens
aaaaaucccauuacuuuugauaaacgacacuaauacaucugaaaagaaagaaauagguuucaaagauuggauuauuugaaacaaca

SEQ ID NO: 178937 - RNA, 43 nt, Homo sapiens
gggacccugguggauuaugggcacaggauggauuucucagaau

SEQ ID NO: 178938 - RNA, 39 nt, Homo sapiens
uucugagaaauccauccugugcccauaauccaccagggu

SEQ ID NO: 178939 - RNA, 46 nt, Homo sapiens
gacaagggcuugauguggucuuuugaaauaauugcuaaagccaggg

SEQ ID NO: 178940 - RNA, 48 nt, Homo sapiens
acaauuccuccucucauuguuuauaccuuacaaaacagacuaugggga

SEQ ID NO: 178941 - RNA, 48 nt, Homo sapiens
guuauucuuaguucaguucuccacugcaaaucuuuaaagagcucucuc

SEQ ID NO: 178942 - RNA, 95 nt, Homo sapiens
uuuccauagaaauaguuuaaaggggggacuguuuuuaaaucagggaagagagggcaagguagaugcuacaaaaauuaucuuuuuccucuugaugc

SEQ ID NO: 178943 - RNA, 40 nt, Homo sapiens
caagaguaaguaauaucaauucuaccauuucuuuucaagu

SEQ ID NO: 178944 - RNA, 25 nt, Homo sapiens
guagaauugauauuacuuacucuug

SEQ ID NO: 178945 - RNA, 51 nt, Homo sapiens
ugcugcuucauucucuaaccuaaucuuuucaguuccuaaaaccgucuacau

SEQ ID NO: 178946 - RNA, 71 nt, Homo sapiens
gaaaaaggggccauucuugaaacgacgcagauguagacgguuuuaggaacugaaaagauuagguuagagaa

SEQ ID NO: 178947 - RNA, 63 nt, Homo sapiens
agccuuauuuuuucugguuuggaaccauauuaccucucaccugaacuauugcaaugccuccag

SEQ ID NO: 178948 - RNA, 52 nt, Homo sapiens
gauucccaugaugcuguaggucacuggggccucaaguuguauacagagcauc

SEQ ID NO: 178949 - RNA, 50 nt, Homo sapiens
uccuucuauaaaauaggagguuggaaauagccuauaaauggucucccaug

SEQ ID NO: 178950 - RNA, 49 nt, Homo sapiens
gagaccauuuauaggcuauuuccaaccuccuauuuuauagaaggagaua

SEQ ID NO: 178951 - RNA, 48 nt, Homo sapiens
gcagaaccuaagcuagaucacuagaaucuugacuuuuggucuagaguu

SEQ ID NO: 178952 - RNA, 64 nt, Homo sapiens
gaaggcauugucuauaucugaacaagugauucauacagcuacauuauuuuagcuuugacuagaa

SEQ ID NO: 178953 - RNA, 100 nt, Homo sapiens
gccaagaucuucagaugccuuguguucugcuauuuaaaugacucagagacagaggucacauuuguuucucuuuaauuugugacugguuugcucuaagccu

SEQ ID NO: 178954 - RNA, 72 nt, Homo sapiens
ugacaacuaaaucauaaaccaaccauugauuguuucagccuaguucaaaacgaggaggugggugaaucagau

SEQ ID NO: 178955 - RNA, 78 nt, Homo sapiens
ggcugaaacaaucaaugguugguuuaugauuuaguugucacugaacuggguguuguuuaaugagccauggcccaaagu

SEQ ID NO: 178956 - RNA, 49 nt, Homo sapiens
uggaaguuguggauauggaaguuuauuuacaagagguuugacuaggcaa

SEQ ID NO: 178957 - RNA, 121 nt, Homo sapiens
acauaguccuaucuguacugaacacaucauaccaucacucaucugcuuagacaacagucucaguauuguuugagaacagucuacauauuggagguauauugaugccuguguauccucagag

SEQ ID NO: 178958 - RNA, 47 nt, Homo sapiens
ugaacucugaggauacacaggcaucaauauaccuccaauauguagac

SEQ ID NO: 178959 - RNA, 44 nt, Homo sapiens
caaauaaaaaaagcuugaugcauauuuacugcuuggagacaaag

SEQ ID NO: 178960 - RNA, 46 nt, Homo sapiens
uguugauauauguuauucaucuuaaugaucaacauuuaaaaauauu

SEQ ID NO: 178961 - RNA, 42 nt, Homo sapiens
gaacuuauuauuuguacucuauucuguccuuaagacagccuu

SEQ ID NO: 178962 - RNA, 43 nt, Homo sapiens
cuuaaucauguuaucauuugaagaugauuuaguuacuuaaaga

SEQ ID NO: 178963 - RNA, 47 nt, Homo sapiens
uauguaccaagcccugagcauacuguccagcacuagaaaaaucaagc

SEQ ID NO: 178964 - RNA, 47 nt, Homo sapiens
cuauccuuggucaggugcuugauuuuucuagugcuggacaguaugcu

SEQ ID NO: 178965 - RNA, 45 nt, Homo sapiens
gaaauuggagcagcauauaccauaaccuuuuugcagucucugcug

SEQ ID NO: 178966 - RNA, 49 nt, Homo sapiens
gaagaagugauuaccccaagcuuaugccuugcuccaagucuagaaauca

SEQ ID NO: 178967 - RNA, 28 nt, Homo sapiens
uccccuauucucugugauuuccacagac

SEQ ID NO: 178968 - RNA, 41 nt, Homo sapiens
caaaucacaggaauuaugccaugucuguggaaaucacagag

SEQ ID NO: 178969 - RNA, 45 nt, Homo sapiens
ucuauuaugcaaauuaauucaagcauauuuuauuccccguucaga

SEQ ID NO: 178970 - RNA, 46 nt, Homo sapiens
aagggauaccagagccccuuagcucaccaacaaggggacuuugcag

SEQ ID NO: 178971 - RNA, 35 nt, Homo sapiens
ucaaaaccccauucuguaucugcaaaguccccuug

SEQ ID NO: 178972 - RNA, 34 nt, Homo sapiens
gauuugguuuuucagcuguccccuccccacagag

SEQ ID NO: 178973 - RNA, 65 nt, Homo sapiens
cgucuuucauucuccacccaauaacaauuuccagcaggaguccaaauauacuuaaacacccguau

SEQ ID NO: 178974 - RNA, 44 nt, Homo sapiens
ugggagcauauugcuuggagggaaaaauaaauguuguugaaagu

SEQ ID NO: 178975 - RNA, 45 nt, Homo sapiens
augccaggaugccuaagcauugggauucuacuaaaacauauagga

SEQ ID NO: 178976 - RNA, 45 nt, Homo sapiens
uauguuuuaguagaaucccaaugcuuaggcauccuggcauacugc

SEQ ID NO: 178977 - RNA, 46 nt, Homo sapiens
uauuucccuaauuauuaccaacaucaaggucuccuuaggagggcag

SEQ ID NO: 178978 - RNA, 74 nt, Homo sapiens
uagaaauucugaaacagguauuuaaaauaaaaaccaaagaucaaauuuugugucauauguuguuuaaagaccug

SEQ ID NO: 178979 - RNA, 76 nt, Homo sapiens
caaucugcuuccugcugaaaccaaguucaguagaaauagagggaggacaaaagauagccuucaagcuagagucaag

SEQ ID NO: 178980 - RNA, 26 nt, Homo sapiens
ucuguccucugccagagcuggaggaa

SEQ ID NO: 178981 - RNA, 70 nt, Homo sapiens
cuuggagugugcuagugugacugaagaacugaaauuucagguuuauuuaauuuuaauuacuuuaaauuua

SEQ ID NO: 178982 - RNA, 39 nt, Homo sapiens
ggaguaggacaagggaucuuuccucaugcuguggaguga

SEQ ID NO: 178983 - RNA, 248 nt, Homo sapiens
gguugugggcauuguucgucuguauuaacgaaccuguguguccuugcuuuuaaaaaaaauucuucuuuucuuuuuagagacagagugucaccauguuggccagucuggucucaaacuccuggccucaagugauccuccugccuugguuucugccaagugcugggauuacaggugugagccaucgcaccuggcuccuguguguccuugaguguguuuaucuuuuauaugugugagugugugccagccag

SEQ ID NO: 178984 - RNA, 49 nt, Homo sapiens
gccuucaugggugcuugucuuuggagcuuggagauuuauuagagcuaaa

SEQ ID NO: 178985 - RNA, 113 nt, Homo sapiens
ccaucauugcuguccuccacccagacuguccccugugggccaccuuuuagcaccugucucuuguugccucaucauucugcuggcacauguguucaccggcuuucagucagucu

SEQ ID NO: 178986 - RNA, 34 nt, Homo sapiens
gguaucugcuuugucuguccagggcucuggacag

SEQ ID NO: 178987 - RNA, 44 nt, Homo sapiens
aguggacaaaagagauuuaagggcuuguacuauuggaagguaaa

SEQ ID NO: 178988 - RNA, 50 nt, Homo sapiens
gaaguaaagcugucugagaaaggagggagugacugacuacgcucagggca

SEQ ID NO: 178989 - RNA, 65 nt, Homo sapiens
gcuugaccuuccugcaggggcuggcucaccuuugcuugggcacugacucauuccaccaucagcca

SEQ ID NO: 178990 - RNA, 22 nt, Homo sapiens
aaccccaggagaagcaugaggu

SEQ ID NO: 178991 - RNA, 60 nt, Homo sapiens
gggacccagcaaucuguguuacuaagagauuccagugauucugaugcaugcccaagcuug

SEQ ID NO: 178992 - RNA, 60 nt, Homo sapiens
agugaaagcuaaagauccagacauuggagaaaauggcuuagucacauacaauauuguuga

SEQ ID NO: 178993 - RNA, 57 nt, Homo sapiens
aggcguauaccagaugucugugucagaagcagccgucccuggggaggaaguaggaag

SEQ ID NO: 178994 - RNA, 47 nt, Homo sapiens
ccaauaaauuucucaaaggauuugaaauugaacuuucuauugacuga

SEQ ID NO: 178995 - RNA, 56 nt, Homo sapiens
gauguggggaggaggaucccacauggccugcuugucaaaagaauguguucuacgaa

SEQ ID NO: 178996 - RNA, 48 nt, Homo sapiens
ucucccuuacauguggcaggugaccccagcauuucaccuggacccaga

SEQ ID NO: 178997 - RNA, 36 nt, Homo sapiens
aacuccaaggcucacuuaugguauugcgaagagccc

SEQ ID NO: 178998 - RNA, 43 nt, Homo sapiens
aaaguaacuauggagcuguugaaggaaggcuuuuaaacagaga

SEQ ID NO: 178999 - RNA, 96 nt, Homo sapiens
uaaacaaaacaagcaaacaaaacaguguccuggcacuaggacaguaccuccauguacaguauuaggcucccaauaaacauuaaauaaauauauagg

SEQ ID NO: 179000 - RNA, 47 nt, Homo sapiens
cacacucugaugucacugcaaugaaaaaggaaaauaaaguaggguaa

SEQ ID NO: 179001 - RNA, 58 nt, Homo sapiens
cuuacacacccacaaccacacacccacucucagaacccucacccuuuuacccuacuuu

SEQ ID NO: 179002 - RNA, 39 nt, Homo sapiens
gcguguucaaucacacucauacacauacacaaacucacu

SEQ ID NO: 179003 - RNA, 48 nt, Homo sapiens
auguguaugagugugauugaacacgcaugcuuguguuaauaaugugug

SEQ ID NO: 179004 - RNA, 44 nt, Homo sapiens
agugugguaggagaagacauucuuuagaaaaaggaaucuaaaau

SEQ ID NO: 179005 - RNA, 43 nt, Homo sapiens
cauuugcuaaucaccuggcugguaguuuuuauccugcagauau

SEQ ID NO: 179006 - RNA, 44 nt, Homo sapiens
uguugcacagaguauuaaaugugaaaagcaaauaagauaauguu

SEQ ID NO: 179007 - RNA, 71 nt, Homo sapiens
aaaguugcaaagcaaaauacuauugauaaauauagacaaaguauuagaacugaugaaaucucuguaagggg

SEQ ID NO: 179008 - RNA, 47 nt, Homo sapiens
gccgugaacuugaaugagauuuggacaaaauccacauaggacauuuu

SEQ ID NO: 179009 - RNA, 46 nt, Homo sapiens
uauaugagccucaggcuuauugaggaugcugaacuugugcccggcc

SEQ ID NO: 179010 - RNA, 97 nt, Homo sapiens
uuacagauaaaacugguuuccguaaaaagugcauaaguugcccuagaaauguggcaaagucagaguuugaacacaagucugucuauguauguacaga

SEQ ID NO: 179011 - RNA, 44 nt, Homo sapiens
cugacuuugccacauuucuagggcaacuuaugcacuuuuuacgg

SEQ ID NO: 179012 - RNA, 93 nt, Homo sapiens
uugaaagguuauuauuaauaauuguaauuauagcaacuaccaucauuuaaugaauagucacuacuauuguaaaucucugcaggagccuacauu

SEQ ID NO: 179013 - RNA, 44 nt, Homo sapiens
ugggggauuauggcuguucuacaaaauuuauaaaauugcagagg

SEQ ID NO: 179014 - RNA, 51 nt, Homo sapiens
cauaagccaccaaauguuuccacuggagucauaaggcucacaaaucuaagg

SEQ ID NO: 179015 - RNA, 63 nt, Homo sapiens
aaacaaaacacaaaaacaagacaacaacaacaacaacaaugucggggaguagagguaguagga

SEQ ID NO: 179016 - RNA, 49 nt, Homo sapiens
cagcucucucccuccucuaaccuauuccugcuuuacugagguaucaaaa

SEQ ID NO: 179017 - RNA, 46 nt, Homo sapiens
ggccaaggacauggguggacauaugggcggacucucagggacaacc

SEQ ID NO: 179018 - RNA, 61 nt, Homo sapiens
cugugauguugccugcuuaccuguccagguaucaucagaacagcccuacccaacauggaca

SEQ ID NO: 179019 - RNA, 46 nt, Homo sapiens
ucuugcugagggcaugggauauuuuauucagcauugcuuccucagu

SEQ ID NO: 179020 - RNA, 74 nt, Homo sapiens
uuuuaaggaacgucaguaauccaggugacagcuucagaugcagaugaccccacuuauggaaauagcgccaaguu

SEQ ID NO: 179021 - RNA, 46 nt, Homo sapiens
aauuuuagaauaaaacuuuguaaacaagaacauaauuugaaaaucu

SEQ ID NO: 179022 - RNA, 42 nt, Homo sapiens
uggccauuuuuauagagcaggaaggaaggaaggaaggaagga

SEQ ID NO: 179023 - RNA, 48 nt, Homo sapiens
uuuuugcaauaauauuuauaauauuauuuuaaucaccaaccaauguag

SEQ ID NO: 179024 - RNA, 50 nt, Homo sapiens
uuacaugcaaagcaacaauaaaaugauguauuuauuguucugcuacagau

SEQ ID NO: 179025 - RNA, 51 nt, Homo sapiens
gccaguagggaacagcauucugcucaguauuuauggccauaaauuaauuaa

SEQ ID NO: 179026 - RNA, 65 nt, Homo sapiens
ucucuccccacucugaagcccaacaugccaugccccagauacuugcuauuugugaccagccagga

SEQ ID NO: 179027 - RNA, 44 nt, Homo sapiens
cagcagaggaaugcuggcaaaauacauggaaugugcccccagau

SEQ ID NO: 179028 - RNA, 46 nt, Homo sapiens
aaaagugagauguacaccacacaaaaaucacugacaauccuauaaa

SEQ ID NO: 179029 - RNA, 85 nt, Homo sapiens
acagaggaaacagcagugucagcaacugagugucaaggguggggaugggguggaaaggcaaaucaucaaaauauauaauccagga

SEQ ID NO: 179030 - RNA, 47 nt, Homo sapiens
ucuuccauuuucccugcccaguccuucagccucuugguguuuagccu

SEQ ID NO: 179031 - RNA, 49 nt, Homo sapiens
guagaacuguucuaaucagggagugagucugcuuaaaagaguuuuagag

SEQ ID NO: 179032 - RNA, 47 nt, Homo sapiens
acuauuuuauuuagcuuuugcaaugauuaaucuuuacaaugagguaa

SEQ ID NO: 179033 - RNA, 57 nt, Homo sapiens
cggaguuccugcacgagaccuaucaugccaacgugccugagagguccaaugugggug

SEQ ID NO: 179034 - RNA, 74 nt, Homo sapiens
aggggaaggagcuggaaccauuuuugugauugaugacaaaucagggaacauucaugccaccaagacguuggauc

SEQ ID NO: 179035 - RNA, 54 nt, Homo sapiens
ccagcuucauucagauauugacucuggugaugggaacauuaaauacauucucuc

SEQ ID NO: 179036 - RNA, 50 nt, Homo sapiens
aaggagagcaugaaucuuagaauuaaaaauauauauauuugaacucuggc

SEQ ID NO: 179037 - RNA, 54 nt, Homo sapiens
agugauugucucugaacagaggagaaaaugaaggaaugggagucagagcugaga

SEQ ID NO: 179038 - RNA, 47 nt, Homo sapiens
cauacaguagaugaggaagaucuauaguuauaaauguggaauaguca

SEQ ID NO: 179039 - RNA, 124 nt, Homo sapiens
agcacugaaugguuucugaaacuggguuuuuguuuuuuuuuuuaaugugugugugugucuguguguguguggagccuaguaaguauccaugucaguuguauaaaucaucuuuguuagacacaaa

SEQ ID NO: 179040 - RNA, 38 nt, Homo sapiens
uucauggugugugaccuucaaaagcuagguacaugaga

SEQ ID NO: 179041 - RNA, 42 nt, Homo sapiens
gcaucucuggaguaagcaauugucaugccuacuagaagaaaa

SEQ ID NO: 179042 - RNA, 114 nt, Homo sapiens
agcuuaaauguugugaagggcugugcaugaaucauucugagauaugaauagaaccuucugcuuuggggacuuucucaaugggaagcaguguguguguucagauuggggguugca

SEQ ID NO: 179043 - RNA, 101 nt, Homo sapiens
aagagauguaccaaaggaauuucauucauuuauaucccaaauggaaauauguggaaguugacgugagaaauggaaauggaaauaauuggcauauggaauuc

SEQ ID NO: 179044 - RNA, 48 nt, Homo sapiens
gaugaacaggaauuauccaguggaagguaaaggggaaagagaauaggu

SEQ ID NO: 179045 - RNA, 48 nt, Homo sapiens
auagcuccuaaccucaaagaggucuaguggaaaagagacaguuaccua

SEQ ID NO: 179046 - RNA, 377 nt, Homo sapiens
uguacaguuaucuuucagaugauagugacauuaaaacugcaaaaagauaugugcggccagcacaguggcucacaccuguaauccuaguucucugggaggcugaggcaggugaaucacgggaugucaggaguucaagaccagccugcccaguauggugaaaccccgucucuacuaacaacacaaauauuagccaggcgugguggugagugccuguaaucccaacuacuccagaggcugaggcaggggaaucgcuugaacaugggaaggaguuguugcaguaagccaagaugugccacuguacuccagccugggagacagagugagacucugucucaaaaaaugaaugaauaaauaaauaaauaaauaauaaaaaagau

SEQ ID NO: 179047 - RNA, 46 nt, Homo sapiens
gcuggaggcauuucccugaccacacccuaaucccaacuugaaugcu

SEQ ID NO: 179048 - RNA, 31 nt, Homo sapiens
gaagagccaguaaaaccacccaaauauugua

SEQ ID NO: 179049 - RNA, 42 nt, Homo sapiens
accugcggcccuccuuccaugggcaccaugagaagggcaagg

SEQ ID NO: 179050 - RNA, 48 nt, Homo sapiens
gacagcugcauucuccugugccuaccacguaaccaaaaaugaaggaga

SEQ ID NO: 179051 - RNA, 45 nt, Homo sapiens
gaagcuaacuggggacgugggcagcccugacgugaugagcucaac

SEQ ID NO: 179052 - RNA, 40 nt, Homo sapiens
uuacagcaaccucacuaaaggauugaguccagccaucugu

SEQ ID NO: 179053 - RNA, 50 nt, Homo sapiens
guuggauauacuguuuuguuuuauuuuccuucuccuaguuagugaaagcu

SEQ ID NO: 179054 - RNA, 31 nt, Homo sapiens
gaggacaagagugacuguggcucagaaaccu

SEQ ID NO: 179055 - RNA, 28 nt, Homo sapiens
aaacagcaucugauguauuauuaaagug

SEQ ID NO: 179056 - RNA, 38 nt, Homo sapiens
ugccccucacuagcucacugaaacucuaaucaugaaua

SEQ ID NO: 179057 - RNA, 55 nt, Homo sapiens
gaauaagauauaaucccauccauucagaaguuuccagucuaguaaggagacaagg

SEQ ID NO: 179058 - RNA, 46 nt, Homo sapiens
cugugaaugagcauuuaauacuuggcauggugcaagaugggcaagg

SEQ ID NO: 179059 - RNA, 74 nt, Homo sapiens
gaaauucugaaacagguauuuaaaauaaaaaccaaagaucaaauuuugugucauauguuguuuaaagaccuggu

SEQ ID NO: 179060 - RNA, 46 nt, Homo sapiens
uuucccuaauuauuaccaacaucaaggucuccuuaggagggcagcc

SEQ ID NO: 179061 - RNA, 47 nt, Homo sapiens
uauauguuuuaguagaaucccaaugcuuaggcauccuggcauacugc

SEQ ID NO: 179062 - RNA, 65 nt, Homo sapiens
ucuuucauucuccacccaauaacaauuuccagcaggaguccaaauauacuuaaacacccguauau

SEQ ID NO: 179063 - RNA, 45 nt, Homo sapiens
auaaccugucucuaacuauaaauuagcuaccuggaaaugaaaaaa

SEQ ID NO: 179064 - RNA, 46 nt, Homo sapiens
gggauaccagagccccuuagcucaccaacaaggggacuuugcagau

SEQ ID NO: 179065 - RNA, 47 nt, Homo sapiens
ugauuugaugugaaaugagagaccagcucagugcugagugaugagau

SEQ ID NO: 179066 - RNA, 49 nt, Homo sapiens
agaagugauuaccccaagcuuaugccuugcuccaagucuagaaaucagg

SEQ ID NO: 179067 - RNA, 47 nt, Homo sapiens
uguaccaagcccugagcauacuguccagcacuagaaaaaucaagcac

SEQ ID NO: 179068 - RNA, 41 nt, Homo sapiens
uaaucauguuaucauuugaagaugauuuaguuacuuaaaga

SEQ ID NO: 179069 - RNA, 47 nt, Homo sapiens
uugauauauguuauucaucuuaaugaucaacauuuaaaaauauuaca

SEQ ID NO: 179070 - RNA, 44 nt, Homo sapiens
aaauaaaaaaagcuugaugcauauuuacugcuuggagacaaagg

SEQ ID NO: 179071 - RNA, 108 nt, Homo sapiens
uacugaacacaucauaccaucacucaucugcuuagacaacagucucaguauuguuugagaacagucuacauauuggagguauauugaugccuguguauccucagaguu

SEQ ID NO: 179072 - RNA, 49 nt, Homo sapiens
gaaguuguggauauggaaguuuauuuacaagagguuugacuaggcaagu

SEQ ID NO: 179073 - RNA, 48 nt, Homo sapiens
ugauuuaguugucacugaacuggguguuguuuaaugagccauggccca

SEQ ID NO: 179074 - RNA, 44 nt, Homo sapiens
uucagaugccuuguguucugcuauuuaaaugacucagagacaga

SEQ ID NO: 179075 - RNA, 56 nt, Homo sapiens
uugucuauaucugaacaagugauucauacagcuacauuauuuuagcuuugacuaga

SEQ ID NO: 179076 - RNA, 58 nt, Homo sapiens
cagaaccuaagcuagaucacuagaaucuugacuuuuggucuagaguuauuuuucuugu

SEQ ID NO: 179077 - RNA, 48 nt, Homo sapiens
accauuuauaggcuauuuccaaccuccuauuuuauagaaggagauacu

SEQ ID NO: 179078 - RNA, 54 nt, Homo sapiens
gauucccaugaugcuguaggucacuggggccucaaguuguauacagagcauccc

SEQ ID NO: 179079 - RNA, 64 nt, Homo sapiens
gccuuauuuuuucugguuuggaaccauauuaccucucaccugaacuauugcaaugccuccagaa

SEQ ID NO: 179080 - RNA, 51 nt, Homo sapiens
cugcuucauucucuaaccuaaucuuuucaguuccuaaaaccgucuacaucu

SEQ ID NO: 179081 - RNA, 90 nt, Homo sapiens
uccauagaaauaguuuaaaggggggacuguuuuuaaaucagggaagagagggcaagguagaugcuacaaaaauuaucuuuuuccucuuga

SEQ ID NO: 179082 - RNA, 48 nt, Homo sapiens
uauucuuaguucaguucuccacugcaaaucuuuaaagagcucucucag

SEQ ID NO: 179083 - RNA, 48 nt, Homo sapiens
aauuccuccucucauuguuuauaccuuacaaaacagacuauggggagu

SEQ ID NO: 179084 - RNA, 47 nt, Homo sapiens
acccugguggauuaugggcacaggauggauuucucagaauucuaaag

SEQ ID NO: 179085 - RNA, 86 nt, Homo sapiens
aaaucccauuacuuuugauaaacgacacuaauacaucugaaaagaaagaaauagguuucaaagauuggauuauuugaaacaacaau

SEQ ID NO: 179086 - RNA, 48 nt, Homo sapiens
gagcaauagauauuucugucaggcaagucaaaauucacaucuguaauu

SEQ ID NO: 179087 - RNA, 50 nt, Homo sapiens
aaauuucacaaaaguacagugucauccaaaggaaaggcaauauucacuuc

SEQ ID NO: 179088 - RNA, 44 nt, Homo sapiens
caugucaacuuuauauucuauugacuccugugacaaggaauuca

SEQ ID NO: 179089 - RNA, 47 nt, Homo sapiens
uuggauguacaauggaaucacacagagaacuucaaaaauacugauuc

SEQ ID NO: 179090 - RNA, 43 nt, Homo sapiens
uuuaugcuucagaugaggguuuuuaguaccugagaccaacauu

SEQ ID NO: 179091 - RNA, 45 nt, Homo sapiens
cagacaggaaaacuagauuacuggacauuacacaaugaguuagug

SEQ ID NO: 179092 - RNA, 65 nt, Homo sapiens
uauaaaaugagaugauaagaguacuaauagcauagaguucuugaggauuaaacaaauuaacguau

SEQ ID NO: 179093 - RNA, 56 nt, Homo sapiens
acuagcagggauggaaccuggcuccucucuuuaccaguuguguaaacuugaacaaa

SEQ ID NO: 179094 - RNA, 40 nt, Homo sapiens
ccaguucacuacauggccugagacagcacacugccuccca

SEQ ID NO: 179095 - RNA, 67 nt, Homo sapiens
ugcugggcagaaauaaaaaguuucuaccugaaagaccuaaaagcacacaguguugugaccaacagau

SEQ ID NO: 179096 - RNA, 42 nt, Homo sapiens
augacuaauauuuauugaguaccuaccaugagccaagcgcug

SEQ ID NO: 179097 - RNA, 42 nt, Homo sapiens
acuaaauacuugcuaagaagacuuaagcuucacgaggcaggg

SEQ ID NO: 179098 - RNA, 54 nt, Homo sapiens
ggcgcaagguuggagcuucuucaccuugcguaguuaacuuaucuguaaaauggg

SEQ ID NO: 179099 - RNA, 55 nt, Homo sapiens
cgucagcgagacuucgggcgcugcggcagccggcgaggagagggagcgccugggg

SEQ ID NO: 179100 - RNA, 24 nt, Homo sapiens
gucccgggaccgcuugucacgcgu

SEQ ID NO: 179101 - RNA, 46 nt, Homo sapiens
uugcagguagcgccgcgcggcgggcugugucgggugggccggggac

SEQ ID NO: 179102 - RNA, 47 nt, Homo sapiens
cggccgccggagcgcuuuggaaggcgcacggggcgaagauggcggcg

SEQ ID NO: 179103 - RNA, 41 nt, Homo sapiens
guuaggcugcgguucgcgccgcggucgccagagggcgcgga

SEQ ID NO: 179104 - RNA, 50 nt, Homo sapiens
gugcuuuguccaaaugagccuuuaugagccggcugccaucuaguuugacg

SEQ ID NO: 179105 - RNA, 55 nt, Homo sapiens
aaagauccagacauuggagaaaauggcuuagucacauacaauauuguugauggag

SEQ ID NO: 179106 - RNA, 67 nt, Homo sapiens
aggcguauaccagaugucugugucagaagcagccgucccuggggaggaaguaggaagagugaaagcu

SEQ ID NO: 179107 - RNA, 45 nt, Homo sapiens
caauaaauuucucaaaggauuugaaauugaacuuucuauugacug

SEQ ID NO: 179108 - RNA, 46 nt, Homo sapiens
gucaaaagaauguguucuacgaagggugauaaaacaauaucugggu

SEQ ID NO: 179109 - RNA, 50 nt, Homo sapiens
cuuucugcuuaucacccacacauuauuaacacaagcaugcguguucaauc

SEQ ID NO: 179110 - RNA, 40 nt, Homo sapiens
agugugguaggagaagacauucuuuagaaaaaggaaucua

SEQ ID NO: 179111 - RNA, 59 nt, Homo sapiens
guggccccaggaaggcacugugguuacucaaaggaauucaaaagcaagaaucuacacaa

SEQ ID NO: 179112 - RNA, 45 nt, Homo sapiens
gaguggcucagacagggccuggaggggcaccaggagaauggcagu

SEQ ID NO: 179113 - RNA, 47 nt, Homo sapiens
auguguucagcuacuuuucucacagccucauacuuuuuagugaaaga

SEQ ID NO: 179114 - RNA, 34 nt, Homo sapiens
auuaauggaaggaucuuagaauaaaaaagaugua

SEQ ID NO: 179115 - RNA, 41 nt, Homo sapiens
ugguggaaaaaaauguaaaauugugugauugauuuggugac

SEQ ID NO: 179116 - RNA, 42 nt, Homo sapiens
uaauuuuuggcacugaagaucugauuaccauauuuuuucagu

SEQ ID NO: 179117 - RNA, 44 nt, Homo sapiens
uaauaaguaguuuguugauuagaacgaagagcacuugccguaag

SEQ ID NO: 179118 - RNA, 45 nt, Homo sapiens
uuuuguuuguuuuuugcuuaucacagcuacuuugaaaacgaacac

SEQ ID NO: 179119 - RNA, 45 nt, Homo sapiens
ucuuccuaauguuaccgucauaguaauguuuaucucuugggaaaa

SEQ ID NO: 179120 - RNA, 50 nt, Homo sapiens
aggaguguucguuuuaaugauuuacgugcugugagagaguggcagcggug

SEQ ID NO: 179121 - RNA, 352 nt, Homo sapiens
uagccaggaaauuguggcccuaauauuucagcacuugaaaaugggaucuggccgggugugguggcucacgccuguauucccagcacuuugggaggccaagguggguggaucacuuggggucaggaguucgagaccagccugaccaacauggugaaacccccucucuaccaaaaauacaaaaauuagccgggcgugguggcgcacgccuguaaucccagcuacuugggaggcugaggcaggagaauugcuugaaccugggagguggagguugcagugagccaagaucacaccacugcacuccagccuaggcaacagaacaagacucugucuggaaaaaaaaaaaaaaggggga

SEQ ID NO: 179122 - RNA, 23 nt, Homo sapiens
cuuggcaaguugaaugccuuaaa

SEQ ID NO: 179123 - RNA, 68 nt, Homo sapiens
cuugugcugucccacaagugaucccuagcgaguuagacuaaaauauaaaaacaaggggaaaaucugag

SEQ ID NO: 179124 - RNA, 41 nt, Homo sapiens
caccuccacccauuaggauggcuaucauauaaaaauauaaa

SEQ ID NO: 179125 - RNA, 47 nt, Homo sapiens
aagggaaaauaucaaaagugaacauuaccuuuuaugaccagcauuuu

SEQ ID NO: 179126 - RNA, 106 nt, Homo sapiens
aacacaaccaaaugaacuguccugacaguaguuugcaaaccagcagcuagcaguuuguccagccucuaacauuguccagcacuuuccagagcaaacucacuguuua

SEQ ID NO: 179127 - RNA, 82 nt, Homo sapiens
caagaacucuuggccuuacgaaguuuauaaccucaagcuuuguuuauuuaaaauauuccugcaaaagaaaaguacccggcac

SEQ ID NO: 179128 - RNA, 47 nt, Homo sapiens
ggauggucauuuuggguuucaucauagcuuucaucuuggccuuuucu

SEQ ID NO: 179129 - RNA, 44 nt, Homo sapiens
ugaaccuguacaacgagacgguggagacucucauggcuggggaa

SEQ ID NO: 179130 - RNA, 27 nt, Homo sapiens
ucaucuugugggacuagcucagcccua

SEQ ID NO: 179131 - RNA, 49 nt, Homo sapiens
ccucugcccagccacacucugccaccccacccccgcccggcagccuccc

SEQ ID NO: 179132 - RNA, 63 nt, Homo sapiens
gaggcuaaggugcuaucaccuacucccaggcccucuugcagguauuuccuggccccaccaggc

SEQ ID NO: 179133 - RNA, 50 nt, Homo sapiens
guauucauacauugucaaggcacagcacccugcaguuagcgucagauguu

SEQ ID NO: 179134 - RNA, 29 nt, Homo sapiens
uaaaaaaaaauuagugcuuacugagauca

SEQ ID NO: 179135 - RNA, 48 nt, Homo sapiens
gagggauggauagauggaaaggagggagggagagagagaaagaaagug

SEQ ID NO: 179136 - RNA, 44 nt, Homo sapiens
auugacagcagauggacaaaauucagggugaugagggcuggaga

SEQ ID NO: 179137 - RNA, 64 nt, Homo sapiens
ucuucugauuuacagaaaugcucccgauucccaaaaccucacauguaacaugccaugauccuua

SEQ ID NO: 179138 - RNA, 52 nt, Homo sapiens
uucuggcucauacguuuucuugauaaguuguaacccaggugggcagcaaggu

SEQ ID NO: 179139 - RNA, 45 nt, Homo sapiens
uuuaaagagcuaccaggugccaaggcuaaugaugacagcaccauc

SEQ ID NO: 179140 - RNA, 52 nt, Homo sapiens
ggcugcauacgguaagaugugccuggagagcuuggguucuguggcagcacag

SEQ ID NO: 179141 - RNA, 57 nt, Homo sapiens
cacaccgugcacaaagacucggggcucuacaaagaucugcugcacaaaauccacauc

SEQ ID NO: 179142 - RNA, 50 nt, Homo sapiens
gacaggggccccgaggagaagccagcccaggaaagcaacuaccggcugcu

SEQ ID NO: 179143 - RNA, 33 nt, Homo sapiens
gcagguaacguggguggaggagcacuggggcag

SEQ ID NO: 179144 - RNA, 43 nt, Homo sapiens
caggccccugggcuggccuuuccugaaaguucucuggccaccc

SEQ ID NO: 179145 - RNA, 37 nt, Homo sapiens
uauauauggaagaggcacaaaacugcucagagguaua

SEQ ID NO: 179146 - RNA, 56 nt, Homo sapiens
cuucuuccagcugcaaacagcuaaagggauggucugguguuggcgugugggagaca

SEQ ID NO: 179147 - RNA, 48 nt, Homo sapiens
auugccuagaagucaauauucaauaaaucuuguacauaacuauuucga

SEQ ID NO: 179148 - RNA, 86 nt, Homo sapiens
uaauuuuuuaauggugugcuucccuuauacuuuuuugaucagagaauuuuggaaaguaccaaagaagcaggggaaucauuggccag

SEQ ID NO: 179149 - RNA, 46 nt, Homo sapiens
uucauuaaucaaccauauuaaauuuauaauaaaaaaugccccucag

SEQ ID NO: 179150 - RNA, 43 nt, Homo sapiens
ugcagacagcagcagagacagaaagcaggacagaucgcaaaga

SEQ ID NO: 179151 - RNA, 44 nt, Homo sapiens
cuuuuaaacauuauuugcaucuuuggguucuuuccaggacccaa

SEQ ID NO: 179152 - RNA, 54 nt, Homo sapiens
agauggggccauuguacuguuuguucugcacacuuggcggagcagcagaggcuc

SEQ ID NO: 179153 - RNA, 46 nt, Homo sapiens
aacgacaagaaaacauacugguagaaccagacacagaugagcagag

SEQ ID NO: 179154 - RNA, 46 nt, Homo sapiens
gagccaaaagggaggaccugaaggucagcauccaccaaauggagau

SEQ ID NO: 179155 - RNA, 45 nt, Homo sapiens
gaaugaaaaguuugccccugagcugcuggagagcaagccugagau

SEQ ID NO: 179156 - RNA, 42 nt, Homo sapiens
ggauuuccugggacaggacucugauggggguagugaggaagu

SEQ ID NO: 179157 - RNA, 46 nt, Homo sapiens
auagugugucugcauuuucaaccuguugcaauaacuuugcugaaau

SEQ ID NO: 179158 - RNA, 43 nt, Homo sapiens
uacuggauuucgucucagauuuaauuucuuuuaugggucuguu

SEQ ID NO: 179159 - RNA, 47 nt, Homo sapiens
uauaguuuuguuauaaauauaacuuaugagaaaaaaauuugauagga

SEQ ID NO: 179160 - RNA, 48 nt, Homo sapiens
uuaaagcaguauuuaaugcaauuuccaguuauuucuuuggagaauuuu

SEQ ID NO: 179161 - RNA, 57 nt, Homo sapiens
uuucuccaggauuuuggugaggguuggcuguggcugucguuuugcaccucccagauu

SEQ ID NO: 179162 - RNA, 45 nt, Homo sapiens
uauucaaagccauuuaauaaaacacaguuggucagcccagugcaa

SEQ ID NO: 179163 - RNA, 46 nt, Homo sapiens
acagaucccacuuccagccgggccccucauguauccacuggccgac

SEQ ID NO: 179164 - RNA, 43 nt, Homo sapiens
cagaggcuaaucuaucaauauucaaauaacuagaauuuugaaa

SEQ ID NO: 179165 - RNA, 43 nt, Homo sapiens
gucuaccuauaugacaaauggcuuuaauaagcaaaggaacauu

SEQ ID NO: 179166 - RNA, 22 nt, Homo sapiens
uuaacagcacuuuaugaauagg

SEQ ID NO: 179167 - RNA, 50 nt, Homo sapiens
agcuaaugcccacaugcucuacaaaggaaauaaacuucuuaguuuugaaa

SEQ ID NO: 179168 - RNA, 43 nt, Homo sapiens
gggauguagcuauuaagauuuauuuucuucuagcuuaucuguc

SEQ ID NO: 179169 - RNA, 56 nt, Homo sapiens
cacuaagcaagacagguguuuggagcaggaagaauaauauaggccgaucgccgggg

SEQ ID NO: 179170 - RNA, 50 nt, Homo sapiens
guccuguccucgccaugaggccgcagcaggcgccgguguccggaaaggug

SEQ ID NO: 179171 - RNA, 47 nt, Homo sapiens
aggacaccccgcgcugcggggucgggggaacaccaaccgcgagucag

SEQ ID NO: 179172 - RNA, 38 nt, Homo sapiens
gagcggggugggggaaggagguggaggggagaggaaaa

SEQ ID NO: 179173 - RNA, 48 nt, Homo sapiens
gagucaggaugacaaccaagcagguguagagcaggggcaugucauuag

SEQ ID NO: 179174 - RNA, 48 nt, Homo sapiens
cauguaaaauauuagacacuaauauuuucauagaaauuaggcuggaga

SEQ ID NO: 179175 - RNA, 52 nt, Homo sapiens
aaucaucauacucuagaaucuugucugucacucacuacaugaauaagcaaau

SEQ ID NO: 179176 - RNA, 58 nt, Homo sapiens
aauuaacuguauugguguaagaguuuugucauuaaguguuuaaguguuauucugaauu

SEQ ID NO: 179177 - RNA, 46 nt, Homo sapiens
auaagucuuauucagucaucggugagguuaaugcacuaaucaugga

SEQ ID NO: 179178 - RNA, 48 nt, Homo sapiens
ugaaaagccuuucuguugcaacuaugaaugaaaacaaaacaccacaaa

SEQ ID NO: 179179 - RNA, 46 nt, Homo sapiens
accacaaccgaaaguaucaucucagggaaacuuaauuccugcccgu

SEQ ID NO: 179180 - RNA, 48 nt, Homo sapiens
aaauaugacuaaaaccaagaaacaauagaccauagaaacagacugaga

SEQ ID NO: 179181 - RNA, 64 nt, Homo sapiens
gcaaacaucucagggucugugcugggacccagaaguaagagugaacuagaccuucaacugauuu

SEQ ID NO: 179182 - RNA, 47 nt, Homo sapiens
uuugaaggcauagaagacuaaagaagugaggaauuguggggguaagg

SEQ ID NO: 179183 - RNA, 50 nt, Homo sapiens
guuaaugucuaauaauuuccccuguauuuuaauguaauuuagugaaaggu

SEQ ID NO: 179184 - RNA, 45 nt, Homo sapiens
cuauauaugcaaacagauuugcaguaccaaccuaugcagccaagc

SEQ ID NO: 179185 - RNA, 43 nt, Homo sapiens
ggucagauggcaaaaaucaagcaaacccuucuagacagccggg

SEQ ID NO: 179186 - RNA, 53 nt, Homo sapiens
ucugugcuauuuuuaucuucaucaagagggaucaacuguggagaagcuacuuc

SEQ ID NO: 179187 - RNA, 60 nt, Homo sapiens
ggcucccccaaauugugagacuaaaggauacggaggaaguguggacaguggaccuacaua

SEQ ID NO: 179188 - RNA, 52 nt, Homo sapiens
cuuuuggcuuguuccugaaaguagugcuaaauaaugagaaaucucaggacua

SEQ ID NO: 179189 - RNA, 44 nt, Homo sapiens
auacuggaugcauuuuauguugcauuauuucucucucuuuauag

SEQ ID NO: 179190 - RNA, 42 nt, Homo sapiens
cuaaaggugacagauuuggcaauugugguuucucuggcaaug

SEQ ID NO: 179191 - RNA, 45 nt, Homo sapiens
guuccagaguacugcaaugguucuucucaguucugucagccagau

SEQ ID NO: 179192 - RNA, 54 nt, Homo sapiens
uucuuuacuuuccauaguuaggacuuacaugaauuaccuguuguuagccauugu

SEQ ID NO: 179193 - RNA, 46 nt, Homo sapiens
ccacuuguguauaauuuuaaagcacacucuuuuacguuaagugguc

SEQ ID NO: 179194 - RNA, 37 nt, Homo sapiens
cugcuacaaucauguuagaaugaaguagauuuuaggu

SEQ ID NO: 179195 - RNA, 47 nt, Homo sapiens
uucagcuagggugaagagccauccaacagagaaguuagacccugagc

SEQ ID NO: 179196 - RNA, 44 nt, Homo sapiens
aguugguggacgcuggggaagagugugacugugguacuccaaag

SEQ ID NO: 179197 - RNA, 45 nt, Homo sapiens
uuaauguuuauuauagggguuccagaaacuuuagcaguugcagug

SEQ ID NO: 179198 - RNA, 44 nt, Homo sapiens
uugaugauuaaugauauugagcaucuuuucaugcaccuguuggc

SEQ ID NO: 179199 - RNA, 419 nt, Homo sapiens
uuuuccacaguggcugcaccaaucuacauucccaccaacagugcucaagauuccuuuuuuucuauacucucacuagcacuugucaucucuuuuauuuauuuauuuauuuauuugagacagagucucucucuguugcccaagcuggagugcaguggugcaaucucggcucacuacaaccucugccucccagguucaagcgauucuccuaccucagccucccaaguagcugagauuacagacgugcaccaccacaccuggcuaauuuuuguauuuuaguagagacgggguuuuaccauguuggccaggcuggucuggaacuccugaccucaagcgauccgcccgccucagccucccaaagugcugggauuacagcggugagccaccauaccuggccguuaucucuuuuugaugguagucau

SEQ ID NO: 179200 - RNA, 46 nt, Homo sapiens
uugcucaugaauugggucauaaucuuggaaugaaucacgaugaugg

SEQ ID NO: 179201 - RNA, 58 nt, Homo sapiens
gguuuugguggaacugcaggaauggcauuugugggaacaguguguucaaggagccacg

SEQ ID NO: 179202 - RNA, 59 nt, Homo sapiens
cuggugaugugcuggggaacuucgugcaguggcgggaaaaguuucuuaucacacgucgg

SEQ ID NO: 179203 - RNA, 50 nt, Homo sapiens
agagcugucuugccacagacccgguauguggagcuguucauugucguaga

SEQ ID NO: 179204 - RNA, 58 nt, Homo sapiens
aaauguggaguuuccaacaaggauauagagaaagaaacugcaaaggaugaagaggaag

SEQ ID NO: 179205 - RNA, 43 nt, Homo sapiens
uagcucugcaauuucugugaugauuuucagcaauguagcaaua

SEQ ID NO: 179206 - RNA, 63 nt, Homo sapiens
auuuaaaauguuaaagaugauauaaugcaucuuguucugcuucuaggcugaaaggucacugag

SEQ ID NO: 179207 - RNA, 51 nt, Homo sapiens
acauggccagacugucauguauuauaaugacauauacuuuuguccauaaaa

SEQ ID NO: 179208 - RNA, 46 nt, Homo sapiens
uggugucucacuuauuucuugguuauuuaauauuguucaguuagau

SEQ ID NO: 179209 - RNA, 41 nt, Homo sapiens
cuguguuuauuacuagagcauaaacauuucuaguuuuguuu

SEQ ID NO: 179210 - RNA, 51 nt, Homo sapiens
auuguuucuuucaacaauugagacagaaauuugccuccauacuuaggaggu

SEQ ID NO: 179211 - RNA, 44 nt, Homo sapiens
cugaaggaaaagagcauauuauucacuuggaaaggaacaaguaa

SEQ ID NO: 179212 - RNA, 43 nt, Homo sapiens
uuuuuuuauauuaauguggaaaaauguuauuuugguucccaug

SEQ ID NO: 179213 - RNA, 73 nt, Homo sapiens
guuaagaaaacgggcaacacgguggaggauagaaucuaggagggagagacuagaggcugggacaccgguuaag

SEQ ID NO: 179214 - RNA, 46 nt, Homo sapiens
aguugauuguagaggggcagaaggugaccaaauaugcuaagcgcau

SEQ ID NO: 179215 - RNA, 61 nt, Homo sapiens
cccgcgggcguucaguccuccaaacgccugcagggagggagcuggcucucgcucguggagu

SEQ ID NO: 179216 - RNA, 47 nt, Homo sapiens
aaauauggucauguguuuuccuaauacugaccuucugaccaugggug

SEQ ID NO: 179217 - RNA, 79 nt, Homo sapiens
uguccccaagugagcuuuguuuauaaacuuucaaaaugucggaaguggacagguuuguuaaaucuugucugccagcacc

SEQ ID NO: 179218 - RNA, 32 nt, Homo sapiens
acuugggaauuccacauuagagcauugcuugu

SEQ ID NO: 179219 - RNA, 47 nt, Homo sapiens
uuggccauuauaauaagcugauuuguuucuuauucagcaagaucucu

SEQ ID NO: 179220 - RNA, 43 nt, Homo sapiens
uagggacuuuugauaucucuuuaaauauucccugacucacgga

SEQ ID NO: 179221 - RNA, 85 nt, Homo sapiens
aauugaguuuggccuaguuuuccugguauaaaacaggaaaucuacauuguucccucuuucucucccuuccaucccuuccccugcc

SEQ ID NO: 179222 - RNA, 53 nt, Homo sapiens
ugaggggaaucauguuucuuucaggacguguuguuucccugaagucuauguca

SEQ ID NO: 179223 - RNA, 49 nt, Homo sapiens
uuguauuuuuaaauuaaaaauuaguaacuagaggaagagacuaagagaa

SEQ ID NO: 179224 - RNA, 48 nt, Homo sapiens
uggcauagaaacauugauuuagauguuaugaguugcuggccagagauu

SEQ ID NO: 179225 - RNA, 45 nt, Homo sapiens
ucuuugacccgaccuggaagcuccagccuuucaagugggcccaac

SEQ ID NO: 179226 - RNA, 24 nt, Homo sapiens
acaccaaugcacgcguguguguuu

SEQ ID NO: 179227 - RNA, 78 nt, Homo sapiens
ugcccucaaggacagaagcccugcuuuuucuuuugaaccgagcaccagaaacaggugcacacacauaagcacaccagg

SEQ ID NO: 179228 - RNA, 25 nt, Homo sapiens
uccuucuaaagucauaggaacuaga

SEQ ID NO: 179229 - RNA, 46 nt, Homo sapiens
uuaaugagggacaaccuguuugaaauaauaacaagcuccaggaccu

SEQ ID NO: 179230 - RNA, 557 nt, Homo sapiens
aggcaccauguagccuggugccguuuuaaaaaaauauauaucuuuuuaggccgggcgugguggcucacaccuguaauccaaucccagcacuuugggaggccgaggcgggcggaucaccugaggccaggaguuccagaccauccuggccaacauagcgaaaccccuucuuuacuaaaaauacaaaaaauuagccgggcaugguggugggugccuguaauccccgcuacuugggaggcugaggcaggagaaucgcuugaacccgggaggcggagguugcagugagccaagaucgugccacugcacuccagccugggcaacaagagugaaacucugucucaaauaaauaaauaaauaaauuuuuacauuuuuuaaaauuucuaucguuuugggggaacaggugguguuugguugcauggaaaaguucuucaguggugauuucugagauuguggugcacccaucugcagcaguguccacggugcccaaaugcauagucuuuuaucccucaccccccuccugcccuucccacccugagaaguagaugugaaaggagugggga

SEQ ID NO: 179231 - RNA, 46 nt, Homo sapiens
cacugcgcaccauauuucuuaaggauguucugaagacccaugaaug

SEQ ID NO: 179232 - RNA, 34 nt, Homo sapiens
ugccgugcuuccacugggccuccccucauuaaga

SEQ ID NO: 179233 - RNA, 39 nt, Homo sapiens
cuucuuugacuuagggcaaagaggccagagauucaggca

SEQ ID NO: 179234 - RNA, 46 nt, Homo sapiens
cuccagcccuggagaagaagccacagguggccuacaagacggagau

SEQ ID NO: 179235 - RNA, 32 nt, Homo sapiens
cucacagaaagugagaaagaguagcuuaggua

SEQ ID NO: 179236 - RNA, 50 nt, Homo sapiens
aauggauuggugacugugaaaagucaaguaaggggaaaagcauaugggga

SEQ ID NO: 179237 - RNA, 42 nt, Homo sapiens
uaugaaggacuggguugaagcccugaaccaagccagcaagau

SEQ ID NO: 179238 - RNA, 22 nt, Homo sapiens
cacaugugacuauacccuguga

SEQ ID NO: 179239 - RNA, 44 nt, Homo sapiens
aggugcuuauuuucaugguuaggccaucagggcagauguaaagg

SEQ ID NO: 179240 - RNA, 35 nt, Homo sapiens
agggccuaaaggaaagugcaugggauuugggaauc

SEQ ID NO: 179241 - RNA, 32 nt, Homo sapiens
aagcccuuugcuuuuauuuaauuuuuuuaaau

SEQ ID NO: 179242 - RNA, 36 nt, Homo sapiens
agcaguugccauuuuccuuugcugccacccauaagg

SEQ ID NO: 179243 - RNA, 46 nt, Homo sapiens
acaacaaguuuaauugguaguuauuauugcccucauucugaagaug

SEQ ID NO: 179244 - RNA, 24 nt, Homo sapiens
uuaugcuuuaagaugcaaugugga

SEQ ID NO: 179245 - RNA, 45 nt, Homo sapiens
gcugagcaucuuguggaggucaggcacaaagaugggggccaccua

SEQ ID NO: 179246 - RNA, 44 nt, Homo sapiens
ggacaucgaggagcaugagaacagcggcaaguuucugcggaggu

SEQ ID NO: 179247 - RNA, 44 nt, Homo sapiens
ugcgcgcagggugaugugagcagagcccaggaaugccuuaugug

SEQ ID NO: 179248 - RNA, 62 nt, Homo sapiens
ugguggagauggucugaugagccuucagccccgggcaggcuuuuguuuccugcaggcuccaa

SEQ ID NO: 179249 - RNA, 65 nt, Homo sapiens
gaugcucaguucuuugccaagauugccacuugccagaggaacaccccauuuccuuugggauagcu

SEQ ID NO: 179250 - RNA, 41 nt, Homo sapiens
gggcuccccagggcugggcugcagccaccacggggccggga

SEQ ID NO: 179251 - RNA, 45 nt, Homo sapiens
ugcucugcacaucgucccgcagccgacagcgaagcugcagcaggu

SEQ ID NO: 179252 - RNA, 42 nt, Homo sapiens
ccugaaacauugacggagaaguagguggugucacugcccgag

SEQ ID NO: 179253 - RNA, 87 nt, Homo sapiens
cuuuccacgccuccuccggcuucccgggguguuuugugugucacucucccacguacagucccuccccgucccucguuccucggcccu

SEQ ID NO: 179254 - RNA, 34 nt, Homo sapiens
gagggggcugugcacaggucgccgcggagaggcg

SEQ ID NO: 179255 - RNA, 35 nt, Homo sapiens
gccagaccccaggaggaauggaaggggaagcgggu

SEQ ID NO: 179256 - RNA, 113 nt, Homo sapiens
gcauuuuaugggaaugaagggagaaaugaggaauggaagugaaggaaaagguggauuaggaaaggggaugaggcaggcugcaauaggagaaugggaaauagacgcaggaaacu

SEQ ID NO: 179257 - RNA, 39 nt, Homo sapiens
aaugaugacagggaugagaacgaucgacuuagcgucaga

SEQ ID NO: 179258 - RNA, 85 nt, Homo sapiens
ggcuagagaauagagaagcuggugguuaugggauugugauuguugugaaauggggagguguggguuuuacuguuuugagggagaa

SEQ ID NO: 179259 - RNA, 52 nt, Homo sapiens
gauuuaaagggggcaggggcagccauguuugcugccaaggcacugcagugua

SEQ ID NO: 179260 - RNA, 68 nt, Homo sapiens
aguaaacaaggaaauugcaucgguuauuuuacuugggccugugcucuuggcaaagcgcuguguccggg

SEQ ID NO: 179261 - RNA, 50 nt, Homo sapiens
gccaguucagcacagugcaaugaucugugaaguaggcaugcaguucuuag

SEQ ID NO: 179262 - RNA, 47 nt, Homo sapiens
augcaaaaaugaauuguguccaaguuaucuugagguguguguuuuug

SEQ ID NO: 179263 - RNA, 26 nt, Homo sapiens
ccauauucucuggcaucuaaguuguu

SEQ ID NO: 179264 - RNA, 27 nt, Homo sapiens
aaaguuaaauuaagguaauguuucagu

SEQ ID NO: 179265 - RNA, 46 nt, Homo sapiens; identical to SEQ ID NO: 106029

SEQ ID NO: 179266 - RNA, 38 nt, Homo sapiens
cacaugaaauucuggaaaaaccuuccccuccacagcca

SEQ ID NO: 179267 - RNA, 49 nt, Homo sapiens
aguuuuaaaaguaacaaaauaagaaaaaggagauaaagcuaugauaugg

SEQ ID NO: 179268 - RNA, 46 nt, Homo sapiens
cuagagaccaaaugagaggguugacacuguaucagaaaaaccaagg

SEQ ID NO: 179269 - RNA, 93 nt, Homo sapiens
cccgagaauaucauguccaguuuuuuagcaaccagccagagagggcguggguucaugaaaaacggguacgagaguauaaaggucauaaacagu

SEQ ID NO: 179270 - RNA, 42 nt, Homo sapiens
auuuuacagauuuauauaugaauauuugacauaugcuaucuc

SEQ ID NO: 179271 - RNA, 41 nt, Homo sapiens
cauugcccaugcagagaaagcauugaaaaugacucgagaag

SEQ ID NO: 179272 - RNA, 42 nt, Homo sapiens
ccgccuguuaaaauagccuggaaaacugcggcagcaaggaaa

SEQ ID NO: 179273 - RNA, 46 nt, Homo sapiens
guugugaaaauugaacaaguguuugcucuucagaaugcuacagggg

SEQ ID NO: 179274 - RNA, 40 nt, Homo sapiens
aucauaucacaauaucacagugaccaaguaauuuucugga

SEQ ID NO: 179275 - RNA, 46 nt, Homo sapiens
ucguucugaaucagagaaauccacugagguugugccaaagaagaag

SEQ ID NO: 179276 - RNA, 43 nt, Homo sapiens
uuuaauuuauauucuuauauuuaagaagcagauauucauagau

SEQ ID NO: 179277 - RNA, 45 nt, Homo sapiens
auuaaaccaguguaaucaauguaguaagauacauuuaaaucaacu

SEQ ID NO: 179278 - RNA, 45 nt, Homo sapiens
uacuagcagcaaaaguauugagcuuccagcuguauggagcccugu

SEQ ID NO: 179279 - RNA, 64 nt, Homo sapiens
gguugcagaaacaaccccucuccugccuuccagacacugaggaaaguauucuuguucucuucau

SEQ ID NO: 179280 - RNA, 46 nt, Homo sapiens
aauucuucugcuguaaauguaggcuuuuguuucguuugugccagag

SEQ ID NO: 179281 - RNA, 53 nt, Homo sapiens
cugaacaugaaagugguuuuuguuugguugguugcuuuugcuuuaggagacag

SEQ ID NO: 179282 - RNA, 67 nt, Homo sapiens
acuuccaaaacaaaaaaaugaacauagguuugacuuacuccauaauuauucugccugagacauuuua

SEQ ID NO: 179283 - RNA, 37 nt, Homo sapiens
agcauggaccuacuuccuuaaaaaaaaaaaagaaaag

SEQ ID NO: 179284 - RNA, 37 nt, Homo sapiens
auccuaaacuguacacccagaucuauguuugguugaa

SEQ ID NO: 179285 - RNA, 45 nt, Homo sapiens
uccuauauacuacagauaccuuagguuucaguauuuuuaugcagc

SEQ ID NO: 179286 - RNA, 79 nt, Homo sapiens
gguaccaggagaaagggaacccccuuucuccugguaaaggguaaggggggggauaauguuuaccacagguacgaaauag

SEQ ID NO: 179287 - RNA, 41 nt, Homo sapiens
uuuuuuguuuuguuuuggucaguccauugcauaagugacaa

SEQ ID NO: 179288 - RNA, 50 nt, Homo sapiens
cauuuguacccauuugagugauauugcacaacaaacacagauaccuacag

SEQ ID NO: 179289 - RNA, 42 nt, Homo sapiens
gucucuugugucugccuucuugagaaauuuggccaggaagau

SEQ ID NO: 179290 - RNA, 42 nt, Homo sapiens
uugguaaagacgccauucagagccagggcaaggcuggcagcu

SEQ ID NO: 179291 - RNA, 42 nt, Homo sapiens
guccuuauccccuguacacaucaagucagaaugggcuagccc

SEQ ID NO: 179292 - RNA, 45 nt, Homo sapiens
gccuuguggugugaagcaguguaacuucccugccagguagaagga

SEQ ID NO: 179293 - RNA, 47 nt, Homo sapiens
auuagccaguacuauagauaacagcaguugaaucacuuagggcggau

SEQ ID NO: 179294 - RNA, 41 nt, Homo sapiens
acauaaaaauaaaguaagggaaauaagaugggucagagaua

SEQ ID NO: 179295 - RNA, 49 nt, Homo sapiens
aagaagaaguccugccuaucaauguggggaugcugaauggaggccaacg

SEQ ID NO: 179296 - RNA, 44 nt, Homo sapiens
aacuguacauuuuuuuaaaugaacuuaugauuauuguuuaagau

SEQ ID NO: 179297 - RNA, 24 nt, Homo sapiens
gacucaguucuuggcccagcccau

SEQ ID NO: 179298 - RNA, 42 nt, Homo sapiens
uaggaccaagaaagaagauauuaaacuauuucagcaccagaa

SEQ ID NO: 179299 - RNA, 46 nt, Homo sapiens
uuucuggaaguuauucuaugauguuuuacuacuagagagacaggca

SEQ ID NO: 179300 - RNA, 50 nt, Homo sapiens
uugaagaaacuucagcucucugaauucuuugauaucuuugagaaggagaa

SEQ ID NO: 179301 - RNA, 46 nt, Homo sapiens
accaaugacacaauucuggaugucuucuucuacaauagucccaccu

SEQ ID NO: 179302 - RNA, 44 nt, Homo sapiens
auccuuggugaugauuuuggcaacuuugggaauaaauggcaauu

SEQ ID NO: 179303 - RNA, 51 nt, Homo sapiens
uccuugaacuugcuacagacacauuuuaagaaagcccaagaaaaucagcag

SEQ ID NO: 179304 - RNA, 47 nt, Homo sapiens
ggucuauugucuuagcugcauaagaagauuuggagaguuaaagacag

SEQ ID NO: 179305 - RNA, 47 nt, Homo sapiens
gucugaugauugggguucaacacccacggagcagggucgaccaagaa

SEQ ID NO: 179306 - RNA, 49 nt, Homo sapiens
ugguuuuacaagggggacaaagacaauaaguauguucccuacucggaga

SEQ ID NO: 179307 - RNA, 46 nt, Homo sapiens
ugggagaguuguuccuacugaugggggcagauaugauguucauuug

SEQ ID NO: 179308 - RNA, 51 nt, Homo sapiens
auucauguguuucauaacauuauuuagaguauaacugagaauuguauguug

SEQ ID NO: 179309 - RNA, 24 nt, Homo sapiens
caagcaaauucagaaaaaucacau

SEQ ID NO: 179310 - RNA, 61 nt, Homo sapiens
uguucggcgcgagcccggcggggcugcagguuccgcccugcuccgccgcgccccgcccggg

SEQ ID NO: 179311 - RNA, 41 nt, Homo sapiens
uuaccuacuuaacaggaacagggaaagggugucccccaacg

SEQ ID NO: 179312 - RNA, 76 nt, Homo sapiens
ggcggcgacugcgguaggagggaagagguuuuggacgcgcuggccucccgccgcugugcauugcagcauuauuuca

SEQ ID NO: 179313 - RNA, 33 nt, Homo sapiens
cccgaacacgaaagaagcccggggagggggggg

SEQ ID NO: 179314 - RNA, 45 nt, Homo sapiens
ugacuuuccagcguccuucuucucgucguccuugggcggcauugc

SEQ ID NO: 179315 - RNA, 50 nt, Homo sapiens
augugggcaaaaaauacggugauauuccucgagggauuuuuguggucaga

SEQ ID NO: 179316 - RNA, 48 nt, Homo sapiens
aguaaagggggaaagggaaagaguagcuauaggaaaagcuuuuccguu

SEQ ID NO: 179317 - RNA, 66 nt, Homo sapiens
ggaaaucgggggccaggggggugacuccccuguucuauaugggcuccaagugccaggccuggcucu

SEQ ID NO: 179318 - RNA, 51 nt, Homo sapiens
cccucacucggaacaggacuuugggaaaggugguuucuauaaauagaugag

SEQ ID NO: 179319 - RNA, 25 nt, Homo sapiens
caggcaaaaaaagacggagaagaga

SEQ ID NO: 179320 - RNA, 42 nt, Homo sapiens
cuuagcaaccaagagggcuggaagaaggagagucagcaggua

SEQ ID NO: 179321 - RNA, 46 nt, Homo sapiens
ggagcgcauggaagcaaugggggaguggaaccccaaugucaaggag

SEQ ID NO: 179322 - RNA, 53 nt, Homo sapiens
uuacaauuauuuuaggggccugaacccucaugucauagcuaaucagugaauga

SEQ ID NO: 179323 - RNA, 53 nt, Homo sapiens
gacugauguuugugugaauuaugauucuuuauucugacuggugccuaugaaag

SEQ ID NO: 179324 - RNA, 45 nt, Homo sapiens
uucaaacucaauuuuuaggaacuagccaaggauuuggcagauggu

SEQ ID NO: 179325 - RNA, 60 nt, Homo sapiens
aaugucaaaucuuaaagcugugucuuuacauguuugauuugccagcuuugaaaaugcaag

SEQ ID NO: 179326 - RNA, 45 nt, Homo sapiens
ucuuccugccaucuuaaauuuugcucuuaaaaacuuucuuuguug

SEQ ID NO: 179327 - RNA, 72 nt, Homo sapiens
aagagauguauucuugguaaaggaacacccagauccaggcaguaaagauccagaagaagauuaccccaaauu

SEQ ID NO: 179328 - RNA, 48 nt, Homo sapiens
aaauacaagaaaugacuguacacaaaugcuaaucagugauuuggggcc

SEQ ID NO: 179329 - RNA, 47 nt, Homo sapiens
uugauccagcagugucgaauuccaagcaaguuaugaugauucuuauu

SEQ ID NO: 179330 - RNA, 71 nt, Homo sapiens
uccaguauugccaaaaaugcuauucaacagcacuuuuauugcccagagagaaaauaaggacaaaauaaagg

SEQ ID NO: 179331 - RNA, 57 nt, Homo sapiens
gccacauuucaaguguuccacagucacauguggauaguaguuaccuaucagacagua

SEQ ID NO: 179332 - RNA, 47 nt, Homo sapiens
ugaacuuggccauuuucuuacauucauauauagcaaaguuuucaacu

SEQ ID NO: 179333 - RNA, 41 nt, Homo sapiens
ccuaacuucagcagugccuccgucacugcauguaccuaaaa

SEQ ID NO: 179334 - RNA, 45 nt, Homo sapiens
gauaagaaauagccuaauuauaaacaaauaugcaggcagagggaa

SEQ ID NO: 179335 - RNA, 41 nt, Homo sapiens
ccuugguaaguuaaaauuuugggaaaauuguaccugcagaa

SEQ ID NO: 179336 - RNA, 46 nt, Homo sapiens
gggcagucauuucuggcgaggcagaggcaagcgaccagcagcagaa

SEQ ID NO: 179337 - RNA, 39 nt, Homo sapiens
agagaggaauggaggcuuggcucagggaaguggugggag

SEQ ID NO: 179338 - RNA, 53 nt, Homo sapiens
aguguguccugcaucccuucucuauucucaaguuuucgucuccucucuuccag

SEQ ID NO: 179339 - RNA, 28 nt, Homo sapiens
aucaauauuguuugacaggaaagugucu

SEQ ID NO: 179340 - RNA, 46 nt, Homo sapiens
gugcuugucgucuggcuccucacucucucaguguaugcucaaaggu

SEQ ID NO: 179341 - RNA, 50 nt, Homo sapiens
cuuagaugguuugaagggguagucuguaggaaaacgaauuguccaaaaga

SEQ ID NO: 179342 - RNA, 45 nt, Homo sapiens
uuagaaugucaagaaaaaugcugccauuacuguuaauauuugggu

SEQ ID NO: 179343 - RNA, 47 nt, Homo sapiens
auucccgagauauucuguuguacuuaucucugucuguuuuauagauc

SEQ ID NO: 179344 - RNA, 35 nt, Homo sapiens
auguaaaacuuauaucuaagaaaaaauaacagaaa

SEQ ID NO: 179345 - RNA, 46 nt, Homo sapiens
ugaauauagccaaguauuccauuuauuaacaaaauaagucuuacca

SEQ ID NO: 179346 - RNA, 50 nt, Homo sapiens
agcugagaacaacugugguguggauagacuuaaaaaugaggggauuaaga

SEQ ID NO: 179347 - RNA, 44 nt, Homo sapiens; identical to SEQ ID NO: 106170

SEQ ID NO: 179348 - RNA, 45 nt, Homo sapiens
gguuuccaucucaugcucccuuucaucacaucauauaagucugug

SEQ ID NO: 179349 - RNA, 49 nt, Homo sapiens
cuuauuugaauucagaaauacgaacauaauuuuugcagugaguggggag

SEQ ID NO: 179350 - RNA, 40 nt, Homo sapiens
cccagaauaaagcuuuuaagcccaaauaagucagagaaaa

SEQ ID NO: 179351 - RNA, 46 nt, Homo sapiens
ggcugugcggguaacaaagcccaacauaccagaggcaauccgcaga

SEQ ID NO: 179352 - RNA, 31 nt, Homo sapiens
gaaggugguggaaaaggaagcagagacagag

SEQ ID NO: 179353 - RNA, 46 nt, Homo sapiens
ccagguggcugagaucaccuacgggcagaaggugauggagaaggag

SEQ ID NO: 179354 - RNA, 42 nt, Homo sapiens
uuuggcuuagaagaugaacccuuggagacggccacuaaggag

SEQ ID NO: 179355 - RNA, 42 nt, Homo sapiens
gaagaaaugaacuuaaauccacucccuuucuagggaaaggag

SEQ ID NO: 179356 - RNA, 46 nt, Homo sapiens
ccuacacauuagugucaauccaaugguugucucuuaucugucuaaa

SEQ ID NO: 179357 - RNA, 53 nt, Homo sapiens
aaaccaaaguuuauuaauaauuuuuauauaacuaaaauaaaauagauguggag

SEQ ID NO: 179358 - RNA, 49 nt, Homo sapiens
gacugaugauuaaguaggcaaacuacuucuacuuucaaagagccccaag

SEQ ID NO: 179359 - RNA, 80 nt, Homo sapiens
gcuggcagcaugucggccgagcugggagucgggugcgcauugcgggcggugaacgagcgcgugcagcaggcuguggcgcg

SEQ ID NO: 179360 - RNA, 48 nt, Homo sapiens
gccgccuugagaagagggacaccugcgugggaaugggucgucacggug

SEQ ID NO: 179361 - RNA, 38 nt, Homo sapiens
ccagccuccuuaccuugagucuguuagguuuucuggag

SEQ ID NO: 179362 - RNA, 39 nt, Homo sapiens
gacguuaccuugaacaagucagguaacuauuccggcccu

SEQ ID NO: 179363 - RNA, 64 nt, Homo sapiens
uccagccccggcuaguggcggucagcaaaaccaaaccugcagacauggugaucgaggccuaugg

SEQ ID NO: 179364 - RNA, 55 nt, Homo sapiens
acaugggcagcgcacuuuuggcgagaacuacguaagagcccuuuccugaagcccu

SEQ ID NO: 179365 - RNA, 41 nt, Homo sapiens
uuuagguucaggaacugcuagaaaaagcaucaaaucccaaa

SEQ ID NO: 179366 - RNA, 46 nt, Homo sapiens
auggcacuucauuggccaccuacagaaacaaaaugucaacaaauug

SEQ ID NO: 179367 - RNA, 52 nt, Homo sapiens
aauuguucugucauuguauugcuucuacuacccuuuguggaagagagagcaa

SEQ ID NO: 179368 - RNA, 45 nt, Homo sapiens
ccaaucucuucaugcuggaaacaguggauucugugaaguuggcag

SEQ ID NO: 179369 - RNA, 45 nt, Homo sapiens
ucuccugaaagguuaaagguuaugguccagauuaacaccagcgga

SEQ ID NO: 179370 - RNA, 60 nt, Homo sapiens
agguagcauaauggcaugcaaagcagucuauguaucauucuuuacuacaucaugguucau

SEQ ID NO: 179371 - RNA, 49 nt, Homo sapiens
aauacucuuagaucuuaaaaaaauuacuugauguugcauugggagagaa

SEQ ID NO: 179372 - RNA, 58 nt, Homo sapiens
uccuggggcggggcggcacggggcgaggcggagcgaggcuggaggcgcgggagggcag

SEQ ID NO: 179373 - RNA, 31 nt, Homo sapiens
aagggcgccgugauuggaaagaacggaaaag

SEQ ID NO: 179374 - RNA, 99 nt, Homo sapiens
cgccuccaggacagccacaugccgagcugugcugccccuuguggguguugggggcgcucccgaagcgggagagggcggaguuaggguggcccacgaucc

SEQ ID NO: 179375 - RNA, 66 nt, Homo sapiens
aggagaggccuggccugguguuuuuaugggauggguauuaucuguugggauaaacgauuccugcag

SEQ ID NO: 179376 - RNA, 51 nt, Homo sapiens
ucagggcauagcauauguuucugagaucacuggaagaagcuagcagugcca

SEQ ID NO: 179377 - RNA, 27 nt, Homo sapiens
auggcacccuguuugguuaagcaaaca

SEQ ID NO: 179378 - RNA, 30 nt, Homo sapiens
ucacauggagggaagaaauuauuaaggaug

SEQ ID NO: 179379 - RNA, 369 nt, Homo sapiens
cugggguugggcuucaacauaagaguuuugggggcaggccgagcaugguggcucaugccuguaaucccagcacuuugggaggucaaggcgggcagaucgcuugaggucaggaguucaagaccagccuggccaacauggcaaaacucugucucuacugaaaauacaaaaaauuacccaggcgugguggcaggugccuauaaucucagcuaccaggaggaggcugaggcaggagaaucucuggaaccagggaggcggaggcugcagugaguuaagaucaugccacugaacucuagucugggugacagagugagaccccaucucacacacacgaaaaaaaguuuuugggagagaugcuauucaacuauucag

SEQ ID NO: 179380 - RNA, 40 nt, Homo sapiens
auaaauggugaaauuaugucaccuggacccugcaggucau

SEQ ID NO: 179381 - RNA, 52 nt, Homo sapiens
uaccaucaucaucaucaucauugucgucgccaaucuggagaagcagaaacug

SEQ ID NO: 179382 - RNA, 53 nt, Homo sapiens
uggagugucggaacucaccugugaccaaaacacccccaagggaucugcccacc

SEQ ID NO: 179383 - RNA, 45 nt, Homo sapiens
cccccauggaagccagccagagccaccugcgcaauagcccagaag

SEQ ID NO: 179384 - RNA, 35 nt, Homo sapiens
auaauuaccuugggaaccucacaguacaagacaga

SEQ ID NO: 179385 - RNA, 37 nt, Homo sapiens
cccccuccucuucgugaacaccagcagauaccuccuu

SEQ ID NO: 179386 - RNA, 44 nt, Homo sapiens
gaaugaucagcaguuccagccccucgcugcugggggcgcaacca

SEQ ID NO: 179387 - RNA, 46 nt, Homo sapiens
ccuccuuccccaagagaggaaauaaaagccaccuucgcccuagggc

SEQ ID NO: 179388 - RNA, 47 nt, Homo sapiens
accgcaucccuagcuugacacuugccugcaugaugaaccucgccacu

SEQ ID NO: 179389 - RNA, 46 nt, Homo sapiens
cucccuaggccccuccccucuucaaggggucuacauggaaacugug

SEQ ID NO: 179390 - RNA, 51 nt, Homo sapiens
gcccacaagucccagagaagagugggaaagaaaguugggugguugcagcuc

SEQ ID NO: 179391 - RNA, 44 nt, Homo sapiens
uuaaucuucuugguauugaucucagggucacuggacaccaagcg

SEQ ID NO: 179392 - RNA, 46 nt, Homo sapiens
ucuccagaugcacagucaccaccuugccguccucaaugagccacga

SEQ ID NO: 179393 - RNA, 43 nt, Homo sapiens
gaccgccagguccagcuccgacagggucuugguccagcgguaa

SEQ ID NO: 179394 - RNA, 38 nt, Homo sapiens
caucaucaucuuuuuccucaguaucugaagagucacuc

SEQ ID NO: 179395 - RNA, 45 nt, Homo sapiens
uuuucucccuacgcuccaccuucuuacucaaaggaacaaguuucc

SEQ ID NO: 179396 - RNA, 42 nt, Homo sapiens
aaaugggcaaaauucccugcgcaaaccccggguguaagaaca

SEQ ID NO: 179397 - RNA, 47 nt, Homo sapiens
aagucgcaauacacaugaaugacugaaaguagguuuuguuaccagug

SEQ ID NO: 179398 - RNA, 42 nt, Homo sapiens
gcccaccugggccugaaaggccaccggcaagagcauggccac

SEQ ID NO: 179399 - RNA, 41 nt, Homo sapiens
gcagaagcacucggcacccuccccaccagucucgguggggu

SEQ ID NO: 179400 - RNA, 88 nt, Homo sapiens
gacaauaggaaauauuaccuagaccuaaaggaaaaucagcggggucgcuuccuacggauuagacaaaccaugaugcgggggacuggca

SEQ ID NO: 179401 - RNA, 46 nt, Homo sapiens
guuucgugaugccuugguucagcugauugaagacuauggcgaagga

SEQ ID NO: 179402 - RNA, 55 nt, Homo sapiens
acuauuacuguuccauucaaagcuuggacaagguuuggggagaauuuuaucaagu

SEQ ID NO: 179403 - RNA, 45 nt, Homo sapiens
uuaaaguuccucuacauuuuauaauuuuccuuguuaaagccccag

SEQ ID NO: 179404 - RNA, 49 nt, Homo sapiens
uaacaaagaauuuuaaaguagaguucacauuugaugucuuaagaacuag

SEQ ID NO: 179405 - RNA, 32 nt, Homo sapiens
agauuccccacagugcccugacaguuaauuug

SEQ ID NO: 179406 - RNA, 50 nt, Homo sapiens
uggagugcugugagguuacaaguacagcuaaacugucucucugguggaag

SEQ ID NO: 179407 - RNA, 30 nt, Homo sapiens
auaugaagaaaaaaacucauuuaaauggaa

SEQ ID NO: 179408 - RNA, 51 nt, Homo sapiens
uuccugccaucuuauugaugucucacaacuuuuccugccauacuccucccu

SEQ ID NO: 179409 - RNA, 76 nt, Homo sapiens
uggaaaaacucggucaaaacaacuaggguaucuggguagaaagaagacugagagcuacuccuucuucugccuugac

SEQ ID NO: 179410 - RNA, 41 nt, Homo sapiens
cucucauuuuucaacagcuaucuugagagaaaucugauagg

SEQ ID NO: 179411 - RNA, 54 nt, Homo sapiens
uagcucuccaaguauaaagcuuaucuccuguauuguuagaauucucacaugcaa

SEQ ID NO: 179412 - RNA, 35 nt, Homo sapiens
gcccaguucccauuuuuacccugccauuuuaauuu

SEQ ID NO: 179413 - RNA, 42 nt, Homo sapiens
gauuugaugaauaugaagacacauuucugucaccccagaaag

SEQ ID NO: 179414 - RNA, 56 nt, Homo sapiens
cacaugaccuacuuuaguguagaauuuggccuaagucauuucucauacaaaagcag

SEQ ID NO: 179415 - RNA, 35 nt, Homo sapiens
uccugugauuaacuugccaguauguuggguucagu

SEQ ID NO: 179416 - RNA, 46 nt, Homo sapiens
aagagaucuucauuuuuuacugucaucccugauuugccaaauuuga

SEQ ID NO: 179417 - RNA, 60 nt, Homo sapiens
aguuuuagcuuuccuccucuauccuaauuucaaaaccuuuaauuuaagaaccauuuaaaa

SEQ ID NO: 179418 - RNA, 47 nt, Homo sapiens
uggccuuuuuuguuuaggccugcaugaucauuuuaaauguaaagaua

SEQ ID NO: 179419 - RNA, 97 nt, Homo sapiens
uuguuuuuuuuaauucaucaagccuuucguuuucaaaccaccauuugucagccuugagguagagagacauauagauuugaaaauacuuucuuaagag

SEQ ID NO: 179420 - RNA, 47 nt, Homo sapiens
cauaagucucacucuggccuguuuggggaagugcuggcccugccagg

SEQ ID NO: 179421 - RNA, 48 nt, Homo sapiens
agaaggaagaggaggaagaugaggaagaugaagaggaugaggaggagg

SEQ ID NO: 179422 - RNA, 33 nt, Homo sapiens
guaaacuuaauuuaaaaaagaagaagaaaggaa

SEQ ID NO: 179423 - RNA, 46 nt, Homo sapiens
augggguauuucaccacguggugcuggcuacacauuuggacaagac

SEQ ID NO: 179424 - RNA, 54 nt, Homo sapiens
guuucagaaaugucuuguccaaauguguagccagcaccacguggugaaauaccc

SEQ ID NO: 179425 - RNA, 69 nt, Homo sapiens
auuucaguauuacuauuuugaguuggaucugaaagaagggaaugauuuaccgggcugaggaaaguagga

SEQ ID NO: 179426 - RNA, 47 nt, Homo sapiens
caucuuugaacuguaaacuuaaaaugaaugaacuguaugguauguaa

SEQ ID NO: 179427 - RNA, 43 nt, Homo sapiens
aaagagcacacaagggccagaaagugacagcuuagcgugcaga

SEQ ID NO: 179428 - RNA, 48 nt, Homo sapiens
uacuaaccagccauacaucguuauggaauauuuguaaugcugagaaag

SEQ ID NO: 179429 - RNA, 45 nt, Homo sapiens
cuagcaguacauuucaccauauauuaaauaaguuagcaacaacaa

SEQ ID NO: 179430 - RNA, 39 nt, Homo sapiens
uacugaaacaauuguccuaaauacauuaauauuaaaaau

SEQ ID NO: 179431 - RNA, 45 nt, Homo sapiens
uucacauuuuuaaagaaucuacuauucucauaaggaaugaggggg

SEQ ID NO: 179432 - RNA, 37 nt, Homo sapiens
gccacgcucagcgccuuucucccagggaguaacagaa

SEQ ID NO: 179433 - RNA, 42 nt, Homo sapiens
acaguaucccucccagccaggcaggauguguuuggggaggug

SEQ ID NO: 179434 - RNA, 66 nt, Homo sapiens
uggugacggugcauauuguguaaaugcuaaagagaaaaaggaaauggcagugauaaaugccaguca

SEQ ID NO: 179435 - RNA, 61 nt, Homo sapiens
cuuuuuaaguuccuggacuacuuugagcugacacuuagcugggcugaaaaaggcagcaaac

SEQ ID NO: 179436 - RNA, 40 nt, Homo sapiens
cauauaucagauuuuucuaagcucccccucaggcuuucca

SEQ ID NO: 179437 - RNA, 33 nt, Homo sapiens
uuuccuugcuaacccucacaacguuuccuagaa

SEQ ID NO: 179438 - RNA, 55 nt, Homo sapiens
aagguaccuaggagaugaagauguuacugagucuggggugcagaggagaggucug

SEQ ID NO: 179439 - RNA, 75 nt, Homo sapiens
aucgcucugugaaugaacacacagaggcuucaaaagacccuuuuggggaagagcaagcaaggcauggcaggagag

SEQ ID NO: 179440 - RNA, 36 nt, Homo sapiens
ccaauacaauuauuuaucagccuguugagccugccg

SEQ ID NO: 179441 - RNA, 46 nt, Homo sapiens
augucuggguaucagcucgguaaaccaggcagcugaggucugccag

SEQ ID NO: 179442 - RNA, 38 nt, Homo sapiens
ucuugccucuaggaagucucuucuguauuacuugucaa

SEQ ID NO: 179443 - RNA, 26 nt, Homo sapiens
ucauuaacuuagugaagaaaauacga

SEQ ID NO: 179444 - RNA, 49 nt, Homo sapiens
uaaccuguacuuggcacugugcccggagccgugacacacauuugccuug

SEQ ID NO: 179445 - RNA, 32 nt, Homo sapiens
uccucccuggccaccugaaaauuggccacuau

SEQ ID NO: 179446 - RNA, 48 nt, Homo sapiens
ugagagaaaaagacaucaagaaaacagcaaaaggaaugcaaggacaga

SEQ ID NO: 179447 - RNA, 47 nt, Homo sapiens
uccucaauaaucuugccagugggaucuuugauggugaagcaguaaga

SEQ ID NO: 179448 - RNA, 25 nt, Homo sapiens
auuuccugcgagaucauguaugaca

SEQ ID NO: 179449 - RNA, 44 nt, Homo sapiens
aacauuuuagaaagugccagaugacgcaucgauaaugcauacau

SEQ ID NO: 179450 - RNA, 47 nt, Homo sapiens
uuuuccauagaauaugcacugauacaauauuaccauucuucuaugga

SEQ ID NO: 179451 - RNA, 58 nt, Homo sapiens
ccacuuggccacagacuuuuucuaacagcugcguauuauuucuauauacuaacugcau

SEQ ID NO: 179452 - RNA, 42 nt, Homo sapiens
auuaacaaguaacuuguuagucuuacagauaauucaugcauu

SEQ ID NO: 179453 - RNA, 45 nt, Homo sapiens
guguaaaaacauuuuugagauaagguuuuuauuuauguuuauuau

SEQ ID NO: 179454 - RNA, 46 nt, Homo sapiens
acuggccccucuuuguucuauuuuuuuacauccuuucaccuauucc

SEQ ID NO: 179455 - RNA, 57 nt, Homo sapiens
ucugcaguggcaagauagcuacacaguaccucagcccuccugcucaguuuuuaacau

SEQ ID NO: 179456 - RNA, 36 nt, Homo sapiens
cagagaaauguucacuuaccaaacacauaccuuugu

SEQ ID NO: 179457 - RNA, 66 nt, Homo sapiens
uugcuuugcagcuuugauuaguuuguccuuuggaggagcaaucggacugauguuuuugaugcuugg

SEQ ID NO: 179458 - RNA, 63 nt, Homo sapiens
uuuugcaggaguuugcauccgagagagaggcaggcagagcgugggauugagaaggcugaggcu

SEQ ID NO: 179459 - RNA, 66 nt, Homo sapiens
agcucaguucaaugagcaaaucuccauacuguuucuuucuuuuuuuuuucauuacuguguucaauu

SEQ ID NO: 179460 - RNA, 89 nt, Homo sapiens
gaacaaugucaccuguacucggaucuaugaaaaaguagaauaaaaauuccaucaucacuuuggacaggaguuaauuaagagaaugacca

SEQ ID NO: 179461 - RNA, 38 nt, Homo sapiens
ggugcauugguucagcaucaggagugggaugggaagga

SEQ ID NO: 179462 - RNA, 30 nt, Homo sapiens
caacacaguuuucuuguacccugggagaga

SEQ ID NO: 179463 - RNA, 45 nt, Homo sapiens
guccaccaggcgccaucuuccuuccagcugcugaacuguggccau

SEQ ID NO: 179464 - RNA, 42 nt, Homo sapiens
gacacggugcuguccucgcggaggcucucggcgcgcgggcug

SEQ ID NO: 179465 - RNA, 35 nt, Homo sapiens
aucagcaaaaucgccuuagcaguucaaccaaaggu

SEQ ID NO: 179466 - RNA, 57 nt, Homo sapiens
gauacugacuuuuuccuucugaccucucuagggaugccuuuccauuagagggcaaag

SEQ ID NO: 179467 - RNA, 54 nt, Homo sapiens
cagaauagugccaggucccaggcagggcucauggccuugcucuugccagaaaag

SEQ ID NO: 179468 - RNA, 43 nt, Homo sapiens
ugcacuuguacugauaguguccuucaaagugguuugggcaguc

SEQ ID NO: 179469 - RNA, 47 nt, Homo sapiens
agcaccuuaguguaauauggcauauugaucacagacgauagacaagu

SEQ ID NO: 179470 - RNA, 45 nt, Homo sapiens
uccauuuagaaaggcccaacuaaggauucaaaauggcacccacgu

SEQ ID NO: 179471 - RNA, 40 nt, Homo sapiens
ccuugaauaacucauaaacucuaagggagagagaguacug

SEQ ID NO: 179472 - RNA, 46 nt, Homo sapiens
uuuaucuauuuguaggauugucagaucaaguacaagaugcccaguu

SEQ ID NO: 179473 - RNA, 43 nt, Homo sapiens
accccucccaaaguucaggaugaaaggcuagaaaacccauuca

SEQ ID NO: 179474 - RNA, 98 nt, Homo sapiens
augcaagcuguguuuuuuaauuguuuuaaaauguaaauuaugguuaugcuaaagugaaaaccuagaggaagcuaaugauuuuauauacuuugcacgac

SEQ ID NO: 179475 - RNA, 49 nt, Homo sapiens
ugugucagugagucggccaugucuccauguguuucagaccuguucaucu

SEQ ID NO: 179476 - RNA, 59 nt, Homo sapiens
ucccucuugugugauaucugugacaaauagccuucuucuuguguuuucuguuggacuaa

SEQ ID NO: 179477 - RNA, 89 nt, Homo sapiens
agcagugcaaccaggauucuuguuuuccuuuuccuucuuggaguuuggaauuucuagcuuuucaagcagcauaaguagaaucaacauua

SEQ ID NO: 179478 - RNA, 59 nt, Homo sapiens
ucccgaacuuucucccuguauuugaccuccuucccucuuuccuaaauuacuagucugga

SEQ ID NO: 179479 - RNA, 47 nt, Homo sapiens
ugguuccaguuuaccugcuguuggccugcuggauacuugacucaggc

SEQ ID NO: 179480 - RNA, 54 nt, Homo sapiens
gugcauauauuacucaucugcuuaagagaguggguuaauggauauaucagagga

SEQ ID NO: 179481 - RNA, 57 nt, Homo sapiens
ugguucaguauuuaaacugccaguguuauacgucucaugcucugugugccaggugaa

SEQ ID NO: 179482 - RNA, 113 nt, Homo sapiens
acagcugugauuuuuaguuaaguaaaagaguuaauaugauauagauauggaaagcuuuauggcuucauuaaaaagauaaaccacuaccuaacugugguuguauguuguuucca

SEQ ID NO: 179483 - RNA, 78 nt, Homo sapiens
uugccaucuguguaguuuucaguagcugucaagugugucuuacuuaccuucccccagacguaguuuaaaaugguaaac

SEQ ID NO: 179484 - RNA, 55 nt, Homo sapiens
ggguguuugugucuuggcuacuuguuuaauagcacuagaauuccaggugaagcuu

SEQ ID NO: 179485 - RNA, 43 nt, Homo sapiens
uugaaaccaaagcccuuucuguuauuuuuucaaugaaggugag

SEQ ID NO: 179486 - RNA, 59 nt, Homo sapiens
cacaaacaccaaccugacuuaggaacgccuaaauucagagaagucaaagccggugaagg

SEQ ID NO: 179487 - RNA, 46 nt, Homo sapiens
cuuguccuucccaggcauacccagaguaucuuaucacuuaccagau

SEQ ID NO: 179488 - RNA, 41 nt, Homo sapiens
gggcuggcauaugcugaauaugucaucuacagaggagaaca

SEQ ID NO: 179489 - RNA, 46 nt, Homo sapiens
gguaacccuaccauuuaggcugcugcgucugcagaaugcaccacaa

SEQ ID NO: 179490 - RNA, 46 nt, Homo sapiens
caaaaaugaaccuaaauaagcaauaaaagugaaccucaaugaaaau

SEQ ID NO: 179491 - RNA, 41 nt, Homo sapiens
uugccaucagccauuuggagucggaugucauauacccggaa

SEQ ID NO: 179492 - RNA, 45 nt, Homo sapiens
caucaaaguccuggaucuucaaucuaauugaaccaguaauuaccu

SEQ ID NO: 179493 - RNA, 53 nt, Homo sapiens
caggaggcuaaaucagcuucuacuagugauacuuacguggauauuggucuccc

SEQ ID NO: 179494 - RNA, 31 nt, Homo sapiens
aguaaguuuuuaaaguuucauggugaaaacu

SEQ ID NO: 179495 - RNA, 28 nt, Homo sapiens
uuuuccauaauuauuuuuaauuuagaga

SEQ ID NO: 179496 - RNA, 52 nt, Homo sapiens
uugcuggaucuugcuccagaagauaaagaauaucagucaguggaagaagagg

SEQ ID NO: 179497 - RNA, 34 nt, Homo sapiens
auaugagacccuugguuuuaaacugaaguuaguu

SEQ ID NO: 179498 - RNA, 61 nt, Homo sapiens
guugguuugguuuggguuuuuuguauucauuuuaugauuagagcuauaaaaugaauaaaua

SEQ ID NO: 179499 - RNA, 30 nt, Homo sapiens
cuuugacaugcuucuaugucucauugccug

SEQ ID NO: 179500 - RNA, 46 nt, Homo sapiens
auguugacauagcggcuuuauugauaaaauacaacacguguguaaa

SEQ ID NO: 179501 - RNA, 45 nt, Homo sapiens
agcagauccaacuaaaaagaacagagauggaaauacaccuuugga

SEQ ID NO: 179502 - RNA, 30 nt, Homo sapiens
ucguagauagugaucauucuacuucagccu

SEQ ID NO: 179503 - RNA, 80 nt, Homo sapiens
cccuaacuauaauauaaagggaaaauagcaguaaguuacaauaaaauaauuuauaguucuuauguaaauagauuggacac

SEQ ID NO: 179504 - RNA, 45 nt, Homo sapiens
gacuugugccucuucauaaugcauguucauauggacauuaugaag

SEQ ID NO: 179505 - RNA, 23 nt, Homo sapiens
ggauuugaagguuagaaauugaa

SEQ ID NO: 179506 - RNA, 25 nt, Homo sapiens
acaaagaauaagacagacagauaug

SEQ ID NO: 179507 - RNA, 113 nt, Homo sapiens
uauugauagaguuuaaugucuacugaccuauggaucagaaugcuaaaguugucagaaccaaggagaucccugccugccaagaguaauucuugccccucagcuauauuagucca

SEQ ID NO: 179508 - RNA, 45 nt, Homo sapiens
cauaaauucuuuagcuguuaaaaugccuuccuaaagaugaguacu

SEQ ID NO: 179509 - RNA, 57 nt, Homo sapiens
uuaauccauucacucaucucauucaguuaaauuaggauuguguuaugaaaacaaauu

SEQ ID NO: 179510 - RNA, 46 nt, Homo sapiens
aaugccaagugcgcuguuuucucugcuggagaaaugaauuuuuagu

SEQ ID NO: 179511 - RNA, 39 nt, Homo sapiens
uacaauuuaaguauuuucccccuugaaaugcaaaaacau

SEQ ID NO: 179512 - RNA, 34 nt, Homo sapiens
gaauuccauaaaccccauccagugaagaacaaga

SEQ ID NO: 179513 - RNA, 29 nt, Homo sapiens
guguuugaaaacuacuuucaaaaggaaau

SEQ ID NO: 179514 - RNA, 47 nt, Homo sapiens
aaugucucuuauacagugguuaguagguggggaauuugccuagagau

SEQ ID NO: 179515 - RNA, 60 nt, Homo sapiens
uuaacaugagggagaaccguauaauuuauaauguauagaacauuuuuaagaacguaccuc

SEQ ID NO: 179516 - RNA, 45 nt, Homo sapiens
ccuuugccauuuagaaaauuaaaucagaaguaugugaaugcgaua

SEQ ID NO: 179517 - RNA, 48 nt, Homo sapiens
uuuucuuuuacuccucuacuagcucuucuuguauuuugcaccaggacc

SEQ ID NO: 179518 - RNA, 58 nt, Homo sapiens
cuuguggcuccuuuucuauauuacucuguggcacuuagaguuccuuaaaguucauaaa

SEQ ID NO: 179519 - RNA, 89 nt, Homo sapiens
agaaaagggccuucuuaucugugguuaaaugcagcuguuuuuuagacagagcuuguuucgcccggccuacgucacuuuucuauaacugu

SEQ ID NO: 179520 - RNA, 81 nt, Homo sapiens
auuucacacucuugugugcacuugaaacuccagauuuuauuuggauucuccaaguagauaaagugauuucuaucacugugu

SEQ ID NO: 179521 - RNA, 61 nt, Homo sapiens
uauguaacagcucugcucuuuuauuauuauuuguacuggcuaaguuuuaguuguggaauau

SEQ ID NO: 179522 - RNA, 48 nt, Homo sapiens
ucggugauuaaaauuacagcauaugcucuuuucuggguaugauaaugg

SEQ ID NO: 179523 - RNA, 45 nt, Homo sapiens
ugauuccauucauuuuaaguguauauaaugcauuaaggaagagaa

SEQ ID NO: 179524 - RNA, 40 nt, Homo sapiens
ugauccuagguuaauuuuuuaauuuaucccaaacuucaua

SEQ ID NO: 179525 - RNA, 42 nt, Homo sapiens
gagaacugaguguauaucuauuuuucaaauuggugcccaaau

SEQ ID NO: 179526 - RNA, 43 nt, Homo sapiens
aaaacacaugaaguagaaauauuaaugaugcuuuauaggagag

SEQ ID NO: 179527 - RNA, 62 nt, Homo sapiens
cauaauggaucucucugccacuacuuaaacuucgcucaguucucuucacugcagcuagaaug

SEQ ID NO: 179528 - RNA, 47 nt, Homo sapiens
agcaguggaaaauugaaucaaagaaagagguaagagcagauugagcc

SEQ ID NO: 179529 - RNA, 46 nt, Homo sapiens
ugcucagauucuacagccuuucagucucuuaacaaagcccugggca

SEQ ID NO: 179530 - RNA, 41 nt, Homo sapiens
augcuagaauggaaaaggucucucauaacaauauagaaaau

SEQ ID NO: 179531 - RNA, 50 nt, Homo sapiens
cguuuauuaucuuuuuacuucagauaaugcaaauuuguggcuuaaauauu

SEQ ID NO: 179532 - RNA, 48 nt, Homo sapiens
ucuguuucuaaacauuuuugauggaaagaaugaguauaagaggcaguu

SEQ ID NO: 179533 - RNA, 48 nt, Homo sapiens
aagagcuuuguaaacagaaggacuuacggcuugguaaugugugaguau

SEQ ID NO: 179534 - RNA, 39 nt, Homo sapiens
uuugauauuuuucuauaaaauuaaaaauuuucuuugcuu

SEQ ID NO: 179535 - RNA, 81 nt, Homo sapiens
agccugacuacuuaggcuguuaaagaugcaacaagccacuuguagguuuagcuaguugauuacuuacguagacagcaaaaa

SEQ ID NO: 179536 - RNA, 46 nt, Homo sapiens
aucuaaaaagcuucuagagggcaaguauaauuucucuugaguguau

SEQ ID NO: 179537 - RNA, 25 nt, Homo sapiens
caguuacuagaauguugggacuauc

SEQ ID NO: 179538 - RNA, 42 nt, Homo sapiens
uccuccuucuccccagccccaaaauacacagacuuaacaaca

SEQ ID NO: 179539 - RNA, 40 nt, Homo sapiens
augggcuuccuguuaguuaacauauacgacuuggauuaug

SEQ ID NO: 179540 - RNA, 34 nt, Homo sapiens
auuggcuuuuuaagaaaguuuuuagcucaguugu

SEQ ID NO: 179541 - RNA, 52 nt, Homo sapiens
ugcuuguuucucaaaucacgugucuucuauuugccacaauaguuacuuguua

SEQ ID NO: 179542 - RNA, 31 nt, Homo sapiens
auauauauaucacuucuucaguuuguucugu

SEQ ID NO: 179543 - RNA, 49 nt, Homo sapiens
ccucaguuuucucaugggcaaaaaucauaaaaugauguugugcgagcau

SEQ ID NO: 179544 - RNA, 68 nt, Homo sapiens
gacugcaggugacagggcguggcggagcugccacagacaagccuagcucugcucacugugcaguggag

SEQ ID NO: 179545 - RNA, 44 nt, Homo sapiens
uuggguguucuuauuuaugguguguauguaaagagauaggggag

SEQ ID NO: 179546 - RNA, 45 nt, Homo sapiens
ccacguuuuauguaaacauaccagacaucggguaacagacaguac

SEQ ID NO: 179547 - RNA, 44 nt, Homo sapiens
aaagucaguuuaauuuuaucuaauaaugaucuuaagacauuccc

SEQ ID NO: 179548 - RNA, 46 nt, Homo sapiens
aaaagacucuacuugccugaguuuccucaucagggcugucauucag

SEQ ID NO: 179549 - RNA, 54 nt, Homo sapiens
gguuaugguuacaaguggcccccgagucccagaaucuuucccagguugccccag

SEQ ID NO: 179550 - RNA, 23 nt, Homo sapiens
uuaaaaaucccaagaauggaugu

SEQ ID NO: 179551 - RNA, 43 nt, Homo sapiens
uuuaacauguugaaacgacaauauucuaaaauacugaugaauc

SEQ ID NO: 179552 - RNA, 41 nt, Homo sapiens
cugcugggcggcuucucgcuggcgcucagcuucgcgcccug

SEQ ID NO: 179553 - RNA, 35 nt, Homo sapiens
gcgaccuuugcuccggccgugagcaguccaggcca

SEQ ID NO: 179554 - RNA, 44 nt, Homo sapiens
caccaaaucaaccuaauuaagguugaugacaacaagaaacuagg

SEQ ID NO: 179555 - RNA, 44 nt, Homo sapiens
gggucuuacuccuuggaggccaugugggccaugagguccaccau

SEQ ID NO: 179556 - RNA, 43 nt, Homo sapiens
agcuugaaaaagugguuguugagggcaaugacagccccagcau

SEQ ID NO: 179557 - RNA, 43 nt, Homo sapiens
cuggugcucaguguagcccaggaugcccuugagggggcccucc

SEQ ID NO: 179558 - RNA, 51 nt, Homo sapiens
ggcuacaguuggauuacugacauuguucccuaaaugauaauauaagcagac

SEQ ID NO: 179559 - RNA, 46 nt, Homo sapiens
aacugaugguccacgaucucaaauagcuaaaacuccugcagaaugg

SEQ ID NO: 179560 - RNA, 21 nt, Homo sapiens
aaaaaauccaaaagguuguuu

SEQ ID NO: 179561 - RNA, 48 nt, Homo sapiens
aguuguuaccuugguagacuauauaccaaaccaguccugcuauugcag

SEQ ID NO: 179562 - RNA, 50 nt, Homo sapiens
uuuaauuuuuuaaauacuacaaagucucuugcugcuaaggcugguaagua

SEQ ID NO: 179563 - RNA, 55 nt, Homo sapiens
uggccucccaaauaaagugagauucuauagcagcaauuguuaauguaaagaguuc

SEQ ID NO: 179564 - RNA, 41 nt, Homo sapiens
uuuaauaagauuaucuuuuuugcuuuaaauuuuuuuuaaau

SEQ ID NO: 179565 - RNA, 78 nt, Homo sapiens
caaaaugccaagaauauuuuuuuuaucuuaacaguuuauucuaaaguucaucugaaacuuuauuuuucagauggguag

SEQ ID NO: 179566 - RNA, 50 nt, Homo sapiens
acacuguaaauccucauuauuuaaaacaguauaguaguuuuauaggaaga

SEQ ID NO: 179567 - RNA, 42 nt, Homo sapiens
uuaaaaacaaucuuuauguuaauauacacuaaaucuauacac

SEQ ID NO: 179568 - RNA, 28 nt, Homo sapiens
uuggauaaccuuguuacaacccagucau

SEQ ID NO: 179569 - RNA, 55 nt, Homo sapiens
aaagaaucugcauuugaauaugcccguaugaauguggguucuguuuuugcaacag

SEQ ID NO: 179570 - RNA, 39 nt, Homo sapiens
aucaguguacgaauuugucauagguagagauuuaaaggu

SEQ ID NO: 179571 - RNA, 43 nt, Homo sapiens
aacauguuacauaaauuauaaugucugucuuguaaaaaaguug

SEQ ID NO: 179572 - RNA, 45 nt, Homo sapiens
uaauaaacaauauagcacaguugaagcacccagugaacccuaguc

SEQ ID NO: 179573 - RNA, 54 nt, Homo sapiens
agaaggaagaggaggaagaugaggaagaugaagaggaugaggaggaggaggaag

SEQ ID NO: 179574 - RNA, 42 nt, Homo sapiens
cccguuaugaaagagaaaugaaaaccuauaucccucccaaag

SEQ ID NO: 179575 - RNA, 47 nt, Homo sapiens
uggaugucugcucacagcagcuugccaugggcacagcuuguauagag

SEQ ID NO: 179576 - RNA, 43 nt, Homo sapiens
uucuaaaaacuuguucuaguuauugaauagacuaaucuacaau

SEQ ID NO: 179577 - RNA, 59 nt, Homo sapiens
agguaggauucagugcuuaccgaugaugcaguacuugauagaagaaaacagucugggag

SEQ ID NO: 179578 - RNA, 46 nt, Homo sapiens
ccaagagaucccccacauccuccgccaucccuuugcagucaccaag

SEQ ID NO: 179579 - RNA, 90 nt, Homo sapiens
uguaucuagaacaggaguuagaaagccugaaagcuguguuagagaucaagaaugagaaacugcaucaacaggacaucaaguuaaugaaaa

SEQ ID NO: 179580 - RNA, 50 nt, Homo sapiens
uuuaaaugaaaaauugaaaucagaagaacaaaaaagaagagcaagagaaa

SEQ ID NO: 179581 - RNA, 51 nt, Homo sapiens
aaagaaaucgcuugaagauuuacuuucugagaagcaggaaucgcuagaggu

SEQ ID NO: 179582 - RNA, 51 nt, Homo sapiens
ucaaaaauauccguuuauuuucccagaaauuaagaaaggccaugaaauaga

SEQ ID NO: 179583 - RNA, 46 nt, Homo sapiens
uuccugcuagaaaugaguauaauuuuagacuuauguuuagguuaug

SEQ ID NO: 179584 - RNA, 35 nt, Homo sapiens
ucuuuuuggguucuaucuucucugcuuugugaguu

SEQ ID NO: 179585 - RNA, 51 nt, Homo sapiens
uaugcacgccccccaccgccacacacacacguuuaugucacagcugccgag

SEQ ID NO: 179586 - RNA, 45 nt, Homo sapiens
uuuuguaaaaagcaaguuccuaauaauuuaugauuuauggaagac

SEQ ID NO: 179587 - RNA, 73 nt, Homo sapiens
ugcuguugugauuuaaaaaaaaaaaaaaaaaaaaaaaagcaucuguucugcagcaugcuggccagugaaugag

SEQ ID NO: 179588 - RNA, 33 nt, Homo sapiens
uuuucucaggccugaaucuuagaacauauuguc

SEQ ID NO: 179589 - RNA, 46 nt, Homo sapiens
uuggcuguauuuauaaguaaaaggccauguucuuucaccugcagau

SEQ ID NO: 179590 - RNA, 41 nt, Homo sapiens
gaacacucucaaggcugccagugggauuguuaguuucagca

SEQ ID NO: 179591 - RNA, 33 nt, Homo sapiens
gcagcaggcauacaucugaugguaaccguucuc

SEQ ID NO: 179592 - RNA, 52 nt, Homo sapiens
gacaggaaauagcuguaacagucugugcccacugucaccuuccuauccuuga

SEQ ID NO: 179593 - RNA, 55 nt, Homo sapiens
uagagguucacauuucagccucucuccgaagacaaggcagcaaugagaauggaac

SEQ ID NO: 179594 - RNA, 52 nt, Homo sapiens
uugcuuuuguccaugccuuaaauaacauaauuaacagaguuagaagaucagg

SEQ ID NO: 179595 - RNA, 36 nt, Homo sapiens
caggacuacugcagaggcugucuggaauucagggaa

SEQ ID NO: 179596 - RNA, 43 nt, Homo sapiens
aaaaaaccaagggcuuuaaauaccauccauagaugaaaugcug

SEQ ID NO: 179597 - RNA, 44 nt, Homo sapiens
aaaacaagcauuaaaccgguaucucuaauauaacacagacaaug

SEQ ID NO: 179598 - RNA, 44 nt, Homo sapiens
guacaguaaacaaaauaauuuauacuucuguauaaaaccuuugu

SEQ ID NO: 179599 - RNA, 40 nt, Homo sapiens
auucuaaguugucuguaguguuguugugaagcagauagcu

SEQ ID NO: 179600 - RNA, 49 nt, Homo sapiens
uuucccaguucagcagccuauauuuuuauguuuuuuuuuucacacuuuc

SEQ ID NO: 179601 - RNA, 46 nt, Homo sapiens
guacagggccuggguguggauuaggggaaaauaauagcacgccugu

SEQ ID NO: 179602 - RNA, 51 nt, Homo sapiens
uucaaauaagcuuguaaaaauggguuaagcacugaaugcuucaguauagau

SEQ ID NO: 179603 - RNA, 41 nt, Homo sapiens
gcauccaauacuguuggcaggagaauggcgcaguuaagaac

SEQ ID NO: 179604 - RNA, 61 nt, Homo sapiens
ucaguuacauagaaaugauugauaagaggccauguggaguagaaaacuggauaugcaaguu

SEQ ID NO: 179605 - RNA, 45 nt, Homo sapiens
gaauggugcagccuuuaccugagaugggaauggaugguggaaaca

SEQ ID NO: 179606 - RNA, 32 nt, Homo sapiens
aggcuggauagguggugggccaugaagugaaa

SEQ ID NO: 179607 - RNA, 49 nt, Homo sapiens
gaucuuuuccaggcguuucacacaauucuuacuuggcaguaauuaugga

SEQ ID NO: 179608 - RNA, 28 nt, Homo sapiens
uaauaaggggauuaagaaaauaaauaca

SEQ ID NO: 179609 - RNA, 42 nt, Homo sapiens
guuaacucugaugugaaugauuuuauguggcuauugaaaauu

SEQ ID NO: 179610 - RNA, 41 nt, Homo sapiens
uuccacagaaaaguuaaauaauuuguccaauguuaaacagc

SEQ ID NO: 179611 - RNA, 56 nt, Homo sapiens
ugagagguguuucuuaaucgccacagaguuaaaaguagaacagaaaaaucaaggag

SEQ ID NO: 179612 - RNA, 53 nt, Homo sapiens
agugucaaggucaaggagacaugaccacagaggcgugaguggaggaagagggg

SEQ ID NO: 179613 - RNA, 40 nt, Homo sapiens
uaguaguaaguucccuuauacaaauaguuauguguccaca

SEQ ID NO: 179614 - RNA, 42 nt, Homo sapiens
uagaaaucccagugcugaucgagccguaucuccucagaggau

SEQ ID NO: 179615 - RNA, 49 nt, Homo sapiens
agugugaguagacugcugugcugcaggagggggaacaagaugugguggu

SEQ ID NO: 179616 - RNA, 63 nt, Homo sapiens
gggaccacaagggagggaauugucagguccguuuagaagacaagguuaggaaagaccgaagau

SEQ ID NO: 179617 - RNA, 41 nt, Homo sapiens
agccucuugcagccuuaauauauuaauuccugguauauaaa

SEQ ID NO: 179618 - RNA, 46 nt, Homo sapiens
agaagaucaaaggcauacucccuguuaaaauggaaagugcagaaug

SEQ ID NO: 179619 - RNA, 46 nt, Homo sapiens
gaaugucaaagcaaaaguuaugucuagagcaguguugcagcccaaa

SEQ ID NO: 179620 - RNA, 48 nt, Homo sapiens
aaaguaaccuuuucuguuucaccgauugaagcgacggagaaauguaag

SEQ ID NO: 179621 - RNA, 40 nt, Homo sapiens
gggaacaacaaaucauuuaaucuucagagcaucuuagacu

SEQ ID NO: 179622 - RNA, 45 nt, Homo sapiens
cuucguguaucucucuagaaugugauacauuauuuauacagcucu

SEQ ID NO: 179623 - RNA, 25 nt, Homo sapiens
uuauuuauuauuaacuugauaauuu

SEQ ID NO: 179624 - RNA, 40 nt, Homo sapiens
uuggcggcccaguaggaaccuaagcaccuugacuucacuc

SEQ ID NO: 179625 - RNA, 49 nt, Homo sapiens
ggcaagauaauaaaauggcaucagugacccacagcuccauacccccacc

SEQ ID NO: 179626 - RNA, 49 nt, Homo sapiens
caaaauccaaguuagggauaaagaaaagggaucaguuuugaugucauga

SEQ ID NO: 179627 - RNA, 90 nt, Homo sapiens
uauuuuauuuaacuuaugauuacuuuaugaagaguugaaaucauuuggagaaaggcaugaauggauacugaauuauuugcuuuuaaaacg

SEQ ID NO: 179628 - RNA, 46 nt, Homo sapiens
cugccauuuugccuauaacggcuaagcuauaggaaguuaguaucaa

SEQ ID NO: 179629 - RNA, 46 nt, Homo sapiens
aguuucuguugccaggauuuucuauacauuggugcugaaaugggau

SEQ ID NO: 179630 - RNA, 47 nt, Homo sapiens
ccugcgguugggcagagcaggucaugagugcuuucuuuuauacugaa

SEQ ID NO: 179631 - RNA, 43 nt, Homo sapiens
ugauacuccauuugaacuguguuuucaaaaaaucaauguagau

SEQ ID NO: 179632 - RNA, 45 nt, Homo sapiens
caauacugcuacucagcaaaguauuuauuugggggggcgggggaa

SEQ ID NO: 179633 - RNA, 43 nt, Homo sapiens
gcgcugcguagcugaggucgaaaaggcggccacuggggccgag

SEQ ID NO: 179634 - RNA, 49 nt, Homo sapiens
auuacaaaauuaguuauaagauuuuccuuuuagcacauuggggaagaug

SEQ ID NO: 179635 - RNA, 45 nt, Homo sapiens
ggaaaguggauuugagacuuggagaaacuaguaaggcugugagau

SEQ ID NO: 179636 - RNA, 71 nt, Homo sapiens
gaaggaugcuagcuagcaaggcauuuuugcaaugacuuaguuggguuuggguuugaguaaagaaucaaggg

SEQ ID NO: 179637 - RNA, 52 nt, Homo sapiens
uuuuucugugugucugggauggaugguacuggauauguaccauccuugggag

SEQ ID NO: 179638 - RNA, 45 nt, Homo sapiens
auccaguauggccacaggaggaggucccuuugaagauggcaugaa

SEQ ID NO: 179639 - RNA, 44 nt, Homo sapiens
aaauagaucaucagaaaagaauaagaaaaaguuugguguagaaa

SEQ ID NO: 179640 - RNA, 61 nt, Homo sapiens
gcaaagugaagucuagaaaaugcuaaucaaauuuucauauuguagugaaagacuguuacag

SEQ ID NO: 179641 - RNA, 46 nt, Homo sapiens; identical to SEQ ID NO: 106589

SEQ ID NO: 179642 - RNA, 46 nt, Homo sapiens
gcuuuaaguaaugaccucuugcaaaacugucaggugucugaagaag

SEQ ID NO: 179643 - RNA, 63 nt, Homo sapiens
gcuuggagggggauguggauugauuuuuguuuuuuuuuuuuuuuaaaaaaaagguggacuggu

SEQ ID NO: 179644 - RNA, 52 nt, Homo sapiens
auaugcuacacuauuuaauaaaggaggaggcaucuuuuauucugagaauucg

SEQ ID NO: 179645 - RNA, 46 nt, Homo sapiens
gcagaaaagguugcagggacaacuggccaucauacuauaccaugca

SEQ ID NO: 179646 - RNA, 46 nt, Homo sapiens
uagaacagugacuaucaugaaaauuguugucacaaaacugcuuuau

SEQ ID NO: 179647 - RNA, 46 nt, Homo sapiens
aaaccaucagcuucagaacguuuaccugaugagaaagucgaacuuu

SEQ ID NO: 179648 - RNA, 46 nt, Homo sapiens
guuuuaacccagugguuauauuguaaaggugauagaaccuguggaa

SEQ ID NO: 179649 - RNA, 45 nt, Homo sapiens
agacaugaugacagaugcugugaaugaaaacaggaaagaugaaga

SEQ ID NO: 179650 - RNA, 47 nt, Homo sapiens
guaaauagucauaguaaugcacaguguguuucuaauaauagagaugg

SEQ ID NO: 179651 - RNA, 57 nt, Homo sapiens
auaauagagaaggggaacaggagauucauguugcacaaggugaagaugaugaggagg

SEQ ID NO: 179652 - RNA, 26 nt, Homo sapiens
gacuguccaauccagaauucagacuu

SEQ ID NO: 179653 - RNA, 52 nt, Homo sapiens
ggaaaugccaauaaaacacagaaagauacuggaguaaaugaaaaggcaaggu

SEQ ID NO: 179654 - RNA, 97 nt, Homo sapiens
uguagagagaaauuuuaugaggcuaaacuacagcagcaacagagagagcuaaaacaauugcaggaagaaagaaagaaacugauugacauucaggaga

SEQ ID NO: 179655 - RNA, 32 nt, Homo sapiens
uggcuagcuuuaucuucaguuagguuguguuu

SEQ ID NO: 179656 - RNA, 27 nt, Homo sapiens
aaaugagaagacaugaaauguugaggg

SEQ ID NO: 179657 - RNA, 51 nt, Homo sapiens
ugaauuauuuagcuauauaguaguaaccauaucaaaaauuuugaaauauag

SEQ ID NO: 179658 - RNA, 47 nt, Homo sapiens
ggagaugaagacgguuaccuuucugaaggaauuguucggacagauga

SEQ ID NO: 179659 - RNA, 48 nt, Homo sapiens
uaacagugugaaucauaacuccuacaauggaaaggaaacuaaaaauag

SEQ ID NO: 179660 - RNA, 45 nt, Homo sapiens
gacagcaagcacuucugcaguucuccaagccaacugaauguccua

SEQ ID NO: 179661 - RNA, 37 nt, Homo sapiens
cacaagaauguuguuccaguagauccagguaaacugg

SEQ ID NO: 179662 - RNA, 59 nt, Homo sapiens
uacaguagcuccacuugaugaaauacuaugugguugaacuuaaagcgugaagaauggaa

SEQ ID NO: 179663 - RNA, 48 nt, Homo sapiens
aaccaaauuauuauguaugaugacuuaaugcuuucaaucuuguguuag

SEQ ID NO: 179664 - RNA, 41 nt, Homo sapiens
cucuuacguagaagagaaagaacaauggcaagaacaaauca

SEQ ID NO: 179665 - RNA, 52 nt, Homo sapiens
caccaguugaaccagugcuauacucagcuaacauggcaacagaauaauguuc

SEQ ID NO: 179666 - RNA, 55 nt, Homo sapiens
uugaaacaaaugcuaaaugaacuuaugcgccagcaaaaucagcauccagaaaaac

SEQ ID NO: 179667 - RNA, 50 nt, Homo sapiens
ugggagaguaaagaugaauaagacagugcucuccuaaaggaguaccaugu

SEQ ID NO: 179668 - RNA, 47 nt, Homo sapiens
guagaaaaaucuacaaguaguaaccgcaaaaaucaauuagauacaaa

SEQ ID NO: 179669 - RNA, 27 nt, Homo sapiens
ugccugauccaguagauccaacaacag

SEQ ID NO: 179670 - RNA, 50 nt, Homo sapiens
cucaacaagcauucaagaccaucugucagugagugccccacuuuaaggca

SEQ ID NO: 179671 - RNA, 38 nt, Homo sapiens
cuuauguggaaggacagaugcccaagaauagucaagaa

SEQ ID NO: 179672 - RNA, 55 nt, Homo sapiens
ccauguggaacaaaaaaaaaaaaggaauuucuaccuuguauauauaccaaaauau

SEQ ID NO: 179673 - RNA, 39 nt, Homo sapiens
acuacagcagucuaacagaaaugcaugcaaugaagcgcc

SEQ ID NO: 179674 - RNA, 42 nt, Homo sapiens
aguaacucaaauaugagaugcaccugcaggauuauugaggau

SEQ ID NO: 179675 - RNA, 48 nt, Homo sapiens
cuaacuucaguaaggcgcaugguuuugacccuuacccagcaaaaugau

SEQ ID NO: 179676 - RNA, 45 nt, Homo sapiens
gcaagauuuggauaauaauaguauaacuguuaaacagagaugcaa

SEQ ID NO: 179677 - RNA, 43 nt, Homo sapiens
ggcuaaaaggauucuugaagaucauggcucaccugcuggagag

SEQ ID NO: 179678 - RNA, 42 nt, Homo sapiens
uggucccaaaaauguaagaucugauauuucugaucaagagga

SEQ ID NO: 179679 - RNA, 51 nt, Homo sapiens
aaagcugaaacucaggcuuuaacuaauuauggaaguggagaagaugaaaau

SEQ ID NO: 179680 - RNA, 46 nt, Homo sapiens
guggauguccagacuucccuccaggcuaacacugaagcuacugaag

SEQ ID NO: 179681 - RNA, 47 nt, Homo sapiens
gugacuuuaaaaagacagcagaaagcaaaaaugucccauuggaacga

SEQ ID NO: 179682 - RNA, 46 nt, Homo sapiens
uuuuguaaaaguugaagauuuaccacugaaacugacaauauauuca

SEQ ID NO: 179683 - RNA, 46 nt, Homo sapiens
cagaaaaaccauuuaucuggugaaauaugugaaaugcagaccgaag

SEQ ID NO: 179684 - RNA, 41 nt, Homo sapiens
agcauuuuuauucuguuuuucagaaacggugggagcccaga

SEQ ID NO: 179685 - RNA, 58 nt, Homo sapiens
uaucaucuguuuguuaggauuugaaauucuggaaaauauuuaucuacaucgccucaga

SEQ ID NO: 179686 - RNA, 124 nt, Homo sapiens
auacaauaauugaaguguucccuuuuucauaauuacucuacuucccaguaacccuaaggaaguugcuaacuuaaaaaacugcaucccacguucuguuaauuuaguaaauaaacaagucaaagac

SEQ ID NO: 179687 - RNA, 41 nt, Homo sapiens
acagcgauauaauuuuauuacauaugauuagagggaugaga

SEQ ID NO: 179688 - RNA, 62 nt, Homo sapiens
cuucuuuaggggaaguaaaacagucaucuagaauucacugaguuuuguuucacuuugacauu

SEQ ID NO: 179689 - RNA, 46 nt, Homo sapiens
gccuacagaaugcggccucugagacaugaagacaccaucuccaugu

SEQ ID NO: 179690 - RNA, 46 nt, Homo sapiens
uguuaccaaaggucaauucgaaacuuaccugcgggacugcccugac

SEQ ID NO: 179691 - RNA, 255 nt, Homo sapiens
aaggcagucuuaaagcauuggggguggagcaaugugcugucaggaauaagcuccuauaaggagcuggagauucuuuccugagccuguuuauauucauuaccugaaacagugauccuguugaaguuguuugcuuuaguuauuuggugagacuuuagcuaauuuuauaugauuauacuauauuaauauaaauauauacauuauauaacaugcuuugcauauauuaaguuauauuauuuaauauuaaauaacuucuaa

SEQ ID NO: 179692 - RNA, 65 nt, Homo sapiens
guuuaucuuuucccuacacuguaguuuuaaaaaaaugcaaaaaguuuccuaucaucccaccacuc

SEQ ID NO: 179693 - RNA, 60 nt, Homo sapiens
cuucuuccuugaugaucgcagaacgccugcaaagaugugucugaaccgcaccagccaaga

SEQ ID NO: 179694 - RNA, 48 nt, Homo sapiens
ucuggggaagguugugugauuacacgagacagaaaggaaucauuggau

SEQ ID NO: 179695 - RNA, 68 nt, Homo sapiens
gaagaagccaagaauuuauugaccaagaccaagauauuggccccagccuacuuuauccugggaggcaa

SEQ ID NO: 179696 - RNA, 46 nt, Homo sapiens
ggauaggguuccucacuagaacaguucuggaaaauagcacaaggua

SEQ ID NO: 179697 - RNA, 27 nt, Homo sapiens
ucuuccucauaguuuacuucuacccau

SEQ ID NO: 179698 - RNA, 67 nt, Homo sapiens
auucaauauuuuuuaugaauuauuuaccauuuguacuucaauaguagcagaagacaaaaaagguaau

SEQ ID NO: 179699 - RNA, 23 nt, Homo sapiens
acaggucuuagauauacagcuca

SEQ ID NO: 179700 - RNA, 44 nt, Homo sapiens
ccuggccuacuuggcaacuuuccuggcccuuuugaagaggaaau

SEQ ID NO: 179701 - RNA, 47 nt, Homo sapiens
uuaugauguuuuuguggugugggucagguuaggucauccaaguggaa

SEQ ID NO: 179702 - RNA, 38 nt, Homo sapiens
cugugcaaucaccaaaccauuucauuuucauccucauc

SEQ ID NO: 179703 - RNA, 38 nt, Homo sapiens
uaagcacauagaaaaugcgcuguuauuuauuuaaaggc

SEQ ID NO: 179704 - RNA, 53 nt, Homo sapiens
ugaauucucugaagaauaugauaaauacauucgugccaaguggaaaaauuaug

SEQ ID NO: 179705 - RNA, 79 nt, Homo sapiens
aguuccaugguacaccauaaaucuugacuuaccacccuacaaaagauggcaugaauugaugcuugacaaggcaccagug

SEQ ID NO: 179706 - RNA, 76 nt, Homo sapiens
agaguaggaaguuggaggauaugacagaauacagcuugggcuuggacuuuguccaggaaaaugagaagagaagagg

SEQ ID NO: 179707 - RNA, 41 nt, Homo sapiens
gugaugaaaaguuuuuuucuagaauauaaguauuguagcau

SEQ ID NO: 179708 - RNA, 33 nt, Homo sapiens
aguucauagggaugagaugcauaucuccaacag

SEQ ID NO: 179709 - RNA, 50 nt, Homo sapiens
gugcagguuugaugguagagagguuuguggggucucaucauccccacuuc

SEQ ID NO: 179710 - RNA, 39 nt, Homo sapiens
uagucauuaaaauaauuugguuuauuagauuaaccaguu

SEQ ID NO: 179711 - RNA, 48 nt, Homo sapiens
ugcuguuauaagguggauacucuuuuauucuuauggggaaauggaggc

SEQ ID NO: 179712 - RNA, 70 nt, Homo sapiens
gccuagcacuugcucucuuauuuguauauguguguguugugucacuuggacuaguuuccaugccaccuag

SEQ ID NO: 179713 - RNA, 44 nt, Homo sapiens
agugcguagauuugggcagcauccaugggcagauaugagggaag

SEQ ID NO: 179714 - RNA, 48 nt, Homo sapiens
acaaagcugucgaggacaaaacaggauuggaacaccuaagaggaggac

SEQ ID NO: 179715 - RNA, 47 nt, Homo sapiens
aaaaucaaccuauccuccuucaggaccaacgugaguaaacaucagau

SEQ ID NO: 179716 - RNA, 45 nt, Homo sapiens
gguuuaggauuuuagaaguuuucuuggaaagaaaagacuuauuuu

SEQ ID NO: 179717 - RNA, 45 nt, Homo sapiens
caguugagacugaaguuuuucuaaacgagcugcccccagccacua

SEQ ID NO: 179718 - RNA, 46 nt, Homo sapiens
agcaguguugggggcagaaaacagcuugcgguaggcuaagugugau

SEQ ID NO: 179719 - RNA, 38 nt, Homo sapiens
uaggagaguaaguggaacaggaagcucagggaagagac

SEQ ID NO: 179720 - RNA, 33 nt, Homo sapiens
cuuacagaaguuuagugacuucauucucugaga

SEQ ID NO: 179721 - RNA, 52 nt, Homo sapiens
acaguuuuuccuguaauaggaaaauacacagaacauguauguggacacgauu

SEQ ID NO: 179722 - RNA, 31 nt, Homo sapiens
ucuuuuauaccuguaaggagaaauucuuuaa

SEQ ID NO: 179723 - RNA, 45 nt, Homo sapiens
augccgggccggaguugcgucgccuuaguccuccuggcugccgcc

SEQ ID NO: 179724 - RNA, 42 nt, Homo sapiens
gacaugaaggugcguaagucuucaacgccagaggaggugaag

SEQ ID NO: 179725 - RNA, 33 nt, Homo sapiens
gucuggcccacaucgcccaccaggaucuccuug

SEQ ID NO: 179726 - RNA, 315 nt, Homo sapiens
ugccagauaaggacugccgcuaugcccucuaugaugcaaccuaugagaccaaggagagcaagaaggaggaucugguguuuaucuucuggugagcucauucuggcacuucuuccugucaccugcccccuuucucaugaugggaacuucuguggcuccuggucaacccagauguguggguuuggagggggaggggguuguaacaaaagacuccucacugccagcccaaggguuucucaaagucaccuguggcuuugcuguugcugggaguugccugacgcguguuucuguccagggcccccgagucugcgccccuua

SEQ ID NO: 179727 - RNA, 255 nt, Homo sapiens
auuuugcucuuaaggggcgcagacucgggggcccuggacagaaacacgcgucaggcaacucccagcaacagcaaagccacaggugacuuugagaaacccuugggcuggcagugaggagucuuuuguuacaacccccucccccuccaaacccacacaucuggguugaccaggagccacagaaguucccaucaugagaaagggggcaggugacaggaagaagugccagaaugagcucaccagaagauaaacaccaga

SEQ ID NO: 179728 - RNA, 262 nt, Homo sapiens
gccaucaagaagaagcugacagguaagggccagcauuggugcugagugcccuucugcucuggccuuggcugcagggcagggugaauggcacgcagagggggucugcccccuugucuucgcugccugcuuguuccuuccaucugcuuugauuggcuccuucccagccacagaaacuacccccaccccagugcuuccugcucacagaugcuccccuuucuucuuuauagggaucaagcaugaauugcaagcaaacugcuacgag

SEQ ID NO: 179729 - RNA, 95 nt, Homo sapiens
ggcagccugcaacccccaagggcagguguggggcugccagaugcuccaggcagggggccagaaggggcucacaaaggcuugcccuccagggagau

SEQ ID NO: 179730 - RNA, 44 nt, Homo sapiens
ugagccccuucuggcccccugccuggagcaucuggcagccccac

SEQ ID NO: 179731 - RNA, 61 nt, Homo sapiens
ggggggaucccagcagggggagggcaaucccuucaccccaguugccaaacagaccccccac

SEQ ID NO: 179732 - RNA, 73 nt, Homo sapiens
aacaacauccccauuccccaccugguccucccccuucccaugcugccaacuucuaaccgcaauagugacucug

SEQ ID NO: 179733 - RNA, 63 nt, Homo sapiens
ugcuugucuguuuaguucuguguauaaauggaauguuguggagaugaccccucccugugccgg

SEQ ID NO: 179734 - RNA, 51 nt, Homo sapiens
uucaaccccaauagaagagagcugaucauauucugugucuuuaaguaaaug

SEQ ID NO: 179735 - RNA, 42 nt, Homo sapiens
cuguucauaaugggaucaaguuaauggaaacucuugggggug

SEQ ID NO: 179736 - RNA, 45 nt, Homo sapiens
uauuaagacgaugaaggcaucgacaguauuaaugucaggugaucu

SEQ ID NO: 179737 - RNA, 85 nt, Homo sapiens
caucgcccgcugugacggcucagggcacgccccucagacguggcuguucagugagcagauggugagagggucuguguuugucccc

SEQ ID NO: 179738 - RNA, 27 nt, Homo sapiens
cuuuccaagaggcccucaggccuaucu

SEQ ID NO: 179739 - RNA, 69 nt, Homo sapiens
ccuuacacacaggcucucugacgugcugaccuuucaaaggugacgagacccagaggcuguaaucaucuc

SEQ ID NO: 179740 - RNA, 78 nt, Homo sapiens
cgauuuuuaaaccuauuagugagaacagguccccagguggcuuggggagauuccccuuucugcucacagaguccuugc

SEQ ID NO: 179741 - RNA, 68 nt, Homo sapiens
cugcgacugugcuggguacucagaucuucaccagugggagacacuacugggagguggaggugggaaac

SEQ ID NO: 179742 - RNA, 47 nt, Homo sapiens
cuggacccagccacagcuaaugccuaucucguguugucggaggaucu

SEQ ID NO: 179743 - RNA, 75 nt, Homo sapiens
cacacucuucagauccuccgacaacacgagauaggcauuagcuguggcuggguccagcguuaucuccgcugcaag

SEQ ID NO: 179744 - RNA, 31 nt, Homo sapiens
agauuuccauugaauucuuaguauuuagucc

SEQ ID NO: 179745 - RNA, 42 nt, Homo sapiens
uuucuuagcaucuccuucauucccgugaugcggcacagacuc

SEQ ID NO: 179746 - RNA, 41 nt, Homo sapiens
acugaagcaagaguggcucgcuccugcaagagagcagagag

SEQ ID NO: 179747 - RNA, 44 nt, Homo sapiens
agcguccccaguuucuuccagggaugugcuguggugaacacaag

SEQ ID NO: 179748 - RNA, 60 nt, Homo sapiens
gucuagaugacugucaucuacaggauggguuaauagcggcacugauuuaauuauucauac

SEQ ID NO: 179749 - RNA, 47 nt, Homo sapiens
aaaaaaaaacacauccagaggaauaacuaucccaaacaagccugaga

SEQ ID NO: 179750 - RNA, 62 nt, Homo sapiens
aaguaguuuuccuaaagaauugacauucuauaugucaauaaagccuuauagaagagagagag

SEQ ID NO: 179751 - RNA, 42 nt, Homo sapiens
ggagcagcugcaacuccagcuacuagaacaggaagagaaaga

SEQ ID NO: 179752 - RNA, 424 nt, Homo sapiens
caugaaacucuaggacuuggccaggcaugguggcccacaccuguaaucccagcacuuugggaggcugaggagggugggucacccggucaagagacuugagacaauccugaccaacauggugaaaccccaucuuuacuaaaaauacaaaaauuagcugggcgugguggcacacuccuagacuauagucccagcuacucaggaggcugaggcaggagaaucauuugaacucaggaggcagagguugcagugagccgagauugcgccacugcacuucagacuggcgacagagugagacuccaucucaaaaaaaaaaaaaaaaagaaagaaagaaacucuaggacuuguaaggauuaaaaaucuacagacaagggcauuucucuuacuaacuuuaucucgugugugugugugugugugugugugugug

SEQ ID NO: 179753 - RNA, 54 nt, Homo sapiens
gagaguauuugccauguauguuucuguuccuuuuugguuaucugacaccuacuu

SEQ ID NO: 179754 - RNA, 50 nt, Homo sapiens
gcucugguagaauuauuuaaaacacaagugauacuuauagacauguaaca

SEQ ID NO: 179755 - RNA, 50 nt, Homo sapiens
ucuuuugcguguaaggagaaaggaagcucaggcuguacuaacccaugaga

SEQ ID NO: 179756 - RNA, 46 nt, Homo sapiens
ucgccaggcagcuccggucccaggugcugcagagcgaggaugagca

SEQ ID NO: 179757 - RNA, 50 nt, Homo sapiens
aggugcaacuuccuggcaugcagugagcagaaggcaggccaggacaggag

SEQ ID NO: 179758 - RNA, 45 nt, Homo sapiens
ucauagcaauauucugaagcugugacaaguuaguauccuggaggc

SEQ ID NO: 179759 - RNA, 62 nt, Homo sapiens
uuuucacccacucacaagucaacaaguggaugcaguauaguguguugacaaaagagaaagac

SEQ ID NO: 179760 - RNA, 45 nt, Homo sapiens
ucuuucucaacauuuugcuugggcuuaauucauagaugaaaugca

SEQ ID NO: 179761 - RNA, 46 nt, Homo sapiens
gggaggcacaguuuugcuaagaggcagaauaaaagcaugccccggg

SEQ ID NO: 179762 - RNA, 48 nt, Homo sapiens
uguuccuucaaacccuauuaggauggaagaagugacgcuugaguagaa

SEQ ID NO: 179763 - RNA, 45 nt, Homo sapiens
aaaucccugaaguaguagugugagauacaguagauaagccauuaa

SEQ ID NO: 179764 - RNA, 44 nt, Homo sapiens
cuugagguugcugccaggauuggcagauggguacugugaguagu

SEQ ID NO: 179765 - RNA, 46 nt, Homo sapiens
ggcuccagagagucuucacugaggauuggagugucuuccaguugau

SEQ ID NO: 179766 - RNA, 48 nt, Homo sapiens
ugauguuugacuaucaucugccaggagacugaaggcaguagcauuauu

SEQ ID NO: 179767 - RNA, 61 nt, Homo sapiens
gagaccacugagaagacugcuggagagacaacuguagaagcugcgggacaaacuucuggag

SEQ ID NO: 179768 - RNA, 41 nt, Homo sapiens
ucucaguggucucuccagcuuccucagcaguccucccagca

SEQ ID NO: 179769 - RNA, 46 nt, Homo sapiens
uggggaugucacugaagccgucaacgggacuucuaaggagacugcu

SEQ ID NO: 179770 - RNA, 41 nt, Homo sapiens
agccaccgauggcagggggagaccugguauuauggccccug

SEQ ID NO: 179771 - RNA, 42 nt, Homo sapiens
gagaaggcuaagacuaaggaaguccccaaggugaaacggggu

SEQ ID NO: 179772 - RNA, 73 nt, Homo sapiens
gggaaaagaaggagaagguaaaaaugaaggaaaaggaggaggugaccaaagccaagccagccuguaaagcaga

SEQ ID NO: 179773 - RNA, 589 nt, Homo sapiens
ucaggcaggggcuagagagagaaaagugaguagagaguucuguuaaacauaacagaagaugacaauuugcaugucuacaagagguucuuccuuuaauuuuuauguaauuuuuuuuuuuuuuuugagauagggucucacucugucacccaagcuggagugcaguggcaugaucucugcuuacugcagccucgaccuccuaagcccaagcaauucucccaccucagucucucaaauagcugggacuacagguacaugccaccacacccagcuaauuuucguauuuuuuguagagaugaggucucgccauguugcccaggcuggucuugaacugcugggcucaagcgaucugcccgccucggccucccaaagugcugggauuacagugugagccauggcacccggccuuccuuuaaucuuuaauggaaaugucucucccauugcagaaguccuuuuuuuuuuuuuaaaggaaagucuucccagcugacccaggaacuguuacucucuccucacuaccugguggucagucagacacauauccucugucggcuucuucauuuccuccaagaucaucugcugccucugccguucc

SEQ ID NO: 179774 - RNA, 46 nt, Homo sapiens
cccuccugcaggacccccaggcuaggcacaucuuuggcaggaucaa

SEQ ID NO: 179775 - RNA, 323 nt, Homo sapiens
agacaccuucucccccaagaucuuuagggacuguguggaggacagcauaaugggggugaguagggaaagaugcacaaccaaguugggugaaugugcaagaggaaaauacaucagaagagaacuauggggguuaagacagaauacgaaagaagaccacaaaagaaaaggaaaaaauaaagaaaaauaaaauaaggagaggagucaggaagaaaaagaaauggaaaaauauaaggaaaagagaaacacuaaguaguuacaucuccuuuacuuguccugguuacuuugggagggacuugcacucaccugacaguaggagggaaagc

SEQ ID NO: 179776 - RNA, 342 nt, Homo sapiens
ucacugcaggggaauagggaauaggaugaaguggcagcacaaaaaaagggaaaggaggcucaaggguaaaggggcugcagcugaaaaaggaguuccagccuagaacccagauugggugaauggcagaaggcuuaggcucucccagggagggcacugcaauucagucccaagucauuccagcaucuucagaacauggcagugaacacacauuucugaggacuucuggaaggcuacaaguccuccaccccauucugaugcaagggauacaaugaccauccccacucccagccucucacuugaugaugaggguggagccauugagcucaugcacaaggaaggcca

SEQ ID NO: 179777 - RNA, 47 nt, Homo sapiens
gacuccucuucuuccucuucuuccaugccacuggucuccuccaugau

SEQ ID NO: 179778 - RNA, 147 nt, Homo sapiens
gucgaagagauggagagguacuggcccaagaucaaggaaagugggaguuagaaaauaaauuccucuuucuugaaucugauaaccuccuuuuucauaaugcccauguguuucucccuagguugaugccacagcaucuagcaucccaga

SEQ ID NO: 179779 - RNA, 46 nt, Homo sapiens
agcgguccugacccagggagaccgcccgaagcaucugggaugagug

SEQ ID NO: 179780 - RNA, 49 nt, Homo sapiens
gaacuggcagugguguuggagccagcuaacuccaucuucauagagaaga

SEQ ID NO: 179781 - RNA, 45 nt, Homo sapiens
ggcuggauucugccucaucaggcucuggcuccuccggggguugug

SEQ ID NO: 179782 - RNA, 46 nt, Homo sapiens
gauguuuaagaucuauuugaacuuugaguuucaccugccuucuaua

SEQ ID NO: 179783 - RNA, 35 nt, Homo sapiens
acacauaaacuucuaacaacgacaaaaacaaaaau

SEQ ID NO: 179784 - RNA, 23 nt, Homo sapiens
uuugacuacugguaguuaacugu

SEQ ID NO: 179785 - RNA, 42 nt, Homo sapiens
ucuucaagcaacgccuacaucuuauguuggguucaggaaaca

SEQ ID NO: 179786 - RNA, 44 nt, Homo sapiens
uggugucugccaagcaccucggcaaauacaaauccacacuggag

SEQ ID NO: 179787 - RNA, 23 nt, Homo sapiens
ccaaggcugcuccauuagaagca

SEQ ID NO: 179788 - RNA, 47 nt, Homo sapiens
auaugguuagaugugauuauuugauaauguuaguccauuugaaucca

SEQ ID NO: 179789 - RNA, 78 nt, Homo sapiens
uccaacaggaugaagcagauuaacagaagagugaucagugacaaacaugccucauugauuauuguuucuaggaaggaa

SEQ ID NO: 179790 - RNA, 45 nt, Homo sapiens
cacacgggggagaaacguuucgugugucccuuucaaggcugcaac

SEQ ID NO: 179791 - RNA, 31 nt, Homo sapiens
ucaugguccccgagaccacgucugugcggaa

SEQ ID NO: 179792 - RNA, 48 nt, Homo sapiens
ugacagucugagcgcaaucgcuuguccucagaguggaugcacuaggaa

SEQ ID NO: 179793 - RNA, 70 nt, Homo sapiens
gaauguucuuuggaauacaugaaaaaagggguaaagaaagagcuuccacaaaagauaguuggagagaauu

SEQ ID NO: 179794 - RNA, 70 nt, Homo sapiens
cucacuuuuugaguccuuggaauaccuaaagaaaggaucagaacaacagcuuucucaaaagguuuucgaa

SEQ ID NO: 179795 - RNA, 48 nt, Homo sapiens
cuaagcccaggcaaggcaagucaagccaagaccugcaggcggaaauag

SEQ ID NO: 179796 - RNA, 45 nt, Homo sapiens
gagccagcaacugaagaaacgggcaaagacaagacaccagaaagg

SEQ ID NO: 179797 - RNA, 47 nt, Homo sapiens
gagugcccuauuuaauauugcaggcuucuguuuccuaccagccccuu

SEQ ID NO: 179798 - RNA, 371 nt, Homo sapiens
caauagggccaggcaugguggcucacgccuguaaucccagcacuuugggaggccgaggcaggcggaucacgaagucgggagcuccagaccagccugaccaacauggugaaaccccauuucuacuaaaacuagaaaaaguagccaggcgugguggcgugcgccuguaaucccagcuacuugggaggcugaggcaggagaauugcuugaacccgggagguggagguugcaaugagcuaagauugcaccacugcacuccagccugggcgacagagugagacuccgucuccaaaaaaaaagaagaaaaagaaaagacaguauuuugcucccucaccgccuucaggcuuuuaaccaacugccacuuaccacccuag

SEQ ID NO: 179799 - RNA, 65 nt, Homo sapiens
uuaccaccccagucuagaaagaaccuggcguguagcaggaugcaacauauacuuguagaaugaau

SEQ ID NO: 179800 - RNA, 78 nt, Homo sapiens
uacaacggcaaaguugaauaguuucaacagacaccacaggacccacaaagcuaaaaucuggcccuuugcagaaauagu

SEQ ID NO: 179801 - RNA, 45 nt, Homo sapiens
agugggagcaccauuaauuucaugugucuuauucucuggaucccc

SEQ ID NO: 179802 - RNA, 49 nt, Homo sapiens
uauaauuuuucuuccuacagaaagacaucaggacaauaaauagggagau

SEQ ID NO: 179803 - RNA, 45 nt, Homo sapiens
ggaacacauuuuguuuuuauuauauguauuuguuuuuuaccaaaa

SEQ ID NO: 179804 - RNA, 45 nt, Homo sapiens
auaggugguauuuuagugagaaaaaagaacauuuguaauggacug

SEQ ID NO: 179805 - RNA, 49 nt, Homo sapiens
gaagaauccagggaagccugccugaagaggugauguuugcgcauuugaa

SEQ ID NO: 179806 - RNA, 37 nt, Homo sapiens
cuucacucuaguagugcucacaguccagcagguaaga

SEQ ID NO: 179807 - RNA, 54 nt, Homo sapiens
ugacuaaugcauacucaugauuucaucucacuagacaaauguacugaggcugga

SEQ ID NO: 179808 - RNA, 47 nt, Homo sapiens
uuaggaaauuccuuucuauguaacacccugcaucauuaauagccagc

SEQ ID NO: 179809 - RNA, 51 nt, Homo sapiens
cucuuaucucuggagauggcaauacccccaacucaaauuacucuagcaaaa

SEQ ID NO: 179810 - RNA, 49 nt, Homo sapiens
uauuucaaaacuucauguaaauauguuuccuuacaauaucuggcuaagu

SEQ ID NO: 179811 - RNA, 59 nt, Homo sapiens
gccacuggccucaaauguugaaaacgggcagaugggcaaguaauacacucucaagaaag

SEQ ID NO: 179812 - RNA, 65 nt, Homo sapiens
gguaacaggggugagucuuguuucauggaacuuuuuucaaauggggagaaggggguuguguugcu

SEQ ID NO: 179813 - RNA, 40 nt, Homo sapiens
uguagccugauuagaccgcgucaguccggagggugggucu

SEQ ID NO: 179814 - RNA, 46 nt, Homo sapiens
agcaaagccaaaugucuccccauugcuuaacugucgggaaucugaa

SEQ ID NO: 179815 - RNA, 45 nt, Homo sapiens
uuuguauccagcaccugcacccugaccuuuguucgcgccuccaca

SEQ ID NO: 179816 - RNA, 42 nt, Homo sapiens
ucccuggaaaggaccucacuguucuaaacugcuggagaaggu

SEQ ID NO: 179817 - RNA, 46 nt, Homo sapiens
auauccuccaccucucccugguuguguaauuuauuugccugcagga

SEQ ID NO: 179818 - RNA, 45 nt, Homo sapiens
uacacuggaacccacaggcugguuuuccuuuaccugaauaccagu

SEQ ID NO: 179819 - RNA, 42 nt, Homo sapiens
cuguaacaauugaguacgucacguguccguugggccccaggu

SEQ ID NO: 179820 - RNA, 45 nt, Homo sapiens
cuguccccuuuuccacaaagcuggaaaacacgggugggugcaggu

SEQ ID NO: 179821 - RNA, 63 nt, Homo sapiens
gagcaacagggaauuuugaagaagcugccacagggcagaugguuaaaaaaaaaaaaaaaaugg

SEQ ID NO: 179822 - RNA, 48 nt, Homo sapiens
aauaggguuccaagcaagacaaucccuacauucaacagcucggaagaa

SEQ ID NO: 179823 - RNA, 40 nt, Homo sapiens
acuugcagcugcugaccugcggccccuggagcaggcacac

SEQ ID NO: 179824 - RNA, 55 nt, Homo sapiens
uagaucucuaugaacgaugaaagaggcacgacacccugaucgguugcaaagacug

SEQ ID NO: 179825 - RNA, 48 nt, Homo sapiens
gucauuagagcucgaaucuggaucaaaugccucgaucuggaccacaga

SEQ ID NO: 179826 - RNA, 46 nt, Homo sapiens
uuuuagucauaaauaaauuucuuucuuacuguauuuguucucaaag

SEQ ID NO: 179827 - RNA, 47 nt, Homo sapiens
aagcacuugcaaucuguaguacgagucaucgaugaccccacacugaa

SEQ ID NO: 179828 - RNA, 58 nt, Homo sapiens
cucuaauauguguucaucuugcuguucucggucuagcuuccuugacguaguugugaug

SEQ ID NO: 179829 - RNA, 69 nt, Homo sapiens
gguauugagggauaaaggggacaagagcuauauucauuaacaauuuccuuauauuccuuuuuccuaaca

SEQ ID NO: 179830 - RNA, 42 nt, Homo sapiens
gagguuuguugucauuuucaucaaggauuuucacaaugacuc

SEQ ID NO: 179831 - RNA, 42 nt, Homo sapiens
ugguugaugacuuuugagggcgaccauugucaacugccuuaa

SEQ ID NO: 179832 - RNA, 42 nt, Homo sapiens
gaugucaaaccaaagggguaugccaggaggcuccacagauau

SEQ ID NO: 179833 - RNA, 30 nt, Homo sapiens
ccaagaaacaaaacaacacacacgacgucu

SEQ ID NO: 179834 - RNA, 45 nt, Homo sapiens
acagguauucaucaaaguaauagacacaaaugaccaucguccuca

SEQ ID NO: 179835 - RNA, 54 nt, Homo sapiens
auuccugaagauacagcgccagaaacagaaauuuugcaaaucagugcuguggau

SEQ ID NO: 179836 - RNA, 45 nt, Homo sapiens
agccgguugcaggaucaagacgaaauuucuugagacucaguggau

SEQ ID NO: 179837 - RNA, 46 nt, Homo sapiens
gcucaguuguguugcaggugacggcucuggacaaggacaaagggaa

SEQ ID NO: 179838 - RNA, 45 nt, Homo sapiens
ggcaagauaagauuauccuguacaauaagagagaaguggauauag

SEQ ID NO: 179839 - RNA, 46 nt, Homo sapiens
aagugaaaaauacuuguuucuucauaguccagacuuaguacuguau

SEQ ID NO: 179840 - RNA, 88 nt, Homo sapiens
gcauuuacugugaugacuuuuacuccuuuguauguugguaacaaaagagaugcuucauauaauggcuuggcaaacacaggggggcagu

SEQ ID NO: 179841 - RNA, 99 nt, Homo sapiens
uaggugacuuucuuugcuuucuuucacauuaauuuugacagagguaaggccggcaaaucugccaucggaagcucuaacgguuagcucguagcggcuucu

SEQ ID NO: 179842 - RNA, 46 nt, Homo sapiens
aaugacagcuaauguuucggccucgguggaauucucuuucacuacc

SEQ ID NO: 179843 - RNA, 44 nt, Homo sapiens
acagguuaagacuguaaaauggcuucagggcgugccggugcagg

SEQ ID NO: 179844 - RNA, 42 nt, Homo sapiens
gaaagcaacuuuuccuccagcauccuuagccauuaaacggac

SEQ ID NO: 179845 - RNA, 45 nt, Homo sapiens
uucuggaguauucccuuugaccaggcuguaaagaacagucccacu

SEQ ID NO: 179846 - RNA, 26 nt, Homo sapiens
aagccaccaucucauggucaucuuga

SEQ ID NO: 179847 - RNA, 45 nt, Homo sapiens
caccugaacccaauaacguguaaguaauuucagcguuagagcgga

SEQ ID NO: 179848 - RNA, 25 nt, Homo sapiens
guguuuucaaacacggugauggcau

SEQ ID NO: 179849 - RNA, 42 nt, Homo sapiens
cacuuauuauugaguaggugauuucugcauuugcuucaauau

SEQ ID NO: 179850 - RNA, 42 nt, Homo sapiens
ucaucauuuccaguuacaauaguaaagaagaaggguggaccg

SEQ ID NO: 179851 - RNA, 46 nt, Homo sapiens
aguauucuucuccagaagaggugaugaaaaucuccaggggcaaaau

SEQ ID NO: 179852 - RNA, 46 nt, Homo sapiens
gugcuaucagcuugcccccugugcuggaaacagagaacagguuguc

SEQ ID NO: 179853 - RNA, 55 nt, Homo sapiens
auccacagacaccuuuucaucgcagaacuuccaggggcaguccagucccgcgcag

SEQ ID NO: 179854 - RNA, 42 nt, Homo sapiens
ucccugcaacaaacacaacgauuccaauuccuuccgccaacc

SEQ ID NO: 179855 - RNA, 107 nt, Homo sapiens
ugggauagcagauccuucgaaggaauuucgguccagauuguuucuugagucacuuggaauacucgggguguaggaaauaggccggacaggcaccuggggugguaugu

SEQ ID NO: 179856 - RNA, 44 nt, Homo sapiens
cccagcuaggcuucuggauggagucgcugucagaaggggaguuu

SEQ ID NO: 179857 - RNA, 47 nt, Homo sapiens
ggaaggcuuuuccucuagaggcuucuuggaaagacagggaucaagau

SEQ ID NO: 179858 - RNA, 47 nt, Homo sapiens
ugcccugccagggccccgcaucuauacacagaagcccagcaggaagu

SEQ ID NO: 179859 - RNA, 46 nt, Homo sapiens
uaguuggggaacucuuguauguccggcagaggaacgcuuggcaucc

SEQ ID NO: 179860 - RNA, 46 nt, Homo sapiens
cuccaggguaauaguccguaucgauggcguuuggaucugcugagua

SEQ ID NO: 179861 - RNA, 42 nt, Homo sapiens
auucaaacugauugcugaauucgggcgguaacggugguagcu

SEQ ID NO: 179862 - RNA, 42 nt, Homo sapiens
uuuuaccugugucacugcagccacuuuccuucacccccuccg

SEQ ID NO: 179863 - RNA, 74 nt, Homo sapiens
uacugaguucugcugugacaauucaaguucauuccuagaugucccugucuuacaaagcuuugugagguguggca

SEQ ID NO: 179864 - RNA, 45 nt, Homo sapiens
cuccagaaccuacucucuuaaauacuacauuauauggggaugagu

SEQ ID NO: 179865 - RNA, 2695 nt, Homo sapiens
acgaguaguggugccagaagccacagagccguucagaaagaucaggaauuaaaaguacuguauuagucuguuuugcaucuuucuaaaggaauaccugagacugggucauuuauaaagaagagguugauuuggcucacaguucugcagacuguacaaaaagcauggugccagcaucugcugcuggugaggcucaggaaacuuucaaucaugguggaaggcaaaggagggggcaguguaucacauggcaaaagaaggagcaaaagagaggaggaggugccaggcucuuuuaaagaaucagcucuuuugugaacugauaggagugagaacucacucuuauuacugugaggauggcaccaagccauucaugagggaucaugauucaaacaccucccaccaggccccacuucaaacauuggagaucacauuucaacaugaaauuuggaggggacagacaucaaaacuauaucagauaccagcauuccuugaaggagauugcagcuggccauccuuuacuagccccguggaagggagggagagggugcagaauauucuuuuccacccaucccuucaacuaauaaauuguucucaguuuugguccacauuugaaucccugccaccagacuacauuaaacuacauuucugggacagagacccaggcaucagucagcuuucuagguaauucuaaugugccauuaagaugagaaccauuuuacuaggacuaaaucacucauuuucaggccuauguuauuaguagaguguagcuguuccuaaaauguuacuuuauggauaaaaccuuacauuucacaacuugauauaaacugaaaacauacuuuacuauaaucuuauuccaaaguagaauuaauccauuaaucaguagauaauccaauaaucaaauguaaacaaggacuacagauacuuuuuaccuaguaauuaauauauuugaacuugucuucugacuugauuguauuccuucuccuuuaucaaacucugucaacacucaacaaagggcuucucauuaaucagaaaauauagagaauggacaugcuuaacuuuaaaggcuucacaguuuuuuuuagguaacuuuaccaaauaguccuuuagggauaaacagaagcuaauuuaagaauuauguuugucuuuuguagugcaacugaaaaucuuuaaauucugcuuucugaaacauaucaaaauauuuuaauaucugauuuguuaugaguaaucucuacaauagcuccaaaguauuuauuuaucaagauaccaguauggucguuguuuauuuauuuauuuuuuaaauacucuuucagcagaaucaggucauugaauaaauauuuacaagguuaaauaggcuuaggauuuaggaauguaaggcuaagaugaguauugaaagauugucuucuuugacuauaucuucuuauauuguuuugacuuuggaaacguaaaaauguuuccaaauugaaugugucaaauauucaaaaauauuaaaauacucuaauuuuuugaauauucaaacauauuuuuuaaaaagucuauuaaaaggaaauccuugaaaacaaaaacaaacuaaagcaaauauguuggugacauaaccauacagaggaaaaaaaaaccaaccgugacuuuagaacacagagcuuugauuauauaggccuagugggauauaguccaaagagaaaaagaacuaagagguuuaaauuucacucaauaguuuuauugcuauaaguaauacauuauuuuaauaguaauuggaauccuuauagauuacugaugggaauauaaaauggugcggcugcugaaaacagcuuggcaguuccugaaagugugaaauagagaguugccaugugauucagaaauucuauucuaggugaucacccaagagaauugaaaacacauccacacagaaacugaacuuaugcacagauguucauggcagcauauauaugauagccaaaaaguggaaacaaaugugcaucaauuuaugaaugaauaacaaaauugguguauccacacaauggaauauuauccugccauaaaaaggaaugaaguacugauucaugcuacaauacagaagaaacauuaagcuaagugaaagaagccagacacaaaaagccauguaaugugugauuccacuuaugugaaauguccacagcaggcaaauccauaaagaaaaaaguagguuaauaauugccauggguaguaugcugaaauucuuuucauuuugcaaaggaagcuggaugagagauaaaaacugugagaucauauaguuaguaaguggauugaaugggauuuaaacuuggauauuguguuccagcacccccaccaggccaugggguaccaugugcaaauuagaaaagauguaggagggccaggcgcgguggcucaugccuguaaucccagcacuuugggaggccgaggcggguggaucacgaggucaggagaucgagaccauccuggcuaacguggugaaaccccgucucuacuaaaaauacaaaaauuagccaggugugguggcgggcaccuguagucccagcuacucgggaggcugaggcaggagaauggcgugaacccgggaggcggagcuugcagugagcccagaucgcgccacugcacuccagccugggcgacagagcgagacuccaucucaaaaaaaaaagaaaagauguaggagguaaaucagaaaauuuucaauuagagaaaa

SEQ ID NO: 179866 - RNA, 70 nt, Homo sapiens
gucugugaauuuugucucacagacuuuuuuaaaaagauaggcaaaaaauuuugaaauuauuauugaauau

SEQ ID NO: 179867 - RNA, 52 nt, Homo sapiens
acuucuauuuauauucuuuuaauuuagaaauuuuucucaagaaggcacugaa

SEQ ID NO: 179868 - RNA, 42 nt, Homo sapiens
ugggcuuuauuagaggaauuuuggagaaaacaugaccagcau

SEQ ID NO: 179869 - RNA, 45 nt, Homo sapiens
aucuuuucaaucugccucacgacagacccuauuucaaaaggucua

SEQ ID NO: 179870 - RNA, 38 nt, Homo sapiens
cauuucaaggaaaauuauagauauauuauuuacccuua

SEQ ID NO: 179871 - RNA, 46 nt, Homo sapiens
auuuaugugguccagggcauauauggcuaucaucauuauaugcagg

SEQ ID NO: 179872 - RNA, 48 nt, Homo sapiens
uuauccuuuccucagugguuauggaaaucagugguaaaaaaaugacag

SEQ ID NO: 179873 - RNA, 42 nt, Homo sapiens
acacaauacuaggaguugcauggaaugagauuacagggcaga

SEQ ID NO: 179874 - RNA, 52 nt, Homo sapiens
aucucccuguguggaggccuucugaggcuguuguaaguagccgucucuguau

SEQ ID NO: 179875 - RNA, 63 nt, Homo sapiens
ucuuccucagcgaccaaauaugauuuaaaauaucuuggagucaaagacugcaguagaguggua

SEQ ID NO: 179876 - RNA, 59 nt, Homo sapiens
gaaugauuguguugccgugcucagacagaaacggagucucggaaguguagaaaauacca

SEQ ID NO: 179877 - RNA, 49 nt, Homo sapiens
ggauuuccagacugugccaaguuucuuacaacaauuaaauguaugcaga

SEQ ID NO: 179878 - RNA, 79 nt, Homo sapiens
ggagaagcuccacuacacaaggcagcaaaaguuggaagccuggagugccuaagccugcuuguagccagugaugcccaaa

SEQ ID NO: 179879 - RNA, 349 nt, Homo sapiens
cuuuuaguuugcuuuuucauaccguuuucauuaauaaaaauguguggcugggcgcgguggcucacgccuguaaucccaccacuuuggaaggcugaggcaggcggaucaccuaaggucaggaguucgagaccagccuggccaacauggugaaacccugucucuacuaaaaauacacaaauuagccgggcacgguggcgcgugccuguaaucccaccuacuagggaggcugaggcaggagaaucucuugaacccaagaagcagagguugcagugagccgagaucgcgccauugcacuccagucugggcgacaaaagcaaaacuccgucucaaauaaauaaaaacguguagc

SEQ ID NO: 179880 - RNA, 32 nt, Homo sapiens
uguaagcaaauaaaaagaguucuuccagaaaa

SEQ ID NO: 179881 - RNA, 90 nt, Homo sapiens
uaugauagucaacagccacuuaaggcuagaguauuugaaauguggcuagucugauuugagauacgcugucacaccagauugugaagacag

SEQ ID NO: 179882 - RNA, 34 nt, Homo sapiens
ugugacagcguaucucaaaucagacuagccacau

SEQ ID NO: 179883 - RNA, 52 nt, Homo sapiens
gaaacaacucuuggcgucugagaaauguuugugugugucuggguuggagggg

SEQ ID NO: 179884 - RNA, 59 nt, Homo sapiens
agccgcaggaagcggccuugcuugcuuucuucucuggcagcugcaaacgggcgcugacc

SEQ ID NO: 179885 - RNA, 47 nt, Homo sapiens
ugcuggagacaggggccucggucaacgcacccccggaucccugcaag

SEQ ID NO: 179886 - RNA, 69 nt, Homo sapiens
gcggggacggaccacugggcgcugccuggucagagcugguugugaagggcggggagguuuccagcccgg

SEQ ID NO: 179887 - RNA, 50 nt, Homo sapiens
uugucaucugccuuaggcgggaaaugcuguugcuggauugcaaccccgag

SEQ ID NO: 179888 - RNA, 46 nt, Homo sapiens
aggcugcucgggcguaaccggagcuggggcgcggcugccaagggcc

SEQ ID NO: 179889 - RNA, 47 nt, Homo sapiens
ucggcggauggccucgcgcgcccgcccccucccccugcccccggcgc

SEQ ID NO: 179890 - RNA, 47 nt, Homo sapiens
aggaucuucaugagguagucggucaggucccggccagccagguccag

SEQ ID NO: 179891 - RNA, 123 nt, Homo sapiens
guugaagguggucucguggaugccgcaagauuccauaccuaggggacagagcccucccuuagugaugcugugucaccgaggauguaagaguagaaaccuuuagcucacaacaccuacccagga

SEQ ID NO: 179892 - RNA, 38 nt, Homo sapiens
ugacuguguguguuucucucgagggcauguuucugggg

SEQ ID NO: 179893 - RNA, 45 nt, Homo sapiens
ccugaugccuugacacgauguuuugcagacggaaaaugccggggu

SEQ ID NO: 179894 - RNA, 53 nt, Homo sapiens
ggggcugcugaggcugcgaggaggaggaggaggaggagguagagagggaggag

SEQ ID NO: 179895 - RNA, 46 nt, Homo sapiens
ggggagcggguccuucucggugcccgcggcggcgccucuccaggcu

SEQ ID NO: 179896 - RNA, 45 nt, Homo sapiens
uuauccuuuuggaaaagagcauuuaauguacacaaauggcuacag

SEQ ID NO: 179897 - RNA, 66 nt, Homo sapiens
gggaggcaaugucaucugguggccagugggugagcagggcauuuuugguugaaagaacagcaagag

SEQ ID NO: 179898 - RNA, 35 nt, Homo sapiens
ccgguuguauguuguggagggccgagccacaggac

SEQ ID NO: 179899 - RNA, 28 nt, Homo sapiens
caguggaaugaugagagucuguuugugc

SEQ ID NO: 179900 - RNA, 41 nt, Homo sapiens
caucucccccaggaaaugaagcuuagagccuccuuguucag

SEQ ID NO: 179901 - RNA, 39 nt, Homo sapiens
ccauccuacuccaugaugaauaaggguaggccuaugaag

SEQ ID NO: 179902 - RNA, 48 nt, Homo sapiens
uguuugcucuucauaugcacugaaacggcaggagguggaaauugacaa

SEQ ID NO: 179903 - RNA, 46 nt, Homo sapiens
uuuuugcugauccauugggugacuggguaauaagaaaaggcguucc

SEQ ID NO: 179904 - RNA, 42 nt, Homo sapiens
ucacggaaggaugcuuguaacucuggcauguucugggcgcag

SEQ ID NO: 179905 - RNA, 37 nt, Homo sapiens
cuggaucuauuccgauggaccaggagaagucuaucuu

SEQ ID NO: 179906 - RNA, 34 nt, Homo sapiens
aaagacacuugggugagagacugcauucggguaa

SEQ ID NO: 179907 - RNA, 45 nt, Homo sapiens
aggaaaagaagauuuuucagauccccuggaugcaugcggcuagac

SEQ ID NO: 179908 - RNA, 78 nt, Homo sapiens
gaucccaaaacauggaaggcgaauuucagaugcgccaugaauuccuugccugauauugaagaagucaaggauaaaagc

SEQ ID NO: 179909 - RNA, 47 nt, Homo sapiens
ucagggucuaccgaaugcugccccuaucagaacggccuucuaagaaa

SEQ ID NO: 179910 - RNA, 52 nt, Homo sapiens
acuugaaaaacagauaagaugagagaugcccugggugaagcagguuaucagg

SEQ ID NO: 179911 - RNA, 46 nt, Homo sapiens
gauuuagauauuccuacuucuaaucauuucaaaaauugugacccag

SEQ ID NO: 179912 - RNA, 47 nt, Homo sapiens
ggagagauggagaauugcagcagugucagacaguucaggccgccaug

SEQ ID NO: 179913 - RNA, 43 nt, Homo sapiens
uccugacuucaacuauaaaaaaugaaguggauaguacggugaa

SEQ ID NO: 179914 - RNA, 51 nt, Homo sapiens
ccugagagauaacguaauuauauuaacuugguauccagaucauagcccaga

SEQ ID NO: 179915 - RNA, 41 nt, Homo sapiens
augaaauggggaacagauuaauaguugcccaggggucaugg

SEQ ID NO: 179916 - RNA, 64 nt, Homo sapiens
uaggacagucccaucuggacagcaacauugagaaucaagagauugucaccaauccgccagacau

SEQ ID NO: 179917 - RNA, 54 nt, Homo sapiens
aaaaacuggacuggauagagagugaaccuacaaccagugucacccuagaacugg

SEQ ID NO: 179918 - RNA, 27 nt, Homo sapiens
gcgacuggggcugugcuggaaucccag

SEQ ID NO: 179919 - RNA, 45 nt, Homo sapiens
gaggggaaaggaaaagaagacagugauauuuauggagagucauua

SEQ ID NO: 179920 - RNA, 42 nt, Homo sapiens
acagaaagcgaaacgacugauagugugcccagcgaugaagag

SEQ ID NO: 179921 - RNA, 45 nt, Homo sapiens
accugcugcccggcauggcguccuucgucacuuccaacaaaccgg

SEQ ID NO: 179922 - RNA, 36 nt, Homo sapiens
ugaagguuauugagaauguuuuauagugacuuuuga

SEQ ID NO: 179923 - RNA, 51 nt, Homo sapiens
ggcuuucuagauucuauuuuuagauacugcccauugagcaauaauggugau

SEQ ID NO: 179924 - RNA, 42 nt, Homo sapiens
agcauugaaguuauuucucaagaaaaagguggugguaaaaau

SEQ ID NO: 179925 - RNA, 42 nt, Homo sapiens
gcaccucacaguugccuucuaaaaguacuucacagucaagug

SEQ ID NO: 179926 - RNA, 45 nt, Homo sapiens
gguugccaaggugaagaaaagagggauaucgaguagcaaugguua

SEQ ID NO: 179927 - RNA, 43 nt, Homo sapiens
caggaaaugcagucccuguggccuguuuuuugcacaaguagga

SEQ ID NO: 179928 - RNA, 39 nt, Homo sapiens
aacaguccaggccaaacccagagaccagcaggcccagaa

SEQ ID NO: 179929 - RNA, 42 nt, Homo sapiens
cccuguuucugggcugguuugcuggacuuucucuucugcuag

SEQ ID NO: 179930 - RNA, 50 nt, Homo sapiens
ucagugucccuaccuggaagaugggacagcagauccucaaguguaagacu

SEQ ID NO: 179931 - RNA, 39 nt, Homo sapiens; identical to SEQ ID NO: 179928

SEQ ID NO: 179932 - RNA, 34 nt, Homo sapiens
aguuuaauagccacaggaaaagaugcauuuucaa

SEQ ID NO: 179933 - RNA, 44 nt, Homo sapiens
auauguaguauuuaggccauuuaaaccauacuuauuacucaaua

SEQ ID NO: 179934 - RNA, 27 nt, Homo sapiens
cugagggcagggagaagaaagaacacc

SEQ ID NO: 179935 - RNA, 40 nt, Homo sapiens
auaaaaaucuaaagccaggguuaggggucaggauggagau

SEQ ID NO: 179936 - RNA, 49 nt, Homo sapiens
gacgccugagcgaacccccgagagagcgggcgugggcgccaggcgggcg

SEQ ID NO: 179937 - RNA, 46 nt, Homo sapiens
cugccgggacuuuucucgcgcuggucucuucgguggucagggaugg

SEQ ID NO: 179938 - RNA, 46 nt, Homo sapiens
gaggcucugcccuggaugcaguggagagcggcugugccauguguga

SEQ ID NO: 179939 - RNA, 46 nt, Homo sapiens
caguaggagaucucagacgaauuaaaaaugcuauugguguggcacg

SEQ ID NO: 179940 - RNA, 46 nt, Homo sapiens
aguaugggguuuaucaaugaagacuuaucuaccacugcuucucaag

SEQ ID NO: 179941 - RNA, 46 nt, Homo sapiens
auugcugcugguacaucuacaaaugguauaaaauucaaaauacaug

SEQ ID NO: 179942 - RNA, 46 nt, Homo sapiens
uuucaagaauccagaagcauuuuccagaauucuuuggggcuguuau

SEQ ID NO: 179943 - RNA, 48 nt, Homo sapiens
uuaagaaauaaaccuuauuagaaagcucaaaguuggauuuaacagaau

SEQ ID NO: 179944 - RNA, 45 nt, Homo sapiens
uuuuucuaagaaaaacacguaagaacaguuaaauaaucguagcag

SEQ ID NO: 179945 - RNA, 46 nt, Homo sapiens
uaaaugaggugaaauuuucagaguguaaaaucuaacagaaauaaag

SEQ ID NO: 179946 - RNA, 40 nt, Homo sapiens
ggcagccuuguuuuuuuguuuuguucauaauauuaaguag

SEQ ID NO: 179947 - RNA, 58 nt, Homo sapiens
accaaaaaacaaaccaacaauacaugaagauguaagggaagagauuaaugagauacaa

SEQ ID NO: 179948 - RNA, 42 nt, Homo sapiens
aaaaaaaaaaaaaagaggacucgauauuucaagcaaauacaa

SEQ ID NO: 179949 - RNA, 41 nt, Homo sapiens
gcucccguuccggcggcggaccggcucccugcgauccgcgc

SEQ ID NO: 179950 - RNA, 39 nt, Homo sapiens
caggagcgggaaaaggccuggggcuucccagaaaacgcg

SEQ ID NO: 179951 - RNA, 44 nt, Homo sapiens
agagcagcggcugcgaguagugaccacgaaaauccgauccgcac

SEQ ID NO: 179952 - RNA, 47 nt, Homo sapiens; identical to SEQ ID NO: 129913

SEQ ID NO: 179953 - RNA, 39 nt, Homo sapiens
caggaccaggaaaaggccuggggcuucccagaaaacgcg

SEQ ID NO: 179954 - RNA, 49 nt, Homo sapiens
gaaggagggguugguuccaucuggggaaggggguaagggagggagggag

SEQ ID NO: 179955 - RNA, 47 nt, Homo sapiens
cucacugccaggcggcgggugagcucggcuucccucucacuccgcuc

SEQ ID NO: 179956 - RNA, 45 nt, Homo sapiens
cgcccccgggggcccagccgcugagaccgcccccgcgcccggcac

SEQ ID NO: 179957 - RNA, 42 nt, Homo sapiens
uccgcgccacggcaacuugacgagcuaggccacgggccacau

SEQ ID NO: 179958 - RNA, 68 nt, Homo sapiens
cuggugcgagcuuuuccucagagucccgcagagcggccggacccaacggagacgcuucccucacgggg

SEQ ID NO: 179959 - RNA, 50 nt, Homo sapiens
uugacggaagaguccggguguuucuucuugugcucuucccggcaggucug

SEQ ID NO: 179960 - RNA, 46 nt, Homo sapiens
ggccaggguguucacuuuugaucuuugggcgauguucagagcaaaa

SEQ ID NO: 179961 - RNA, 42 nt, Homo sapiens
uuagcugcuuucuguucauaugguuguuuaucuuuggcugac

SEQ ID NO: 179962 - RNA, 45 nt, Homo sapiens
ugaaaaagugguuguugagggcaaugacagccccagcauugaagg

SEQ ID NO: 179963 - RNA, 53 nt, Homo sapiens
gcccauaucucccaauaaagaugucuaugccuuuauagcagaauguauguaau

SEQ ID NO: 179964 - RNA, 51 nt, Homo sapiens
guguaagaugcuucacauuuauuauuucaccuaaccucuacacaaccuguu

SEQ ID NO: 179965 - RNA, 45 nt, Homo sapiens
cucucgcuuagaacacucugugguucuuacaccaaccccucuccc

SEQ ID NO: 179966 - RNA, 44 nt, Homo sapiens
uuaaugagaaagaagaguagcacuuaccauuacuaugauuucag

SEQ ID NO: 179967 - RNA, 46 nt, Homo sapiens
uucccacucaaaucuaggucuuucucaagugagacacuagagagag

SEQ ID NO: 179968 - RNA, 110 nt, Homo sapiens
ccaaauguccccuggggggcaaaaucaccaccgguugagaaccacugcucuagguaggaagaauaaaaaggaaagaacuuaauccaaaaagaaagaaucuagguucauag

SEQ ID NO: 179969 - RNA, 45 nt, Homo sapiens
acauaaacuaagaauuauguuugaggauauuuacuuaaagaaaaa

SEQ ID NO: 179970 - RNA, 48 nt, Homo sapiens
uuggguucagaagagcucuuuuggcccaagaaagauaauuuagagcag

SEQ ID NO: 179971 - RNA, 45 nt, Homo sapiens
uuacagauuguuuaucaaaugaaaaauuggcaacauauccagcaa

SEQ ID NO: 179972 - RNA, 39 nt, Homo sapiens
guaauggagugaauuugauauauaagcuucaacauuuac

SEQ ID NO: 179973 - RNA, 47 nt, Homo sapiens
uaggucagacuucuccaaaguaguaugccauaucuuaguaucaagug

SEQ ID NO: 179974 - RNA, 42 nt, Homo sapiens
gguacucgcuugaacagagaaccgugaagaugaaacagagag

SEQ ID NO: 179975 - RNA, 45 nt, Homo sapiens
cauauaaucuguugaagaggaaucuguuugcagaaauuauugagg

SEQ ID NO: 179976 - RNA, 91 nt, Homo sapiens
auuucaaaggacuaguauuaaacuugugauuuuuguuuuguuuuuaaggaauacaaaaaauaaacauuuacuaaaaacguuuauaagguuc

SEQ ID NO: 179977 - RNA, 53 nt, Homo sapiens
ggacugcuucaaaaggauacaccgauuuaaagaggcuuuguuacagcucagua

SEQ ID NO: 179978 - RNA, 47 nt, Homo sapiens
gugaaaaaucagaaggcaguccuaaaagauuauuauaggugaagcag

SEQ ID NO: 179979 - RNA, 30 nt, Homo sapiens
auauuuuucuaauuucuaugaugucacaac

SEQ ID NO: 179980 - RNA, 38 nt, Homo sapiens
aauaguuacuuagcuugauggcuggggugggagguggg

SEQ ID NO: 179981 - RNA, 40 nt, Homo sapiens
uuauaaaggaauuuaguaaagcacaucaugcuuugcuaca

SEQ ID NO: 179982 - RNA, 46 nt, Homo sapiens
auauagacaauuuucaagacguauguuuguguagguaagaggggag

SEQ ID NO: 179983 - RNA, 41 nt, Homo sapiens
ucuuaaaaacucaaagaucucuguaccaucuagggcuguag

SEQ ID NO: 179984 - RNA, 47 nt, Homo sapiens
gccucuggcauuuuuaggcaugcaugaaauugcugaugaggagaaau

SEQ ID NO: 179985 - RNA, 42 nt, Homo sapiens
cgucuaugccuuucucugucuuuacauuuuucucgcacccaa

SEQ ID NO: 179986 - RNA, 57 nt, Homo sapiens
gauuuugaaaaguguagaaguguacgguagcuauacagaagaaaaugcccuuucuug

SEQ ID NO: 179987 - RNA, 47 nt, Homo sapiens
aaagaaaaagcuugcuagcuuaaaaagaaagugacauuucuuccauc

SEQ ID NO: 179988 - RNA, 58 nt, Homo sapiens
gacuuugauagagacuuuuuauuaccauauuaacaaacugaauuacagucagggugga

SEQ ID NO: 179989 - RNA, 56 nt, Homo sapiens
aacuaacagaaauuacuaggauaauuuuacugaaaaaaaauguguugcucaauuua

SEQ ID NO: 179990 - RNA, 31 nt, Homo sapiens
uuucaaaccuagaaccuagcuacccucggag

SEQ ID NO: 179991 - RNA, 28 nt, Homo sapiens
gaguuuaucauaacuuuuuuugcaggcc

SEQ ID NO: 179992 - RNA, 46 nt, Homo sapiens
aaagaugccuuagaaaaagaaucauggagaaguauguuagacuaca

SEQ ID NO: 179993 - RNA, 71 nt, Homo sapiens
uacugguuuacuuacccaucucccccaguagucuuugauauggaucaauaaacaauggcccaugaaccaaa

SEQ ID NO: 179994 - RNA, 42 nt, Homo sapiens
agaacauauuuuuaacuaaagauggaacaguacaacuuggag

SEQ ID NO: 179995 - RNA, 81 nt, Homo sapiens
uucauucuucaugaaaaccuuuaucugcuguuucucagauuuauuuucuacuauauaucgcuuguuguuuaaagauaaaaa

SEQ ID NO: 179996 - RNA, 48 nt, Homo sapiens
uugguaucauaguuuugaagugaaggagagaaaaauauggaguaagga

SEQ ID NO: 179997 - RNA, 27 nt, Homo sapiens
auugaauggauuuuuuuuuauuuuucu

SEQ ID NO: 179998 - RNA, 43 nt, Homo sapiens
ucacccucacgucccaccuccauccauuuagcuaaauaaccag

SEQ ID NO: 179999 - RNA, 58 nt, Homo sapiens
ugccagucugaaucuuauacuuccucuuuuauucauacagcauccuauacauaucucu

SEQ ID NO: 180000 - RNA, 46 nt, Homo sapiens
acaguaugaacauuaccaugccauuuuugaccaaaugcagcaacaa

SEQ ID NO: 180001 - RNA, 50 nt, Homo sapiens
acauucuuucauaauugucagagaaagacacaaaaguaaaauuggaaaag

SEQ ID NO: 180002 - RNA, 49 nt, Homo sapiens
auaaguagaauagaucaaauaaauauaaaagaaacuaucuugugaagac

SEQ ID NO: 180003 - RNA, 45 nt, Homo sapiens
gaguuccugcagcgaaaacgggaagcuaugcagaauaaagcucga

SEQ ID NO: 180004 - RNA, 25 nt, Homo sapiens
uaugcauuugcucaaaagcaaauua

SEQ ID NO: 180005 - RNA, 24 nt, Homo sapiens
gaaauauauaaacuauguucaaaa

SEQ ID NO: 180006 - RNA, 45 nt, Homo sapiens
caagacugaggcaaauaagacuacagaauuucaaugagcgccaac

SEQ ID NO: 180007 - RNA, 48 nt, Homo sapiens
agaaauucugagaggaaaauauaacuaguauucaugggaggauuaaaa

SEQ ID NO: 180008 - RNA, 46 nt, Homo sapiens
ugcacgugcugcuguacuaaaagaacaacuagaacgaaagagaaag

SEQ ID NO: 180009 - RNA, 26 nt, Homo sapiens
caaggauauauauacaugaaacauaa

SEQ ID NO: 180010 - RNA, 42 nt, Homo sapiens
gaccuggaugggaucuaaaaggaaaaugaaguguguaugggu

SEQ ID NO: 180011 - RNA, 55 nt, Homo sapiens
uuuuaguagguaugacagacauuauuaauucuaggacuggggaaggagaguuguc

SEQ ID NO: 180012 - RNA, 46 nt, Homo sapiens
auuccugauccauaaguuuuguggccuuugguauuacagcuaugca

SEQ ID NO: 180013 - RNA, 55 nt, Homo sapiens
agucaaagcagucacagcccaaccuggauucaaagggagggcaaacagaacccac

SEQ ID NO: 180014 - RNA, 50 nt, Homo sapiens
gaugagagcuugccaugcacuauuacugauguguggauuagugaggaaaa

SEQ ID NO: 180015 - RNA, 47 nt, Homo sapiens
cugaagucuucugaggcacaugaccucagaagaauucuucaacaagg

SEQ ID NO: 180016 - RNA, 43 nt, Homo sapiens
ccugggugagugucaggaugaguuucccaucacuuagcucugg

SEQ ID NO: 180017 - RNA, 34 nt, Homo sapiens
uacauauugcuaguuuauaauauacaugguccaa

SEQ ID NO: 180018 - RNA, 60 nt, Homo sapiens
uacaaaauguguuugcauauucauacaaaaaagucuaagauugcauugaaauauauauau

SEQ ID NO: 180019 - RNA, 44 nt, Homo sapiens
augagaguuaaaugaaaugacuagauauagauuucauauucauu

SEQ ID NO: 180020 - RNA, 61 nt, Homo sapiens
aaaauuuuaucucgcucacccgaaagugacaucaagucauuaagauacaaguuaaaaagaa

SEQ ID NO: 180021 - RNA, 46 nt, Homo sapiens
guuuauguaaugaaauuguauacaucggcuaaaaugaaugaauuaa

SEQ ID NO: 180022 - RNA, 48 nt, Homo sapiens
auuuuuagccuuaaaguuuauauucucaaguccuuuuacaaucagugu

SEQ ID NO: 180023 - RNA, 60 nt, Homo sapiens
acagaugugucucaguucccacccugcacagguggacugaauggcuagaguggguuggag

SEQ ID NO: 180024 - RNA, 53 nt, Homo sapiens
uugguuuucuuuagguagaaugaauggaggcaggacaaaagugggaauccaag

SEQ ID NO: 180025 - RNA, 74 nt, Homo sapiens
aaaagggcgaguucucggcccccggagacagggcugggucgaaaggaguucaggcaggaaaggugggagugcag

SEQ ID NO: 180026 - RNA, 47 nt, Homo sapiens
uuguucugccaaauucuuuuuuauugcauuuaaacuucaggguuuuu

SEQ ID NO: 180027 - RNA, 38 nt, Homo sapiens
gauaaguuuugccaguuugugaacuuaauacuaauaga

SEQ ID NO: 180028 - RNA, 25 nt, Homo sapiens
ucuuguuauuauaugcuauuauaug

SEQ ID NO: 180029 - RNA, 46 nt, Homo sapiens
uucauacuaaccucuuggguuccaugcugaccuguaaagcugccau

SEQ ID NO: 180030 - RNA, 39 nt, Homo sapiens
gcccaugaaaccacuaacaguggaucaacagagacugaa

SEQ ID NO: 180031 - RNA, 61 nt, Homo sapiens
uucaauaggugucugagcagaggaagaauacaugacuucgacuugggagagucagggaaag

SEQ ID NO: 180032 - RNA, 46 nt, Homo sapiens
ggggcaggagaccaaggcugaaauaauugcuagagagaauaagaaa

SEQ ID NO: 180033 - RNA, 45 nt, Homo sapiens
ucauccuagucccauacauggcccauuuaaacuuccuuuggcuuu

SEQ ID NO: 180034 - RNA, 43 nt, Homo sapiens
uuugacagcugcaugguauagcauguguuuauauaggacauau

SEQ ID NO: 180035 - RNA, 48 nt, Homo sapiens
caacugaguaaauaauuccuggucuuguguaguccauuuuucagauua

SEQ ID NO: 180036 - RNA, 45 nt, Homo sapiens
ccuuucaccucgagaaagcauccagcuguaugaugccauguuuca

SEQ ID NO: 180037 - RNA, 29 nt, Homo sapiens
caaauaguaguguacccuuaagccuuuug

SEQ ID NO: 180038 - RNA, 48 nt, Homo sapiens
acuccguauacuuaaacauuaauacuaaccauuggcauguaugacaau

SEQ ID NO: 180039 - RNA, 45 nt, Homo sapiens
aaguuuguccugcuccuuuucugcucaguuaugacaauuuagggg

SEQ ID NO: 180040 - RNA, 41 nt, Homo sapiens
gaauguuguaugugacugaauaacaauuuuuacucugcgaa

SEQ ID NO: 180041 - RNA, 35 nt, Homo sapiens
aacuugucaucacccuguccccaccuaccccccac

SEQ ID NO: 180042 - RNA, 48 nt, Homo sapiens
cuaauguuaaguaugaucauuucaguugcuugcuguaaaagccuccug

SEQ ID NO: 180043 - RNA, 25 nt, Homo sapiens
auacagaacacacuuaauaaauauu

SEQ ID NO: 180044 - RNA, 48 nt, Homo sapiens
aggagggggcccaccauggugacguccucguggccacggagcagcucc

SEQ ID NO: 180045 - RNA, 47 nt, Homo sapiens
caaccggacuauuggcaccggucuagucaccaacacgcuggccauga

SEQ ID NO: 180046 - RNA, 77 nt, Homo sapiens
ugcccggggaggaccugaaguucaaccuaaucuugcggcagccaaugaucuuagagaaaggccagcguuucacccug

SEQ ID NO: 180047 - RNA, 45 nt, Homo sapiens
ggagauaaccucggggcccugguccgaggcuugaagcgggaggac

SEQ ID NO: 180048 - RNA, 29 nt, Homo sapiens
guggcaccguggugacagguacacuagag

SEQ ID NO: 180049 - RNA, 50 nt, Homo sapiens
ggugguguaugugaacaaggcugacgcuguccaggacucugagauggugg

SEQ ID NO: 180050 - RNA, 46 nt, Homo sapiens
ugccgcccgccacuacgcccacacagacugcccgggucaugcagau

SEQ ID NO: 180051 - RNA, 45 nt, Homo sapiens
gcagugcuauacuccacaugagccgcauugauggugauaccccga

SEQ ID NO: 180052 - RNA, 46 nt, Homo sapiens
ggggcuaaguucaagaaguacgaggagauugacaaugccccggagg

SEQ ID NO: 180053 - RNA, 476 nt, Homo sapiens
acuuagccccaccucccucagcuagaacuaaaggaggaaaagaacacaccucucagcuaaaguuccagugcuagaggcagagcuuagaccacgccccugaacccucccaccuaaauacauaaccuccuccaaucucuaacucuuccagcagagagaacugugggucagaaagaaauguuagagggccuuaagggucugcccugugacuucuuuaggguacagccucugcuugcagagcauuccccacgacuuugugauccccaagccauugguggaucacaaaguucuuccuguucaggagaaauuugucucuugcaucucccaauccaccugucgcacaaauucgggcucuuggggccacaguaaacuccuccagcagacacucugcuggccuugccucccuggcuccaggucccaucaguagauagggcgcugcuggacgccccaaccccacucacucuucgugauggcugcag

SEQ ID NO: 180054 - RNA, 45 nt, Homo sapiens
uggccuccacggccaggccgcggcacaagagaggcaaugccgggg

SEQ ID NO: 180055 - RNA, 44 nt, Homo sapiens
ggucauacucgcgccccgguaaccggggagccgggaccaggagc

SEQ ID NO: 180056 - RNA, 42 nt, Homo sapiens
gcgaguuccuggugcagcgagcccgggaguuggugccgcaag

SEQ ID NO: 180057 - RNA, 41 nt, Homo sapiens
guauuguuucaacuguucucuuuggcuguguguauucugug

SEQ ID NO: 180058 - RNA, 46 nt, Homo sapiens
gccccccucuuaauacucaccaauaaauucuacuuccuguccaccu

SEQ ID NO: 180059 - RNA, 46 nt, Homo sapiens
uaauagaagggcugacggaaaaaucaucccagaucguggacccuug

SEQ ID NO: 180060 - RNA, 45 nt, Homo sapiens
uguuguuggaaugagaugugaauggcagauggauaaaggaagacg

SEQ ID NO: 180061 - RNA, 46 nt, Homo sapiens
gaaauugaucguaauaaacacauccauaaaaagaggaaacuagcug

SEQ ID NO: 180062 - RNA, 34 nt, Homo sapiens
uuugcccucaggggacauuuggcaaugucuggag

SEQ ID NO: 180063 - RNA, 47 nt, Homo sapiens
agccugcaucacuuagcagcucuccagggauccauuucucagccaca

SEQ ID NO: 180064 - RNA, 36 nt, Homo sapiens
gaguacagagugaguacugcacacauacaugccugc

SEQ ID NO: 180065 - RNA, 42 nt, Homo sapiens
cugccuagauuuauuacuuaaucugcuagugaacaucacaau

SEQ ID NO: 180066 - RNA, 46 nt, Homo sapiens
uuugaugugcuacaugguacuccccauucaagauggaggcaaaucc

SEQ ID NO: 180067 - RNA, 363 nt, Homo sapiens
aaaaucaguggccaggcaugguggcucaugccuguaauugcagcacuuugggaggccgaggcaggaggaucacgaggucaggagauagagaccauccuugcuaauauggugaaacuccaucucuacuaagaaauacaaaaaauuagccaggccugguggcaggcaccuguaaucccagcuacucgggaggcugaggcaggggaaucgcuugaacccgggaggcggagguugcaguaagcugagauugcgccacuacacuccagccugggcgacagagugagacuccguuucaaaaaaaaaaccaaacaaacaaaaaucaguguaauucacuccauuagcagacagaaggagaaaaaucaugac

SEQ ID NO: 180068 - RNA, 48 nt, Homo sapiens
gcaagaguggccacggggcgagaaucuuuuccugaaagcugucaauaa

SEQ ID NO: 180069 - RNA, 32 nt, Homo sapiens
gauuuuuacuauuuugcagcgaagagaaggaa

SEQ ID NO: 180070 - RNA, 49 nt, Homo sapiens
uauuucugaauugcaaggaauauaaaugauauucuuguucaggugcuca

SEQ ID NO: 180071 - RNA, 46 nt, Homo sapiens
cagauauugauaugcuggaggaauuugccuacuugagaacucagga

SEQ ID NO: 180072 - RNA, 47 nt, Homo sapiens
ucggucauauauauuuaaggaugcugacguuuauuuuaaguacauuu

SEQ ID NO: 180073 - RNA, 74 nt, Homo sapiens
uauuugauaggcuaaaaugccacauuuauuagcugguuuauccuguucuuaaaccacaaaagcuuacuaauucu

SEQ ID NO: 180074 - RNA, 47 nt, Homo sapiens
ccacucuuuauauauggagauaauacaaauuggacccugaucugcag

SEQ ID NO: 180075 - RNA, 23 nt, Homo sapiens
auuucuuuuucuaaagcacaacc

SEQ ID NO: 180076 - RNA, 75 nt, Homo sapiens
gaccuuuccaccagacacagcucgggccuguguaauuguaggagaagacacucagcagugauugccauggcacag

SEQ ID NO: 180077 - RNA, 46 nt, Homo sapiens
ccaucugaguucuaacuccuugguugcuuaaaaguaguucccaaga

SEQ ID NO: 180078 - RNA, 42 nt, Homo sapiens
ugagaguugggugccaaaacuuguggccgcccuguacaagag

SEQ ID NO: 180079 - RNA, 45 nt, Homo sapiens
uagaaagaauugaagaauguuagugccuugauagggcccucagag

SEQ ID NO: 180080 - RNA, 44 nt, Homo sapiens
ugauauaaaggacauuauuacaccuuauuaaaacuucacccaga

SEQ ID NO: 180081 - RNA, 52 nt, Homo sapiens
ccugcggaaggcggcggcggcgguggcgggagaaggcgggcaggggggaacg

SEQ ID NO: 180082 - RNA, 42 nt, Homo sapiens; identical to SEQ ID NO: 107347

SEQ ID NO: 180083 - RNA, 47 nt, Homo sapiens
gugucuucuucuaucuuugccacuugacuuucauauuaaacagccag

SEQ ID NO: 180084 - RNA, 41 nt, Homo sapiens
aaccucuuaaaaugcuuuuuacaggcaagacuguauucugg

SEQ ID NO: 180085 - RNA, 52 nt, Homo sapiens
acuccuucucacuaauccucuucugggaaagaggcuaguuaaauuuacuuag

SEQ ID NO: 180086 - RNA, 45 nt, Homo sapiens
uuugaaaucccaaaucaaacccaauguguauuuuuucauagguuc

SEQ ID NO: 180087 - RNA, 45 nt, Homo sapiens
gaugcaaaaaauagcuuucucacagaaaaccacuauaaugcuuaa

SEQ ID NO: 180088 - RNA, 38 nt, Homo sapiens
ggccuggcagggaaacaugaaauuuucaaagauagaag

SEQ ID NO: 180089 - RNA, 46 nt, Homo sapiens
cugcucagucagggcagguaaacaugaacuuuuuaaggauggaagg

SEQ ID NO: 180090 - RNA, 41 nt, Homo sapiens
acaaaugcaauugcuguguguggacagccacagcaguuacu

SEQ ID NO: 180091 - RNA, 45 nt, Homo sapiens; identical to SEQ ID NO: 180086

SEQ ID NO: 180092 - RNA, 50 nt, Homo sapiens
uccauagaaauaguuuaaaggggggacuguuuuuaaaucagggaagagag

SEQ ID NO: 180093 - RNA, 47 nt, Homo sapiens
auucuuaguucaguucuccacugcaaaucuuuaaagagcucucucag

SEQ ID NO: 180094 - RNA, 45 nt, Homo sapiens
agacaagggcuugauguggucuuuugaaauaauugcuaaagccag

SEQ ID NO: 180095 - RNA, 47 nt, Homo sapiens
ccugguggauuaugggcacaggauggauuucucagaauucuaaaggc

SEQ ID NO: 180096 - RNA, 36 nt, Homo sapiens
auucugagaaauccauccugugcccauaauccacca

SEQ ID NO: 180097 - RNA, 93 nt, Homo sapiens
aaaaaaucccauuacuuuugauaaacgacacuaauacaucugaaaagaaagaaauagguuucaaagauuggauuauuugaaacaacaaugaga

SEQ ID NO: 180098 - RNA, 47 nt, Homo sapiens
agcaauagauauuucugucaggcaagucaaaauucacaucuguaauu

SEQ ID NO: 180099 - RNA, 47 nt, Homo sapiens
uucacaaaaguacagugucauccaaaggaaaggcaauauucacuucu

SEQ ID NO: 180100 - RNA, 64 nt, Homo sapiens
aauggaaucacacagagaacuucaaaaauacugauuccuggguuuaaauugguuuagaguaagg

SEQ ID NO: 180101 - RNA, 97 nt, Homo sapiens
gaaaugggauuaguacuuugaagaacugcuuuuuaaauuuaauuuaaauuuuaaaagccacaugugccuaguugcuacccuauuggauaguguagcu

SEQ ID NO: 180102 - RNA, 43 nt, Homo sapiens
uguuuuaugcuucagaugaggguuuuuaguaccugagaccaac

SEQ ID NO: 180103 - RNA, 47 nt, Homo sapiens
caggaaaacuagauuacuggacauuacacaaugaguuaguggcaggu

SEQ ID NO: 180104 - RNA, 34 nt, Homo sapiens
auagaguucuugaggauuaaacaaauuaacguau

SEQ ID NO: 180105 - RNA, 58 nt, Homo sapiens
uuccaucccugcuagugugcuuaggcccucacucuuaagcgcuuccaguacagcccgg

SEQ ID NO: 180106 - RNA, 38 nt, Homo sapiens
cuuugcacaaacacaagaaagcauugaggucacagaga

SEQ ID NO: 180107 - RNA, 40 nt, Homo sapiens
guccuguuccugccaggcaagucacaugcaugauccucag

SEQ ID NO: 180108 - RNA, 43 nt, Homo sapiens
agcaaauucuuugcccucugugcuuccaauuccucauccauaa

SEQ ID NO: 180109 - RNA, 47 nt, Homo sapiens
acuucgggcgcugcggcagccggcgaggagagggagcgccugggggc

SEQ ID NO: 180110 - RNA, 51 nt, Homo sapiens
gggggaacgcgggccagccccagccaguucugccgugccaguuucacccug

SEQ ID NO: 180111 - RNA, 41 nt, Homo sapiens
gcgcggcgggcugugucgggugggccggggacugcugggag

SEQ ID NO: 180112 - RNA, 44 nt, Homo sapiens
gagaaagaagcgggcccgguccuccucggcgcccgucaccgcca

SEQ ID NO: 180113 - RNA, 25 nt, Homo sapiens
ggagcgcuuuggaaggcgcacgggg

SEQ ID NO: 180114 - RNA, 47 nt, Homo sapiens
gucuagcuggggucuggggacugccugguaacuggggcugggcggaa

SEQ ID NO: 180115 - RNA, 32 nt, Homo sapiens
ucuccccgaccccugaguccagaagucucaug

SEQ ID NO: 180116 - RNA, 73 nt, Homo sapiens
uccuccccucaccccguuggggccccgacugagugccccacuccucgccccuaagccacccuggagacaccag

SEQ ID NO: 180117 - RNA, 41 nt, Homo sapiens
cgaaggggcugcccagcccauucuccagcccgucucccagg

SEQ ID NO: 180118 - RNA, 42 nt, Homo sapiens
ccaagugccgcgagugcgaagccuucauggucagcgggacgg

SEQ ID NO: 180119 - RNA, 45 nt, Homo sapiens
uucccggaggagguacccuuuguggucacgaagugcacggcugag

SEQ ID NO: 180120 - RNA, 45 nt, Homo sapiens
ucccagggucguccccagggucugcaugcaaggucuuagccagag

SEQ ID NO: 180121 - RNA, 66 nt, Homo sapiens
auauccagaacuggaggucaggggucaguacccaaaguuaugaaucauggauuaagguucagaguu

SEQ ID NO: 180122 - RNA, 45 nt, Homo sapiens
cccucacaaccagcucccaaccgccacccccgcaccuugacccag

SEQ ID NO: 180123 - RNA, 50 nt, Homo sapiens
cacugccaagcaucagggccacucgggcucagaggucacucagggucaau

SEQ ID NO: 180124 - RNA, 42 nt, Homo sapiens
acgcaccagguagacaagcacacacaugugcuccuugggcag

SEQ ID NO: 180125 - RNA, 57 nt, Homo sapiens
caagaggcauuugaaagaugcuuggcuauaagcaaagucagucucucagaggggagg

SEQ ID NO: 180126 - RNA, 41 nt, Homo sapiens
ccugcaggcagugcacgcacaggcggauuuugggcgggcug

SEQ ID NO: 180127 - RNA, 59 nt, Homo sapiens
agaggcagagggagcgacagagagggagagggagagacagaaagggagagggagagaca

SEQ ID NO: 180128 - RNA, 97 nt, Homo sapiens
uggaaagggagagacagagaggaagagacagagaagcagagggagagagagagaggcagaggaagagacagagauggagagggagagacacagaugg

SEQ ID NO: 180129 - RNA, 31 nt, Homo sapiens
gagcccucaguggacagaucugggggucagg

SEQ ID NO: 180130 - RNA, 42 nt, Homo sapiens
aaggugacguuugaggaugccacugacuuuuuuggccgugug

SEQ ID NO: 180131 - RNA, 48 nt, Homo sapiens
aaguucccucccucccuaggaacccaggcuauuuauagagaagucagg

SEQ ID NO: 180132 - RNA, 64 nt, Homo sapiens
aaaaaccagagcaggcgagcucuagcagaugcagggguggaaggaaggcuggguuacagggagg

SEQ ID NO: 180133 - RNA, 52 nt, Homo sapiens
augaggccaucucccacucaacgggaacccccagcccacauccugaucugag

SEQ ID NO: 180134 - RNA, 24 nt, Homo sapiens
acuuaccaggcuccaggcccagcu

SEQ ID NO: 180135 - RNA, 42 nt, Homo sapiens
ccgccagccgcagcaggcacagcaccaccagcaaccagaggc

SEQ ID NO: 180136 - RNA, 41 nt, Homo sapiens
uggagcagcugcgaagggaggcuggccgcaucgaagcccgu

SEQ ID NO: 180137 - RNA, 41 nt, Homo sapiens
uugcaguaccugacgccgcucauccucacccucaacugcac

SEQ ID NO: 180138 - RNA, 47 nt, Homo sapiens
cuccccagagccgaugggggcagcgcuggcugaggaugggucggggg

SEQ ID NO: 180139 - RNA, 42 nt, Homo sapiens
gccagcgcugcccccaucggcucuggggaggacgaaguccag

SEQ ID NO: 180140 - RNA, 45 nt, Homo sapiens
caggcagccguccaccagaugagguaggccaggacgccacggagg

SEQ ID NO: 180141 - RNA, 53 nt, Homo sapiens
gugucccgcugccccaggaacagaccucagggccccaggagggucugcaggca

SEQ ID NO: 180142 - RNA, 44 nt, Homo sapiens
gguggggccggacuccccggcguucccuucaccacagugccuga

SEQ ID NO: 180143 - RNA, 77 nt, Homo sapiens
ccccaccccagguccgcagcuuuggggaccucuucgcagccuccuccaacgccggguccagaacuuugggaaccucc

SEQ ID NO: 180144 - RNA, 46 nt, Homo sapiens
ucccaaugcccaccaugagggcagagcagaauccacacugggagac

SEQ ID NO: 180145 - RNA, 48 nt, Homo sapiens
gcuugguggcugggucaauuuggaacacgugcgcccgugugcugaaga

SEQ ID NO: 180146 - RNA, 46 nt, Homo sapiens
aacuggaggcggcccacuuugacgaaaagaaggagaucaacaaacg

SEQ ID NO: 180147 - RNA, 31 nt, Homo sapiens
ggugcgaagagagugugagaucgugaguguc

SEQ ID NO: 180148 - RNA, 46 nt, Homo sapiens
cgguacagguggucaucaaccacaacacccccgggcuccccaagau

SEQ ID NO: 180149 - RNA, 71 nt, Homo sapiens
caauuuucuucccaacccugugcagaaagaacgcuuugccgcccuagccaaguucaaguccagcaucuacc

SEQ ID NO: 180150 - RNA, 41 nt, Homo sapiens
cagcuuccccaccguggcucugcacuccaugaugaagcagg

SEQ ID NO: 180151 - RNA, 49 nt, Homo sapiens
gcugcuggaacagggcugcacugacuucaccguggaccuggaggccauc

SEQ ID NO: 180152 - RNA, 48 nt, Homo sapiens
ugcgcagcuccaacacuuuuaguauaaagaagauccgcuuccugguga

SEQ ID NO: 180153 - RNA, 60 nt, Homo sapiens
cacgggccccuacaaggggccccuacaagcggccacaaggauggcaggcuucgcggagcu

SEQ ID NO: 180154 - RNA, 44 nt, Homo sapiens
ucccgcggcggcuccuaccaucggcugcaugccuuggcagcaga

SEQ ID NO: 180155 - RNA, 168 nt, Homo sapiens
ggaccaggcagggaaggaggcggggcccggugagguggguguguggcaugacaggggaggggccucaugauuugggugggacugaaggggcggggcuauacaggaaaggaguaggacaaggguggggccaacugagcuaggaguggggcugggcagaaaaggauaagc

SEQ ID NO: 180156 - RNA, 53 nt, Homo sapiens
agggaaggaggugggguuuggugagguagguggggccuagcagagaaggggag

SEQ ID NO: 180157 - RNA, 57 nt, Homo sapiens
ggugggcggggcauggcaggggaggggaaggacagagcaguaguagaaacagguggg

SEQ ID NO: 180158 - RNA, 36 nt, Homo sapiens
ggcccgggccuggccggguaaaaggagccagggggu

SEQ ID NO: 180159 - RNA, 88 nt, Homo sapiens
caguuccugcucuaggcugcgagcggcuggcggcuucgaggggagcugaggcgcggaggggcucggcggcagcggcggcggcucggca

SEQ ID NO: 180160 - RNA, 47 nt, Homo sapiens
uuugcuaagaggccacaauaaccaugaccaggagggaggaggucagg

SEQ ID NO: 180161 - RNA, 46 nt, Homo sapiens
caccaccacuuucccauugucagucugcaaguaguauguccaggug

SEQ ID NO: 180162 - RNA, 45 nt, Homo sapiens
ccuuaucgcaaggaccugcauccccaagcacucccccaucagagg

SEQ ID NO: 180163 - RNA, 27 nt, Homo sapiens
caccaaagucuccugcugucauccaag

SEQ ID NO: 180164 - RNA, 46 nt, Homo sapiens
cagugcacggggugacccaggccuucgccgccgccucgcgggaggu

SEQ ID NO: 180165 - RNA, 52 nt, Homo sapiens
ugagagugucugcuuuugccugguauaguagugccugcaaauguucaaggaa

SEQ ID NO: 180166 - RNA, 43 nt, Homo sapiens
ggcgguccggaaggugaagcgcguggacguggggugcaccuga

SEQ ID NO: 180167 - RNA, 46 nt, Homo sapiens
ucagcagcgcuagguccagcaugaugggugcggccagcagcgaguc

SEQ ID NO: 180168 - RNA, 35 nt, Homo sapiens
gcgggggcagugcccagggaaggcuuggaggagga

SEQ ID NO: 180169 - RNA, 112 nt, Homo sapiens
gcagggacugcaaaccagaccugggaggacccuuucagcagcccccacuccacccuaucccaggacuucccagcgacccgccguucugggagauaccgggagcgugaucagg

SEQ ID NO: 180170 - RNA, 45 nt, Homo sapiens
ggggcauccccugccccucuaccaucugguggcuggacucuacac

SEQ ID NO: 180171 - RNA, 57 nt, Homo sapiens
uuugaggucugaaguuggggaugagggggugauuaaaaaaugggggguacagcuggg

SEQ ID NO: 180172 - RNA, 49 nt, Homo sapiens
ccugaagaagaugccagucugcaaaaccuuucuaguuucuuuuccagau

SEQ ID NO: 180173 - RNA, 55 nt, Homo sapiens
cggccuuuguccccuggggccagggguugggggagcgguguggggacaggcugga

SEQ ID NO: 180174 - RNA, 58 nt, Homo sapiens
cccaggcuuccuggaaaguggaggaggaggagccuugggggucccagggucgggaguc

SEQ ID NO: 180175 - RNA, 46 nt, Homo sapiens
ccaggcccaagcccacuuccugcaccggcuuccuggaagagccaga

SEQ ID NO: 180176 - RNA, 26 nt, Homo sapiens
aagccuggcaggaggggaacagagag

SEQ ID NO: 180177 - RNA, 27 nt, Homo sapiens
gcagcaugaugaagaaggacgcgcuga

SEQ ID NO: 180178 - RNA, 41 nt, Homo sapiens
ccacgccgacgagcucacaguuccucuaccccaagguggcg

SEQ ID NO: 180179 - RNA, 45 nt, Homo sapiens
ggcggcggccgcgcccgaagcgccugucuacgcgaaccugagcag

SEQ ID NO: 180180 - RNA, 42 nt, Homo sapiens
gcggugacuuuuuuggcgguggcggugacaggaccccggugc

SEQ ID NO: 180181 - RNA, 34 nt, Homo sapiens
gcccauagcgcgagucuguggcggaugccaucug

SEQ ID NO: 180182 - RNA, 46 nt, Homo sapiens
caaggucaagaccaucuaucgcaacgacaagaggaucaagcugcag

SEQ ID NO: 180183 - RNA, 46 nt, Homo sapiens
gggcgcuaugggcuucauccucauguaugacaucaccaacgaggaa

SEQ ID NO: 180184 - RNA, 46 nt, Homo sapiens
ucaugggacaaugcccaggugcugcugguaggaaacaagugugaca

SEQ ID NO: 180185 - RNA, 56 nt, Homo sapiens
ucuucaauaaauaaauaaauagcuacaauaauaaauaagggugacgggcuaaguca

SEQ ID NO: 180186 - RNA, 42 nt, Homo sapiens
ugaacuuccucuucgugcccccccaauuucgagucaccuaca

SEQ ID NO: 180187 - RNA, 42 nt, Homo sapiens
gucagacagugggugagagcugccaggagcugcgggagaagu

SEQ ID NO: 180188 - RNA, 50 nt, Homo sapiens
acuuaccaacuggaaaauuuuaugcaucccaugaagcccagauacacaaa

SEQ ID NO: 180189 - RNA, 70 nt, Homo sapiens
uguuugcuucaagugauggccggugagcugcggagagcucauggaaggcgagugggaacccggcugccug

SEQ ID NO: 180190 - RNA, 49 nt, Homo sapiens
gcucuccgcagcucaccggccaucacuugaagcaaacacuccugaggga

SEQ ID NO: 180191 - RNA, 34 nt, Homo sapiens
uccuuacccuugucugccaguuguaccagguaag

SEQ ID NO: 180192 - RNA, 44 nt, Homo sapiens
gcggcaugcagcucaugcacgccaacgcccagcggacagaugcu

SEQ ID NO: 180193 - RNA, 49 nt, Homo sapiens
gacauggagcuagccuuccugaccauugucugcauggaagaguuugagg

SEQ ID NO: 180194 - RNA, 42 nt, Homo sapiens
ccagcauggagaagaggagugcaaauucaacaagguggaggu

SEQ ID NO: 180195 - RNA, 43 nt, Homo sapiens
ccucaaugucacgcuggugcccuacggaaacgcacaggugugu

SEQ ID NO: 180196 - RNA, 42 nt, Homo sapiens
aggcaaucuauaccugcgggggccccugaagaaguccaaugc

SEQ ID NO: 180197 - RNA, 48 nt, Homo sapiens
ugaaacccgccaccggguuacccccacaagggggccgcugcgagaagu

SEQ ID NO: 180198 - RNA, 39 nt, Homo sapiens
agccugggcacccugauuuuuaagccauagaccuggggu

SEQ ID NO: 180199 - RNA, 48 nt, Homo sapiens
acccagugcgcgccccgggccccggcccgccgccugccgcccgcugag

SEQ ID NO: 180200 - RNA, 46 nt, Homo sapiens
uguacgggucgcugaaggagcuggugcugcacuaccagcacgccuc

SEQ ID NO: 180201 - RNA, 45 nt, Homo sapiens
aggaacgcacuugguacgugggcaagaucaaccgcacgcaggcag

SEQ ID NO: 180202 - RNA, 44 nt, Homo sapiens
aaaugagacugaggagugagugaccgucuggagggaggcaggga

SEQ ID NO: 180203 - RNA, 46 nt, Homo sapiens
cuggagcagcagcugcgggcccaggccucggacaacagagagaucg

SEQ ID NO: 180204 - RNA, 41 nt, Homo sapiens
auaccuggagcgcuuccggcgugagggcaacgagaaagaga

SEQ ID NO: 180205 - RNA, 45 nt, Homo sapiens
ggcagugggcgcccagcuuaaggucuaucaccagcaguaccagga

SEQ ID NO: 180206 - RNA, 37 nt, Homo sapiens
cuccguuguggaccucaucaaucacuaccgccacgag

SEQ ID NO: 180207 - RNA, 33 nt, Homo sapiens
acuggggggacauuucaagguagguugcuggca

SEQ ID NO: 180208 - RNA, 42 nt, Homo sapiens
gcggcgucuagacccuaagaagggaggggaugggguccagag

SEQ ID NO: 180209 - RNA, 37 nt, Homo sapiens
uccuaggggauuccagcaccaccaauuggcugggaag

SEQ ID NO: 180210 - RNA, 27 nt, Homo sapiens
ggccucaugucccccaagaguggguuu

SEQ ID NO: 180211 - RNA, 36 nt, Homo sapiens
auuccgggggacucguggugagagaguugacccggc

SEQ ID NO: 180212 - RNA, 45 nt, Homo sapiens
uaggcauccuccagcuccuucugcuucuuggcaucagcggccgcc

SEQ ID NO: 180213 - RNA, 46 nt, Homo sapiens
acagccggccggcggcacuugcuggccgcgaucuccuccaccuuca

SEQ ID NO: 180214 - RNA, 46 nt, Homo sapiens
gcgguggucaggucccgguauucccgguacauguugugggugccgc

SEQ ID NO: 180215 - RNA, 53 nt, Homo sapiens
acuucuucaucuucuuuaacugagauacaaaguaccagaagcgggacuuggcg

SEQ ID NO: 180216 - RNA, 42 nt, Homo sapiens
ugcccgaggccuucauggcgugcucuccgcguucgccgccac

SEQ ID NO: 180217 - RNA, 48 nt, Homo sapiens
ccacacaggagccauggaaguggcagagcccagcagccccacugaaga

SEQ ID NO: 180218 - RNA, 39 nt, Homo sapiens
cucaccacccuccaacuaccuugcagauuaucugccugg

SEQ ID NO: 180219 - RNA, 42 nt, Homo sapiens
ucccagaagaugauugagauguucgugcggacaaaacacaag

SEQ ID NO: 180220 - RNA, 42 nt, Homo sapiens
cgcaccauccuugucuacagccguccaccuugccagccccag

SEQ ID NO: 180221 - RNA, 44 nt, Homo sapiens
auauuucuucuuugacguuguuuacauccacaauggcacugagg

SEQ ID NO: 180222 - RNA, 43 nt, Homo sapiens
aaucacuuuguguuaauggggaucaucuucauugcaagugaug

SEQ ID NO: 180223 - RNA, 42 nt, Homo sapiens
ccaggcagaugaagacgcgcuggcccagcaguuugagcagcc

SEQ ID NO: 180224 - RNA, 32 nt, Homo sapiens
gggugugugugugugugugugugugugugugu

SEQ ID NO: 180225 - RNA, 43 nt, Homo sapiens
gaccaccugggcgggccguucgcuccggugggcggggccaggu

SEQ ID NO: 180226 - RNA, 62 nt, Homo sapiens
gcuuguauccugcugaccgccucccuucaauccuccuaucaccccacccguuccgggcagug

SEQ ID NO: 180227 - RNA, 52 nt, Homo sapiens
augcgagcaaucuucaagcgcuaugccaagaagcgaaaugugcucauuggcc

SEQ ID NO: 180228 - RNA, 42 nt, Homo sapiens
gagcacauuucgcuucuuggcauagcgcuugaagauugcucg

SEQ ID NO: 180229 - RNA, 45 nt, Homo sapiens
uaggcugcggccaccuggggcgcagagcuggccccguggccggcc

SEQ ID NO: 180230 - RNA, 37 nt, Homo sapiens
uccgccccgacccgggccccgcggcccucgaugaggu

SEQ ID NO: 180231 - RNA, 46 nt, Homo sapiens
caaggcucgcgggaaugaguaucagccgagcaacaucaaacgcaag

SEQ ID NO: 180232 - RNA, 50 nt, Homo sapiens
cagcccucaaggcccugcuccaaucacuagaguccuuccugugcucagaa

SEQ ID NO: 180233 - RNA, 69 nt, Homo sapiens
aggguguggaugggccggcagggaggcgggcgggcggggugcuuacacauggcgggcaggcgggugggc

SEQ ID NO: 180234 - RNA, 51 nt, Homo sapiens
ccaacagaaaacacacacacacacacacacacacacacacacagaacaggc

SEQ ID NO: 180235 - RNA, 37 nt, Homo sapiens
ggccuuuaagguaggggggccaggcugggcucgguuu

SEQ ID NO: 180236 - RNA, 46 nt, Homo sapiens
ucaagcugugcaccgggcugcagcggcccuucggccagcgcgugga

SEQ ID NO: 180237 - RNA, 46 nt, Homo sapiens
gcucacccaggcagagcuggagagcuguaugaagaaguacgaggug

SEQ ID NO: 180238 - RNA, 53 nt, Homo sapiens
gcugagcgcugggggccucgcgucgaggcgcguccaaagcagcggaguuagga

SEQ ID NO: 180239 - RNA, 47 nt, Homo sapiens
agagguggaaguuggauuugagggacugggaacagugcccuaggugg

SEQ ID NO: 180240 - RNA, 49 nt, Homo sapiens
ugagaauguggagagcgagcuacgcuucuucaccucccaggugaggccg

SEQ ID NO: 180241 - RNA, 45 nt, Homo sapiens
ggggucuuugagcuccaaaaaauaaacacuuccuuugagggagag

SEQ ID NO: 180242 - RNA, 90 nt, Homo sapiens
ccagggcugucucccuccagagccucccuccggacaaugaguccccccucuugucucccacccugagauugggcauggggugcggugugg

SEQ ID NO: 180243 - RNA, 45 nt, Homo sapiens
gaaggcccaaggacaaaagaaaguggaggagcuugagggugagaa

SEQ ID NO: 180244 - RNA, 90 nt, Homo sapiens
caaaacucccauuuugaggacccacaugcuuauggguggcccugggagagugugugguuguggcuguucuuuaagguuggagaccauggu

SEQ ID NO: 180245 - RNA, 55 nt, Homo sapiens
cccccggcggcaguggcgccagcagcagaagcagcagcgccaggagcggcugccc

SEQ ID NO: 180246 - RNA, 42 nt, Homo sapiens
auagcgccgugcgcucccgcgggugccgcagccgcucgagug

SEQ ID NO: 180247 - RNA, 46 nt, Homo sapiens
cgcagcacaguugacguguuauccauguugugguccguagccaccc

SEQ ID NO: 180248 - RNA, 54 nt, Homo sapiens
ugccuucgggguacucagagagagcuuccuggaggaggggacguguaagcugau

SEQ ID NO: 180249 - RNA, 56 nt, Homo sapiens
ggcgcaacuucaugacaugcucguagcgugagucagaccaguguuucgggccuucc

SEQ ID NO: 180250 - RNA, 50 nt, Homo sapiens
gaauccagcaugggggcgaccaccgucuuguucucagcgaugagcaggcu

SEQ ID NO: 180251 - RNA, 47 nt, Homo sapiens
ggguagaaggccagguuccuggacgccgccuuccgcaggucgaucag

SEQ ID NO: 180252 - RNA, 46 nt, Homo sapiens
cccgccgguccugccgccgccucagguugaucaugaagaccugcag

SEQ ID NO: 180253 - RNA, 38 nt, Homo sapiens
ucuucuuuuuguggcugcuaauggcagaagugccugug

SEQ ID NO: 180254 - RNA, 68 nt, Homo sapiens
gaaggggcgacaccuuccucccaggaagcugagaccuuuguggucugagcauaagggagugccaggga

SEQ ID NO: 180255 - RNA, 21 nt, Homo sapiens
agcucggcgagcgagaggcgg

SEQ ID NO: 180256 - RNA, 37 nt, Homo sapiens
uguauuuuaauagcaaacuuacaggaacagcacagaa

SEQ ID NO: 180257 - RNA, 43 nt, Homo sapiens
aaaaaacugaacauuuuaauuugagcuuccugguggccuagga

SEQ ID NO: 180258 - RNA, 41 nt, Homo sapiens
gcaccaugaaacgccauucuucacgugaguagccuuugguc

SEQ ID NO: 180259 - RNA, 42 nt, Homo sapiens
agccccgcaaguucuaugugcacaucaagccugccccggccc

SEQ ID NO: 180260 - RNA, 65 nt, Homo sapiens
accguugcauggaccaggagcggcugcggagggagaguaccagccagaaggagauggacaaggug

SEQ ID NO: 180261 - RNA, 58 nt, Homo sapiens
gugcagguacucucgggcgucagccagcuccugcccaagucccgcgagaacuaccuga

SEQ ID NO: 180262 - RNA, 59 nt, Homo sapiens
caggaucucaucaaggacguucuccgcuacggcgaggaacagcucaagacccacaagaa

SEQ ID NO: 180263 - RNA, 43 nt, Homo sapiens
uaauauuaaugacaguauuagugcucuuuaaaucgggucacag

SEQ ID NO: 180264 - RNA, 32 nt, Homo sapiens
auuuucagaaaaaguauaggauaucugcccug

SEQ ID NO: 180265 - RNA, 90 nt, Homo sapiens
aaggaguuguuuguguaagggggaaggagaagguuauaaagggagaaagaaggaagagggagggaaagugagggacagagagagauaaag

SEQ ID NO: 180266 - RNA, 49 nt, Homo sapiens
cggcugggcucggcuccggcgagagcugcacagccgcgccccggccccc

SEQ ID NO: 180267 - RNA, 48 nt, Homo sapiens
guguaaauucccuauggccuggacuccugggugggcuuugacggggaa

SEQ ID NO: 180268 - RNA, 79 nt, Homo sapiens
gcuucugcagggccguggccagucguuccugagcccuguccaacuccuccucaacgagcuggaugcgucgguugagggc

SEQ ID NO: 180269 - RNA, 86 nt, Homo sapiens
ggaggaguuggacagggcucaggaacgacuggccacggcccugcagaagcuggaggaggcagaaaaagcugcagaugagagugaga

SEQ ID NO: 180270 - RNA, 56 nt, Homo sapiens
uuuuuuuuuaaauacuaugauaagcuuugagcucccugggacagagcuucugcaaa

SEQ ID NO: 180271 - RNA, 56 nt, Homo sapiens
gagguccccagggagacaguucagaaguacaggggacagaaggcaagggucggaau

SEQ ID NO: 180272 - RNA, 47 nt, Homo sapiens
cagcaaagcgaagauggcaauaacaaaaggaacuucuuacaagagaa

SEQ ID NO: 180273 - RNA, 47 nt, Homo sapiens
cugcuggggaauguggaauguucuagcucugagauguuaacugagaa

SEQ ID NO: 180274 - RNA, 45 nt, Homo sapiens
uuuauuugaccaaaauguagaaaaagugauacuauuacauaugau

SEQ ID NO: 180275 - RNA, 46 nt, Homo sapiens
gcuggacauaaacuagaacccaggcaucuuccccagaggaucugag

SEQ ID NO: 180276 - RNA, 68 nt, Homo sapiens
cugccggaacuaccguggcgacguggacaugucagagguggagcacuucaugcccauccugauggaga

SEQ ID NO: 180277 - RNA, 46 nt, Homo sapiens
uuucuggcugcugaguggggcaagacuguggggacaggagaggaca

SEQ ID NO: 180278 - RNA, 71 nt, Homo sapiens
gcucugaggguugugaggguuagggggucccuccaugaaccaggaucuuccaggcagcagccccagccucu

SEQ ID NO: 180279 - RNA, 42 nt, Homo sapiens
gcuggacgagcucauggacuucggcuacccccagaccaccga

SEQ ID NO: 180280 - RNA, 46 nt, Homo sapiens
agccaccgucaccaacgcgguguccuggcgguccgaaggcaucaag

SEQ ID NO: 180281 - RNA, 101 nt, Homo sapiens
gggggcccugcucugccgggguggguugcaggugguaggaguacugcugagauagugacccggagggcccagaucuguccuacccucaccccugaccccag

SEQ ID NO: 180282 - RNA, 43 nt, Homo sapiens
cacgcuucgagaaugaccgcaccaucuccuucaucccacccga

SEQ ID NO: 180283 - RNA, 83 nt, Homo sapiens
aaaagccaguucaagcggcggucaacagccaacaacguggagauccacauucccgugcccaaugaugccgacucacccaaguu

SEQ ID NO: 180284 - RNA, 49 nt, Homo sapiens
cuuuacucugagggcacuggagagccaugggaggauuuugagcagggga

SEQ ID NO: 180285 - RNA, 43 nt, Homo sapiens
cuggggaagaggaaugaggagugauugcugauggggacggggu

SEQ ID NO: 180286 - RNA, 46 nt, Homo sapiens
caauguggccaaggucaacacccugauucggccugauggagagaag

SEQ ID NO: 180287 - RNA, 41 nt, Homo sapiens
uccggcggcccaagacacugcgacuccggaggcagcccaaa

SEQ ID NO: 180288 - RNA, 44 nt, Homo sapiens
uauuugggcugccuccggagucgcagugucuugggccgccggaa

SEQ ID NO: 180289 - RNA, 126 nt, Homo sapiens
auaaggcuugggcgggcccggccgcggcccacagagccguccccgcccgcccgcgccccgaccagcccggccucgggcagccacucaccgguguccccguccgcguccuuucuccccgggucccgg

SEQ ID NO: 180290 - RNA, 45 nt, Homo sapiens
aaacgcaccgccacucacaccugcagcuacgcgggcugcggcaag

SEQ ID NO: 180291 - RNA, 50 nt, Homo sapiens
agcccccgucugugacugaaggcccggugggaaaagaccacgauccuccu

SEQ ID NO: 180292 - RNA, 48 nt, Homo sapiens
uugugaugccuugugagaaauaagggccuuaauuuguacugucugcgg

SEQ ID NO: 180293 - RNA, 74 nt, Homo sapiens
uggucugguugcuuggaacuggggccuuggggcacuugggaggaggggggagcggagaguuugauggagggcag

SEQ ID NO: 180294 - RNA, 70 nt, Homo sapiens
acacagcggucagucgaggagaggaagcacccagggcuuccccgccuccucccuacucauagcugcagac

SEQ ID NO: 180295 - RNA, 48 nt, Homo sapiens
aguuaacaauuguucuggaacuaccagaaaugcuaagccaaaugauac

SEQ ID NO: 180296 - RNA, 50 nt, Homo sapiens
auaaaagcaggaacuagaccuagaagguuugaaaaauacagccgcuaaaa

SEQ ID NO: 180297 - RNA, 48 nt, Homo sapiens
ugcagcccuugccuggcagguuuuauguaaaugucaugggagccuuuu

SEQ ID NO: 180298 - RNA, 43 nt, Homo sapiens
aaaauaaucauuaaauuggggagagguuaaaggugacuggcug

SEQ ID NO: 180299 - RNA, 42 nt, Homo sapiens
uggagcuuuggugugggcacuaaguucuucuugccuggaggu

SEQ ID NO: 180300 - RNA, 39 nt, Homo sapiens
gcucuugcccauaaccagaggccuccugggcugcacgug

SEQ ID NO: 180301 - RNA, 43 nt, Homo sapiens
gcccuggucccccgccauccggcaccgguaggcgguggcugcg

SEQ ID NO: 180302 - RNA, 75 nt, Homo sapiens
cgagcccagagagccccugacagcuuuacugaaaccuuucuaaaaauagagauuuuccuugaagccgcugcccga

SEQ ID NO: 180303 - RNA, 46 nt, Homo sapiens
cagugaucccuuuucauccuccagugucuccucaaaaggaucaggu

SEQ ID NO: 180304 - RNA, 53 nt, Homo sapiens
uggaggaugaaaagggaucacuggauucaaaggggucgagcuaaaugaaagga

SEQ ID NO: 180305 - RNA, 52 nt, Homo sapiens
aguggccugaaggcugggaagugaacaagacaggaagaagacuuuggaggag

SEQ ID NO: 180306 - RNA, 50 nt, Homo sapiens
gacgacuucuucaagaaacagacaaagaaugacccauuuaccucggaucc

SEQ ID NO: 180307 - RNA, 42 nt, Homo sapiens
aggcgacccguuccagaaugaccccuuugcagaacagcagac

SEQ ID NO: 180308 - RNA, 34 nt, Homo sapiens
gcucuaguaauucuaacugcauaaguacucauuu

SEQ ID NO: 180309 - RNA, 45 nt, Homo sapiens
ccuagcaaggcugccaccacccuggggcagccaacuuaggggugc

SEQ ID NO: 180310 - RNA, 42 nt, Homo sapiens
gcuaauaaaucaucccagacuuaggccuuacugaggacagau

SEQ ID NO: 180311 - RNA, 29 nt, Homo sapiens
gccaaagucaggguucuuaaagccauauu

SEQ ID NO: 180312 - RNA, 45 nt, Homo sapiens
cuauucucagggaccuaaaacccccaacuucgacccacaagggag

SEQ ID NO: 180313 - RNA, 52 nt, Homo sapiens
acguuacauggaaacuugcaacuggcauccgaaagaaaaacuguuuuuaucc

SEQ ID NO: 180314 - RNA, 73 nt, Homo sapiens
uugggacugaggacuuggcugcugagaaaagaaacacaucaagcauugaacauaaagaggcaagugugguguu

SEQ ID NO: 180315 - RNA, 40 nt, Homo sapiens
gaagggcuccagggaggagcccugggagagaggguggcag

SEQ ID NO: 180316 - RNA, 45 nt, Homo sapiens
uuuaagucagauuccugagauuggauuugcguuuucagugaugag

SEQ ID NO: 180317 - RNA, 46 nt, Homo sapiens
agcucgaggcucagaaacaggaugcucaagaccgccuggacgagau

SEQ ID NO: 180318 - RNA, 46 nt, Homo sapiens
guuucugagccucgagcuccugcaaacugcuuguuucccggucuag

SEQ ID NO: 180319 - RNA, 47 nt, Homo sapiens
caagacauucgagaaaaggaagaggcaaucagacagaaaaccagcga

SEQ ID NO: 180320 - RNA, 29 nt, Homo sapiens
ucugaauguuuaaaaauauuucaugaaaa

SEQ ID NO: 180321 - RNA, 37 nt, Homo sapiens
agcuccuucacgccaguaaacuccccggagccgagag

SEQ ID NO: 180322 - RNA, 41 nt, Homo sapiens
gggcgugccucucuccgaaggcgggaccauguccggcgaga

SEQ ID NO: 180323 - RNA, 45 nt, Homo sapiens
uuggucuuugcuuaacuuccccguuugccucguaucggccagggc

SEQ ID NO: 180324 - RNA, 45 nt, Homo sapiens
cauaugugugcuagaagguucugggugaggcccgagugcaugaag

SEQ ID NO: 180325 - RNA, 46 nt, Homo sapiens
ugaacuggguggugcccguggcagacaagaugcgauuugaugagau

SEQ ID NO: 180326 - RNA, 67 nt, Homo sapiens
cccugugcuguugaggcugcugacgcugccgugggacggcguggagcggaggcugucuuuugguggg

SEQ ID NO: 180327 - RNA, 63 nt, Homo sapiens
gggcuggcaggcaggacggggacggcgccagggaacacagucuucuuucucuuggaggguggg

SEQ ID NO: 180328 - RNA, 45 nt, Homo sapiens
cgagcccuggagaaggagcccgugcccuccgcccugcccccgucc

SEQ ID NO: 180329 - RNA, 48 nt, Homo sapiens
ccaccuccucaucugugaaguggaaggauucuggcaccuuccccaggg

SEQ ID NO: 180330 - RNA, 46 nt, Homo sapiens
ccagcagcccucugauggucacaccgcccucugcagaggcccacug

SEQ ID NO: 180331 - RNA, 99 nt, Homo sapiens
cucccguggugaugagcaaugguugagccauacucccugggcuuucccucagcuguaggucuuuugagagugacauccgguggucaucaaguguucgag

SEQ ID NO: 180332 - RNA, 362 nt, Homo sapiens
aagguuuuuggaacaggggaauauguuuuagaagaugaauccuagccagaugcaguggcugacaccguaauuccaauacuuuaggaggcugagauagaaggauugcuugaggcuagggguuuaagaccugccuaggcagcauagcaagacuucaucucuucaaaaaaaaaauuguuuaauuagcuggguaugauuggugcugcgcuccuguagucccagcuacuugagaggccaaggugggagaauugcuugagcccaggaguuugagguugcagugagcuaugauccuaccacugcacuccagccugggggacagagcgagacccugucucaaaaaucaaaaagaugacuuccacaguggc

SEQ ID NO: 180333 - RNA, 27 nt, Homo sapiens
guaaacuguuaaguguccuaccgauaa

SEQ ID NO: 180334 - RNA, 32 nt, Homo sapiens
gucccggcgcccgggcgggcagggucccgccg

SEQ ID NO: 180335 - RNA, 47 nt, Homo sapiens
agcucugugguagagaauuuccuuuacccaucaggguauggucuggc

SEQ ID NO: 180336 - RNA, 90 nt, Homo sapiens
uccugaaaucucugaaguugcugaaauuuguauauuauuuuccuuuuccaaugcaagaucugcuggugacgggaaaugacugucugguuu

SEQ ID NO: 180337 - RNA, 99 nt, Homo sapiens
gcggagauauuacgggaguugucuauaugauuauauauaguaccugauucuuugaacauauuauugaacuccaaaaugaauucgaccuccauucaggcu

SEQ ID NO: 180338 - RNA, 47 nt, Homo sapiens
ccccgugagccgcaggaggaugcguugccugcagugcagacggccgu

SEQ ID NO: 180339 - RNA, 59 nt, Homo sapiens
guuguacgggacauuguacccagcuugggcaaggagccggaacuucacacagugaggaa

SEQ ID NO: 180340 - RNA, 36 nt, Homo sapiens
aaacagccagaaguugugauggucugggaacggaag

SEQ ID NO: 180341 - RNA, 127 nt, Homo sapiens
gcccugacggcugauguccaaggaccagccgggauggaccagccccaggaggccccaguggaggaaaacaggacgagguuuucaguaagaugaucuuauacuaauucaagggcuauaauuuguucuc

SEQ ID NO: 180342 - RNA, 81 nt, Homo sapiens
gugagcuuccgcucuuuuaaccggacaggcuugacgcccgccucagccaccugcccguccaaguuaaccguauagucucga

SEQ ID NO: 180343 - RNA, 65 nt, Homo sapiens
cauagacccaacaaccugaugccgaggugccuauccgaagucacugcauauuucaucggcacccu

SEQ ID NO: 180344 - RNA, 45 nt, Homo sapiens
gaacaugcuggcacaggguggggauguuccugggaugcugggcag

SEQ ID NO: 180345 - RNA, 2077 nt, Homo sapiens
ucuugggauccggagaguggccgggccggcagagcagggggccgaggacaccaggugagccggggaucuggccuuauggcguggaggaggacgcugcgggucgucugccucgccgcgcagcuuuguccugcccugcacugagcuggcggaaagcugcccacacccgggaguggcuucagccuucggacccgggagcuagcugacgguggggcgggggcgcccggggcgcgauugcagggcuggcggggagcggugcccuccaccugacccgccuggcgccucccaugagagggauaccgcuuggaauccucccagagcaggaacgcugcgcagcgcccccucccuaggaucgugccaacccccuaccccuccgcgcaaggacaauuuccccgucucguaggacagugacaccccuuugugccgccgccuugcaccgugacaggucucacgccaugcggcacccccuccucuuaguucaguggcaccccgcggcucuucuuccuuagaccugugacagcccccgcacccccauggcaccaucuuuucccacaauguccuccccaaggcgaaaagccuaccacccucucauuacucugcaccugaaccccaagcaggcucugucuccccagcuuucccuuauucaccacugucaguucccccggccgguuuuuccuucuuaaagccuugaccuuuuccauacuggaaacccuuaccuuuacguucacuccaccagcccaguuugcugcugugggcucaccugaggacgcugccuggcuuucacugaaggucuuuccccuuaacuaaauguuccauucuugcccaaggccccccucugguucucgggugcccuucgcuaccuaccacucgauaccuguggacuuggugcuuugccccaggcucuaccuccauuuugcaucuccucucccagccuguuugggacugagggaugggaugaguccaccaccuugagagaccgcucaccccucuggaagaccuugacagccacaggaaaaggcuuuauuuuccaguuuagaaaaguccucuaaaguacucccugugaaauuaauaccagggcuaauccaggaaaucuaaaaccaaauuaaugccuuuucucaaacagucuaaauuaauuugacccaaauaauuuggauaauucaggcauccugacaucccugcuucuugcuuauaggcacccaggccagaaaugaguuacuucaugggccuggaaucacgauuucagauggaaggauuucuuaauuuuaugagccugcgccacccccaccccccaguccuuauuuuuauugcauuccagagcuuuuugaaaggggggugguaaucagaaauaacuguaauaagcagcuugggugauggaaguguagucugccagcccuaggaccuuccuccugugcccuuugccugcuuauuccacugccuggaagagguuaagccacacucccggguccacauuagggccuaagggcucccuucucuucuccuuauacccuuuccuggaauguuugaauucugugaauuagagugccggaaguucaggcccugcgaccuucucugaaggguaguggagcccaagagacuggaugcucuaaagguuaugccugggggccccaggccugaaccaacuggaguaaugccuaccgccauuccugcagccgcaggcaggcaggcaagccuuagugagucacuggcgggagcccgagagucugcacaggagggggccgaaaaggaucauuccugagcucagugcuggggagagggggcggggguuacugaugcucagccccaggaaagggagggucaaaauggccuuagaauccugggccuaaucucucucuguuucuuucucccaucuaguguggaauaaacaggaacuggagccuggcugaggggaggggcaugucugggagggcugcagggucacuuacuaaaggguugagucaggaaagaagcuccagugaccugcacagcuccacaggggauguuggcagcgauucugaggucuucuuuuacccugcccccgccuguccuaggucuguucucagagcgaugggccgcggagacu

SEQ ID NO: 180346 - RNA, 1903 nt, Homo sapiens
gaucugccgccaugauuggaggcuuauucaucuauaaucacaagggggaggugcucaucucccgagucuaccgagaugacaucgggugaguccccuggcggagccagcugugccccaccacuccagccccccagccccagcauacaggauuaggucuuuucccaccauuggcuugacuugggccacccugaccccuggcugcacccuggaagcucagcuaguguagccuggcucccauuaggucuggugguauuggcccggcagccagccugccagccccuaggugggaccuguggaauggcauggucccacagcuuuaggaacuccuucccuuccugcauccuguuucucuaguuacagugccuuugcccaggcuggugaauuccuucuuugaggaggaggaggagaaaugucuccagugggugggguuaguggccacgcuggaggcacuaauccaucuaagccuugcucucagaagcccuucccauaucaaacgccuucacuggauucuguugaaagccccuccaggcugcccaauccucuccugcucccuuucucaggagucgucaggcugcugacucagcugucuucaguuccucuggcccauucccuggggaguggcuggaagcgugaggcacucucugggucacugugggagggcagggaagccaugcuacccucucaguagacccagagcagcuccauauccugggccuucacacagagccacagccugccuucucauucugcgcccccuugcacgcccuuguucuuugcgacugaagggaccuauccuagccuccgaggcgcuaaagaguaggcuccucugguuccugcugccuguuuuucuuccucagagagcuugagauaaagucacagaaugggccuguggcagugcucuucauuuggcucccuggcugaugggcuggcuuggcccuugcgggcguuuguccauuggcuggugguguggcaugagcuagagcugcagcuguggcaaggccuggccugucugaaccuggcuggcuacaccccccaccccagacccccuccugccuuggauggacugggcaagccaaggccaggucacacgccgccuugccugucuugucugcuucugccucacggugugugccgcccucccgguguguugugugucuaacccucucucucguugcuaucacucuccucuucuugcuggcgucauuucucucaucccaucucauuggcugccguagcaauagguaagcggccucucaagcugcugcccagguacaggugggugggggccugcccccaucguuuuccugcauccuuuuucauucccucaacuugcucuggaguuggauccugggcaagaauggguagcacaauuccauggccccuugguacuucucccuccuuugugacuucugaagccaugcuggcuuugucuaacaucuggaggagucggcccuccccacuggugggaucacuagcgggaggacugaagaagcagugucucuuucuguccuggaccugggagcuuacagggaagcuagauaaagcugggaaauuagggccagcccugggaguaaggaauaucugucucuaaaccugaugaaccucacuuuauuaagguuacaucagccuuaauaguugacuucccuauuucuuguggccuuuagacacuagcccagcucaggcacucuucccaugccuccacagggagucauaagaagggaaccacuccagugguuuaggcauuggcuuucuuuggagugugugugucagacuucugcagaaaggaggguggggcuguuagcagcugugguugauccuuaugggguaagguucaccugggugcugagcaggcccuaugcacucuuuucccucaggaggaacgcaguggaugccuuucggguca

SEQ ID NO: 180347 - RNA, 76 nt, Homo sapiens
gccauggucuucgaauuccucuauaagaugugugacgugauggcugccuacuuuggcaagaucagcgaggaaaaca

SEQ ID NO: 180348 - RNA, 636 nt, Homo sapiens
gcugaaaaccuucaucacgcagcagggcaucaagagucagguacuugaauugugcagacuauagucaggguggaguccaaucucccuucaucucagcuggccccugagccuugucugagcugacucaugagcccucccaugacaggaagugcuggccugagccuccugccaugauugcaggccgauuuugcucugugugguccucccacugcaggagcagccaauucagcaucucuauuaccaggaauacagcucaagcaguuuccuuuugcacugaggggugggggaggaggccuggucuugaggccugguauuccucaggaggagcgagcuugggcccucuccucuaggauccaagccucauagcuuucuccuccuuuucugccucccuugcugcuucaugugggcaccucguuggcccugcggccuccagcaucagguaagcucuucccucagcuuccacccuugcagcuuugcuuuguuucuccaggcccugcccuuuggggcuuauaggggaaaauggauuacagguggggacuagaagggauggggaaugaggguggaguggggauagagacaggaugauuaaagggacagaggagugaggccauugcuguuuguuucugcccucaugua

SEQ ID NO: 180349 - RNA, 577 nt, Homo sapiens
aggccaaguacaaggccagcgagaaugccaucguguggaagugagucuuuccuucauuaggccacagcagggcucaagaucccaguauacccucuuguuuucagcuuugauccuucugaaugaggggcaggggagugugccuguuugcuuuucuaggagccucugcuuguacugucagucuuuauaccuccaugugaguauguacacgccugcauuuggguucaugcacgugcuuauuuuuuaagaugcuuuggcauuucccuuuguaauguauacauuacaaagggaauacauugccuuuguaauguaucugugaagcagacaaagcaaacgauagcauguccaagugucuaggcagaaacugcauccuguuguucuaaagaaguagacccaaguuuccauagcaagugguuagcaggguccugaccacuucuccuuguucuggcaccuccugcaagcuccugggcucucuccuugcuugaaaugggcaacugcccuugaaacuccuccaagccccaaugggcugcccauugucccuguguucccaggaucaagcgcauggcaggcaugaaggaau

SEQ ID NO: 180350 - RNA, 42 nt, Homo sapiens
caucaugugauaauucaauuuguacaauauauuaugaacuug

SEQ ID NO: 180351 - RNA, 48 nt, Homo sapiens
ucugucucugaaccaaucacugcccaggaagaugcagccccauuacug

SEQ ID NO: 180352 - RNA, 42 nt, Homo sapiens
aggcgggggguugcggccgggccagcgggcgggcgggcugag

SEQ ID NO: 180353 - RNA, 33 nt, Homo sapiens
agaggggagccggggccgggucucggucccggg

SEQ ID NO: 180354 - RNA, 48 nt, Homo sapiens
acgcggcggcuucuccaccucggcaccacuggcauuugggcgggaucg

SEQ ID NO: 180355 - RNA, 61 nt, Homo sapiens
ucugccuugagauucuguaaaacugagaugcucauucucuuaaccaaacacgucacagagg

SEQ ID NO: 180356 - RNA, 62 nt, Homo sapiens
gagcucuguuggaaaugcucuugugagacgggauggaaaggcaagcucggcggccucgggag

SEQ ID NO: 180357 - RNA, 40 nt, Homo sapiens
gcgaggaagauaaaccaggcuggaggcgugcccagagggc

SEQ ID NO: 180358 - RNA, 42 nt, Homo sapiens
gcgaccuacucacagcuuaaaguucagcaccgccccggcauu

SEQ ID NO: 180359 - RNA, 47 nt, Homo sapiens
gggacugcggaauuacgagggcuggcuguuuuacaccggucacauuu

SEQ ID NO: 180360 - RNA, 44 nt, Homo sapiens
gcugcccugaaauaucucacagccgagaacaacagcuagcacca

SEQ ID NO: 180361 - RNA, 45 nt, Homo sapiens
ccgauuuugagccguauguuguugugagacgugacugcccggagu

SEQ ID NO: 180362 - RNA, 42 nt, Homo sapiens
aagcaaugauuguccccgcguucgagacacugcgcuaccggc

SEQ ID NO: 180363 - RNA, 67 nt, Homo sapiens
gaagucaggagagagaggagcagucagguuuggaagcugcugcugucuggcuccaagucacuuaugu

SEQ ID NO: 180364 - RNA, 35 nt, Homo sapiens
cuccggguuuccuaguguuaaucccuccccugggg

SEQ ID NO: 180365 - RNA, 46 nt, Homo sapiens
aggcgggaacuguuuggcugccccagugaggcugaugucaacagug

SEQ ID NO: 180366 - RNA, 30 nt, Homo sapiens
gggcauggauggcugggagauuuaugugca

SEQ ID NO: 180367 - RNA, 46 nt, Homo sapiens
uuuucaaugccgucaucaaacaaaaccccuuccuuguguaccagcu

SEQ ID NO: 180368 - RNA, 47 nt, Homo sapiens
ggagcagauguggaggcugaccgcagagagggagcucaugggcaugc

SEQ ID NO: 180369 - RNA, 37 nt, Homo sapiens
aaaucccaagaugcaaaucgggcagaggucauuguuu

SEQ ID NO: 180370 - RNA, 48 nt, Homo sapiens
agaugccauagagcuaugacauuaucagcagcugcauuuucuuagcau

SEQ ID NO: 180371 - RNA, 32 nt, Homo sapiens
acaauggagaauucugggcucugcccuucaag

SEQ ID NO: 180372 - RNA, 26 nt, Homo sapiens
uuggaagaggcuacaacacagguaaa

SEQ ID NO: 180373 - RNA, 56 nt, Homo sapiens
gaauuaaauaagauugugguugauaagcugcuucacacacugccuggcuucuaguu

SEQ ID NO: 180374 - RNA, 53 nt, Homo sapiens
ucacugugauuuugcagaaccugcaggcaguuuggaaacagcacuggcaaagg

SEQ ID NO: 180375 - RNA, 41 nt, Homo sapiens
aucaagagaugauuccugaaaugacacagucgcagcacgac

SEQ ID NO: 180376 - RNA, 51 nt, Homo sapiens
cucauauaguuauugauuaaaucaguaaauauguauaaaaugcuuagagga

SEQ ID NO: 180377 - RNA, 67 nt, Homo sapiens
aagaaggaguauuuggagcgaaagucuagggaccuucauuaaaaucuagguuucugggccucagcac

SEQ ID NO: 180378 - RNA, 36 nt, Homo sapiens
uagagcagcgcucagcauaaaggacuucaugcacau

SEQ ID NO: 180379 - RNA, 68 nt, Homo sapiens
uggccuggugaccugggagggccucauuggagaacaagaauauuggacacuaucaugaucaacacuag

SEQ ID NO: 180380 - RNA, 40 nt, Homo sapiens
acggucaguaccacaccccuuucucugccccacuccaguc

SEQ ID NO: 180381 - RNA, 106 nt, Homo sapiens
cacacacacacacacacacacgcgcgcgcacgcacgcagcucagggaccugcagaauugccagagaucauugcagugagucaggauuccucugucuugacuuggau

SEQ ID NO: 180382 - RNA, 56 nt, Homo sapiens
gcuuacuccaaacccuccaggaggaaaaucauugucugguaccagauguaauuuca

SEQ ID NO: 180383 - RNA, 45 nt, Homo sapiens
uuuuuuuuuuuagcuuuaccuagaaaguuuuggcagaucagccaa

SEQ ID NO: 180384 - RNA, 65 nt, Homo sapiens
gaaucucucuugccugguuucuuuaccaaaacaaacuacuuuugccaucuggagauuaauucagu

SEQ ID NO: 180385 - RNA, 59 nt, Homo sapiens
aucacuugacuugaguaagccaugaguuccaucuugaugacaucaacacauugccugau

SEQ ID NO: 180386 - RNA, 91 nt, Homo sapiens
aaggcaggaugguauuuaauagauacauuuucauaucugggaccugcaucuugauuauagaucaaauaucacuugcauuuguuuuucuuua

SEQ ID NO: 180387 - RNA, 41 nt, Homo sapiens
ugcugucaccuuccuuuaauggguuccacaucugggcagau

SEQ ID NO: 180388 - RNA, 56 nt, Homo sapiens
ucagccgugagagguuccagguauucccaaaugccacauggaauggauccccagcc

SEQ ID NO: 180389 - RNA, 36 nt, Homo sapiens
gaagaggagaauacagacaaggguugccggcaaauu

SEQ ID NO: 180390 - RNA, 48 nt, Homo sapiens
agcaaucagagaggagaucagaagcucauuuucuagaacccauuugcu

SEQ ID NO: 180391 - RNA, 369 nt, Homo sapiens
uuuaucccgggucagaagaacuucaaagcccauauuuugucuuauuacuacacaucuuaagagauuagagggccgggugcaguggcucacaccuguaaucccagcgcuuugggagggcaaggcagguggaucauuugagccuaggaauuugagaccagccugggcaacauagcaagaccucuucucuacaaaaaaauacaaaaauuagccagguggguguggucccagcuacuugguaggcugaggugggaggaucaccugaaccuggaaaauuugaggcugcagugagcugugaucgugucacugcacuccaguauagguaguggagcgagacccugucucaaaaaaaaaaaaaaaaguuuggaggau

SEQ ID NO: 180392 - RNA, 49 nt, Homo sapiens
aggcaucauuaagguucuccagacugauccacuuuauacauguguguca

SEQ ID NO: 180393 - RNA, 42 nt, Homo sapiens
aacagagcauuuuguagcuuuacuuacaugcacacauguagg

SEQ ID NO: 180394 - RNA, 47 nt, Homo sapiens
ccuggcuauagggauugguuuagggcagauuugugacccaagcugaa

SEQ ID NO: 180395 - RNA, 46 nt, Homo sapiens
augaagugauuacuguugauguuccuauuuuagagauuugggagcu

SEQ ID NO: 180396 - RNA, 40 nt, Homo sapiens
cauuacaaugguggagcuggugaggaggcagguggcuaaa

SEQ ID NO: 180397 - RNA, 45 nt, Homo sapiens
uguaacucucgucacggccucaagguauaugagaguaccuagggg

SEQ ID NO: 180398 - RNA, 63 nt, Homo sapiens
acucuuccugccaaccuggagagagucaucguccuugacacggauaucaccuuugccacugac

SEQ ID NO: 180399 - RNA, 59 nt, Homo sapiens
ggauccccaauaaacauuacucugggauuuauggucugaugaagcuuguccugaccaag

SEQ ID NO: 180400 - RNA, 45 nt, Homo sapiens
gagagaggaagcugagcugagcuccaaaggccagggcuuucauga

SEQ ID NO: 180401 - RNA, 35 nt, Homo sapiens
auuauaauugggugauuuccuugaugucuacauca

SEQ ID NO: 180402 - RNA, 65 nt, Homo sapiens
agcuauauaccuugagaggcauugauugcuacuaaguccaaaacccugaccuuaagguuuucaag

SEQ ID NO: 180403 - RNA, 45 nt, Homo sapiens
ggacaaggcgagggaagcacacuucauacuggaugggggggaccc

SEQ ID NO: 180404 - RNA, 58 nt, Homo sapiens
agcgaaugcauuguggaaccaaaacaugaauuuuggguagucugacucuugagcagcg

SEQ ID NO: 180405 - RNA, 44 nt, Homo sapiens
uuucucuuagacccaaugcccgcuuguuaccaacaucagaaaga

SEQ ID NO: 180406 - RNA, 45 nt, Homo sapiens
uuacaauuuuuuuguggugccauuuugcuugcaucguguugagac

SEQ ID NO: 180407 - RNA, 44 nt, Homo sapiens
agugcacaaaauccacuuuggucugugaguuuugaccaccaagg

SEQ ID NO: 180408 - RNA, 50 nt, Homo sapiens
cuuccgugaucuccucuagcuggaagcguuauuacuugugguugagcaga

SEQ ID NO: 180409 - RNA, 44 nt, Homo sapiens
aagcuauagaaauauuaaaagugaggacaggcuguuacugggug

SEQ ID NO: 180410 - RNA, 101 nt, Homo sapiens
gguagagugcauacgggagcugagagcagaguggggugaugguucagaugagcccuggugggggccagcauggagccuaacagucaacggcaaagggaccc

SEQ ID NO: 180411 - RNA, 46 nt, Homo sapiens
gaucugugauacuaaaaugauaauacuguaccugucucauacaacu

SEQ ID NO: 180412 - RNA, 42 nt, Homo sapiens
uuuauucaugguggcagguguauucgaugaaacuaaagagau

SEQ ID NO: 180413 - RNA, 57 nt, Homo sapiens
auucucaaguuuguuacauuggugccguuuccuuuagggaucagcaaguaucuauga

SEQ ID NO: 180414 - RNA, 50 nt, Homo sapiens
cuguaucaucaaguacagccugcaagauucaaagugugcuggguaccaug

SEQ ID NO: 180415 - RNA, 64 nt, Homo sapiens
gcacuggagacagcgagaaccuucgggcuggcaucguggcaggcaacagcuccgagugugggca

SEQ ID NO: 180416 - RNA, 64 nt, Homo sapiens
cccagguacacggccuccagccagcgggagcgcgagagccuggaggugcgcaugcgcgaggugg

SEQ ID NO: 180417 - RNA, 56 nt, Homo sapiens
gcagcugggcuagaagggaacugcuuuugaaggagacugucuuccaggaagcaggg

SEQ ID NO: 180418 - RNA, 54 nt, Homo sapiens
auaaaaaggaaacagauacguuuauacuugaggagaguguugugauuuguggag

SEQ ID NO: 180419 - RNA, 50 nt, Homo sapiens
agaagacucugcuaccauugaacuuguguucaugagguggagacaggcaa

SEQ ID NO: 180420 - RNA, 47 nt, Homo sapiens
cuugcaagaggguauccccagcuuguuguauagaaguacaaccuuua

SEQ ID NO: 180421 - RNA, 58 nt, Homo sapiens
ugugccuugguagaguucagcagacuguuaaaaaugguaugauuuggauucucuuguu

SEQ ID NO: 180422 - RNA, 44 nt, Homo sapiens
ucaaagucagagcaacagaaaguggaaugguguccaccaggggc

SEQ ID NO: 180423 - RNA, 30 nt, Homo sapiens
cuaucggcugguaaugaauauuauuuaaaa

SEQ ID NO: 180424 - RNA, 40 nt, Homo sapiens
ugcgacgccuccuggaaccuucacucauucaacaaauguc

SEQ ID NO: 180425 - RNA, 45 nt, Homo sapiens
aacauucggccaaggacauagcuggcgggggcccugacaaggggu

SEQ ID NO: 180426 - RNA, 28 nt, Homo sapiens
ucuuaccuuuauuuucugaaaucuggag

SEQ ID NO: 180427 - RNA, 93 nt, Homo sapiens
ccaccuccacacccccagaucauacccucacacugaauuguauuaaugccaguuuccuuuuaguugcuggcuuuguguguguguguggcaggu

SEQ ID NO: 180428 - RNA, 28 nt, Homo sapiens
caaguguacgucugauacuggacuagag

SEQ ID NO: 180429 - RNA, 25 nt, Homo sapiens
uuccuccuucuccucccuccuuucu

SEQ ID NO: 180430 - RNA, 28 nt, Homo sapiens
guuucaggcagggagaagagcaagagau

SEQ ID NO: 180431 - RNA, 68 nt, Homo sapiens
agcuuuagacaaggacgagacaaacccugagacaagugaaaaugggguaucuuggacaacagagaaga

SEQ ID NO: 180432 - RNA, 47 nt, Homo sapiens
uucugcagucacugaagaacuugcagauauagaaacaacugguagau

SEQ ID NO: 180433 - RNA, 64 nt, Homo sapiens
gucuguaguucuuaccuugggacuguuaagagucucuuuaaggucuuggcaucugagagggcag

SEQ ID NO: 180434 - RNA, 358 nt, Homo sapiens
uuggaucaaaaaugaagagcuggccgggcacgguggcucacgccuguaaucccagcacuuugggaggcugaggcgggcagaucacaaggucaggagaucgaaaccauccuggcgaauacggugaaaccccgucucuacuaaaaauacaaaaaaauuagccgggcgugguggugggcgccuguagucccagcuacuugggaggcuggggcaggugaauggcaugaaccuggggggcggagcuugcagugagccgagauggcgcccugcacuccagccugcgugacagagcaagacuccgucucaaaaaaaaaaaaaagaacuuuuucagccaauguuuaauaaguguuagugcugagcu

SEQ ID NO: 180435 - RNA, 27 nt, Homo sapiens
ggaauuugauaguuaauaggauuugua

SEQ ID NO: 180436 - RNA, 70 nt, Homo sapiens
gcuaagaaaugaucgcggcacguugcgaugcgcguugugauggaggaaggcagggugcugugggagaggu

SEQ ID NO: 180437 - RNA, 381 nt, Homo sapiens
uuugucugguuuuuuuguuuuguuuugguuugguuuuuuugagacggagucucgcucuguuaccaggcuggagugcaguggcgcgauuguggcucacugcaaccccugccucccgaguucaagugauucuccugccucaaccucccaaguagcuaggacuacaggugcccgccaccacacucagcuaauucuucuauuuuucguagagaugggguuucaccauguuggccaggauggucuccaucucuugaccuugugaucugcccaccuuggccuccaaaagugcugggauuacaagugugagccacugcgccuggcuguguuguuguuauuauuggaugccugcacuaaacuuggugcugagaauauggagauaacaga

SEQ ID NO: 180438 - RNA, 45 nt, Homo sapiens
gauuagggauugccacuucugagaggaugcugggaaucugcaggg

SEQ ID NO: 180439 - RNA, 52 nt, Homo sapiens
gggaaaagcagaguuggugugggaaagucuagcaguuaaaagaggcagcagg

SEQ ID NO: 180440 - RNA, 64 nt, Homo sapiens
gguuaauauuguaaguggaaaauuuugauuacuucucgauucuuuccucccauuugcuucugua

SEQ ID NO: 180441 - RNA, 45 nt, Homo sapiens
guuuuggaauggauaagcagauguuguguguuagauguuagagau

SEQ ID NO: 180442 - RNA, 43 nt, Homo sapiens
gaguagcaauauugaaucucacuuugauagcuccugguggagc

SEQ ID NO: 180443 - RNA, 39 nt, Homo sapiens
ucggcgacgcuggucaguggugcagccuucucuccaaac

SEQ ID NO: 180444 - RNA, 88 nt, Homo sapiens
guuuucuuucugcaguuucuuuaaugguguguugguauggugcuuuuggugggauaauuuuacuuggaaaauaauguuucugacccau

SEQ ID NO: 180445 - RNA, 59 nt, Homo sapiens
cuccccagacccagacuucuggacacccuagaucguuuugggaagaagaaagaggagaa

SEQ ID NO: 180446 - RNA, 43 nt, Homo sapiens
auaucagaugcuggugagguugcagagaaacugugucuuuggu

SEQ ID NO: 180447 - RNA, 55 nt, Homo sapiens
uugagcagagcuugcagacaaggauagaggaagggagaucaguuaggaaacuagg

SEQ ID NO: 180448 - RNA, 39 nt, Homo sapiens
gguaugcagccaugaagguuguggggucugccccacggg

SEQ ID NO: 180449 - RNA, 91 nt, Homo sapiens
guauagggaugagucauugcuguguccucagaugcggagggcaaggacagggacaaaucaugucgucggaccuaucugaggggugcgugag

SEQ ID NO: 180450 - RNA, 36 nt, Homo sapiens
auaucaucucuuuuauucuaguucuucugcucccug

SEQ ID NO: 180451 - RNA, 16 nt, Homo sapiens
acucccugugccaggg

SEQ ID NO: 180452 - RNA, 56 nt, Homo sapiens
uccuaaguggaagcugugcugaaauugaaaucacuuccuguguucaaagcaccgaa

SEQ ID NO: 180453 - RNA, 35 nt, Homo sapiens
uuuggaaaccacacucuuauuuuauaaacaaggaa

SEQ ID NO: 180454 - RNA, 41 nt, Homo sapiens
cuuugcauuucccggaagauuuuauuggggacaaaaagggg

SEQ ID NO: 180455 - RNA, 92 nt, Homo sapiens
ggggagguaagggagagagacucagguaagugggacuuuagaauccuguaaauacacuucaaucacagaugcgucaccuguguguuuuagau

SEQ ID NO: 180456 - RNA, 56 nt, Homo sapiens
gcaguuuggguaaaacugugaauaucuaauauucuauauuuguguaugcaugaaac

SEQ ID NO: 180457 - RNA, 48 nt, Homo sapiens
accaagaaaacauaccuggauuuaagccccggucucuguuugauaccu

SEQ ID NO: 180458 - RNA, 47 nt, Homo sapiens
uaccaagauagggcugugcuuacugaccuuuuccuugccgcacagau

SEQ ID NO: 180459 - RNA, 42 nt, Homo sapiens
gaggaggucaugguguggcagaugcuggcugggauggugagg

SEQ ID NO: 180460 - RNA, 89 nt, Homo sapiens
agucaagacagcgugcuguguguggagugaccagccucugugggugggcgagugacuggcugaaagguugacgucagagcaugcucuau

SEQ ID NO: 180461 - RNA, 30 nt, Homo sapiens
cugcaucucagcuucccggaaggccccagg

SEQ ID NO: 180462 - RNA, 44 nt, Homo sapiens
aagaaacuugcccaaagucauucaaugaagguuugaacccagau

SEQ ID NO: 180463 - RNA, 44 nt, Homo sapiens
cuccuggcuggcaucugcuucccucaccugccccuuuaucacug

SEQ ID NO: 180464 - RNA, 53 nt, Homo sapiens
uaccuuauuuguagucuuaguugccuuauaugauaaagauuagccuuccuguu

SEQ ID NO: 180465 - RNA, 67 nt, Homo sapiens
ucaaaucucacagguuuccuagacaugcugaagugagguaauucagugcauccuuuuacucugugga

SEQ ID NO: 180466 - RNA, 71 nt, Homo sapiens
ugugucaugucucauggccucuuggauuuguggagagaugggggugauuuguagacgcacgugaggaaaau

SEQ ID NO: 180467 - RNA, 32 nt, Homo sapiens
uaucuuuagaaaucuucuaacccauucuuggu

SEQ ID NO: 180468 - RNA, 38 nt, Homo sapiens
uacucggagagaagaaaauacagaagggagagagaggg

SEQ ID NO: 180469 - RNA, 42 nt, Homo sapiens
cagcaguguggacggacagcugcaguaaugauucguacacag

SEQ ID NO: 180470 - RNA, 42 nt, Homo sapiens
ggggcuugagaaaaagcucacgaaauuaaaaggagaaugaag

SEQ ID NO: 180471 - RNA, 42 nt, Homo sapiens
gagaagagccugacuuaugucucugcuagacuuuagagggga

SEQ ID NO: 180472 - RNA, 43 nt, Homo sapiens
gcuucacauccuucccucauugaacacucagaaaguuaugaau

SEQ ID NO: 180473 - RNA, 804 nt, Homo sapiens
cuuguugcuuuagggaaacugaggcagcacccccccgcccccaccccaaaauuaugaccuccucuguccugaacaaccugaggaauuguugccuaugagggcuggcuuaucacgaagcucaugguccuuuugaauagaucugagaauuuugcagauauaaaauaaauuugaaauagcuuguuguaguuuaaaccuugacagcauuaugugcagugauucuugguuuuugaaacaauuucuugaugauucucaacuugacucagacuccagcauguaccugugagauuuuggugaaguucuguugcagaguuuugagccucaguuuuuucauuucuugcagcuuuuugagccucaguuuuuucauuugugaaacagagauaaaauaugccuccuagaauugcugugcggguuaauuugaaaaaaauaugaagaaaagcucauuuuuuuuuuaagcaccaacuacugugccaagcacucuuuuuagccucuauaugaaugaauucauuugacauuuuaaauccucacauaaaacccuaagauggaauaaacaggagugugagccccgccuugcaucugaggcauuguggaguuugguaacuugcuuagggcuacagggcuggguaggggagaaacuaggauuugaacaccagaauuaugcgcuuaacccugaagcuguaguagcucuguuccuagaauguggcaggugcacaugggucgcuaguuccccucuaucuucagaccacugucguuguucucucccaggccugaggagccagugggccagcugggcugggagggcuuggc

SEQ ID NO: 180474 - RNA, 92 nt, Homo sapiens
ggggucugaaugaggcaagggggaagcaaggggccugccuguugaggagacgagaguucacagaaccguaugcagcuucccauaugcacaga

SEQ ID NO: 180475 - RNA, 46 nt, Homo sapiens
ugaacucucguacgugguagagaagguacgaaacgucuuaagaaag

SEQ ID NO: 180476 - RNA, 95 nt, Homo sapiens
ucaguccuauuugaauugcuugaagaguggggaaggagucauucuaggagagaagcuggguagacagaauggccgaaaauauucaguaggaagau

SEQ ID NO: 180477 - RNA, 27 nt, Homo sapiens
cuccuggggaugaagaagaggccaguc

SEQ ID NO: 180478 - RNA, 47 nt, Homo sapiens
cuuaagcuuuuccugguacugagcacugaaccgcaucugcaccucag

SEQ ID NO: 180479 - RNA, 68 nt, Homo sapiens
ucugcagucucaccccccaccccuggccaccccccauuucaugcaucaucaaucuguaacuuaaucau

SEQ ID NO: 180480 - RNA, 66 nt, Homo sapiens
gcucaccaucagccccuggaaaacuucagcugucauauugggacgcacaaagcuuguuaugaacca

SEQ ID NO: 180481 - RNA, 49 nt, Homo sapiens
cugugacggcugguguuucucugucugaggaggagcuugcuuugagauu

SEQ ID NO: 180482 - RNA, 70 nt, Homo sapiens
ggcuuuguaaaaaggcaaggagaguacaauaccgaaaugcgugcuuucuuuccuccgaguuuguagggau

SEQ ID NO: 180483 - RNA, 76 nt, Homo sapiens
ggcauagaggcaagcccauaggccgguggggcuuuaccuuucuucaggaguggugcuggugcuuaguaggucugca

SEQ ID NO: 180484 - RNA, 47 nt, Homo sapiens
agguuuguuacauucuuauuugggaguugaagccaaguggaggagug

SEQ ID NO: 180485 - RNA, 107 nt, Homo sapiens
cccaggggaucagggguuuagucuuacagcauccugugcuaacuugcugugugaccuuagaauauuucuuggcaucucugggcuucaggcgcugucucuauacauua

SEQ ID NO: 180486 - RNA, 85 nt, Homo sapiens
ggccagacauucaacuauuauuaccagguaaguacuauccugcagacuuguucaagggaugaguuugaacuucccaggagaguag

SEQ ID NO: 180487 - RNA, 42 nt, Homo sapiens
auucucuugggcacaguacagccaagggguaagagauuggaa

SEQ ID NO: 180488 - RNA, 45 nt, Homo sapiens
gcaaaauguuaugugacauucugaaaagacucaguuauaaucucu

SEQ ID NO: 180489 - RNA, 43 nt, Homo sapiens
cuuguggagaacacauuuaucgagccugucccuguuaauucca

SEQ ID NO: 180490 - RNA, 46 nt, Homo sapiens
ucuccugucuucccaccucaggagucagcuuugauagacuuaagau

SEQ ID NO: 180491 - RNA, 44 nt, Homo sapiens
ggaaagggcucguggccgcggccacgggagggcuggggcugcgg

SEQ ID NO: 180492 - RNA, 42 nt, Homo sapiens
uugagcuccugcaaucaacaaccuucuucaccccauaaugua

SEQ ID NO: 180493 - RNA, 47 nt, Homo sapiens
gagcaacucugcccccuccuuuuucauauccugaagaaaaguccccg

SEQ ID NO: 180494 - RNA, 44 nt, Homo sapiens
aauagugaacuuuuacuuauguugucauaucuuagcacacugag

SEQ ID NO: 180495 - RNA, 45 nt, Homo sapiens
gcuugagauuuaucugguaucuuuccaaaacuaaacccugagcug

SEQ ID NO: 180496 - RNA, 47 nt, Homo sapiens
cuuauucuuuucagccuuucgucugcaagucuguguccuccuaccaa

SEQ ID NO: 180497 - RNA, 46 nt, Homo sapiens
uauaggauagugaacuuuacuucuuggggacggacacacacaagaa

SEQ ID NO: 180498 - RNA, 42 nt, Homo sapiens
ccuuuccccuaccccgacuccaagaaccagcgauguguuuau

SEQ ID NO: 180499 - RNA, 46 nt, Homo sapiens; identical to SEQ ID NO: 108267

SEQ ID NO: 180500 - RNA, 46 nt, Homo sapiens
aaaagaaaaaguccagcccacagucuacugauacagcuauggaccu

SEQ ID NO: 180501 - RNA, 38 nt, Homo sapiens
cuaccccuagaggaugguggcucccacaaaucgaaaaa

SEQ ID NO: 180502 - RNA, 46 nt, Homo sapiens
guuucauuuuuuucgauuugugggagccaccauccucuagggguag

SEQ ID NO: 180503 - RNA, 45 nt, Homo sapiens
aaaaugaaacuuauucugucaccaaaggagaagggaagcagcucu

SEQ ID NO: 180504 - RNA, 46 nt, Homo sapiens
ggaacuagaggcuggggaguuagugauagaugauucuuaccgagaa

SEQ ID NO: 180505 - RNA, 90 nt, Homo sapiens
aucccauacgcuggagcagcagcaccuccccugccacuuccuggccuccacacagaugggcauagugaaaaaaaaaagaaaaaagaagag

SEQ ID NO: 180506 - RNA, 45 nt, Homo sapiens
ucuucuuuuuucuuuuuuuuuucacuaugcccaucuguguggagg

SEQ ID NO: 180507 - RNA, 46 nt, Homo sapiens
gcugguuuuccuuuuagccagaucagauuuggggaucucagucaag

SEQ ID NO: 180508 - RNA, 122 nt, Homo sapiens
uuugagaaaacguuguuaaacaccuuccuuguaaguuuuauaauauggccaaacaagcugugaaaucucucaagcauauauacuuucuaauguucucaguauuuaauagugagauugauugu

SEQ ID NO: 180509 - RNA, 111 nt, Homo sapiens
uucccaacuguacaaucaaucucacuauuaaauacugagaacauuagaaaguauauaugcuugagagauuucacagcuuguuuggccauauuauaaaacuuacaaggaagg

SEQ ID NO: 180510 - RNA, 46 nt, Homo sapiens
gacuucuucuggggugacaguacuccuacagaagaggcugagaaca

SEQ ID NO: 180511 - RNA, 110 nt, Homo sapiens
uuuuggaacagaccaggaggaaggaaggaaagagggaaggaaacagggaaggaaggaaggaaagaagggagggcggaagggagaaaugacaaaucuguaucuuccacaug

SEQ ID NO: 180512 - RNA, 41 nt, Homo sapiens
aaauguguacaaauuuuaaauacaaauacaauagggcuggg

SEQ ID NO: 180513 - RNA, 24 nt, Homo sapiens
ucuuucugcuaguuccuuuucucu

SEQ ID NO: 180514 - RNA, 49 nt, Homo sapiens
cuaguaagggaucaaugagugcccaaguguggagguguuucauuuacac

SEQ ID NO: 180515 - RNA, 49 nt, Homo sapiens
caggcuuuugauccucaggcagugagggugauggacaauguuuaaacag

SEQ ID NO: 180516 - RNA, 17 nt, Homo sapiens
cucgagaggaggcaggc

SEQ ID NO: 180517 - RNA, 53 nt, Homo sapiens
agggcuuucugggcaaucuuuuugagcaccuggcccccagacaggucacccag

SEQ ID NO: 180518 - RNA, 72 nt, Homo sapiens
gcgggagcgguagagcugcuugaacuugguggcacuggcaauguuggggaaggugaagaaggccaggcccuc

SEQ ID NO: 180519 - RNA, 52 nt, Homo sapiens
ggugcccgugaggggcucugguccuuggugucaugggucagcagcuccugca

SEQ ID NO: 180520 - RNA, 45 nt, Homo sapiens
caacugucgccaccagaaagcugaguguaaggacccaucggagaa

SEQ ID NO: 180521 - RNA, 43 nt, Homo sapiens
agugagagggcuggaggcccugaaagccuucagugcccacggu

SEQ ID NO: 180522 - RNA, 49 nt, Homo sapiens
acucagggcuuuuggagguuugagacagcugccacauuagggugucuuc

SEQ ID NO: 180523 - RNA, 85 nt, Homo sapiens
acaccgccucuuguuuuucccgcgaaacucggcggcugagcguggagguucuugucuccccugguuugugaagugcggaaaacca

SEQ ID NO: 180524 - RNA, 46 nt, Homo sapiens
auccuggcauuuucuacagcgacagcuucgggggcgacgcccaggc

SEQ ID NO: 180525 - RNA, 46 nt, Homo sapiens
uaccgagugggcaccgaccgcacgggcuucaccuucaaauacaggu

SEQ ID NO: 180526 - RNA, 41 nt, Homo sapiens
aagcggcauuacaaccugggggaguacuggauugaggugga

SEQ ID NO: 180527 - RNA, 45 nt, Homo sapiens
ggaagcugccaaggagguagcugaugaggugacccggccccggcc

SEQ ID NO: 180528 - RNA, 61 nt, Homo sapiens
gacauccaggucaugcucaagucggacgccagcccuuccagcauucguagccugaaggugg

SEQ ID NO: 180529 - RNA, 370 nt, Homo sapiens
cauagcuacaauaacaucacacuuaaaaauuaacauuacggccgggcgcgguggcucaugccuguaaucccagcauuuugggaggccgaggccagugaauugccugaggucaagaguucgagaccagccuggccaacauagugaaaccccgucucuacuaaaaauacaaaaaguuagcuggacaugguggcaguuaccuguaaucccagcuacuugggaggcugaggcaggagaaucgcuugaacccgggaggcggagguugcaguaagccgagauccugccauugcacuccagccuuggcgacacagcaagacucugucucaaaaaaaaaaaaagaaaaaagaaaaaauauuacugccuuauuguccgg

SEQ ID NO: 180530 - RNA, 45 nt, Homo sapiens
aauuccuucaugcagauuacguaaucaggauguaugauuuuccaa

SEQ ID NO: 180531 - RNA, 45 nt, Homo sapiens
agcacuucuaugucugcugccucaccugacuccacaacaugagag

SEQ ID NO: 180532 - RNA, 48 nt, Homo sapiens
caugggcaucuacuccaucaagaaguuuggccugacuaccagcagggg

SEQ ID NO: 180533 - RNA, 51 nt, Homo sapiens
gcucguuacuucaugagguagcccaggauguccuuguguugcucauaucau

SEQ ID NO: 180534 - RNA, 104 nt, Homo sapiens
uaagugaucccuggaacuuccacacauugguccuagcuguggcuccugggcugaggguguuugccuaagugcaggauuaaggcagaaggacugaggucaaauca

SEQ ID NO: 180535 - RNA, 227 nt, Homo sapiens
cuggggaauuacugaaagccaagucuucacuucugugacaggaaauacaagagaagugaaacgcaggguuccaggcaggcagccgccuagugucuaguuggagaaauaagaaaacugugagaccgcuggggacauguggguaaagugguggcuguugugggucacgcaguuccaaggaggugcuaaaggaggucugagaaggaggaggucggggcugggccuugggg

SEQ ID NO: 180536 - RNA, 70 nt, Homo sapiens
aagguuuucugggaggagguuaaucugagcugggcuuugaagagugguggauguggaagaacuuccaggc

SEQ ID NO: 180537 - RNA, 64 nt, Homo sapiens
uggagggccgagugggagucuaggggaugaggggccaggugguguaagaggccuugagugccga

SEQ ID NO: 180538 - RNA, 43 nt, Homo sapiens
ucucaucccccacaucuaaucacucaggaacucuggccagcuc

SEQ ID NO: 180539 - RNA, 71 nt, Homo sapiens
aggccgcagcuuugcuggggccgugagcccccaggaggaggaggaguuccgucgccuggcugcccucccaa

SEQ ID NO: 180540 - RNA, 52 nt, Homo sapiens
uuugggggcacagacaugaagaaggccauugccugccugcucuuugggggcu

SEQ ID NO: 180541 - RNA, 67 nt, Homo sapiens
ucaaccugcugaugcuaggggacccugggacagccaagucccagcuucugaaguuuguggagaagug

SEQ ID NO: 180542 - RNA, 46 nt, Homo sapiens
uccuccuuucucuuggcugcggucaggauggccgaggagaugggag

SEQ ID NO: 180543 - RNA, 59 nt, Homo sapiens
uacugagagucaggaugggguuugggucucacccuggccagaaauuggcugugggcuuu

SEQ ID NO: 180544 - RNA, 43 nt, Homo sapiens
aguccucauccuagcccugaggcuaacuccucuucucugggcc

SEQ ID NO: 180545 - RNA, 47 nt, Homo sapiens
uacacgucugggaaaggcagcagcgcagcuggacugacagccucggu

SEQ ID NO: 180546 - RNA, 47 nt, Homo sapiens
augguccuggccgaugguggggucgucuguauugacgaguuugacaa

SEQ ID NO: 180547 - RNA, 46 nt, Homo sapiens
gcgagaagaugaccguguggcaauccacgaagccauggagcagcag

SEQ ID NO: 180548 - RNA, 49 nt, Homo sapiens
ggcugcugccaacucaguguucggccgcugggaugagacgaagggggag

SEQ ID NO: 180549 - RNA, 51 nt, Homo sapiens
gcacgugagcgcacugacacagacacaggcuguggagggcgagauugaccu

SEQ ID NO: 180550 - RNA, 44 nt, Homo sapiens
gcuacaucaucaugcggagcggggcccgucagcacgagagggac

SEQ ID NO: 180551 - RNA, 55 nt, Homo sapiens
uccuugaucucaaugaugauccauguuucuugauuuaaggccgggcaaaccuaga

SEQ ID NO: 180552 - RNA, 45 nt, Homo sapiens
uaccugguuugaauccugucuccagcacugacugguuggaaaugg

SEQ ID NO: 180553 - RNA, 38 nt, Homo sapiens
gauggccgcuagaacuucagccaucaccuccaggcagc

SEQ ID NO: 180554 - RNA, 42 nt, Homo sapiens
ucagcaagaugaagcugcagcccuucgccacagaggcagaug

SEQ ID NO: 180555 - RNA, 59 nt, Homo sapiens
uguuagaaaugagacagcugacacucgaaggggccuuucccuggugcccaagaucacag

SEQ ID NO: 180556 - RNA, 62 nt, Homo sapiens
acagggguggagggcuucaccagccaggaggaccaggagaugcugagccgcaucgagaagca

SEQ ID NO: 180557 - RNA, 73 nt, Homo sapiens
cucacuggacucauggacucgcccacgccucgccccuccugccgcugccugccauugacaauguugcugggac

SEQ ID NO: 180558 - RNA, 52 nt, Homo sapiens
agauggggggauuccucacccugaguugugaggauugaaugacagaaggcac

SEQ ID NO: 180559 - RNA, 38 nt, Homo sapiens
caacauccccugucauccuccuggugcuggggacaagg

SEQ ID NO: 180560 - RNA, 41 nt, Homo sapiens
gagucaaagagaggaggcagagggucaaagaggcagggaau

SEQ ID NO: 180561 - RNA, 42 nt, Homo sapiens
uucugaaggcgcuugaccucaucgaaggacucccgguuaucc

SEQ ID NO: 180562 - RNA, 61 nt, Homo sapiens
uguguccucccacagaggagaugaaaccaccaaggagcuguggacaagcggacucaggaaa

SEQ ID NO: 180563 - RNA, 41 nt, Homo sapiens
ccacccaaaccaagcuggguguuaugccaggagagaggaga

SEQ ID NO: 180564 - RNA, 65 nt, Homo sapiens
cagcugggggccaacuugugugugugcugggggugggagggggugcagaggcagcugaaccagag

SEQ ID NO: 180565 - RNA, 41 nt, Homo sapiens
gcacugucugggcguccaggacuucggcacugccuaugccc

SEQ ID NO: 180566 - RNA, 45 nt, Homo sapiens
uggagacaggaagggguggugugcaugggugaauggagacaggaa

SEQ ID NO: 180567 - RNA, 71 nt, Homo sapiens
acaggaaggggguggugugcaugggugaauggagacaggaaggggguggugugcaugggugaauggagaca

SEQ ID NO: 180568 - RNA, 45 nt, Homo sapiens
ggagacaggaaggggguggugugcaugggugaauggagacaggaa

SEQ ID NO: 180569 - RNA, 54 nt, Homo sapiens
uugagauuacuuuauggacggacugacuauggaauucuugaguaggguugaaaa

SEQ ID NO: 180570 - RNA, 31 nt, Homo sapiens
auucuuauuguuauuuuuuuuagaccaaagg

SEQ ID NO: 180571 - RNA, 45 nt, Homo sapiens
accagcaagugcuguuauauuugggauggcaguagaaugugcaga

SEQ ID NO: 180572 - RNA, 51 nt, Homo sapiens
guuugcaugaagauuccacuuauuguauguaaagaaaaugauuaaagggua

SEQ ID NO: 180573 - RNA, 41 nt, Homo sapiens
agcaagagaagcuuaucacucuaguguguguguuagugaau

SEQ ID NO: 180574 - RNA, 42 nt, Homo sapiens
cugauaagauugguauuccuguuauuaaagaaggcauacuag

SEQ ID NO: 180575 - RNA, 31 nt, Homo sapiens
uuaggaguucuggggcaggaaacaagaugaa

SEQ ID NO: 180576 - RNA, 63 nt, Homo sapiens
caguguuccugauaaacacagcugacauucuauucuuauaagauuuucagggaaagagaaggu

SEQ ID NO: 180577 - RNA, 46 nt, Homo sapiens
uaugugcugauguuuggguugcuuguggaaucacagacacuccuag

SEQ ID NO: 180578 - RNA, 365 nt, Homo sapiens
gguagggcuggugugguggcucaugccugaauucccagcacuuugggaggccaaagugggaggauugcuugggcccaggaguucaagaccagccugggcaacaaagugagacugucucucuacaaaaauuagcuaggcaugguggugugccccucuagucccagcuacucgggaggcugcggugggaggacggcuugagcucaagaggcugaggcugcugugagccaagguugugccacugcacugcagucugggcaacagcaagacugacccugucucuaaaaauaaauaaagguagaauuuuugauaaguuggaugugggcuaugaaagaggacuccuuuuuuuuuuaggugaaagcagcugg

SEQ ID NO: 180579 - RNA, 34 nt, Homo sapiens
cuuuguguguagcuguggucacugagcaauuggg

SEQ ID NO: 180580 - RNA, 43 nt, Homo sapiens
cuuacacacacacacacacacacacacaccucuaacagaaggg

SEQ ID NO: 180581 - RNA, 44 nt, Homo sapiens
gugguggugguggugauggugguggugguggugcgugcccgcca

SEQ ID NO: 180582 - RNA, 41 nt, Homo sapiens
gucucccagagcaagagccaccaccaccauccaccccacca

SEQ ID NO: 180583 - RNA, 42 nt, Homo sapiens
uauuaauuuuuaugaccugggauguugccugugcgcguguug

SEQ ID NO: 180584 - RNA, 36 nt, Homo sapiens
aagcggagucaggcauccguucagacugacagcaga

SEQ ID NO: 180585 - RNA, 46 nt, Homo sapiens
ucacgguaaguauaaucucguggugguggugcauaaucucuuguau

SEQ ID NO: 180586 - RNA, 45 nt, Homo sapiens
agcuuuccugggcgaucugcuucaaccauuuuuuuuuuugccggu

SEQ ID NO: 180587 - RNA, 55 nt, Homo sapiens
auacaugcagaugucagauacccagcucuuccacuugcuaaaucaggcaaauuug

SEQ ID NO: 180588 - RNA, 35 nt, Homo sapiens
aagccuuuagguucuccauucaauccaagaacgga

SEQ ID NO: 180589 - RNA, 69 nt, Homo sapiens
ugauuucucucacgugccuauggaggagagaacacacauaguuggauugauccauacauaauugggcgu

SEQ ID NO: 180590 - RNA, 49 nt, Homo sapiens
aaaggaaguaggaauggcgaugagauagaucaacaaaacacugaagaua

SEQ ID NO: 180591 - RNA, 47 nt, Homo sapiens
acacgggagugagaaaacauggcccauccagagaaguacaguuugcu

SEQ ID NO: 180592 - RNA, 42 nt, Homo sapiens
ucuuuuuguguguuugugugaaaggugacauuagaucuuuua

SEQ ID NO: 180593 - RNA, 53 nt, Homo sapiens
uagucacaauaacugguaaaauuaaggauucaucaaauuugacucugauguua

SEQ ID NO: 180594 - RNA, 56 nt, Homo sapiens
uaccauuuuucuguuuggaagguugguugcaugucaaaggugucuugauucaaaac

SEQ ID NO: 180595 - RNA, 45 nt, Homo sapiens
aggagagauaucauagagggggaaggauguaaaagaugaguuaaa

SEQ ID NO: 180596 - RNA, 38 nt, Homo sapiens
uagagaguuuacuccaaauuaggaauuaaaacuaugag

SEQ ID NO: 180597 - RNA, 45 nt, Homo sapiens
cucagcugcuuuuucgucuguuggcucagucaucaccaaaaagcu

SEQ ID NO: 180598 - RNA, 28 nt, Homo sapiens
aacuuggaaucaauucucuacaggaacu

SEQ ID NO: 180599 - RNA, 32 nt, Homo sapiens
aaccaggucugcugagaacagacccagucccu

SEQ ID NO: 180600 - RNA, 54 nt, Homo sapiens
uggaauuaugagugaggaagaguguuuacuaaauaaaugacuggggcaagcaaa

SEQ ID NO: 180601 - RNA, 48 nt, Homo sapiens
gguguauuauauucacgguaccaaaugcugaccaguguugcuccauuu

SEQ ID NO: 180602 - RNA, 45 nt, Homo sapiens
ugaaauuacauucagaagagauccaaacaacuauaggccacgaau

SEQ ID NO: 180603 - RNA, 33 nt, Homo sapiens
agcuagaaauucuagacuugauucugugacucc

SEQ ID NO: 180604 - RNA, 46 nt, Homo sapiens
uguucuuagauggaacaccaucaaaaacgaugacgcgauccgcuag

SEQ ID NO: 180605 - RNA, 45 nt, Homo sapiens
uuuguuguggaacaugacuucaucauggccaccuaucuagcggau

SEQ ID NO: 180606 - RNA, 42 nt, Homo sapiens
ccaucugcauauuuggauucugagcaaagacugauggcagcu

SEQ ID NO: 180607 - RNA, 46 nt, Homo sapiens
uauacucacccacaauuugugaccgauguaaugaagccucugcaaa

SEQ ID NO: 180608 - RNA, 48 nt, Homo sapiens
acauuuaucagaaugcuugcuggaagacuuaaaccugaugaaggaggu

SEQ ID NO: 180609 - RNA, 51 nt, Homo sapiens
acauguaaauugauaaggcaguuauuaaucuuauaaauugacuaagaugga

SEQ ID NO: 180610 - RNA, 44 nt, Homo sapiens
auuugagcuagcaauuguagcuggagaguuuacagauucugaaa

SEQ ID NO: 180611 - RNA, 58 nt, Homo sapiens
aagaaguuaaaaagauguguauguauaaauauccaggaaugaagaaaaaaaugggaga

SEQ ID NO: 180612 - RNA, 56 nt, Homo sapiens
auugaaaucagugcagcauacuuaaaagcuuucuauaaacuguaaaggugauuaug

SEQ ID NO: 180613 - RNA, 46 nt, Homo sapiens
gacaacuccauaggcgcuugguacaccauauaaacagcagaugaag

SEQ ID NO: 180614 - RNA, 377 nt, Homo sapiens
gucaguuauucauuaucuaagcucucuuuuuuugagacggagucucgcuguguugcccaggcuggagugcaguggcgcaaucuuggcucacuacaagcuccaccucccggguucacgccauucuccugccucagccuccugaguagcugggacuacagacgcccgccaccacacccagcuaauuuuuuuuuguauuuuuaguagagacgggguuucaccauguuagccagguuggucuugaucuccugaccucaaugauccacccaccucggccucccaaagugcugggauuacaggcgugagccaccacgccuggccuaagcccuguuuuuaugugaaaagacuuaagcucuccagccaggcuagcaagcuuuuua

SEQ ID NO: 180615 - RNA, 46 nt, Homo sapiens
ugacuuauuuccguggaucugaauuacaaaauuacuuuacaaagau

SEQ ID NO: 180616 - RNA, 55 nt, Homo sapiens
aagggagugaucugguggucacuacuaacuaaagcaguuagauaguugagaugca

SEQ ID NO: 180617 - RNA, 25 nt, Homo sapiens
gaagcuaaaccugcuggagaggaag

SEQ ID NO: 180618 - RNA, 42 nt, Homo sapiens
ugcggaggggagcacagaggccaaaucagcucuugccuucac

SEQ ID NO: 180619 - RNA, 42 nt, Homo sapiens
uacggaggucacaaaagugauguuuucaagaggaggagaaac

SEQ ID NO: 180620 - RNA, 37 nt, Homo sapiens
auuguauuuuaaaguaguuucuaaguguuagcaagac

SEQ ID NO: 180621 - RNA, 54 nt, Homo sapiens
gucucaucuggaaagauuauauaaauugcauucuccuugcuuauguggguagaa

SEQ ID NO: 180622 - RNA, 55 nt, Homo sapiens
uaccuuaauuacuuugauugaaagagaaaacauggaacuagaagaaaaggagaag

SEQ ID NO: 180623 - RNA, 45 nt, Homo sapiens
gcugagaauaucauaugguacuaacaaaggaaaaaacuauacuga

SEQ ID NO: 180624 - RNA, 117 nt, Homo sapiens
gcuguguuuugggaaaggugcaacgagcuccaggacauagagaagauuauggcucagauugaaaggggagaggcgagaauucaaagaagaauaagcaucaagaaagcacuugacaca

SEQ ID NO: 180625 - RNA, 56 nt, Homo sapiens
auauagcaagagaaguagaaggcaaaacuccagaagaagucauugaauauucaggu

SEQ ID NO: 180626 - RNA, 70 nt, Homo sapiens
aauuggaauaagagagauuuuaaccaguuuaucaaagcuaaugagaaguggggucgugaugauauugaaa

SEQ ID NO: 180627 - RNA, 48 nt, Homo sapiens
ccucgaaauccugagcugccuaaugcagcacaggcacaaaaagaagaa

SEQ ID NO: 180628 - RNA, 62 nt, Homo sapiens
auaaacuugggucuguuuuucuuuaacaagaaaaaauaagacuucaugaccaaucugguuug

SEQ ID NO: 180629 - RNA, 92 nt, Homo sapiens
ccuccaaaacaacccaauguucaggauuuccaguucuuuccuccacguuuauuugaauuacuggaaaaagaaauucuguuuuacagaaaaac

SEQ ID NO: 180630 - RNA, 51 nt, Homo sapiens
gauugcauucacagaguggauugaaccaccuaaacgagaaagaaaagccaa

SEQ ID NO: 180631 - RNA, 48 nt, Homo sapiens
acuuuacaauggauacagagucaaguguuuauaacuucgaaggagaag

SEQ ID NO: 180632 - RNA, 46 nt, Homo sapiens
cugugaaucuaagaagcugauuguuuuguucucuagacugcagaga

SEQ ID NO: 180633 - RNA, 50 nt, Homo sapiens
aaagugagaucacugaugaagauaucgaugguauuuuggaaagaggugca

SEQ ID NO: 180634 - RNA, 44 nt, Homo sapiens
cagggaggcuuguggaucagaaucugaacaaaauugggaaagau

SEQ ID NO: 180635 - RNA, 50 nt, Homo sapiens
aacugauaacacuguagaagaaagaauaguagaacgugcugagaugaaac

SEQ ID NO: 180636 - RNA, 42 nt, Homo sapiens
uuauacaacagauaugcaucuaguaaccaacaguggcaaaau

SEQ ID NO: 180637 - RNA, 53 nt, Homo sapiens
uuucuacauacagcuuccugugacgguucacaaguaaaaguugguagguagag

SEQ ID NO: 180638 - RNA, 46 nt, Homo sapiens
cuaggacuuugauuccugguuugauacaaacaacugccuuggggau

SEQ ID NO: 180639 - RNA, 45 nt, Homo sapiens
gaaaugcuuauuaaagagaagucuguguucaaaaaauuuaauugg

SEQ ID NO: 180640 - RNA, 45 nt, Homo sapiens
guuacacaggcugcuuuugucagagacguuuuauuaccgggagaa

SEQ ID NO: 180641 - RNA, 49 nt, Homo sapiens
ugaggcuaaaauaauuugaauucaggcuuggguauggguauagcuggaa

SEQ ID NO: 180642 - RNA, 46 nt, Homo sapiens
aagagauggguaccaacacuuagaucuguuuguuugauaggagaua

SEQ ID NO: 180643 - RNA, 42 nt, Homo sapiens
aagacucuucaaacaauuucucuucuuggguacaugaaacau

SEQ ID NO: 180644 - RNA, 46 nt, Homo sapiens
gaagcaaauuuuuaguagucuuagauguuuauugguuaugaaauaa

SEQ ID NO: 180645 - RNA, 47 nt, Homo sapiens
cacgaauaaaaaaagaugagaagcagaacuuacuauccguuggcgag

SEQ ID NO: 180646 - RNA, 45 nt, Homo sapiens
caaacugaccgggcaaauagauucgaguauuuauuaaagcagaca

SEQ ID NO: 180647 - RNA, 45 nt, Homo sapiens
gaugaugcgucaccuggaaagcaaaaggaaauccaagaaccagau

SEQ ID NO: 180648 - RNA, 44 nt, Homo sapiens
acuaauucugauuucuuuguagacauuugugugguagcacagua

SEQ ID NO: 180649 - RNA, 32 nt, Homo sapiens
aguacugagggggcuggaaagaugggggaagc

SEQ ID NO: 180650 - RNA, 45 nt, Homo sapiens
cgaucgccagcggcgggagcaacagcagcaacaaaggcggccccg

SEQ ID NO: 180651 - RNA, 48 nt, Homo sapiens
ccccgccggacucgggccucuggcagcagcgggugacgcagacggaac

SEQ ID NO: 180652 - RNA, 43 nt, Homo sapiens
gagugugcagcuccugggcccggcucaggcccgucgcggaggc

SEQ ID NO: 180653 - RNA, 46 nt, Homo sapiens
cucagucucucuuucguuuuccuuuucccuucccccaacccuccgc

SEQ ID NO: 180654 - RNA, 41 nt, Homo sapiens
gaaagucgguggcguaggucgucguccuggaugcuggcgag

SEQ ID NO: 180655 - RNA, 56 nt, Homo sapiens
ugggacaagagucuuugguuuuauuucagggccuaauaucuguaacagaucaagac

SEQ ID NO: 180656 - RNA, 36 nt, Homo sapiens
gaaucuuuggcugcaaaauuuuaaugaaauguuagg

SEQ ID NO: 180657 - RNA, 46 nt, Homo sapiens
aaauguaauuuauuuagcauucuuuauaaaagaauugaugcuagag

SEQ ID NO: 180658 - RNA, 41 nt, Homo sapiens
ccaaccaguggacucuggauaaauggagacccaccucuaca

SEQ ID NO: 180659 - RNA, 46 nt, Homo sapiens
cucacuaagaucagugaagucaacaucuacagaccaacuuucugac

SEQ ID NO: 180660 - RNA, 42 nt, Homo sapiens
caucacccaguauacaagaugguggucuaaugcaagccucug

SEQ ID NO: 180661 - RNA, 42 nt, Homo sapiens
gcuuccacuuuuugugagguacuccugcaguucaaacaacgu

SEQ ID NO: 180662 - RNA, 46 nt, Homo sapiens
uacaagugacggugagaagacuuuaauagaaaaaauguuuggagga

SEQ ID NO: 180663 - RNA, 46 nt, Homo sapiens
guuuacauuaaauuugauuagaauaguuuauagaagccacuaauau

SEQ ID NO: 180664 - RNA, 47 nt, Homo sapiens
cauguguauaggcucaaaaucuaaacuaaaaguucuuugaacauaaa

SEQ ID NO: 180665 - RNA, 81 nt, Homo sapiens
uuuuuuuuuuuuuuugaguaguuuauccuuuucccacgcucuauucuuuaaaugacuuuaauuuuauaguguguuuuaaug

SEQ ID NO: 180666 - RNA, 25 nt, Homo sapiens
uuacagucucacaggauaacaacaa

SEQ ID NO: 180667 - RNA, 41 nt, Homo sapiens
uugauacacuguaugauguaucauuauucuggauuuccaga

SEQ ID NO: 180668 - RNA, 42 nt, Homo sapiens
aucauuuuugaaagaaugaaccaaauuaaccacaugaggaac

SEQ ID NO: 180669 - RNA, 55 nt, Homo sapiens
uaaauguggcuuuaugcgacagaaguauaauucauauuugcuuagaaauguaaag

SEQ ID NO: 180670 - RNA, 51 nt, Homo sapiens
uucacauagguugcucagugucucauuuccacugaaggaaaguccacaggc

SEQ ID NO: 180671 - RNA, 45 nt, Homo sapiens
gcuaagcagcaugugagaaagaacugcaagagcaccaggucucac

SEQ ID NO: 180672 - RNA, 49 nt, Homo sapiens
agagggaaugaaaaaaagauaagaauagcuucaagguuuuuggcuugag

SEQ ID NO: 180673 - RNA, 46 nt, Homo sapiens
gcaaaguaacaucuaucaaaauaguaaacuucuggacagcugccag

SEQ ID NO: 180674 - RNA, 36 nt, Homo sapiens
auuuaggguccccuagcuaauaaauggugaauugag

SEQ ID NO: 180675 - RNA, 76 nt, Homo sapiens
accuguaaauuacagauaaacaugcuuauuuuauagcacuguugugaagauuaaaugaauuaaucuauaacacugg

SEQ ID NO: 180676 - RNA, 50 nt, Homo sapiens
gagucgaaacggcaauccauaggaaguaucaccuggcugugcaaauacaa

SEQ ID NO: 180677 - RNA, 41 nt, Homo sapiens
uguaaaaugucauuuuguuuggaauguuaagugagcaaaua

SEQ ID NO: 180678 - RNA, 45 nt, Homo sapiens
aauguaguacagguuagacccaacuacuaccuuacuauuauagga

SEQ ID NO: 180679 - RNA, 59 nt, Homo sapiens
aacaguuaugguuuuaauaggaucugaaagacaaucuuuaaagaaaugggagaaauugg

SEQ ID NO: 180680 - RNA, 45 nt, Homo sapiens
uugaaaaugcuuaucuuuguguuuugaucuuccaacagcugagag

SEQ ID NO: 180681 - RNA, 43 nt, Homo sapiens
ggaaaauaagaugcaguguuguauagcacauacauuuaaagug

SEQ ID NO: 180682 - RNA, 50 nt, Homo sapiens
uuggugacuagcuuuuuuguuuuuaaauaacacacuuuaaaaugccacag

SEQ ID NO: 180683 - RNA, 42 nt, Homo sapiens
ugcagguuaucuugucuaugaauuugacaaguuuugguuuga

SEQ ID NO: 180684 - RNA, 33 nt, Homo sapiens
agugggcugaaauugguuuucagggugaugauc

SEQ ID NO: 180685 - RNA, 41 nt, Homo sapiens
acauguuguucagagugaaguggacaaauauguagaugaua

SEQ ID NO: 180686 - RNA, 67 nt, Homo sapiens
ucccucucacuaguaucucccugacuuuuucauuuagaagcugaagaauuuucuuauggcauaagau

SEQ ID NO: 180687 - RNA, 87 nt, Homo sapiens
gucauagguggccccgaugcacaaagacuugucccaggacacuuccccccaaaaacugaugacgaaggccagggcuucacggggcac

SEQ ID NO: 180688 - RNA, 97 nt, Homo sapiens
cugugcugacaucuccccauuggcaggaaacucauccaccucgggcuccuccucuguggcaggcaccaccacgcgggccaggcuggcagugagggca

SEQ ID NO: 180689 - RNA, 41 nt, Homo sapiens
ugacccuguaguccaugucuguuggguggucaugggagaag

SEQ ID NO: 180690 - RNA, 45 nt, Homo sapiens
cugaugucuucgauaagguaaaaaguuugggcugcuguagaacgu

SEQ ID NO: 180691 - RNA, 830 nt, Homo sapiens
gaaggguggccggucgugguggcucaugccuguaaucccagcacuuugggaggcuaaggcgggcagaucaccuggggucaggaguuugagaccagccuggccaacauggugaaacaccaucucuacuaaaaauauaaaaauugaggccgggcauggugucucacacccauaaucccagcacuuugggaggccgaggcgggcagaucacgaggucaggggauugagaccauccuggccaauguggugaaacccugucucuacuaaaaauacaaaaauuagccaggggcgugguggugcacaccuguagucccagcuacucaggaggcugaggcaggagaaucgcuugaacccaggaggcagagguuauagugagccgagaucacaccacugcacuccagccugggcgacagagcaagacuccaucucaaaaacaaaauacaaaaauuaagccgggcacgguggcuuaugccuguaaucccagcacuuugggaggccaaggccgguggaucaccugaggucaggaguuugagaccagccuggccaacauggugaaaccccgucucuacucuacuaaaaauacaaaaauuagccaggugugguggcgcaugccuguaaucccagcugucugggaggcugaggcaggagaauuggcuggaacccaggaggcagagguugcagugaaccaaggucaggccaccacacuccagccugggugacagagcgagacugucugaaaaaacaaaacaaaacaaaacaaagaugugaaggggcaugaguagggguugaccaaagagagguggcagagccaagcuucuaagcagaggagggac

SEQ ID NO: 180692 - RNA, 53 nt, Homo sapiens
cugggcuguuggguggcccugugagagcccgugucugggcagugaggggguag

SEQ ID NO: 180693 - RNA, 46 nt, Homo sapiens
acugcgcccaccaccucauccggcugcucaagugcaagcgugacag

SEQ ID NO: 180694 - RNA, 85 nt, Homo sapiens
caugaaggaguuugagcgggagcggaggcugcuccagcggaagaagcggcgggagaagaaggcggcagaguuggccaaaggccag

SEQ ID NO: 180695 - RNA, 43 nt, Homo sapiens
cuauggaccagucaaauaaaagccuucaggccccucaaccaga

SEQ ID NO: 180696 - RNA, 42 nt, Homo sapiens
cugaaggaguuccgggacuacccgccccugcgcaugcccauc

SEQ ID NO: 180697 - RNA, 45 nt, Homo sapiens
gcuuccucuucagccuacggagcucagcaggugaaacuggcgcuc

SEQ ID NO: 180698 - RNA, 46 nt, Homo sapiens
guggauggccuauuacaucaaucacccucucuacacucccccuagu

SEQ ID NO: 180699 - RNA, 53 nt, Homo sapiens
agguggagccccacgccaccauugcggagaucaagaaccucuucacuaagacc

SEQ ID NO: 180700 - RNA, 44 nt, Homo sapiens
ccaagaaaccuaaaaaggcuguucucuucuucgagguggagauu

SEQ ID NO: 180701 - RNA, 91 nt, Homo sapiens
aucgcgcuugcccggcccagggcugcuucccguggggaggucgguggugggggcugacggccggcagcuggggcugcuggccaccgugggc

SEQ ID NO: 180702 - RNA, 47 nt, Homo sapiens
cucagagaaggucuguggcauggcuccuggggggcgcagucuggggu

SEQ ID NO: 180703 - RNA, 44 nt, Homo sapiens
ucagccauccuggcauuagcagguugacuugauauuucuggaag

SEQ ID NO: 180704 - RNA, 41 nt, Homo sapiens
ggucuuaguuccuagccacuaugccaugcugguccucaaau

SEQ ID NO: 180705 - RNA, 48 nt, Homo sapiens
gggagccugugcugugccgcgcaguuaggcagcagcagccgcggagca

SEQ ID NO: 180706 - RNA, 48 nt, Homo sapiens
acacauacauacguauagauguauacacacauacauacguauauaugu

SEQ ID NO: 180707 - RNA, 45 nt, Homo sapiens
acacauacauacacauauauguguauauguauacacauauacaua

SEQ ID NO: 180708 - RNA, 46 nt, Homo sapiens
ggcucugaaagucuggggugccucugucaaggacagagcugauggg

SEQ ID NO: 180709 - RNA, 45 nt, Homo sapiens
accagucccggacucuauauacccguccggcggaagcuuccagag

SEQ ID NO: 180710 - RNA, 23 nt, Homo sapiens
caguuucccugucugucaaaagg

SEQ ID NO: 180711 - RNA, 43 nt, Homo sapiens
ggauuucugccaccgaagaacucagcaaacauggcaugagggu

SEQ ID NO: 180712 - RNA, 42 nt, Homo sapiens
agcggccaaaguucacguuggugaagccacccaugcccauag

SEQ ID NO: 180713 - RNA, 66 nt, Homo sapiens
gagcauucgaaacgaagacaaaauauugaccaucgaagugaagaagggguggaaagaaggaaccaa

SEQ ID NO: 180714 - RNA, 50 nt, Homo sapiens
agcaguguggccagcaggaggaggggaaggggguuccugggagcacacag

SEQ ID NO: 180715 - RNA, 42 nt, Homo sapiens
ccaccuucucaauggccuucucuucaaaggcagagggcuggg

SEQ ID NO: 180716 - RNA, 46 nt, Homo sapiens
ccgucuggaagcucacucagaaguuuucugaaaucaauccagacau

SEQ ID NO: 180717 - RNA, 45 nt, Homo sapiens
uacagcaagggcuacggccgccccagauagugagugcagcgagau

SEQ ID NO: 180718 - RNA, 49 nt, Homo sapiens
gggccacggcaggagcugcucugugccuucuggaagagugacagcgaca

SEQ ID NO: 180719 - RNA, 45 nt, Homo sapiens
auaucaugaggauccuggccaagagccugccuaaaggccccuuca

SEQ ID NO: 180720 - RNA, 45 nt, Homo sapiens
gcagagacuccaagacaagcucagccgaggucaccauccagguaa

SEQ ID NO: 180721 - RNA, 41 nt, Homo sapiens
gccacagcuccacccacugccucaacaacgugggcagcuau

SEQ ID NO: 180722 - RNA, 95 nt, Homo sapiens
ucugguaggaagaccaucauaagaugcuuugaaggugaaguugaaggucaccaaguggcggcaugugcaauaauggucuucagucugaggcaaug

SEQ ID NO: 180723 - RNA, 112 nt, Homo sapiens
ccccuuccucaucugucacgugcgaguggaagaaggugucacuuccaguucuaagaaggggaaucuccacuaugaccagggagggagcagaugagaguuuuuaguuuuuagu

SEQ ID NO: 180724 - RNA, 57 nt, Homo sapiens
gcacguccuccaaagcagccgaggaggagggggaagauccgcagguucccacaaggu

SEQ ID NO: 180725 - RNA, 50 nt, Homo sapiens
cucaggaaggccccacccuggccuuugcccggaauccuuaggcugggaca

SEQ ID NO: 180726 - RNA, 43 nt, Homo sapiens
gaugcugagaauuuggccagcgagcggccguucugugggaguc

SEQ ID NO: 180727 - RNA, 53 nt, Homo sapiens
ucacggccaguucugcuuagauauggauucucaccaaauccugcuauuuccau

SEQ ID NO: 180728 - RNA, 52 nt, Homo sapiens
ccacaccuggaaccccucugacacccacaccuaccauaaugaaccccaaaac

SEQ ID NO: 180729 - RNA, 412 nt, Homo sapiens
cugugccucaguuuacccuuaagacuggggaggggguacauucuggcuaugagguuuuuuuuuccuuuuuuuuuuuuuugagacagagucucacucugucacccaggcuggagugcagugacccgaucucggcucacugcaaccuccaccuccuagguucaagcgauccuccugacucagccuccuaaguagcugugauuacaggcaugcaccaccaugcccagauaauuuuuguauuuuuaguagagacgggguuuugccaucuuggccaggcuggucucgaacuccugaccucaggggauccaccugccucagccucccaaaaugcugggauuacaggcgugagccacugcacccggccgccaugggguuuaaauuucuacaaagagacuggggauggggauguggagcu

SEQ ID NO: 180730 - RNA, 46 nt, Homo sapiens
ucaaugccaccgccugucgcugcaauccaggguucagcucuuuuuc

SEQ ID NO: 180731 - RNA, 43 nt, Homo sapiens
guucuggccgagggaggaacuagccaagccuuguggccagaga

SEQ ID NO: 180732 - RNA, 89 nt, Homo sapiens
ugggggaggaggucacggggagguccguguuggcugguggcggggggucuccaccgggagauccgguugacuggcgggcugggggagau

SEQ ID NO: 180733 - RNA, 79 nt, Homo sapiens
aagaucuccguggguuaagaaauggaggccgagaaggucuccccaugaaaacggguaccuaggaagagcuccagagaaa

SEQ ID NO: 180734 - RNA, 61 nt, Homo sapiens
aaggggcuggauauugggggucuccagagggaaaaugggaggugugaguaucucacuacag

SEQ ID NO: 180735 - RNA, 89 nt, Homo sapiens
cccaacgaaggagagaaaccagguuccaggguaugugcauuggggcagaaaagcggcagcaacuggugggcgugggguuauugaaauau

SEQ ID NO: 180736 - RNA, 45 nt, Homo sapiens
uauaggccuguagaggaaaagcgagaucauccuucuggccaggac

SEQ ID NO: 180737 - RNA, 45 nt, Homo sapiens
uggaagaagcuagcauauuagaauccaguuuaagagaaugaggaa

SEQ ID NO: 180738 - RNA, 45 nt, Homo sapiens
acuugggaagacacaggccagaguccagccaauucgugcccacag

SEQ ID NO: 180739 - RNA, 42 nt, Homo sapiens
cucuucaccccggggaugcgucccagacugaguucugaccag

SEQ ID NO: 180740 - RNA, 41 nt, Homo sapiens
ucccccgcagcgagcaggggcgacggaaaguugguggugau

SEQ ID NO: 180741 - RNA, 42 nt, Homo sapiens
caagagagcgaaguccucgagccaucagucgagcaggacgca

SEQ ID NO: 180742 - RNA, 44 nt, Homo sapiens
ggaggaugcuagugaguagugagaugggagugcagccacggggu

SEQ ID NO: 180743 - RNA, 33 nt, Homo sapiens
ggagaugggguuccauagauggggaauaaaaag

SEQ ID NO: 180744 - RNA, 52 nt, Homo sapiens
gggagaggacaaaagggaagacaggguuaagauggaacaaaaggacugccau

SEQ ID NO: 180745 - RNA, 45 nt, Homo sapiens
gcacgaccucagggacccugccuaucucccccauggccucugcau

SEQ ID NO: 180746 - RNA, 46 nt, Homo sapiens
accccuccaccagcagcuccucccacucuucacugagggucacucu

SEQ ID NO: 180747 - RNA, 86 nt, Homo sapiens
uuccgcuuuucucuucucugccucccaggucuccucgccuccucccgucuuggcccccucggcccccagcgggcuuucaucuccuc

SEQ ID NO: 180748 - RNA, 36 nt, Homo sapiens
uucuagauucagaucucccuccgucccuugggucuu

SEQ ID NO: 180749 - RNA, 38 nt, Homo sapiens
uggcaaucaugggggguggggggcagaagggccaggcu

SEQ ID NO: 180750 - RNA, 46 nt, Homo sapiens
agagggucgggccugucugugcuggccuggccacugagccuccgcc

SEQ ID NO: 180751 - RNA, 69 nt, Homo sapiens
ggugugucuggggaagguguguccuuuagggccggucgccugggaaggauguugagcggagggcagugg

SEQ ID NO: 180752 - RNA, 44 nt, Homo sapiens
ccacaucauuuuguaacuuuuuuucuauuuauugaacgguguau

SEQ ID NO: 180753 - RNA, 88 nt, Homo sapiens
ccggagacccccacccccgaucuggaaaggaaagagaccuguaucuugguguuuuucuggcuuuuucacccuuucgccuccugucuuu

SEQ ID NO: 180754 - RNA, 47 nt, Homo sapiens
agggugggcucaggguuggggaaguccucgcugcccucucuucucac

SEQ ID NO: 180755 - RNA, 53 nt, Homo sapiens
ggaggcugggaggcaggacuuuccagaaaucgacccucuaagucaauguagca

SEQ ID NO: 180756 - RNA, 42 nt, Homo sapiens
ggagaaccucaaacagaccuacaagggcaagaagaaacucau

SEQ ID NO: 180757 - RNA, 41 nt, Homo sapiens
ccaggcugcccauacuggagacagcauuuccugcuggagaa

SEQ ID NO: 180758 - RNA, 50 nt, Homo sapiens
uauuuugaguuugagaauauucacaugauacaugaaaagauacacaaagc

SEQ ID NO: 180759 - RNA, 43 nt, Homo sapiens
gggggucccuucaguggcuuuggggaggugcuguuccgggaga

SEQ ID NO: 180760 - RNA, 42 nt, Homo sapiens
gguggugcgcaacgaggagcagcugcuggcccugcuggagga

SEQ ID NO: 180761 - RNA, 42 nt, Homo sapiens
ccagcagcccuggcccugucucccccagacucaggccccgag

SEQ ID NO: 180762 - RNA, 200 nt, Homo sapiens
ugacacuucggguguuuuagaaagcguccaguggccaggcaugguggcccaugccuguaaucccuuugggaggccgaagcaggaggaucgcuugagcuccagaggcugcagugagcuaugauugggccacugcacuccagccugggcaauaagcgagaccccaccucaaaaaaaaaaguugaaggugaccauugggugag

SEQ ID NO: 180763 - RNA, 52 nt, Homo sapiens
uccuugggggcccuaaaggcuguuggggcuuuaucuucagagagguggagag

SEQ ID NO: 180764 - RNA, 116 nt, Homo sapiens
ggaaagugagauauugaggagagagaaacaagugaagagaggcagagauggauggagagagggagaggcagacagaggagcagauaggaaggaagacagagagagauugaggagag

SEQ ID NO: 180765 - RNA, 45 nt, Homo sapiens
ugcgucguccugagcccccacugcaaaccagaggaaagggcaggc

SEQ ID NO: 180766 - RNA, 66 nt, Homo sapiens
cagaucccagauaucuggacacaggacagaugaguaguugcaaaucagccuacgggcagagggcga

SEQ ID NO: 180767 - RNA, 25 nt, Homo sapiens
uaagaaaacaaaagggcugcagaga

SEQ ID NO: 180768 - RNA, 56 nt, Homo sapiens
gugagacggagagaagagcaggucccagcugaggaucagagaagcagcugucagcc

SEQ ID NO: 180769 - RNA, 125 nt, Homo sapiens
uagggacaaggguagagguugagacaugguggugaaggugccagaccucaggcuucagguccagaugggguuggguucgggauuaugagcugaagguggaaagugcuccuagagcccuagaccuc

SEQ ID NO: 180770 - RNA, 60 nt, Homo sapiens
gccaggagguccauaccaggccuggaaaugggggaguuggagggaggccuggggccaggg

SEQ ID NO: 180771 - RNA, 76 nt, Homo sapiens
cuuuuuuccccauucauuccugcccucgagccuccagauuccaccuguuccuuggggaccccucucuacuccucca

SEQ ID NO: 180772 - RNA, 51 nt, Homo sapiens
uacguggcugcccccagcucuucaugugaccuccgucuggagaccggcaag

SEQ ID NO: 180773 - RNA, 46 nt, Homo sapiens
cgcgugguugccaacggcgacacagccaacaaggugggcaccuacc

SEQ ID NO: 180774 - RNA, 42 nt, Homo sapiens
cagauccccgccacccuuaucaccgacagcaugguggcugcu

SEQ ID NO: 180775 - RNA, 52 nt, Homo sapiens
acuggggagaagggagugagcagagaaagauuagguagcugugaccaggaga

SEQ ID NO: 180776 - RNA, 45 nt, Homo sapiens
gcaccgaggacaugcuggagaaagaccucagagacaaccgaagca

SEQ ID NO: 180777 - RNA, 55 nt, Homo sapiens
aaugaacggagugacacuucgguggcccuggccgaaggguccaggccccacagca

SEQ ID NO: 180778 - RNA, 42 nt, Homo sapiens
ugcagcccgggaggccgaacgggagggcgcuacggaagaggc

SEQ ID NO: 180779 - RNA, 42 nt, Homo sapiens
cgggggaccgggacucgccgcgcucguggccuucgugcgcga

SEQ ID NO: 180780 - RNA, 46 nt, Homo sapiens
augguccccuuccagaguaacaagagucucaaggugguggucccgg

SEQ ID NO: 180781 - RNA, 56 nt, Homo sapiens
gagugagcgauccccauccuggagacuggacccgcucuagaggcccggacacaccc

SEQ ID NO: 180782 - RNA, 34 nt, Homo sapiens
uugccuggagaugggggguccucagccaugagug

SEQ ID NO: 180783 - RNA, 47 nt, Homo sapiens
uguucuuggcccucaacacaggaaaagaaaaaagccauccaggagga

SEQ ID NO: 180784 - RNA, 47 nt, Homo sapiens
cugcgaaguccaggaucaaggcgcuggcagauccagugucuggugag

SEQ ID NO: 180785 - RNA, 48 nt, Homo sapiens
gacggaccccgccaacugcgacuacgugaucgugaguggcgcccagcg

SEQ ID NO: 180786 - RNA, 25 nt, Homo sapiens
uugaauaaaugaacuaguggacaaa

SEQ ID NO: 180787 - RNA, 48 nt, Homo sapiens
gcggcuugguggcaucuugggaacaggugggguggccacagggcgagg

SEQ ID NO: 180788 - RNA, 74 nt, Homo sapiens
aggacagugcaguguguucacaaggccaguuucugaucguccgccccgaggcugaggaccaguaggcagcuccc

SEQ ID NO: 180789 - RNA, 54 nt, Homo sapiens
aaauacaagcccagggaagcgcagucacugaccaaggucacccagcugaugagg

SEQ ID NO: 180790 - RNA, 46 nt, Homo sapiens
cuuugugguguuccccuucuucuuugucaauaucuuuguggccuug

SEQ ID NO: 180791 - RNA, 35 nt, Homo sapiens
ggaagagagagcccaggaauccuggcugggggcaa

SEQ ID NO: 180792 - RNA, 42 nt, Homo sapiens
uucgccaucagcgccaagccgcugacccgacacaugccgcag

SEQ ID NO: 180793 - RNA, 45 nt, Homo sapiens
cgaauccuccagccacaauacucaccucucccuggaacuggaaca

SEQ ID NO: 180794 - RNA, 45 nt, Homo sapiens
gagggcgucaaccaugagauguccugaagagcccucuccuccuac

SEQ ID NO: 180795 - RNA, 57 nt, Homo sapiens
acccuuggcagacaggauuggcagcaacaucagaguagcagaacucagcucccacug

SEQ ID NO: 180796 - RNA, 40 nt, Homo sapiens
aaacaaaaacaaaaaaacaaaacgggaaugggaacagaga

SEQ ID NO: 180797 - RNA, 42 nt, Homo sapiens
caaggguagucuaccuuguaagccacucuggccggacacuuc

SEQ ID NO: 180798 - RNA, 68 nt, Homo sapiens
aaaggucaucccugaacuucuuguggaugaauggagggaacagagcaucuguccuugggcaccaaggg

SEQ ID NO: 180799 - RNA, 54 nt, Homo sapiens
aagaaaagauuccccaugucccaggcaggggcucuguccaccaugcuugguggc

SEQ ID NO: 180800 - RNA, 55 nt, Homo sapiens
cccguagcccggggcgggucaccgccuacaagcaagggcuggcguacgcuagaga

SEQ ID NO: 180801 - RNA, 41 nt, Homo sapiens
ggcagccacguguucacggggacugucgugcgcgccggguu

SEQ ID NO: 180802 - RNA, 44 nt, Homo sapiens
gccuccaaaccaccaucaacagaguuuuacaugcucauucccuc

SEQ ID NO: 180803 - RNA, 45 nt, Homo sapiens
ucuccagggcugccgaauacagcagcgauggagaacggcaccggg

SEQ ID NO: 180804 - RNA, 46 nt, Homo sapiens
cagucaagguuccaggagagaaggacacgcaaaaaguggucgugga

SEQ ID NO: 180805 - RNA, 23 nt, Homo sapiens
uuucugcuuacuccaacaggaag

SEQ ID NO: 180806 - RNA, 43 nt, Homo sapiens
caccgauaaugcuggucagaauagguuggaucuaugcuuuccu

SEQ ID NO: 180807 - RNA, 46 nt, Homo sapiens
agccuggaccuccgcgccaacugcuaccagcgcuucguggugccgc

SEQ ID NO: 180808 - RNA, 47 nt, Homo sapiens
ccaggcauagacugaaccaauaaagagaugucacgucaccuucuccc

SEQ ID NO: 180809 - RNA, 52 nt, Homo sapiens
gggcuucgccuuccgcucccccagccacuguagggaccccgggccucugggg

SEQ ID NO: 180810 - RNA, 42 nt, Homo sapiens
gcgggcacauggaccccgacguggggguacucaccuguggga

SEQ ID NO: 180811 - RNA, 62 nt, Homo sapiens
acucaugggucugagagguccucucauuaugacugucuguguccugugucuuguaugacugu

SEQ ID NO: 180812 - RNA, 43 nt, Homo sapiens
ccuggguaaugugggguggugugugccaggcagggggugagca

SEQ ID NO: 180813 - RNA, 49 nt, Homo sapiens
cuuggaggacaaaucaagucaguuugggugagggguggaggggcugcag

SEQ ID NO: 180814 - RNA, 74 nt, Homo sapiens
gggugcugcaggaggauguugaggggccgugcguggcaggacugccggaaggagcagaaaugcagaaauggcag

SEQ ID NO: 180815 - RNA, 46 nt, Homo sapiens
cacccccaccccagaacagaaccgugucucugauaaagguuuugaa

SEQ ID NO: 180816 - RNA, 42 nt, Homo sapiens
acaaugguagaguuauaucagagcuuccagauacccagguag

SEQ ID NO: 180817 - RNA, 46 nt, Homo sapiens
ccugcccccaccucaggcaugucccaucccccaccugccgccagag

SEQ ID NO: 180818 - RNA, 46 nt, Homo sapiens
caggguaccucagcacccccagaggccucacccacagcugccccag

SEQ ID NO: 180819 - RNA, 42 nt, Homo sapiens
uauuuaccccauaacccucaaaaccaacgggggaauggcugu

SEQ ID NO: 180820 - RNA, 50 nt, Homo sapiens
ucccuuucuccccugcccccaggacugggccacuucuggguggggcagug

SEQ ID NO: 180821 - RNA, 78 nt, Homo sapiens
uuucuugccucuguccccuucucucaucucuuagcuccccuccaaccuggggggcagugguguggagaagccacaggc

SEQ ID NO: 180822 - RNA, 83 nt, Homo sapiens
uuuuuuuuuuuuuaaacugguauuuuaucuuugauucuccuucagcccucaccccugguucucaucuuucuugaucaacaucu

SEQ ID NO: 180823 - RNA, 49 nt, Homo sapiens
ggccugccuccagggcuggacugaggccugagcgcuccugccgcagagc

SEQ ID NO: 180824 - RNA, 100 nt, Homo sapiens
ggacgaggagcagaggcuuaaggaggaggaagaagacaagaaacgcaaagaggaggaggaggcagaggacaaggaggaugaugaggacaaagaugaggau

SEQ ID NO: 180825 - RNA, 51 nt, Homo sapiens
gacaacuuccucaucaccaacgaugaggcauacgcugaggaguuuggcaac

SEQ ID NO: 180826 - RNA, 79 nt, Homo sapiens
ccccggcagaucgacaacccagauuacaagggcacuuggauccacccagaaauugacaaccccgaguauucucccgauc

SEQ ID NO: 180827 - RNA, 81 nt, Homo sapiens
cccugaugcuaagaagcccgaggacugggaugaagagauggacggagagugggaacccccagugauucagaacccugagua

SEQ ID NO: 180828 - RNA, 120 nt, Homo sapiens
cuccuuggaagacgauugggacuuccugccacccaagaagauaaaggauccugaugcuucaaaaccggaagacugggaugagcgggccaagaucgaugaucccacagacuccaagccuga

SEQ ID NO: 180829 - RNA, 53 nt, Homo sapiens
ugaugaguuuacacaccuguacacacugauugugcggccagacaacaccuaug

SEQ ID NO: 180830 - RNA, 47 nt, Homo sapiens
uggcaccaagaagguucaugucaucuucaacuacaagggcaagaacg

SEQ ID NO: 180831 - RNA, 61 nt, Homo sapiens
gggcggcuaugugaagcuguuuccuaauaguuuggaccagacagacaugcacggagacuca

SEQ ID NO: 180832 - RNA, 56 nt, Homo sapiens
cagcaacaaaggccagacgcugguggugcaguucacggugaaacaugagcagaaca

SEQ ID NO: 180833 - RNA, 37 nt, Homo sapiens
gccgggacaguccccuuggaggaggacagguggagga

SEQ ID NO: 180834 - RNA, 41 nt, Homo sapiens
ggcaaauucguucucaguuccggcaaguucuacggugacga

SEQ ID NO: 180835 - RNA, 45 nt, Homo sapiens
cgggcggcggcguccguccguacugcagagccgcugccggagggu

SEQ ID NO: 180836 - RNA, 59 nt, Homo sapiens
gucccccagacacacucaucauuucccgcugauaucuggaagauugucugugagccuag

SEQ ID NO: 180837 - RNA, 53 nt, Homo sapiens
ggaagucuuaucuccugucuccagccagaccugaucgguuucugucccuggag

SEQ ID NO: 180838 - RNA, 43 nt, Homo sapiens
ccgggccgccagcauaugcgcccagagucucgggcggcggcgg

SEQ ID NO: 180839 - RNA, 41 nt, Homo sapiens
ucccaaacaacucaggaaggagggggacguggcgggaccgg

SEQ ID NO: 180840 - RNA, 65 nt, Homo sapiens
aagggccggcagggagcgagagagggaggagggaggccgcauagaagagagggaggaauuacuga

SEQ ID NO: 180841 - RNA, 65 nt, Homo sapiens
agggccaagguuuaagagaugcagcuuaauguuuagagcccagguagauaggggcgaggcaugag

SEQ ID NO: 180842 - RNA, 45 nt, Homo sapiens
gcgugggcaaaggcuagacgcacggacgaucacacgcguggaccc

SEQ ID NO: 180843 - RNA, 46 nt, Homo sapiens
uucaccucuuugaaggcgccaucaaccaccgcuguggccuugaagu

SEQ ID NO: 180844 - RNA, 46 nt, Homo sapiens
gugaacugagaguccaccgagacgcccagcacuucacagcccagcu

SEQ ID NO: 180845 - RNA, 26 nt, Homo sapiens
gggggauguucagggggcccaagccu

SEQ ID NO: 180846 - RNA, 46 nt, Homo sapiens
acccagccgcacacaggccuagagguaaccaauaaaguauuaggga

SEQ ID NO: 180847 - RNA, 47 nt, Homo sapiens
acauuuugucaccagccagccuggguucaaaugccguuuaagagcug

SEQ ID NO: 180848 - RNA, 61 nt, Homo sapiens
cugguuucucuaccuguuuuucuccacugcucugggggcuuccaaccccgaagccggccag

SEQ ID NO: 180849 - RNA, 41 nt, Homo sapiens
uuuuuccccccgcccucccagcuuggaaaaaaagacaacag

SEQ ID NO: 180850 - RNA, 46 nt, Homo sapiens
gagagaggccaccaggggcccggccguaucccguagcuguguauga

SEQ ID NO: 180851 - RNA, 56 nt, Homo sapiens
gggaucccuggcccugguucggucagucucuuggugcuggggcugggaggugcggg

SEQ ID NO: 180852 - RNA, 41 nt, Homo sapiens
ggcaagucugcguggaaaggacaggugaggccccgccccuc

SEQ ID NO: 180853 - RNA, 42 nt, Homo sapiens
ccacguuccgucucccugugccagcccucaggaccugagcag

SEQ ID NO: 180854 - RNA, 32 nt, Homo sapiens
gaagcugaaggugacaaguggacuccugauua

SEQ ID NO: 180855 - RNA, 45 nt, Homo sapiens
gcgcugacuagccuggcccaggaggcacaggcccugaaggaugag

SEQ ID NO: 180856 - RNA, 43 nt, Homo sapiens
augguggcugaaccagcuugggagcugugggaugggaagaagu

SEQ ID NO: 180857 - RNA, 38 nt, Homo sapiens
ccaagucuugccaggucucaccccaaccauccuucccu

SEQ ID NO: 180858 - RNA, 39 nt, Homo sapiens
ggacggcaguuaccagagcccacggccaggaguccaggg

SEQ ID NO: 180859 - RNA, 49 nt, Homo sapiens
gaauggggcaugcuacagguggccucugggugaaggggaucgggcagag

SEQ ID NO: 180860 - RNA, 44 nt, Homo sapiens
gaggaaaggucaaggcggauccgggaggaaaagggagugggggg

SEQ ID NO: 180861 - RNA, 62 nt, Homo sapiens
aagagggaaccugcgggcaggaaugcauccggaguccucccggggcggggaguggagggcuu

SEQ ID NO: 180862 - RNA, 42 nt, Homo sapiens
ugagcggaugacgggcagcgucuccuccagcuuggaggccag

SEQ ID NO: 180863 - RNA, 65 nt, Homo sapiens
caaagggaugagacugagguugcugcuacugcugggggagccuucccaccugggcacagggccag

SEQ ID NO: 180864 - RNA, 42 nt, Homo sapiens
ggcuccgcccgucucccucgggcagccauuuugucgccaggu

SEQ ID NO: 180865 - RNA, 45 nt, Homo sapiens
uuguucgccaacgacggcagcuuccuggagcuguucaagcggaag

SEQ ID NO: 180866 - RNA, 39 nt, Homo sapiens
ucuucggauccccggggccagcggcggcggccgacuggu

SEQ ID NO: 180867 - RNA, 43 nt, Homo sapiens
cccuucacgggccccgacucccgcugccaagacaggccguggc

SEQ ID NO: 180868 - RNA, 61 nt, Homo sapiens
cccgccccuagaccccaguugucgggaauccaaguuccacacccucagcgggugacccgga

SEQ ID NO: 180869 - RNA, 42 nt, Homo sapiens
guacccggaccuugggucaugggaccaccacuaauugugagg

SEQ ID NO: 180870 - RNA, 99 nt, Homo sapiens
uggaaauagucccagcagcacagguuacugaaugccugguugucugugaagacuguuggagccccuggagcgcaggaagcccucaaucaaugggagaag

SEQ ID NO: 180871 - RNA, 50 nt, Homo sapiens
aagaggccaugccaggcuaggcacagggaaggcaauguugcuugaugucu

SEQ ID NO: 180872 - RNA, 38 nt, Homo sapiens
acauccacagcacuuggcacagggcuuggcauacagua

SEQ ID NO: 180873 - RNA, 42 nt, Homo sapiens
caggcgcugagucgcgugugcuccucucugauugcugcgcag

SEQ ID NO: 180874 - RNA, 27 nt, Homo sapiens
acgggaauaguagccaagaagcagaag

SEQ ID NO: 180875 - RNA, 45 nt, Homo sapiens
cauguacuuggcccacgcgucaccuuuacuuguuaauaccugugg

SEQ ID NO: 180876 - RNA, 95 nt, Homo sapiens
acuuaaaagcagaaggaaaccgagaugcuucccgcagccguggacgauucuccaggacucuuuuuuuaccuugagcacuugccucgugagacuuc

SEQ ID NO: 180877 - RNA, 46 nt, Homo sapiens
agucucacgaggcaagugcucaagguaaaaaaagaguccuggagaa

SEQ ID NO: 180878 - RNA, 55 nt, Homo sapiens
ucucucuggcucuuucugucuuccucuucucacccuccucccuccccuuagccau

SEQ ID NO: 180879 - RNA, 42 nt, Homo sapiens
gagggccagugggacugcuggggucgggcuggaggggaucug

SEQ ID NO: 180880 - RNA, 45 nt, Homo sapiens
aucggguguguguaggggccuguuucgguggggcuugguuggguc

SEQ ID NO: 180881 - RNA, 46 nt, Homo sapiens
cuucggccuagaggguuuucuuggaucugacuucgaggcguugcug

SEQ ID NO: 180882 - RNA, 25 nt, Homo sapiens
ucagggagaggcuuggccagaccug

SEQ ID NO: 180883 - RNA, 41 nt, Homo sapiens
auaucuggcauccacugagcuugaagggcaggaacagggga

SEQ ID NO: 180884 - RNA, 54 nt, Homo sapiens
gaaauuggacuagggcaggaggccucugggaucuggcagaaguuaagggcagag

SEQ ID NO: 180885 - RNA, 49 nt, Homo sapiens
cagccgcugcgagggagguggaagccuucgggcucggagccggggucag

SEQ ID NO: 180886 - RNA, 47 nt, Homo sapiens
cagggccugcagcagguccugcagcugcucaaagacucacagucgcc

SEQ ID NO: 180887 - RNA, 50 nt, Homo sapiens
uaccaagauuuucaguguauucaggggucuauaauccacugaguggccag

SEQ ID NO: 180888 - RNA, 45 nt, Homo sapiens
gaaugggaugaaguacucggaaauugacaucauccugcucaaggu

SEQ ID NO: 180889 - RNA, 26 nt, Homo sapiens
cugcacuggacguccucgccaauguc

SEQ ID NO: 180890 - RNA, 45 nt, Homo sapiens
cagccagccacccgacaugcaccucaagccccugaugacagagcu

SEQ ID NO: 180891 - RNA, 45 nt, Homo sapiens
guauucguacuggcugauccugaguugcccuccccaacugcccau

SEQ ID NO: 180892 - RNA, 45 nt, Homo sapiens
ccuugucuuugccuuugggaaauaccagcacaagaaccugcucau

SEQ ID NO: 180893 - RNA, 42 nt, Homo sapiens
caggaauacauccagaagcugaugcccccacugauccagaag

SEQ ID NO: 180894 - RNA, 43 nt, Homo sapiens
ucuagauguacacccagcacccugagcaguaugaggcucccga

SEQ ID NO: 180895 - RNA, 65 nt, Homo sapiens
cguagcacuggaucugcucagcggccuggccgagggccuggguggucacguggagcagcuggugg

SEQ ID NO: 180896 - RNA, 69 nt, Homo sapiens
agagcuccuuugcccuccugggagaccucaccaaagccugcuucauccaugucaagcccuguaucggua

SEQ ID NO: 180897 - RNA, 96 nt, Homo sapiens
ccagccgaguucaugcccauucugggcaccaaccugaacccagaguucaucuccgucugcaacaacgccaccugggccauuggugaaaucugcaug

SEQ ID NO: 180898 - RNA, 35 nt, Homo sapiens
acuugggcagcguguugucaccuuagcgacuccag

SEQ ID NO: 180899 - RNA, 57 nt, Homo sapiens
ugcagccuuaugugcagaugguccucaacaaccugguggaaaucauuaaccgaccca

SEQ ID NO: 180900 - RNA, 43 nt, Homo sapiens; identical to SEQ ID NO: 108857

SEQ ID NO: 180901 - RNA, 42 nt, Homo sapiens
ugcaugaugaucggugucaacccggggggcguugugcagguu

SEQ ID NO: 180902 - RNA, 41 nt, Homo sapiens
ugcgcugcauccggaagucgcugugcccugguugagggggg

SEQ ID NO: 180903 - RNA, 41 nt, Homo sapiens
gggucaucucuggcagcccacuugggccagcuacgugggag

SEQ ID NO: 180904 - RNA, 75 nt, Homo sapiens
ggcgaggcugggccagccgcuccaccauuuccccgacugcauggagacaguagaauuagugaaccccugaguuaa

SEQ ID NO: 180905 - RNA, 46 nt, Homo sapiens
cagaggacacagguuuuugccagcaaaaaggaaaaccaaggcuugg

SEQ ID NO: 180906 - RNA, 65 nt, Homo sapiens
aaccuuccggaauagucugggaacauggucaagguggaaggggcuccccuagagagggugggggu

SEQ ID NO: 180907 - RNA, 38 nt, Homo sapiens
aagauggggggauacaaacaccuucagggaaggggagc

SEQ ID NO: 180908 - RNA, 43 nt, Homo sapiens
cagacuggccuugagccacagucccucuuucccuccucacccu

SEQ ID NO: 180909 - RNA, 45 nt, Homo sapiens
uuuguuacugugcugugcuggggauuggcgccgagguggcgugag

SEQ ID NO: 180910 - RNA, 42 nt, Homo sapiens
ucuucuccuugaaggaguugguggcggccgggaugcccacaa

SEQ ID NO: 180911 - RNA, 42 nt, Homo sapiens
agauggaugccuucaugcaugagaagaacgaggacugagcgg

SEQ ID NO: 180912 - RNA, 55 nt, Homo sapiens
cagggguuggugacugccuagccuggcaugcggagugggggaucgucaucugggg

SEQ ID NO: 180913 - RNA, 45 nt, Homo sapiens
cgcauccagcaccucguagccguggccgcuguacguccgcagcag

SEQ ID NO: 180914 - RNA, 46 nt, Homo sapiens
gcgccccugacccucgagccugucgcagguacaagcccccgccgag

SEQ ID NO: 180915 - RNA, 44 nt, Homo sapiens
cacaugcugaagaucaugcccagcagguucauguaguccggcgu

SEQ ID NO: 180916 - RNA, 49 nt, Homo sapiens
cugaggauucugcagauaggacaucaccacggcagagauggacagccug

SEQ ID NO: 180917 - RNA, 43 nt, Homo sapiens
gggcuuuggcugcuaaaccugcugccuucagcugccauccugg

SEQ ID NO: 180918 - RNA, 34 nt, Homo sapiens
ggcuuaccccuccugccucccuuccccugccugc

SEQ ID NO: 180919 - RNA, 47 nt, Homo sapiens
uucgacggcuucuucuuugggcgccuugauuaucaagauaagugggu

SEQ ID NO: 180920 - RNA, 44 nt, Homo sapiens
acaaauuugaagugucauggugagcuguguggacucugggucag

SEQ ID NO: 180921 - RNA, 60 nt, Homo sapiens
gucugugguguguuggggcccagggguggugagggaaauuugcugauuacaugagugugg

SEQ ID NO: 180922 - RNA, 42 nt, Homo sapiens
caugcagcugacugugcugacugaccgcucccaggggggcag

SEQ ID NO: 180923 - RNA, 46 nt, Homo sapiens
uuucuuuugacauucccacacgcccuuacccaguuucuggcccaag

SEQ ID NO: 180924 - RNA, 45 nt, Homo sapiens
gcugcugaaggacgauggacgcggaguaucggagccacuaaugga

SEQ ID NO: 180925 - RNA, 28 nt, Homo sapiens
guaggcguuggcggaaugaacggaaagu

SEQ ID NO: 180926 - RNA, 72 nt, Homo sapiens
gcuuuauuucgaaccccggaucccgcuucccaucucaacgcuuuuacaggagcugucgccccugccugggcu

SEQ ID NO: 180927 - RNA, 66 nt, Homo sapiens
uaggcgaaaaucaccuuggggacuugcaaauuacugggucccaggccgaguuacugaucagcaggc

SEQ ID NO: 180928 - RNA, 70 nt, Homo sapiens
cacccgccagaggcuuguuugaggcccgcggggacugggcgggcggaggccgggcugccgaagugugagg

SEQ ID NO: 180929 - RNA, 56 nt, Homo sapiens
cagaauuccuuccuuuaggccccucuggagccuuggccgaccagccacuucugugg

SEQ ID NO: 180930 - RNA, 41 nt, Homo sapiens
uggggaguucugggcauuuggggaagggggcuggugcugua

SEQ ID NO: 180931 - RNA, 62 nt, Homo sapiens
acagccuugcuuccccuugccagcuuaaacagugcccuucuugcgagagccacauuucccca

SEQ ID NO: 180932 - RNA, 44 nt, Homo sapiens
ugcccaggguaucaaaaagccauucacagaggucauccgagcca

SEQ ID NO: 180933 - RNA, 49 nt, Homo sapiens
cuccccuucugcugcagagagcccagcgucuuccccucccacucccaag

SEQ ID NO: 180934 - RNA, 48 nt, Homo sapiens
gguggaugaagccaagacaggugguuaagcaguuucccacaguuccaa

SEQ ID NO: 180935 - RNA, 59 nt, Homo sapiens
uuagaggccaugcugaggauuugggucauugugcuaagaacaacagggagccacugaag

SEQ ID NO: 180936 - RNA, 43 nt, Homo sapiens
guuagaaucacaaagggaacuuugaaaaaugucaaaauugagg

SEQ ID NO: 180937 - RNA, 42 nt, Homo sapiens
gacauaaguaauuuuuauaaagaauaacuuuaugagugggca

SEQ ID NO: 180938 - RNA, 45 nt, Homo sapiens
acacacugugaccaggguggcuuaaaggugucagaguggacuggg

SEQ ID NO: 180939 - RNA, 398 nt, Homo sapiens
ucccgcuggaguuccccauaggacagugguauuaggccauucuugcauugcuauaaagaaauaccugagacuggguaauuuuuaagaaaagaggcuugauugguucacaguucugcagacuguacaggaagcauggugguaucagcuucuggggaugccucaggaagcuuccagucaaagcggaaggugaagggggagcacgcacaucgcauggcaagagcaggaacaagagagagaaucagggcggggcaggggaugccgcagacuuucagggucugcucccuugacccaaacaccucccacuagacccaccuccaacauggggauuacauuucaaugugagauuuggguggggacaaacauccaaacuacgugaacagucgugaucugucacucaa

SEQ ID NO: 180940 - RNA, 52 nt, Homo sapiens
gucuguucauucagcuaauguuuacugagcacuuacgaugaguccggcacug

SEQ ID NO: 180941 - RNA, 53 nt, Homo sapiens
uacagaggaggcuacauggaggugaucaaccugcacccugagaucaagggcca

SEQ ID NO: 180942 - RNA, 46 nt, Homo sapiens
aaggagucgguccuggguaaucuggccaaaaaagcaaagcugacgg

SEQ ID NO: 180943 - RNA, 30 nt, Homo sapiens
ugugugcagaccccagggccccauuuucag

SEQ ID NO: 180944 - RNA, 38 nt, Homo sapiens
gcaggaagccacugcugaugccuguugaguggcugccu

SEQ ID NO: 180945 - RNA, 73 nt, Homo sapiens
guuauuguuuuugcuucuggaaaguucauuugggguuuacaacaacuaggauguguugggugagauguuucag

SEQ ID NO: 180946 - RNA, 46 nt, Homo sapiens
gugacuuaaccguggugagggcuggaaauccaaacucaccaccaug

SEQ ID NO: 180947 - RNA, 44 nt, Homo sapiens
auccgguccuuugaacagaagggccuggaaggccccuggggcug

SEQ ID NO: 180948 - RNA, 45 nt, Homo sapiens
aaacagaaacucccaacuguccuuacccaccgacaucacagcccc

SEQ ID NO: 180949 - RNA, 44 nt, Homo sapiens
agugacauggcaggaugaugacuauagaugauacagcacuccca

SEQ ID NO: 180950 - RNA, 46 nt, Homo sapiens
ccucauguucuuucuccuguagcaaaagaacaaugucuccggguuc

SEQ ID NO: 180951 - RNA, 46 nt, Homo sapiens
ucuguuguaccaucccuggagccagcugucugaucaugaugcgcac

SEQ ID NO: 180952 - RNA, 34 nt, Homo sapiens
gcucguucucgcuggcgccgggcgggacgcccag

SEQ ID NO: 180953 - RNA, 31 nt, Homo sapiens
cagcgagggggaagcgggggcggggcugaac

SEQ ID NO: 180954 - RNA, 53 nt, Homo sapiens
ggaccaggagauggaacuagaagcauuacgcucuauuuaugaaggagaugaaa

SEQ ID NO: 180955 - RNA, 40 nt, Homo sapiens
gccagguuuauaauaagcuagagcuuccccggcacgccgu

SEQ ID NO: 180956 - RNA, 58 nt, Homo sapiens
ugcuaugaagaucuccugagugcugucuuugaaugccuggcgcacaguaccccuggaa

SEQ ID NO: 180957 - RNA, 44 nt, Homo sapiens
gggcagcaagacaguacacaaucaguggcagcagcaccagccag

SEQ ID NO: 180958 - RNA, 48 nt, Homo sapiens
uucuggcagaagcacuggaaaggagacgaggacucaggcugggccuuc

SEQ ID NO: 180959 - RNA, 49 nt, Homo sapiens
caucugcagagcccacaggucaugggaaacauguggcugcagggagagu

SEQ ID NO: 180960 - RNA, 54 nt, Homo sapiens
cuagaaguauguuacuggaagguaaaucuggccacacugcagcaucuggacggc

SEQ ID NO: 180961 - RNA, 111 nt, Homo sapiens
gguguggaagaagggaggggccccaugcaagcugcaggucuggggagccugaggaugucauagggcuuccugguagaguggaaagugcacuccugaaggucagggccaguc

SEQ ID NO: 180962 - RNA, 47 nt, Homo sapiens
cuuccuccagaacuacugggcaagcaucugccgggucaugcccggua

SEQ ID NO: 180963 - RNA, 96 nt, Homo sapiens
ggaaguggagagugggaggugaggggaagcacuagcaaugaaugaagaggauucuuccgggaaucaggcuguuucaaucuaaaacauccaagauaa

SEQ ID NO: 180964 - RNA, 53 nt, Homo sapiens
gaacagacggaggugagccagagacaccuccugggcaagucggccaggaggcg

SEQ ID NO: 180965 - RNA, 47 nt, Homo sapiens
ugcgccccgcagagcugcagccagaugcgcgcgggcagcggcuccuc

SEQ ID NO: 180966 - RNA, 44 nt, Homo sapiens
ugacuucccugcuugcgauucuuaauugcuuaauuguaagaggu

SEQ ID NO: 180967 - RNA, 45 nt, Homo sapiens
cccaggagcaugcaugcgacccaugauggcggcagucaggcagug

SEQ ID NO: 180968 - RNA, 58 nt, Homo sapiens
caacaguuucccuucuacucuguuaggccccagggaagugugaaugagaagaaauaag

SEQ ID NO: 180969 - RNA, 49 nt, Homo sapiens
cuuucagagaaacguuuuccuggcccaauauucaggaaugaauuuuauu

SEQ ID NO: 180970 - RNA, 46 nt, Homo sapiens
agauuaaagcaaaauuaaaccuugacuauucacacguauguuacag

SEQ ID NO: 180971 - RNA, 47 nt, Homo sapiens
cacgacuugaaacuuccuacauguucucuaacuguaucuggguaaaa

SEQ ID NO: 180972 - RNA, 93 nt, Homo sapiens
guguuuccucucugacuggcucguagccggaagggaggcagggagagggcgaaggcaggaaggggagugagaaagaggcugaaauuaagaggg

SEQ ID NO: 180973 - RNA, 51 nt, Homo sapiens
acgaacaaacaaaaagccccugaucccuccuggacccagcugccaggacac

SEQ ID NO: 180974 - RNA, 56 nt, Homo sapiens
cuaccccucacccuccggggcuaaaugcugcuagcucaaaaacccacaguccgcac

SEQ ID NO: 180975 - RNA, 81 nt, Homo sapiens
ccgggaacacagcgcggaggggacgcuagucgcggaggggacgcuagucccggagugcgaggaagagguguaguguccaga

SEQ ID NO: 180976 - RNA, 43 nt, Homo sapiens
uauuuaguccauuugcucauaaagcagaagagaaaagcuacuu

SEQ ID NO: 180977 - RNA, 148 nt, Homo sapiens
gaauuugacaacuggcaaaacaaaacaauagccuacaauugcagagugcugucuguuuaaaaaccaacauaucuuucaccaacaaauacauauucaccucaacacgagacuuucaugugguuauuaauaucaaauuuuugaaugucca

SEQ ID NO: 180978 - RNA, 27 nt, Homo sapiens
cuguccuucaaaaacacacuuccgcug

SEQ ID NO: 180979 - RNA, 70 nt, Homo sapiens
uuuaguauuuuaaauuuuuuuaaaucacauuuuauugagauaaugcuauuaguguuucuuucccaucacu

SEQ ID NO: 180980 - RNA, 47 nt, Homo sapiens
cucaaggaguuccuggucuaguagagaaucacaucacuuuauaguug

SEQ ID NO: 180981 - RNA, 37 nt, Homo sapiens
aaaauugagcuuggcaggagaaaucagggucaggaac

SEQ ID NO: 180982 - RNA, 51 nt, Homo sapiens
uccuuuaaucccuacagcaacccagugaggauggcuucacaauuuuccuau

SEQ ID NO: 180983 - RNA, 45 nt, Homo sapiens
gcaaaaaauuaaagugguuugccuaagguuuccagauaauaggug

SEQ ID NO: 180984 - RNA, 46 nt, Homo sapiens
cuuuggccugucuuuucaauuuguuuauggugucuuuugucaccau

SEQ ID NO: 180985 - RNA, 46 nt, Homo sapiens
uuauaagccuuacuggaaaaaaaaagucaauuauuuuuuagacuca

SEQ ID NO: 180986 - RNA, 27 nt, Homo sapiens
aaagaaagauaauauggagauguaaaa

SEQ ID NO: 180987 - RNA, 42 nt, Homo sapiens
ccucuuuggggaaaugacauuugaacagagguuuaaaugaag

SEQ ID NO: 180988 - RNA, 28 nt, Homo sapiens
auuugccauuuuuacuguccccauacau

SEQ ID NO: 180989 - RNA, 51 nt, Homo sapiens
uaaacauuuugacauuucccuccuaaauauuucagugugcuucuccuaagg

SEQ ID NO: 180990 - RNA, 45 nt, Homo sapiens
acaagggcaggaucucugacucuccuucgcuuaccagaucugccu

SEQ ID NO: 180991 - RNA, 57 nt, Homo sapiens
uucauucauucauucauucauucauucccuugauauuaccauucauuuauucaucaa

SEQ ID NO: 180992 - RNA, 26 nt, Homo sapiens
ggacaauagcagaguggcagaaaugg

SEQ ID NO: 180993 - RNA, 43 nt, Homo sapiens
gaaauuucauuccuuuuccuggaaacaccaaucugcucucauu

SEQ ID NO: 180994 - RNA, 60 nt, Homo sapiens
auuuacaagaucucuuccagcucuaaccuucuauaaggaaacuggcaucauggcaaagag

SEQ ID NO: 180995 - RNA, 41 nt, Homo sapiens
ugcaguaguagagcagugucuauauucaacaaagaagggug

SEQ ID NO: 180996 - RNA, 44 nt, Homo sapiens
guagcucagcaccuguuuuuucugggucuuaaaucugugauuaa

SEQ ID NO: 180997 - RNA, 50 nt, Homo sapiens
uauuaauucuugaaguuuucaucuccauuuacuaagaaacaguaacgcac

SEQ ID NO: 180998 - RNA, 47 nt, Homo sapiens
acuuauuuuuugccucguagcauauuguuugcagacagugacugagg

SEQ ID NO: 180999 - RNA, 51 nt, Homo sapiens
cuaagaaaauaguaucuguggaguaagcccuugugacucagccccuguggg

SEQ ID NO: 181000 - RNA, 60 nt, Homo sapiens
gguuaguguuuggagagaucacucaggcagcuggaggaagggagagcacaggggccuggc

SEQ ID NO: 181001 - RNA, 43 nt, Homo sapiens
ugcuacguaacaaguuauuccaaaacucugugacuuaacaaca

SEQ ID NO: 181002 - RNA, 45 nt, Homo sapiens
uugccauggccauuuuuagaaaauacagucuaccacaccaagcaa

SEQ ID NO: 181003 - RNA, 42 nt, Homo sapiens
guugacuuucuagaagccauaaguagugcuuugagggcccuu

SEQ ID NO: 181004 - RNA, 116 nt, Homo sapiens
gggcaaauucagaauuuuuaaagaugccuucugccuuugcuguugcauccaauguaugcauguuacauucuccugcugaugaaugaacaauccacaccauuuuccuugcacaccag

SEQ ID NO: 181005 - RNA, 46 nt, Homo sapiens
aaagaagccgaaagagccucgauucaaauuaaauuauuaucugcuc

SEQ ID NO: 181006 - RNA, 33 nt, Homo sapiens
agucauauaugauuuuuuguuuuuuguuugcag

SEQ ID NO: 181007 - RNA, 38 nt, Homo sapiens
ggcugggcccugccaagacaggugaaagcagguggaua

SEQ ID NO: 181008 - RNA, 42 nt, Homo sapiens
uaauaacagauacaaaccuuuacaacucaaaggaauaccucu

SEQ ID NO: 181009 - RNA, 49 nt, Homo sapiens
caacugccaaaaccguccagagcaguguccaccccaccagugucuuugu

SEQ ID NO: 181010 - RNA, 71 nt, Homo sapiens
gguuucagugcauuaacucauuuaauccucacugggugagguaggcacuaugccuauccuuguuuuaugaa

SEQ ID NO: 181011 - RNA, 42 nt, Homo sapiens
auuugaacuagaacaguauuaggagaaaaugauuugcuggaa

SEQ ID NO: 181012 - RNA, 45 nt, Homo sapiens
uuuauucuaauuuaaauagcuuccugugguuuuuagaacaagcag

SEQ ID NO: 181013 - RNA, 67 nt, Homo sapiens
gaguuguacgcuucagaggaccccuguuagcagagaggacagucuccggaauauucuuuggaguuga

SEQ ID NO: 181014 - RNA, 156 nt, Homo sapiens
gaagaaggucguggucaagguuucacugacgggguguaccaagggaaacagcuuuuucagugugaugaagauuguggcguguuuguugcauuggacaagcuagaacucauagaagaugaugacacugcauuggaaagugauuacgcagguccuggg

SEQ ID NO: 181015 - RNA, 87 nt, Homo sapiens
uccuuuggaaauaaacuccagaguuucuuugaagguuggagaaacaauagaaucuggaacaguuauauucugugauguuuugccagg

SEQ ID NO: 181016 - RNA, 51 nt, Homo sapiens
acuauuuaaaugcucagggaauaugaagaacuuagggcuaauuagaggcag

SEQ ID NO: 181017 - RNA, 91 nt, Homo sapiens
acugggauggaagauuugauggagugcagcuuuguaguuuugcguguguugaaaguacaauucuauugcacaucaaugauaucaucccagg

SEQ ID NO: 181018 - RNA, 45 nt, Homo sapiens
aagagguguuggggacaaagguucauccagucauaauaaaccaaa

SEQ ID NO: 181019 - RNA, 56 nt, Homo sapiens
uagauuuuuuugguuugaacaguugggugccauugacugaggugcauaaauaugga

SEQ ID NO: 181020 - RNA, 41 nt, Homo sapiens
aaaagaaggcuuggagauaaugauugggaagaagaaaggca

SEQ ID NO: 181021 - RNA, 59 nt, Homo sapiens
uuauaugcguuaaaaauaacugaagagcauauucacaugucaaaguauuagcugaaaug

SEQ ID NO: 181022 - RNA, 49 nt, Homo sapiens
uagaguuaaagacuaauggcaugcuauaguaaaauauuuaggaggaaag

SEQ ID NO: 181023 - RNA, 46 nt, Homo sapiens
gcuugcaauguaugaguguagagaaugcuacgacgauccggacauc

SEQ ID NO: 181024 - RNA, 25 nt, Homo sapiens
ccauaguguguguuuagaccacagc

SEQ ID NO: 181025 - RNA, 46 nt, Homo sapiens
aguuuccuccucugcauaaugagaggguuagacuacugaauuguau

SEQ ID NO: 181026 - RNA, 50 nt, Homo sapiens
agcaggugaggagucggggaggagaaagcgauguuaaaaugaaaacucac

SEQ ID NO: 181027 - RNA, 39 nt, Homo sapiens
cccuucuccguuccccuucagaccuuucuggggagaaga

SEQ ID NO: 181028 - RNA, 62 nt, Homo sapiens
ccacaugugagugcccauguguaccugagauauggggagggcaggcagagagacagagagag

SEQ ID NO: 181029 - RNA, 45 nt, Homo sapiens
caacgaguuggcgggaaucaccgcugaguucugauuggggccaag

SEQ ID NO: 181030 - RNA, 30 nt, Homo sapiens
gcaguguuuuuaaauuuaccccggucucua

SEQ ID NO: 181031 - RNA, 45 nt, Homo sapiens
agacuccauggacucagaguagcugucggggacugggguguuggg

SEQ ID NO: 181032 - RNA, 42 nt, Homo sapiens
uggguuuuaagauucccuuucguggugaaagcccggccacag

SEQ ID NO: 181033 - RNA, 42 nt, Homo sapiens
cuaccaguugcugaagcuuggacgucucugaugccugagcug

SEQ ID NO: 181034 - RNA, 44 nt, Homo sapiens
gcccccggagucacuuuugacugagccuggggggcugguggcag

SEQ ID NO: 181035 - RNA, 42 nt, Homo sapiens
aaggguaugaggcuugggaggguugggggcaacggcaggccg

SEQ ID NO: 181036 - RNA, 46 nt, Homo sapiens
ggauaugaggguauuucucuuuguggcgcugaaaguggacuuucag

SEQ ID NO: 181037 - RNA, 45 nt, Homo sapiens
uguugucagguccccgaguugagguagagagguugugaucgcuga

SEQ ID NO: 181038 - RNA, 42 nt, Homo sapiens
gcuaagugacuagcaggauucaauuugggggucacugggaag

SEQ ID NO: 181039 - RNA, 40 nt, Homo sapiens
aauuuacaaaacacacuauauaaugcucucuuaucucuag

SEQ ID NO: 181040 - RNA, 58 nt, Homo sapiens
agcacucuccaccccggccgcaaccccagcgggucaggcgcuggcgccccgacaccag

SEQ ID NO: 181041 - RNA, 47 nt, Homo sapiens
uccuccagcucuaaaauucuaagggucuccuccuuucagguccuuag

SEQ ID NO: 181042 - RNA, 42 nt, Homo sapiens
uguccuagggccuugguuuugccuucuguaaaaggaagaggc

SEQ ID NO: 181043 - RNA, 48 nt, Homo sapiens
ugcguuuauuuuucucucccuucguaacugugcaauggagaacgggag

SEQ ID NO: 181044 - RNA, 47 nt, Homo sapiens
ucuucccgaggcucaggcucccguucuccauugcacaguuacgaagg

SEQ ID NO: 181045 - RNA, 48 nt, Homo sapiens
gucccuucgcuuuuaauaauuacagucucugcuuuuugcugcccuuag

SEQ ID NO: 181046 - RNA, 45 nt, Homo sapiens
acgccuuagcaacuuuauguaagaaagaagcgacuugaucucgau

SEQ ID NO: 181047 - RNA, 47 nt, Homo sapiens
gaggugcagaguaacuugcccaaggcaacagcuaguaaguagugaag

SEQ ID NO: 181048 - RNA, 29 nt, Homo sapiens
uuaaggauuugccugaaacguuaagaaca

SEQ ID NO: 181049 - RNA, 43 nt, Homo sapiens
agcacuucuagcaggcggagauucccuuuguuucugaucuggu

SEQ ID NO: 181050 - RNA, 44 nt, Homo sapiens
caggggucuuacuccuuggaggccaugugggccaugagguccac

SEQ ID NO: 181051 - RNA, 45 nt, Homo sapiens
aaugagcuugaaaaagugguuguugagggcaaugacagccccagc

SEQ ID NO: 181052 - RNA, 40 nt, Homo sapiens
gcgcgcccugcgccccccgggcccugccccucccggccag

SEQ ID NO: 181053 - RNA, 24 nt, Homo sapiens
gucuccgcgagggaccagaucuug

SEQ ID NO: 181054 - RNA, 42 nt, Homo sapiens
aucuuccgagucgcuauuuuuggaguccgaaaugggucccag

SEQ ID NO: 181055 - RNA, 52 nt, Homo sapiens
gacgaggagggaaacgcuuaugggagcgagcgcgaggaggaagacgaagagg

SEQ ID NO: 181056 - RNA, 41 nt, Homo sapiens
cuccguccgugccccgcgggccaccauguccuucccccagc

SEQ ID NO: 181057 - RNA, 42 nt, Homo sapiens
cuccggcggccgagaggagggagcgcggcgcagagaggaggg

SEQ ID NO: 181058 - RNA, 45 nt, Homo sapiens
uggggggaagaggagugcggagaggggaggggagaggaagggcga

SEQ ID NO: 181059 - RNA, 48 nt, Homo sapiens
ugaguaaagagagagauuuacaaaauagaaguagugagaaaggaagaa

SEQ ID NO: 181060 - RNA, 45 nt, Homo sapiens
uguccacaacuuuuggcugccuuacuuagcccagggcgcagaggc

SEQ ID NO: 181061 - RNA, 42 nt, Homo sapiens
cggcugcuaauagcggagaaagagaacgcgaaagugggagag

SEQ ID NO: 181062 - RNA, 48 nt, Homo sapiens
caacucuagaguggcuuguuuuugucugagagcuugcuucgugaagcu

SEQ ID NO: 181063 - RNA, 44 nt, Homo sapiens
ucccaauaaauugcaagucaaaagaagauauguuuagaguuuau

SEQ ID NO: 181064 - RNA, 44 nt, Homo sapiens
ugguuuugccauuuuggaaaaguaguucaaaagaaauagacucg

SEQ ID NO: 181065 - RNA, 45 nt, Homo sapiens
cgauuugggaguauuaaauuucugaaaagucggucgagcugcggu

SEQ ID NO: 181066 - RNA, 47 nt, Homo sapiens
cgggggcuggggcgcgggggccggaccaugagccgcugagccgggca

SEQ ID NO: 181067 - RNA, 45 nt, Homo sapiens
gcgcggcggcggcguggcucagcaggcagcccaggagacagagcg

SEQ ID NO: 181068 - RNA, 45 nt, Homo sapiens
acagguugcagcucuccuuggggcagccauagaagguguucaggu

SEQ ID NO: 181069 - RNA, 46 nt, Homo sapiens
cugcggcaacccagauguggccaacuacaacuucuucccucgcaag

SEQ ID NO: 181070 - RNA, 41 nt, Homo sapiens
uaaagguaugugguauagacacugagugguaagugaugaag

SEQ ID NO: 181071 - RNA, 44 nt, Homo sapiens
cagaucucuacugagcuccuguugacaguccuggauaaccccac

SEQ ID NO: 181072 - RNA, 48 nt, Homo sapiens
uaaggacggacuccuggcucaugccuucgccccaggcacugguguugg

SEQ ID NO: 181073 - RNA, 47 nt, Homo sapiens
aacgccgauggggaguacugcaaguuccccuucuuguucaauggcaa

SEQ ID NO: 181074 - RNA, 46 nt, Homo sapiens
cgcagcgauggcuuccucuggugcuccaccaccuacaacuuugaga

SEQ ID NO: 181075 - RNA, 92 nt, Homo sapiens
aggagggagggauagagaggagggcaggaaggagacagggaggaaagcacggagcucuuaauaaaaaacagacuaaaagguggagauacaga

SEQ ID NO: 181076 - RNA, 43 nt, Homo sapiens
gaaggugcccccugugucuuccccuucacuuuccugggcaaca

SEQ ID NO: 181077 - RNA, 42 nt, Homo sapiens
uguugcccaggaaagugaaggggaagacacagggggcaccuu

SEQ ID NO: 181078 - RNA, 46 nt, Homo sapiens
aucaucguaguuggcuguggucgcacaccacaucuuuccgucacug

SEQ ID NO: 181079 - RNA, 34 nt, Homo sapiens
uccugaaugcccuugaugucauccugggacagac

SEQ ID NO: 181080 - RNA, 46 nt, Homo sapiens
ccuuggcaccggccccacccccacgcugggcccugucacuccugag

SEQ ID NO: 181081 - RNA, 89 nt, Homo sapiens
cggaucugagcgaugccaucaaauacaauguccuguuugcagaucucaggagugacagggcccagcguggggguggggccggugccaag

SEQ ID NO: 181082 - RNA, 45 nt, Homo sapiens
cagaguugaugauuuugagaggcuuagagagggaaaacacaauau

SEQ ID NO: 181083 - RNA, 46 nt, Homo sapiens
gcaucaaucuuuuccgggagcucaggccagaauguggccaccagca

SEQ ID NO: 181084 - RNA, 44 nt, Homo sapiens
gccugagcucccggaaaagauugaugcgguauacgaggccccac

SEQ ID NO: 181085 - RNA, 85 nt, Homo sapiens
ugcccccugauguccagcgaguggaugccgccuuuaacuggagcaaaaacaagaagacauacaucuuugcuggagacaaauucug

SEQ ID NO: 181086 - RNA, 38 nt, Homo sapiens
ggaaaaggagcuaacaguaucuaccucaacugagaaau

SEQ ID NO: 181087 - RNA, 42 nt, Homo sapiens
cgcagaugccuggaaugccauccccgauaaccuggaugccgu

SEQ ID NO: 181088 - RNA, 46 nt, Homo sapiens
ucauuuacaggagacacuuucuucucaccuucagauaauuauuggc

SEQ ID NO: 181089 - RNA, 51 nt, Homo sapiens
aggucacagcuacuucuucaagggugccuauuaccugaagcuggagaacca

SEQ ID NO: 181090 - RNA, 46 nt, Homo sapiens
uccgacuggcuaggcugcugagcuggcccuggcucccacaggcccu

SEQ ID NO: 181091 - RNA, 49 nt, Homo sapiens
aucuuaaauuaccagguaggagugagaaugcugauuagcuguagagcug

SEQ ID NO: 181092 - RNA, 45 nt, Homo sapiens
cuccaaggguucugugagccacagaagguugugaaaggagaagag

SEQ ID NO: 181093 - RNA, 47 nt, Homo sapiens
cacuccagaccccuggcuuuucacugcuggcugccuuagaaccuuuc

SEQ ID NO: 181094 - RNA, 46 nt, Homo sapiens
auacaaagcaaacugcuaauguaagaaagguucuaaggcagccagc

SEQ ID NO: 181095 - RNA, 45 nt, Homo sapiens
gcccacauagugaugguuccccuguucacucuacuuagcaugucc

SEQ ID NO: 181096 - RNA, 62 nt, Homo sapiens
ucuuuuuccagaggugccaacguuaaaccccauuuugauuuggauuuuguguauacuauuuu

SEQ ID NO: 181097 - RNA, 49 nt, Homo sapiens
agcuauuuguuuuuauuguaaaacaauaauaauaauaaaaagcaaacuc

SEQ ID NO: 181098 - RNA, 49 nt, Homo sapiens
uuagaauguugaaaaguaauugaaaaaggugauagguaaauuuuuaggc

SEQ ID NO: 181099 - RNA, 46 nt, Homo sapiens
guuuuccuagcuguguuauuccugguuuaauucagcagagaaggua

SEQ ID NO: 181100 - RNA, 76 nt, Homo sapiens
agguucacaccuuaccuucucugcugaauuaaaccaggaauaacacagcuaggaaaacgcagugcucccaggauaa

SEQ ID NO: 181101 - RNA, 49 nt, Homo sapiens
gagcaccagaguucacggaaaucaagccggcuuuggacuggaggcucgg

SEQ ID NO: 181102 - RNA, 51 nt, Homo sapiens
agcagggcaucuuggaaaaggaacucuugguucgauaccuggagcagagga

SEQ ID NO: 181103 - RNA, 40 nt, Homo sapiens
augaucucuucugguguugacuggacugcuuggggugggg

SEQ ID NO: 181104 - RNA, 49 nt, Homo sapiens
cagacccugugauugugggaguucugugcugugucuguggguggagggg

SEQ ID NO: 181105 - RNA, 42 nt, Homo sapiens
agaaguuucucccucuuccuggucacugcuuggccuuuccac

SEQ ID NO: 181106 - RNA, 45 nt, Homo sapiens
cuuggccuucaggcuguaguuugccaacccccugcucuaggagcu

SEQ ID NO: 181107 - RNA, 42 nt, Homo sapiens
uuuagaaggacggauucaaguaccuuuuccuacacagguaaa

SEQ ID NO: 181108 - RNA, 50 nt, Homo sapiens
acugacgucacagugucuggcaggcuuugggcagugaauguggcaucaug

SEQ ID NO: 181109 - RNA, 45 nt, Homo sapiens
gauuauugucggcaauauuaagagacauucugcauguuggacagg

SEQ ID NO: 181110 - RNA, 96 nt, Homo sapiens
guuccuggcuagaacaagacaccuccuguccaacaugcagaaugucucuuaauauugccgacaauaaucgugucagggaagaacaucaaggagaga

SEQ ID NO: 181111 - RNA, 34 nt, Homo sapiens
uaagugaguuggaaggagaggagcuugagugaau

SEQ ID NO: 181112 - RNA, 42 nt, Homo sapiens
ccacagggcaguuuccgcgcagccugcauggagucccaacag

SEQ ID NO: 181113 - RNA, 44 nt, Homo sapiens
uuauuaucaaauagacacuucauugggcuucuacccuguucauu

SEQ ID NO: 181114 - RNA, 88 nt, Homo sapiens
cagccuggucaucuuuaugcagcugcguuaccuguuucaugaggugcaacgucgaauucgucggcacaagaacuaucuacgugugguu

SEQ ID NO: 181115 - RNA, 137 nt, Homo sapiens
aauauaaugcauauuguuauacucaguaaauuaaaugacacggaucucuaaauaucaccucaugcucauauuuggguuauuggagaauaggaccauauaguaaugggaugcuuuucugugcuuagcacagaacccua

SEQ ID NO: 181116 - RNA, 41 nt, Homo sapiens
cucacauauucaaaucgauccuugcagagcugaaccaucag

SEQ ID NO: 181117 - RNA, 27 nt, Homo sapiens
aauaaaguggaaaaaaaucauagagua

SEQ ID NO: 181118 - RNA, 42 nt, Homo sapiens
ucuacuuuuaaaagcaaaugauaauuuuaaagaagaaagaaa

SEQ ID NO: 181119 - RNA, 45 nt, Homo sapiens
cuaucaacuuggaauauuaaucucucagucauuuacagcccacuu

SEQ ID NO: 181120 - RNA, 47 nt, Homo sapiens
caugcugguuucguucauuagaacagauaauuucagacugaucagau

SEQ ID NO: 181121 - RNA, 79 nt, Homo sapiens
uuguaucuuaguaauggaucauaucguaaaaauagagauaaguugggaagauauauugauuaugcuguucuguugaggg

SEQ ID NO: 181122 - RNA, 42 nt, Homo sapiens
acugugcauuccagaucuacauacuaaaugcucuuaucauuu

SEQ ID NO: 181123 - RNA, 49 nt, Homo sapiens
cuacaguggccacauuucagauguucacuuuugcaauuuguggagggug

SEQ ID NO: 181124 - RNA, 27 nt, Homo sapiens
cucugugagcacagcuauauacagugu

SEQ ID NO: 181125 - RNA, 46 nt, Homo sapiens
cugguagcugcaccauuguuugaauuguaugacaaugcaccaggau

SEQ ID NO: 181126 - RNA, 41 nt, Homo sapiens
uaugacuuuauagcuccuuuacaugacaagauguuucaggu

SEQ ID NO: 181127 - RNA, 135 nt, Homo sapiens
uuaauuccuuagcauccucuaaagacuugacuuuauucaaaagagaggguaagaccaagacuuggguacaggcaguuugagaggugauuccaggaagcagcagaauacaggggagagagagaccagaagcagcag

SEQ ID NO: 181128 - RNA, 31 nt, Homo sapiens
uauaaaaagaaacuuauguauuacugaagug

SEQ ID NO: 181129 - RNA, 73 nt, Homo sapiens
auuugguuguuucuuguuguaauguuagcagcucauugaugaucauuuccuggucuaugaauucauaaggguu

SEQ ID NO: 181130 - RNA, 46 nt, Homo sapiens; identical to SEQ ID NO: 109215

SEQ ID NO: 181131 - RNA, 46 nt, Homo sapiens
cuguugcagccagauuucagcgcaugagggaagaauuugauaaaau

SEQ ID NO: 181132 - RNA, 42 nt, Homo sapiens
guuuaugccagucaggguacaagugcaaggauuuggugguau

SEQ ID NO: 181133 - RNA, 46 nt, Homo sapiens
ggggggucacucaguucggcaacaaguacauccagcagacgaagcc

SEQ ID NO: 181134 - RNA, 42 nt, Homo sapiens
aaccgcuucccgcacggggaaagucuacccugccugccacuu

SEQ ID NO: 181135 - RNA, 85 nt, Homo sapiens
guucugugccuugggaagagaugaaugggaagcggccagcggagcccggcccagcccgggugggaaaaaagggaaagaaggaggu

SEQ ID NO: 181136 - RNA, 47 nt, Homo sapiens
cagagcuguuaaaaagauugaaugagaucaugggccuggcaccuggu

SEQ ID NO: 181137 - RNA, 47 nt, Homo sapiens
ccuuggccaaccuguuuauaauugcaaaccacuccccaggcuuagca

SEQ ID NO: 181138 - RNA, 48 nt, Homo sapiens
uugucaagucacagacccauccaauggaggggcccuguguuaaaccua

SEQ ID NO: 181139 - RNA, 49 nt, Homo sapiens
cuauuuucaugaucaagucugaugauuugaagaagagaagagagccuca

SEQ ID NO: 181140 - RNA, 47 nt, Homo sapiens
cuuguugacauuguuaacccacuuuguagaggaggaaagagaccgag

SEQ ID NO: 181141 - RNA, 50 nt, Homo sapiens
ugaaguauugcuuguguguuaauuguaaugcauuauguuucauauuuacu

SEQ ID NO: 181142 - RNA, 40 nt, Homo sapiens
gucugauguuuucucaugauuagauucaggccauauauuu

SEQ ID NO: 181143 - RNA, 55 nt, Homo sapiens
acucggccucccaacuacuuugaaccccccauaccucggagcccucacaucccac

SEQ ID NO: 181144 - RNA, 46 nt, Homo sapiens
uaagcaugagauuuuguaugauuggaucaacccuacuuaucuggac

SEQ ID NO: 181145 - RNA, 38 nt, Homo sapiens
aucuguuguugaacauuugacagugaugagguagcuug

SEQ ID NO: 181146 - RNA, 46 nt, Homo sapiens
gauuuaggaagagagguacaaagcuaacgaucagcuuuuauucugu

SEQ ID NO: 181147 - RNA, 42 nt, Homo sapiens
gaggcacuauucuugcugcucuccaacuucacaggccugaag

SEQ ID NO: 181148 - RNA, 46 nt, Homo sapiens
aucagcaacaacagccaacagagcaaugagcagacagacccagagc

SEQ ID NO: 181149 - RNA, 46 nt, Homo sapiens
gagccagaauauggcgguuuuacuucuuacauugccaaaggugaag

SEQ ID NO: 181150 - RNA, 72 nt, Homo sapiens
gaacaaaaaugugacccuucguaauuacugggaagucugaaagagcuaagcauggagucaaggagaacuaca

SEQ ID NO: 181151 - RNA, 112 nt, Homo sapiens
auagagucuucuguuuccuuucucuuuuuuacauuuauuuuuagcuuuugcaguaguguuuaguguggguuuuacuaauuaauagaaaaagcacugggccuuuaaacuucuu

SEQ ID NO: 181152 - RNA, 164 nt, Homo sapiens
aacuacucuucucuuucaucuccuaaaacuuuugaguauucauucuuuucugaaguuugcauuuaaaugaaaaugacuuucgcuuuggcuuuuagguuuaguuucaaaaagguuuaauucugcacccuagccaguuaagaaauguuuuagcagguaugcccuug

SEQ ID NO: 181153 - RNA, 59 nt, Homo sapiens
guaauauuauuucuauaacuuacuguuauaaaacacuaauuuuuaaaugaugagauaaa

SEQ ID NO: 181154 - RNA, 46 nt, Homo sapiens
gugaggugagaaaagggaaugugacuaguguuuuaguauuuucuug

SEQ ID NO: 181155 - RNA, 45 nt, Homo sapiens
caucccagcauucacaaccucuccaguuccaucugcaucccuauu

SEQ ID NO: 181156 - RNA, 83 nt, Homo sapiens
uauuuauuuguucucucucuuggaaaugggagacuuagaggauaggagagcucucuaaaguaucugaauaguuuuuaugugga

SEQ ID NO: 181157 - RNA, 36 nt, Homo sapiens
auagcauuaauacuugacagugauauacuguagaca

SEQ ID NO: 181158 - RNA, 46 nt, Homo sapiens
cuuuccaauggcacaguuggaguuuaugacaaaacaucccgauacu

SEQ ID NO: 181159 - RNA, 34 nt, Homo sapiens
cccaacugcuccugcgccgccgguaagaggcugg

SEQ ID NO: 181160 - RNA, 46 nt, Homo sapiens
cgccggcuccugcaaaugcaaagagugcaaaugcaccuccugcaag

SEQ ID NO: 181161 - RNA, 50 nt, Homo sapiens
gcccuggaaucagcauuguuagagguuccagugugaugccgaagucugug

SEQ ID NO: 181162 - RNA, 41 nt, Homo sapiens
ccggccgagcgaucgcagccgucagcgggaggaggccacag

SEQ ID NO: 181163 - RNA, 76 nt, Homo sapiens
agggugaaaugacucgcccaaggucaggcugcugauuacugacggcuacugggcaacagaggggcgcccgcgucgg

SEQ ID NO: 181164 - RNA, 46 nt, Homo sapiens
agcauaauucuucaucacacaggagagggcauccgggcaggaaaag

SEQ ID NO: 181165 - RNA, 27 nt, Homo sapiens
cccaauagucauucucauggcaacaca

SEQ ID NO: 181166 - RNA, 48 nt, Homo sapiens
cuucaugaugguaacaauuuguaucauucagacuuucaggggaguaau

SEQ ID NO: 181167 - RNA, 65 nt, Homo sapiens
cuaauuuuuauaaagaguacaaaagugaauauauuuccuuuggaaauuuucauugugauuaguug

SEQ ID NO: 181168 - RNA, 180 nt, Homo sapiens
agugaucuuuaaagaauuuuuuuuuuuuaaaaauggucucgcuguguggcccaggcuuuucucaaacuccugagggcaagcgauccucccaccucagccuccugaguagcugggacuacaggcaugugccacuagaccuggcucuaaagacauauaugacacacgaaaccauuuauuuuu

SEQ ID NO: 181169 - RNA, 45 nt, Homo sapiens
ccucuguggauucagccaccuaaauaaguguaacaugaacacaga

SEQ ID NO: 181170 - RNA, 49 nt, Homo sapiens
uguucauguuacacuuauuuagguggcugaauccacagaggagccugcu

SEQ ID NO: 181171 - RNA, 83 nt, Homo sapiens
ggggacaguauccugaggauuccucaagugaugguuuaaggcaaagggaaguucuucggaaccuuucuuccccuggaugggaa

SEQ ID NO: 181172 - RNA, 29 nt, Homo sapiens
aacaugaauguuccucguuugcaucaauu

SEQ ID NO: 181173 - RNA, 36 nt, Homo sapiens
gucuucccugagcuguacuuggguuccccuuguaaa

SEQ ID NO: 181174 - RNA, 42 nt, Homo sapiens
ugaguguauuuucaucagucugcagagcccugcucuguuugg

SEQ ID NO: 181175 - RNA, 42 nt, Homo sapiens
ccuguggucucugcaccugcuccagccccuauucacaaccag

SEQ ID NO: 181176 - RNA, 45 nt, Homo sapiens
uuuugauuggcuccaggauuaacaaccacuugaggagcagcauuc

SEQ ID NO: 181177 - RNA, 69 nt, Homo sapiens
aguaaauauuuggcucaauaugucacuagugccaaagcugagaaagccuggccuagagugaugggucuu

SEQ ID NO: 181178 - RNA, 46 nt, Homo sapiens
gaggaggaccaucauuugggaaguucugaaccggccucggucuaaa

SEQ ID NO: 181179 - RNA, 24 nt, Homo sapiens
ucccugucuggagggaggugguug

SEQ ID NO: 181180 - RNA, 46 nt, Homo sapiens
cgagggccucgcccaccuggcaucuggucugggccacugccaccac

SEQ ID NO: 181181 - RNA, 55 nt, Homo sapiens
gauugccuuaucuaugaaaauggggcucaugagccuugcucugcugggcuggcug

SEQ ID NO: 181182 - RNA, 777 nt, Homo sapiens
aggggaaauggaugcuaaagaggcuggaguaaguagugauggugguugugggugagugaguggugggggugguuaauggaugguggaagugggugaguggugggguugguuaauggaugguggaagugggugaguggugggguugguuaauggggaauggggugagugaguggugggagugguuaauggggaaugggcugagugaguggugggagugguuaauggggaauggggugagugaguggugauggugguuaauggggaagggugugagaguggugauggugguuaauggggaagggggugagugaguggugauggugguuaauggggaaguguugugagugaguuguguuggugguuaauggggaaggagaugagugagugguguuggugguuaauggggaaggguugugagugagugguggcguugguuaauggggaagggggugagugaguggugauggugguuaauggggaagaguugugagugagugguguuggugguuaauggggaagggggugagugaguggugggguugguuaauggggaaguguugugagugaguggugauggugauuaauggggaaggguugugagugaguggcguuggugguuaauggggaagggagggagugagugaugauggugguuaauggggaaggguugugagugaguugugggguugguuaauggggaagcguugugagugaguggugaugguugguuaauggggaaggguugugagugaguggugauggugguuaauggggaag

SEQ ID NO: 181183 - RNA, 46 nt, Homo sapiens
ggugguuaauggggaaggguugugagugaguggugggguugguuaa

SEQ ID NO: 181184 - RNA, 21 nt, Homo sapiens
aacaaauacuucccaaggggc

SEQ ID NO: 181185 - RNA, 36 nt, Homo sapiens
aagcuguuuucucccccaagcuugagccacaaccag

SEQ ID NO: 181186 - RNA, 54 nt, Homo sapiens
acugcgggaccuuaagccaccccagccccugcucuucucugggccuuucugccu

SEQ ID NO: 181187 - RNA, 23 nt, Homo sapiens
gggaauagcaucagcucagccgg

SEQ ID NO: 181188 - RNA, 44 nt, Homo sapiens
cuggagcugcucccauccucucuggccaguccucccauuuguaa

SEQ ID NO: 181189 - RNA, 45 nt, Homo sapiens
cucaggaaagaagagccucggcagggcgcucugcacuccacccag

SEQ ID NO: 181190 - RNA, 46 nt, Homo sapiens
ccuguguagggacggagaaacuagggggccucgaggaagguguugg

SEQ ID NO: 181191 - RNA, 45 nt, Homo sapiens
gucugagcuggacucggagucgcugcucccagaguaggcacccag

SEQ ID NO: 181192 - RNA, 41 nt, Homo sapiens
cagaaaauuacuaauagagaauguucuuaguauucagacag

SEQ ID NO: 181193 - RNA, 100 nt, Homo sapiens
ucgccugggagaacuuguucuugguuucuauaggcuucacagucaguuucuuuuccacuuccuucuuguucucuugagaaauuccaaccuucuugagguu

SEQ ID NO: 181194 - RNA, 46 nt, Homo sapiens
cugcugcuuccuguccuucuguuccuguagccuuucauauagagau

SEQ ID NO: 181195 - RNA, 41 nt, Homo sapiens
gacuuaguguucaaguccagucuguauagcagggaaggugc

SEQ ID NO: 181196 - RNA, 47 nt, Homo sapiens
aacgugaacuuucuagggcucuaaugguugggagagacauuccgaac

SEQ ID NO: 181197 - RNA, 33 nt, Homo sapiens
uccuaguaaauaauucagggugggauaguccuu

SEQ ID NO: 181198 - RNA, 58 nt, Homo sapiens
uucaacucucuuuguuucuuaaguuuucugcaaaacgggccagcuggcuuguuuuccg

SEQ ID NO: 181199 - RNA, 82 nt, Homo sapiens
uugaaaggugauuggcugucaaggagagggcuugccaccgaggaaggggcguuuccuaggggacugagggagggcuggggcg

SEQ ID NO: 181200 - RNA, 59 nt, Homo sapiens
caccagaagagguucuugggggucgcccuucugaggaggcugcggcuaacagggcccag

SEQ ID NO: 181201 - RNA, 53 nt, Homo sapiens
guggcacggaugaggcauaccuccccggggagauuuagaaacgccuugggaua

SEQ ID NO: 181202 - RNA, 73 nt, Homo sapiens
aaggaccuuggggagaggggauuucugggcggugaugggaagaagacaccuccauccacaggaaagccagagu

SEQ ID NO: 181203 - RNA, 42 nt, Homo sapiens
gaugucuacaggcagugaauaucauacuuucucccucaguug

SEQ ID NO: 181204 - RNA, 38 nt, Homo sapiens
uuucccugauauucaaauuagaaaauugaaaagcagaa

SEQ ID NO: 181205 - RNA, 45 nt, Homo sapiens
ugaauuacuaaggauuacuaaaacaugguauucauaaccuaaaac

SEQ ID NO: 181206 - RNA, 49 nt, Homo sapiens
acaaauaggaugcaaauuccucaacuccagguuaugaaaacaguacuug

SEQ ID NO: 181207 - RNA, 46 nt, Homo sapiens
acuggaggugccgcuacuaccauggguaauuccuguaucugccgag

SEQ ID NO: 181208 - RNA, 46 nt, Homo sapiens
gaucaggaaccucccuauucaaugauaacauuacacgaaauggcag

SEQ ID NO: 181209 - RNA, 28 nt, Homo sapiens
aaaaaugauauugagagacauagacuaa

SEQ ID NO: 181210 - RNA, 45 nt, Homo sapiens
cagguguuucccgagugcuuauuuauucccuccuauguuuaaaaa

SEQ ID NO: 181211 - RNA, 41 nt, Homo sapiens
ugguacuaugaaguaacaguggucacuucuggcgucaugca

SEQ ID NO: 181212 - RNA, 46 nt, Homo sapiens
uggcuugacuucuuucacuugacuuuuaccuaguaauuaguuggca

SEQ ID NO: 181213 - RNA, 44 nt, Homo sapiens
gauuugguacaaugccagaaguaagccucacauacacccaugcu

SEQ ID NO: 181214 - RNA, 32 nt, Homo sapiens
aacccauuugaucagaccuaaaacuaucccaa

SEQ ID NO: 181215 - RNA, 48 nt, Homo sapiens
uuugauuuuuauuaauucuauuggccucuguacucauuuuauuuguag

SEQ ID NO: 181216 - RNA, 46 nt, Homo sapiens
cuaguuucaugucauaucaacaaugugaguucaauuuuggagcaaa

SEQ ID NO: 181217 - RNA, 41 nt, Homo sapiens
uaaucaguuguacacacauugaaacuuauagccauggccag

SEQ ID NO: 181218 - RNA, 79 nt, Homo sapiens
auauugcauugcaagacuugaaucuauaaaaauuagaaucacacagucaguacuacaagcaaaacagagaaccugaaag

SEQ ID NO: 181219 - RNA, 42 nt, Homo sapiens
ucagauuucuguuuuuuuguuaaaaaaaauuuuuuuaaucag

SEQ ID NO: 181220 - RNA, 42 nt, Homo sapiens
cccuccaggcuuugcugacagcugaggguuggcggcugggga

SEQ ID NO: 181221 - RNA, 46 nt, Homo sapiens
aauauccaaccacagcaucaaauucugcaucagaggcggaggagcu

SEQ ID NO: 181222 - RNA, 45 nt, Homo sapiens
guuguggugaaggcugccauguugaacucaggaauccgcugcagc

SEQ ID NO: 181223 - RNA, 43 nt, Homo sapiens
ccgaacaugaaccucccacgcuucccccaucauucucccuuca

SEQ ID NO: 181224 - RNA, 38 nt, Homo sapiens
acacaccagcagguaugcuggggaagggccccccaggu

SEQ ID NO: 181225 - RNA, 30 nt, Homo sapiens
guguguuugcauguuugcugaaaauccuuu

SEQ ID NO: 181226 - RNA, 58 nt, Homo sapiens
ugguuuagugcaaugugugguagauuacuuaucagaaaacauauaugucaucucuaga

SEQ ID NO: 181227 - RNA, 42 nt, Homo sapiens
aauacuuuuguaccaugaguaaaacuucagguguuucgcaag

SEQ ID NO: 181228 - RNA, 56 nt, Homo sapiens
gggaguauuacagagagaggcuugggaaagggaaggaaaccuggacaggcuuuuca

SEQ ID NO: 181229 - RNA, 61 nt, Homo sapiens
uuacucacauaucuugccuggauccuguaggggucuguagcccccaugccagaaaauccca

SEQ ID NO: 181230 - RNA, 40 nt, Homo sapiens
cuaucucccccagccccauccucuguacagagcccacgcc

SEQ ID NO: 181231 - RNA, 45 nt, Homo sapiens
aaguacuccaggcagcacucccggcccacauuggucccucgagcu

SEQ ID NO: 181232 - RNA, 42 nt, Homo sapiens
aggagaaacagauggaaguuuggacaugauugaacacaaaug

SEQ ID NO: 181233 - RNA, 23 nt, Homo sapiens
agcauguucgggaaggauggcag

SEQ ID NO: 181234 - RNA, 46 nt, Homo sapiens; identical to SEQ ID NO: 109370

SEQ ID NO: 181235 - RNA, 71 nt, Homo sapiens
cucaaucucuauaaacccgacaauacuuaguacacuugguaaagcuggguuucaaacuuggacauaccaaa

SEQ ID NO: 181236 - RNA, 42 nt, Homo sapiens
accuuacagccaauccaggaccucucugaucaccuccccagu

SEQ ID NO: 181237 - RNA, 44 nt, Homo sapiens
aauucugaugcucagucaaguuugagaugguaguguuguccaga

SEQ ID NO: 181238 - RNA, 43 nt, Homo sapiens
cacagcuggucuugcucccuuuuggccucagcugacaguccug

SEQ ID NO: 181239 - RNA, 45 nt, Homo sapiens
ucgagaacaccgaccuggcguaaggcuaccgagggaagaggcugg

SEQ ID NO: 181240 - RNA, 32 nt, Homo sapiens
gcugagggugguagugcugagaaaagugcauu

SEQ ID NO: 181241 - RNA, 45 nt, Homo sapiens
uauuaaacuucugugugcugcaguuuccucaucuguaacauucgg

SEQ ID NO: 181242 - RNA, 25 nt, Homo sapiens
gggaagucugaacagaguuuuguga

SEQ ID NO: 181243 - RNA, 46 nt, Homo sapiens
uugaugccaauuccucaguucuucaugaugaauucauugcucacag

SEQ ID NO: 181244 - RNA, 24 nt, Homo sapiens
guuuuuuacaggauuaauuccccu

SEQ ID NO: 181245 - RNA, 48 nt, Homo sapiens
cucgguggaguucacccucgaugugcggugcaaugaagaccagacgcg

SEQ ID NO: 181246 - RNA, 45 nt, Homo sapiens
auugaagaagaaacugagugauuuacaaacucaauuaagccacga

SEQ ID NO: 181247 - RNA, 33 nt, Homo sapiens
uuaggcagccuggagaaaaccagagauccagua

SEQ ID NO: 181248 - RNA, 41 nt, Homo sapiens
cugcagcuugcacucgccauacacguccagguuggggcagg

SEQ ID NO: 181249 - RNA, 81 nt, Homo sapiens
uucuuggcuggcuccaaaacgcuguuccacaaagggugcucuccugaccugccauguacugugugcaccgcugaguuuagu

SEQ ID NO: 181250 - RNA, 42 nt, Homo sapiens
ccucuucgggaagauccgcagugcucgcuuuggcaccgagga

SEQ ID NO: 181251 - RNA, 59 nt, Homo sapiens
uaaaguguugugcaggggcccaggcgugggcccaagucaggacccaugccuggcuggcu

SEQ ID NO: 181252 - RNA, 38 nt, Homo sapiens
agggacggagcccaaaccaaggcuggagggggagacga

SEQ ID NO: 181253 - RNA, 56 nt, Homo sapiens
gggaagauagguguguccgggagagcaggaaggcauggcuaggcaugcuagauggg

SEQ ID NO: 181254 - RNA, 46 nt, Homo sapiens
ggguggagcagcacgaggcugaggugaagaagcugcggcugcgggu

SEQ ID NO: 181255 - RNA, 37 nt, Homo sapiens
cguuaacugguagugugcggauuuaggggaggggaug

SEQ ID NO: 181256 - RNA, 46 nt, Homo sapiens
gccgggagcggcuggagacagagaaacugggccuugagcgggagaa

SEQ ID NO: 181257 - RNA, 41 nt, Homo sapiens
cuccagcauggaccggaaaauggccgagcugaggggcgagg

SEQ ID NO: 181258 - RNA, 43 nt, Homo sapiens
agcauccugaaggaggcgcaccaggacgagcugggccgcaugu

SEQ ID NO: 181259 - RNA, 47 nt, Homo sapiens
acgcacaagcuccccguccucccaggcuagcuuuccaguggggagug

SEQ ID NO: 181260 - RNA, 42 nt, Homo sapiens
ugugugugugugugugugugugugugugugugucugcuucac

SEQ ID NO: 181261 - RNA, 42 nt, Homo sapiens
cuggagguggguuuugaaggauguguaggaguuugcugauga

SEQ ID NO: 181262 - RNA, 71 nt, Homo sapiens
cccugaucuuucuggggaaguuguugguggggugugugugcguguuuauguguguugggaggaggaaguug

SEQ ID NO: 181263 - RNA, 39 nt, Homo sapiens
ugggauaaacgaugaggaugauguggaaaaucuggugag

SEQ ID NO: 181264 - RNA, 42 nt, Homo sapiens
ggagccugacaaguguccccagcagcauauguguggcagugg

SEQ ID NO: 181265 - RNA, 82 nt, Homo sapiens
cuggcccaagagcccucauuacagcaaagacggacagagggcagcccaaagagucagaacccagucauggacccccaggaaa

SEQ ID NO: 181266 - RNA, 45 nt, Homo sapiens
gcauuugagacccgcugcccgaacgggaagaaggugauucaguac

SEQ ID NO: 181267 - RNA, 42 nt, Homo sapiens
accaauauuuuggagauaaaggagugguaccagaaccgggaa

SEQ ID NO: 181268 - RNA, 34 nt, Homo sapiens
cccagugcacucguacaaguccaugcaaccugag

SEQ ID NO: 181269 - RNA, 46 nt, Homo sapiens
cagagcgguucuuccgcaacccagcgaagcccgcggaggaggacgu

SEQ ID NO: 181270 - RNA, 78 nt, Homo sapiens
gguggguggguggauggauggauggauggaugggcgaguggauagauggacgguuggaugggcgaguggauagaugga

SEQ ID NO: 181271 - RNA, 46 nt, Homo sapiens
uguuuagaaccuagagggaugucacaugccgccaggggcccugcag

SEQ ID NO: 181272 - RNA, 44 nt, Homo sapiens
augaggagccugggcccgggaggagugucgcacagccccagccu

SEQ ID NO: 181273 - RNA, 42 nt, Homo sapiens
agguagccucauuauacaaauaaggaaacuaagagacauaga

SEQ ID NO: 181274 - RNA, 27 nt, Homo sapiens
caaaaaucccugccuucgcauauauca

SEQ ID NO: 181275 - RNA, 59 nt, Homo sapiens
ugccuuugguggaggugaccauccuuuagcacgcuccagccccaccacccuuucugucu

SEQ ID NO: 181276 - RNA, 48 nt, Homo sapiens
cuuucccacauuaaaugaucuuggcaaccuugucaaaaaucauuuaac

SEQ ID NO: 181277 - RNA, 33 nt, Homo sapiens
auuuuuguauaugguauaagguaaggauccaac

SEQ ID NO: 181278 - RNA, 51 nt, Homo sapiens
gcuuauuccgccgccugccccaguguggggggagauaccuuuaccaugaac

SEQ ID NO: 181279 - RNA, 51 nt, Homo sapiens
accccuggaugugacucuucuuuuuaaaaggaaacuauguggaggacgaug

SEQ ID NO: 181280 - RNA, 46 nt, Homo sapiens
cggcagaguucaaacuguaucucccaguucagaacaaggcaaaggu

SEQ ID NO: 181281 - RNA, 50 nt, Homo sapiens
uccaugcaaauugucgcauccgacggguuuacuucucagacagacucuac

SEQ ID NO: 181282 - RNA, 30 nt, Homo sapiens
gucagguauagaggugaauacagcaaguaa

SEQ ID NO: 181283 - RNA, 51 nt, Homo sapiens
acuucacacggcgagcauacggcaccaauuacaucgagacccucagagugc

SEQ ID NO: 181284 - RNA, 53 nt, Homo sapiens
caagaaugugcgucgucgcuuucgggcaaguaacuaccagagcaccacccggg

SEQ ID NO: 181285 - RNA, 34 nt, Homo sapiens
aacagcaccuagaaaaccuaguaauuucaaagug

SEQ ID NO: 181286 - RNA, 42 nt, Homo sapiens
aucaaaaaccugaagaaguauuuuaccuucgaagugcaggua

SEQ ID NO: 181287 - RNA, 61 nt, Homo sapiens
cacaugcccugcagaccccaagaagacgcugggaauuaaacuuccuuuccuugucaugauu

SEQ ID NO: 181288 - RNA, 47 nt, Homo sapiens
caaauuauacagcaaucgagcugccuguuacaccaaacuccuggauu

SEQ ID NO: 181289 - RNA, 48 nt, Homo sapiens
agcacauaguaagcacgaugucaguauuagcuauauuauuaaccaaag

SEQ ID NO: 181290 - RNA, 47 nt, Homo sapiens
aucaaaagaaucacugauaaugacauccagucccuggugcuagagau

SEQ ID NO: 181291 - RNA, 47 nt, Homo sapiens
gugugauauuccuggugcauaguaggcauucaguagauauuagcuga

SEQ ID NO: 181292 - RNA, 37 nt, Homo sapiens
gaugggaauugaauuccugcuuuaaaaaguagaaaau

SEQ ID NO: 181293 - RNA, 45 nt, Homo sapiens
uaaauuaugucgucuagacaacaugagccagaaaaacaaaucaga

SEQ ID NO: 181294 - RNA, 46 nt, Homo sapiens
auaaaacuaccagacccaacacugauuuauccccauaugcaagucu

SEQ ID NO: 181295 - RNA, 48 nt, Homo sapiens
ugucuugagagccuaagaaaugcuccauuggcagggauuggggucccg

SEQ ID NO: 181296 - RNA, 54 nt, Homo sapiens
uuacccucuaaugcacauaucugauugaucgcccuuaccaccuccacgcuacuc

SEQ ID NO: 181297 - RNA, 69 nt, Homo sapiens
gauagugggaaugugucaugaaugaaaaagaauuaacaaaucaaaaacagucggcucuuugugaucuag

SEQ ID NO: 181298 - RNA, 36 nt, Homo sapiens
ugaucuguaauugccaguaacuggauucugaagcuc

SEQ ID NO: 181299 - RNA, 47 nt, Homo sapiens
gguguucuuuauuaguugcccuagcaaccauggaaagccugggagag

SEQ ID NO: 181300 - RNA, 46 nt, Homo sapiens
uuuaauguaaauuagagcaugugucauuaaagcuaggaugccagau

SEQ ID NO: 181301 - RNA, 42 nt, Homo sapiens
aaauuggugcuguuuucaguaguagaauugaguguauuugga

SEQ ID NO: 181302 - RNA, 46 nt, Homo sapiens
uuccugcugccagggacuaaggcaaaguuguaauaaggacagaguu

SEQ ID NO: 181303 - RNA, 43 nt, Homo sapiens
auugaggauuuuuccccucuuggggcaagggaaggaaagagaa

SEQ ID NO: 181304 - RNA, 50 nt, Homo sapiens
ccuucugggcuugaucuugugugcuguguuuuauuuuucaaaugaggcuu

SEQ ID NO: 181305 - RNA, 96 nt, Homo sapiens
uauaaggcaauugaaaucgagaaugggacuugaccuaggaggagagguuuucagagcagauagagaacuuacuaaagcugaaagaauuccaguagu

SEQ ID NO: 181306 - RNA, 43 nt, Homo sapiens
agcugucacuugacucaguuaugggcugucagaaggcaugaag

SEQ ID NO: 181307 - RNA, 72 nt, Homo sapiens
gcucucugggagaauggcgaguguggguaugccgaaugcugcuuuuuagagagaugcauguggaauaaucuc

SEQ ID NO: 181308 - RNA, 38 nt, Homo sapiens
uucuugaauauaaguuacgggaggcacuccaaugugaa

SEQ ID NO: 181309 - RNA, 60 nt, Homo sapiens
gaaaacugcagaaugcugacagucaaagucuuguuuggauuaauaaacucagagccaagu

SEQ ID NO: 181310 - RNA, 41 nt, Homo sapiens
cggugcugggcacuagacacagagccuuuguucaggcaccc

SEQ ID NO: 181311 - RNA, 77 nt, Homo sapiens
uuccccaccaauauaaugggguugauggugcccaucucguagcaugaaaugcacgaacuuauuugaaggagcuuugg

SEQ ID NO: 181312 - RNA, 26 nt, Homo sapiens
aaccaaaucaaacgucuuaacgcgua

SEQ ID NO: 181313 - RNA, 51 nt, Homo sapiens
ucccaggugcucuguugauaaggauggaagcagaacuacuuugagacacaa

SEQ ID NO: 181314 - RNA, 50 nt, Homo sapiens
gugagccugacugcaagguuugcuucugcugagaaaucccauggugagag

SEQ ID NO: 181315 - RNA, 162 nt, Homo sapiens
ccaaaaggggugugugugugucugugugugugucugugugugugucugugugugugucugugugugugucugugugucuaauauuuagacuaaaccaugguaaauguacgcacccaguauccuuuucaguuagcauauucuuucuuaaacucaucucaguac

SEQ ID NO: 181316 - RNA, 31 nt, Homo sapiens
uccuuuccaaacugaagugaguccaguuuca

SEQ ID NO: 181317 - RNA, 44 nt, Homo sapiens
ucuuugaugucaggagggaucacgaaaccuugcaaugccaugaa

SEQ ID NO: 181318 - RNA, 47 nt, Homo sapiens
aagucuuagcgaaaugucagcagucuauacugacacaccagccucau

SEQ ID NO: 181319 - RNA, 45 nt, Homo sapiens
agugugauaaaaagaaauucuuaucauuccuucuaaaugcacaga

SEQ ID NO: 181320 - RNA, 46 nt, Homo sapiens
ccaucaacagagacugacugccaaagaggccauggagcacccauac

SEQ ID NO: 181321 - RNA, 49 nt, Homo sapiens
agaaguaucacauagaccuagauccacacuucaacgauauccugggaca

SEQ ID NO: 181322 - RNA, 46 nt, Homo sapiens
gugcaguguccucacgggcucaugguguguucugugcucagugauu

SEQ ID NO: 181323 - RNA, 42 nt, Homo sapiens
agggaaccauucuuccauggacaggacaacuaugaccaggug

SEQ ID NO: 181324 - RNA, 45 nt, Homo sapiens
aaaagguugagcucuguugaucuagagagagggaugaaccaggau

SEQ ID NO: 181325 - RNA, 58 nt, Homo sapiens
uggcccuaaucagugaguaaauggaucaucuaguauuagacgaauaaaucauuagagc

SEQ ID NO: 181326 - RNA, 60 nt, Homo sapiens
uacuuggucaucuagaaaacccacgugggacccuuauguacaaaauaagccauacugaaa

SEQ ID NO: 181327 - RNA, 46 nt, Homo sapiens
ucuugcuacaguuauuauaaaacagagggaaaaaauugaaguagaa

SEQ ID NO: 181328 - RNA, 39 nt, Homo sapiens
gucugcccucacaaccccugguuucauaaagcacugcca

SEQ ID NO: 181329 - RNA, 36 nt, Homo sapiens
caugugucgucauccccuucuugcaugagucuuccu

SEQ ID NO: 181330 - RNA, 45 nt, Homo sapiens
aaaagcuuggguguguguuauguagcugaagcucuccugagcaga

SEQ ID NO: 181331 - RNA, 37 nt, Homo sapiens
uggucuccuccuacccggagauccugagaagugaggg

SEQ ID NO: 181332 - RNA, 81 nt, Homo sapiens
gagaagggagguaucauugucagcucuguagaaagcagacagguugguuuuggcuuuacaggcuaagguggaguagggcua

SEQ ID NO: 181333 - RNA, 85 nt, Homo sapiens
uuguguaugccacgaagcacagggaauguuggcaugagacucuuggggucuggacaaagcacgcagcagagugaggagucaccuu

SEQ ID NO: 181334 - RNA, 57 nt, Homo sapiens
gaaaugggugugguacugagugaguuguucagugggcccuuggcauacuuggguggu

SEQ ID NO: 181335 - RNA, 51 nt, Homo sapiens
ucuuggaagagugcuucuguuuuguuccauugacugugaacauuguaaaaa

SEQ ID NO: 181336 - RNA, 78 nt, Homo sapiens
uuauuuuuugaaaauguaaccaaagcugacuuccugccagcauuuugcaguggauuguuuaauaauguucucccugua

SEQ ID NO: 181337 - RNA, 66 nt, Homo sapiens
aguuuuuaugcuucauauaugccaaaacuguaauaaagauacuuuagaacaagacaaaacuucgaa

SEQ ID NO: 181338 - RNA, 44 nt, Homo sapiens
uugaaugaguucuggaaagugagaacaaagaagaaaggggagaa

SEQ ID NO: 181339 - RNA, 46 nt, Homo sapiens
aaaagcccagcaaguaugcagaacaaaagauaaaagggacccauac

SEQ ID NO: 181340 - RNA, 42 nt, Homo sapiens
uuuuuaccucuggaagcuuuuaggauuuucucauuugcacuc

SEQ ID NO: 181341 - RNA, 54 nt, Homo sapiens
ucaaggaaauuaugaauuauaaccuagaacucuauacccuagcaaauacauuaa

SEQ ID NO: 181342 - RNA, 54 nt, Homo sapiens
caguuaaaagauguugguaucaggacggaugguucuggguaaaaguaagagaac

SEQ ID NO: 181343 - RNA, 51 nt, Homo sapiens
uuuaguuguauguuaacuuugccuuuuguacgaaaucuuacuuugccgaga

SEQ ID NO: 181344 - RNA, 46 nt, Homo sapiens; identical to SEQ ID NO: 109513

SEQ ID NO: 181345 - RNA, 59 nt, Homo sapiens; identical to SEQ ID NO: 109516

SEQ ID NO: 181346 - RNA, 44 nt, Homo sapiens
acuugggaaacaaaagcacuguggcaagaguauagcaugcaguc

SEQ ID NO: 181347 - RNA, 45 nt, Homo sapiens
ugcugaauaaccggagaccaaugcaagacuuuacauggggcagcg

SEQ ID NO: 181348 - RNA, 42 nt, Homo sapiens
ggcugaacuuucuuuuuacucuguccuucuacauucuuggca

SEQ ID NO: 181349 - RNA, 52 nt, Homo sapiens
gagaguaaacaguuacccucaaggaguagaucauguaauuggggugaugaaa

SEQ ID NO: 181350 - RNA, 59 nt, Homo sapiens
uuguacuggggagucacagauuaagaguguaguuaaccugugucaaacagaaucgcaga

SEQ ID NO: 181351 - RNA, 72 nt, Homo sapiens
uuucaucuuuugauuuugaaaaaucaguucuucauuuccuuuguaguaccucuuagaaaaguguacacagaa

SEQ ID NO: 181352 - RNA, 53 nt, Homo sapiens
gcuaaaaucuuaaaacuuuccaaucaauagagagguuguaucuuuuuuugaca

SEQ ID NO: 181353 - RNA, 44 nt, Homo sapiens
aaugagcugcuaaaaaguuuuaggaauuuagaaacuggugagca

SEQ ID NO: 181354 - RNA, 53 nt, Homo sapiens
uucguaucaguucuuugcaauauaugugagaauggguggaugaugagugacua

SEQ ID NO: 181355 - RNA, 45 nt, Homo sapiens
ucccccuacuuuaaagauucuuggcguauguuaggaaacccagua

SEQ ID NO: 181356 - RNA, 41 nt, Homo sapiens
agaagaaugaauugcugacucuaaagcaauuccagaaaaau

SEQ ID NO: 181357 - RNA, 100 nt, Homo sapiens
uguucucagacacacuggggcugagaagugaggaacugauguugaagauacugagugugacuccucucuucccuaaauaugaauugcauuuaugaaguca

SEQ ID NO: 181358 - RNA, 77 nt, Homo sapiens
cugugguauagaaaagcuguuucugugugcuagggcagcugguauagguaaucccuguuuaaugugaggggucaggc

SEQ ID NO: 181359 - RNA, 44 nt, Homo sapiens
uuuccauuguggcccuuuugcagagguucuguggacuagaaaag

SEQ ID NO: 181360 - RNA, 45 nt, Homo sapiens
augauuuuaauuagcaugaagggucggcuaaauuuuccuucuggu

SEQ ID NO: 181361 - RNA, 46 nt, Homo sapiens
ggaaauuccuuagcggauaaucacuuguuuuuuuccuuuggcagua

SEQ ID NO: 181362 - RNA, 44 nt, Homo sapiens
aaaagggcuccguuuguuagaaaauaaauagguaaucaaaagac

SEQ ID NO: 181363 - RNA, 45 nt, Homo sapiens
gauuaugucguggcuuucauuuagggaaugaguugugacgugaug

SEQ ID NO: 181364 - RNA, 42 nt, Homo sapiens
uagcuguuuggcagaaugucgcccagcuuggauuugucugau

SEQ ID NO: 181365 - RNA, 56 nt, Homo sapiens
agcugcauuaagagcuugaggauauuuaugucuucuagagugaaagagauuuagaa

SEQ ID NO: 181366 - RNA, 83 nt, Homo sapiens
cgcucgcgccgcggucuccugcaguucccagcggccucucugggggucggaccuggucacugcgcgcacuuaucucagguggc

SEQ ID NO: 181367 - RNA, 43 nt, Homo sapiens
ggaaugaagggaaccugggugugggugucccugcaggccagag

SEQ ID NO: 181368 - RNA, 46 nt, Homo sapiens
cuaaaccacuuagccaaucacaacgccaaucuagaauacucugcgg

SEQ ID NO: 181369 - RNA, 46 nt, Homo sapiens
agcaucguggagacagcugcuucaaaacaguguucuacugacuuug

SEQ ID NO: 181370 - RNA, 46 nt, Homo sapiens
uuacagguucgcuauggucagaagaugaucuuacaucaguuguugg

SEQ ID NO: 181371 - RNA, 68 nt, Homo sapiens
cuguucccugaaggaacagcaauaagaacuuuauucuaagcuaauacucauugauguuugaaaaagag

SEQ ID NO: 181372 - RNA, 93 nt, Homo sapiens
aagccaguggacauacgguaguaauaaguaagucuuguuguguuucagcauuuaauaauagacuuuggagguagaccccugguuuaaaucuaa

SEQ ID NO: 181373 - RNA, 49 nt, Homo sapiens
acauaauauucaaacuggcuuuuugcuauucuuugggacaccaggaaug

SEQ ID NO: 181374 - RNA, 46 nt, Homo sapiens
aaaaaaaugcauuuaaacuuuggaacgugcccacauaagacaggag

SEQ ID NO: 181375 - RNA, 61 nt, Homo sapiens
uccuauagagaaauguaaaucagcauccagguauucagaaaaauccuaggaguaccaacag

SEQ ID NO: 181376 - RNA, 33 nt, Homo sapiens
ccguucaauugccugacgcacacacugcuucaa

SEQ ID NO: 181377 - RNA, 70 nt, Homo sapiens
cuaugauauacauuaagcaucuuuuacucuguguaaggaauuccuggagauugugauuuuauugcuagcu

SEQ ID NO: 181378 - RNA, 46 nt, Homo sapiens
uugaugucgugguagcuguacuguggcugugguggaaccguggcug

SEQ ID NO: 181379 - RNA, 28 nt, Homo sapiens
acuuucaguuauuauaguacuucccccg

SEQ ID NO: 181380 - RNA, 28 nt, Homo sapiens
auagugaacuauuaauauguuugccucu

SEQ ID NO: 181381 - RNA, 51 nt, Homo sapiens
ugauaaaauucuaauacauguucaccacugauuauuacaauauaaucauaa

SEQ ID NO: 181382 - RNA, 46 nt, Homo sapiens
caucaucuaucucuuuacuaaagugcugguuugccucuggccacac

SEQ ID NO: 181383 - RNA, 44 nt, Homo sapiens
uaacauucagacaagccuuucacacuaacguuaucaagucagcu

SEQ ID NO: 181384 - RNA, 35 nt, Homo sapiens
cucuuuugcucuauccaaaauccccucaaacccaa

SEQ ID NO: 181385 - RNA, 45 nt, Homo sapiens; identical to SEQ ID NO: 109575

SEQ ID NO: 181386 - RNA, 45 nt, Homo sapiens
auuugagcacuuuacucagcugggcaaauaaguggggugcaggcu

SEQ ID NO: 181387 - RNA, 42 nt, Homo sapiens
caugcgaaaauaggcagcguaauaaaugccugucugccucag

SEQ ID NO: 181388 - RNA, 67 nt, Homo sapiens; identical to SEQ ID NO: 109589

SEQ ID NO: 181389 - RNA, 44 nt, Homo sapiens
uucuuuaccaggggucuuacucuguucugaaacauggcaccugu

SEQ ID NO: 181390 - RNA, 69 nt, Homo sapiens
ucuuaucagccuugaggccuacaagugcucagcucacuagcgggacacuuguccugggugagcaggacc

SEQ ID NO: 181391 - RNA, 30 nt, Homo sapiens
cugcagacaccggaccgaguaggugggggc

SEQ ID NO: 181392 - RNA, 44 nt, Homo sapiens
ucuucgguuaacuccgcuuguuucucuacaaaauggcgccggag

SEQ ID NO: 181393 - RNA, 36 nt, Homo sapiens
aaggggcccauaacuccucgccacccugcgcgggaa

SEQ ID NO: 181394 - RNA, 42 nt, Homo sapiens
ccguaggaggaagauggcgguggggucgcgcguuacccggga

SEQ ID NO: 181395 - RNA, 47 nt, Homo sapiens
ccggggaaacguacaguccagagaguugcagaucuacgcuuggaugg

SEQ ID NO: 181396 - RNA, 51 nt, Homo sapiens
caauuuugcagucguuuuuacagauguuaaaagaccuggcuaucgaguuaa

SEQ ID NO: 181397 - RNA, 48 nt, Homo sapiens
accacauuaaauucuauuuacuauuucuuguguuuauuuuuuggucag

SEQ ID NO: 181398 - RNA, 77 nt, Homo sapiens
gagagggcgaagagauaggcuaucuccccaccucccacccuacuccccacuauauucccguuuugaccaccucagcc

SEQ ID NO: 181399 - RNA, 1966 nt, Homo sapiens
aggccagucacaguggcucacaccuauaaucucagcuaugggaggccaaggugggagguucucuggagcccaggaguucaagacaggcugggcaacauggugaaacuccaucucuacaaaaaauuuaaaaauuagccagguuaugguaacaugcaccuguggacccagcuacuugggaggcugaggugggaggaucgcuugagccuaugagaucaaggcuguagagacccaugaucaugccauuacacuccaaacugggcaacagagugagacccugucucuaaaaaagagagaaaugaguguuaggggacaggcccaguggaucaugccuguaaucccaacacuuugaaaagcugagaugggagaaccgcuugaggccaggaguucaagaccagccucggcaacauagugagacucaucucuacaaaaauuaaagaauuagcugggcguccgccaggcaugguggcucacgccuguaaucccaggacuuugagaggccaaggugggugaaucacuugaggccaggaguucgagaccagccuggccaacauggcaaaacccugucucuaucaaaauuacaaaaauuagccgggcguggugguggugccuguaaucccagcuacucgggaggcuaaggcaugagaaucacuugaaccugggaggccgagguugcagugagccaagaucgcgccgcugcacuccagccugggggagaaagugagacucugucuucaaaaaaaaaaaauuagccaggcaugguggcaugugccuguagucccagugacuugggaggccaagucaggaggaacuugagucuaagaauucaagacuacaguggaacuaugauuguaccacuucacuccagccugagugacagagcaagauccugucuuuaaaaaaaaaaaaaaaaacggccaggcacuggggcucacgccugugaucccagcacuuugggaggcccaggcaggcagaucacaugaggucaggaguucgagaccagcccaaccaacauggcgaaaccccaucuuacuaaaaauaaaaaaauuagggcugggcgugguggcucacgccuguaaucccagcacuucccgaggcaggcggaugacgaggucaggaguucgagaccagccuggccaacauagugaaaccucauuucuacuaaaaauacaaaaauuagucaggcuugguggcgggcgccuguaaucccagcuacucgggagucuguggcaggagaaucacuuaaaaccagaaggcagagguggcaguaagcugaaaucgcaccacugcauuccagccugggugaaagagcaaaacuccaucucaaaaaaaaaaaaaaauuagccagguguggcggcaggugacuguaaucccagcugcuuaggaggcugaggcaugagaacccaggagaccaagaucaugccauuguacuccagccugggcaugacagagcgcgacuccaucucaaaaaaaaaaaaaaaaaaaaaaaaaaaaauuagccgggcaugguguaaucccagcuacucaggaggcugaggcaggagaaucacuugaaccugggaaguggaggcugcacugagccgagaucgugccaccgcgugccagccugggcaacaagagugaaacuccaucucaaaaaaauaaaaaagaagaaggcuggguguaguggcucacacucugggagggugagguaggaggauuacuugagcccaggaguucaagaccagacugggaaacguagcaagaccccaucucuacaagaaaauuagcugggugugguggcaucugccuguaguccuagcuaccugggaggcucaggugggagaaucgcuugagccgaggaggucaaggcugcagugagccaugaucacacuacugcgcucuagucuggguaacagggcaagacucugucucaaaaaagaaaagaaaaauaagacagcgugaugugagagagugccugggguggggg

SEQ ID NO: 181400 - RNA, 35 nt, Homo sapiens
ucagagaaggcccaaaugaugagaaagagccagaa

SEQ ID NO: 181401 - RNA, 26 nt, Homo sapiens
ggaaggaggaaagagccccugcucug

SEQ ID NO: 181402 - RNA, 46 nt, Homo sapiens
gacacuuguggucgcuagagcugaagguggaugucccuaggggugg

SEQ ID NO: 181403 - RNA, 51 nt, Homo sapiens
acccccagugggcugaaggcaucagagaggguggcccaaugguuagggcag

SEQ ID NO: 181404 - RNA, 48 nt, Homo sapiens
gacaucugacagaucuuucuggguuucgagccagcagaggaauguuuc

SEQ ID NO: 181405 - RNA, 45 nt, Homo sapiens
gccuucgcugcucacugcuuugauuuugcugaguugcugguuggg

SEQ ID NO: 181406 - RNA, 63 nt, Homo sapiens
ccagaccuuuggggagaaggagcaaccgccucuggcacagcccaucagggagaaagagcaggu

SEQ ID NO: 181407 - RNA, 56 nt, Homo sapiens
cuacaugguuagagcagauggugguucuuuccagugggugaagccugaacccagcu

SEQ ID NO: 181408 - RNA, 50 nt, Homo sapiens
ccacauucaacaaagggaggagguccaaccgggcagagacaacaucccaa

SEQ ID NO: 181409 - RNA, 46 nt, Homo sapiens
ugaguccgcaugccaaugaugcggucagccaugacuuucacuucuu

SEQ ID NO: 181410 - RNA, 45 nt, Homo sapiens
ucauaauaccgauaaccuuguagcugcaugccagcaucccugaag

SEQ ID NO: 181411 - RNA, 45 nt, Homo sapiens
ugggcagguauuccuuguccaaauuuuuugcggcaaucugggccu

SEQ ID NO: 181412 - RNA, 41 nt, Homo sapiens
gauuaaaucaaacuaaauacaaaagagaaagcaugucaagc

SEQ ID NO: 181413 - RNA, 45 nt, Homo sapiens
gcuauuggugucccucuuaaaggcuucagugacucccagaauggg

SEQ ID NO: 181414 - RNA, 28 nt, Homo sapiens
gagggcagugggcagccgcaggacggag

SEQ ID NO: 181415 - RNA, 42 nt, Homo sapiens
uguccgcucgcccucugcuccguccugcggcugcccacugcc

SEQ ID NO: 181416 - RNA, 43 nt, Homo sapiens
acgguaaguauaaucucguggugguggugcauaaucucuugua

SEQ ID NO: 181417 - RNA, 44 nt, Homo sapiens
aguggggguccuucuccuaagagaucugcaccuucaggacuagu

SEQ ID NO: 181418 - RNA, 41 nt, Homo sapiens
agguggaacaagccaccaaaccaucauuugaaagagguaga

SEQ ID NO: 181419 - RNA, 45 nt, Homo sapiens
ugucaccuuugaaagcccagcagacgcuaaggaugcagccagaga

SEQ ID NO: 181420 - RNA, 92 nt, Homo sapiens
auacggaaacaaaugagaaagcucuugaaacaguauuuggcaaauauggacgaauaguggaaguacucuugauaaaagaccgugaaaccaac

SEQ ID NO: 181421 - RNA, 491 nt, Homo sapiens
agggagaaugagaaagucacugcgagggaagggagugaauugggaguaaagcucucagcuuagggcagcaugagacuccauccccauguaccaaucaacccguaacgcaugugagcagagaguggcacugacagagucugugugucacaggcacagcacaagguggaaauggguacaggggaccuuuucugccaccgagcugucaucagugcuccuggcacccugacaauuccaugugucuggagcauggaaucuccggccugagauuccaagcacuacugagaugcuucuccguaccccaagcaccgcuccagaugucucaaagugagccccggagguggguggccaauucccgaaaccugucccccacgcccacgcccaaggcggcucucggaagcccccaucuggccuuuuccccagggugccgccccucucuucgcccaggugagccccauaggcccgcacuuguaggugaggccgucuccgcaguu

SEQ ID NO: 181422 - RNA, 44 nt, Homo sapiens
gaauuucauuugccuccuucagugugaugccugcaggggcuacc

SEQ ID NO: 181423 - RNA, 46 nt, Homo sapiens
ucccgauucuucuucaggucuguccgggcaaugauggccacaagcu

SEQ ID NO: 181424 - RNA, 144 nt, Homo sapiens
uuggccugggcagcagugaccacuauggugaaggaaaggaaaaugcucaugugaagguuaaggugggagcccagcuuacccacucccaccacacauccuucagggcacaaucuugccuuaccauugccuccaaugacuuggaga

SEQ ID NO: 181425 - RNA, 139 nt, Homo sapiens
uugauuuugucagcuucacugcagggagaggcagagacacgggcaaggucacagcagagaugagacugucagugcaggauuagggugggguaacuggcuugccugucccaccugaaauaucuguucuggcugcugaggu

SEQ ID NO: 181426 - RNA, 45 nt, Homo sapiens
uggugauaccuaaagccuggaaaaaggaggucuucucgggcccga

SEQ ID NO: 181427 - RNA, 42 nt, Homo sapiens
agcaguuucuccagagcuggguuguuuuccaggugcccucgg

SEQ ID NO: 181428 - RNA, 86 nt, Homo sapiens
aucauccaauaguuggaugaucuuaaggaaguaguuggacuuccaggucgcccugucuucccugggcaucacggcggugcgucagg

SEQ ID NO: 181429 - RNA, 47 nt, Homo sapiens
uugccacgcaggguuuaaagacgaugucacuuccacgaggaugccug

SEQ ID NO: 181430 - RNA, 56 nt, Homo sapiens
ucaguccuucgugauccaagcuggucuguucuuggccaugggcagaagcuccugug

SEQ ID NO: 181431 - RNA, 48 nt, Homo sapiens
cucagaaauggcuugaauuguuggaaacccaagugguguuggagaacu

SEQ ID NO: 181432 - RNA, 44 nt, Homo sapiens
aaugggaaugauggcgugccuuccucccaggguugcugaaagga

SEQ ID NO: 181433 - RNA, 53 nt, Homo sapiens
acgggguuugaauucccgacagugagaacaauaccuugccgcagccccuggga

SEQ ID NO: 181434 - RNA, 26 nt, Homo sapiens
uuucacagaugagacacuugagaccu

SEQ ID NO: 181435 - RNA, 38 nt, Homo sapiens
aaugucccaugugagaagcugccacuggagggagacag

SEQ ID NO: 181436 - RNA, 46 nt, Homo sapiens
auccugagacuuguuaccagagguuaaagaagagaugcagggaaga

SEQ ID NO: 181437 - RNA, 24 nt, Homo sapiens
ggccgcugacacugaaagagaaug

SEQ ID NO: 181438 - RNA, 39 nt, Homo sapiens
aagggcagagcugggcugggcagacaagcuguguauggu

SEQ ID NO: 181439 - RNA, 83 nt, Homo sapiens
gccugcugggagauggagcagaguuugaggcaggaguguuggaacagguacaagucacagaagaaugagaaccugcaggccug

SEQ ID NO: 181440 - RNA, 37 nt, Homo sapiens
ugcgggcaggcccccagcguacucagggugguggaga

SEQ ID NO: 181441 - RNA, 40 nt, Homo sapiens
aagaguugagggaaagugcugcugcugggucugcagacgc

SEQ ID NO: 181442 - RNA, 49 nt, Homo sapiens
auucuagaaggugguacgugcaguggaacgagaaaaguaaaagccaggu

SEQ ID NO: 181443 - RNA, 71 nt, Homo sapiens
acacaacugagauguuucuaggaugaugagaaaaggagcuagcagaggacagauugaaaguacaaggggga

SEQ ID NO: 181444 - RNA, 47 nt, Homo sapiens
cacagaagagaguuaaccuagaauaguugucucaguaucuccuacaa

SEQ ID NO: 181445 - RNA, 47 nt, Homo sapiens
uaaguaaaugauuggcauaucacagguaaaagaaaaccacuaggugu

SEQ ID NO: 181446 - RNA, 47 nt, Homo sapiens
uuuaguuugauacuaaguauuaaacauauuucuguauucuuccacau

SEQ ID NO: 181447 - RNA, 50 nt, Homo sapiens
ucccgaugaugauuccaaaguccucucauuaaagacugacucuacccggg

SEQ ID NO: 181448 - RNA, 46 nt, Homo sapiens
aacugauuucuaccugaucuuuaacgacguggccaaauuccucaaa

SEQ ID NO: 181449 - RNA, 48 nt, Homo sapiens
gacugaaggccuggcgggugccuuggcaaccugagccacacaggccuc

SEQ ID NO: 181450 - RNA, 37 nt, Homo sapiens
uguuucaaagaagagcucauagacugacugguccaga

SEQ ID NO: 181451 - RNA, 49 nt, Homo sapiens
ugucacacaccacaugugcugaaaauggguaagaaagcugggugugcag

SEQ ID NO: 181452 - RNA, 34 nt, Homo sapiens
agcagggccuguggggggaagcagcgugagucag

SEQ ID NO: 181453 - RNA, 78 nt, Homo sapiens
auaaagugaagauuauuguguguggugaaugaguucagugaguccccaugaugcaguaguuuuuuuaaaaaauuagag

SEQ ID NO: 181454 - RNA, 46 nt, Homo sapiens
ugcagauuuucagucauuuuaccuucucagguaaaagccaugaaag

SEQ ID NO: 181455 - RNA, 71 nt, Homo sapiens
uuaaauggggcugcuaagaggggggaaauaugaaggaaugaagggacagcauuggaacggucagucggcag

SEQ ID NO: 181456 - RNA, 51 nt, Homo sapiens
uccuuugacucugagccaccuugucguguguauuuguaacaagacuuugga

SEQ ID NO: 181457 - RNA, 53 nt, Homo sapiens
guucauuuugggaaaggguuucccgaguggcccagugggcggguccgcggugg

SEQ ID NO: 181458 - RNA, 43 nt, Homo sapiens
ugccugucucucagucaaguuuucuuucccuuguccugucaga

SEQ ID NO: 181459 - RNA, 44 nt, Homo sapiens
ccgcacggaguccagggauguggacagucgcccugagauccagc

SEQ ID NO: 181460 - RNA, 39 nt, Homo sapiens
cuuuccugggagagggugggauaagcugaugucuggcag

SEQ ID NO: 181461 - RNA, 43 nt, Homo sapiens
gacaaguaaaaaucucuauauuuacuguguacagcaugauguu

SEQ ID NO: 181462 - RNA, 46 nt, Homo sapiens
gauuucagcuucaucuaugaagcuaggaccaugagaaaguaaaggg

SEQ ID NO: 181463 - RNA, 73 nt, Homo sapiens
ucacuuuccuuggagguucaggggagaggaggagaagauaagggaugagaauggaaugguuaguucuagaagg

SEQ ID NO: 181464 - RNA, 41 nt, Homo sapiens
aaauacuguguuuuaaaguaaguaaacugcaaggaguaugu

SEQ ID NO: 181465 - RNA, 45 nt, Homo sapiens
aggggucugcagaacuucuccuuugugucuuugccuccauggagu

SEQ ID NO: 181466 - RNA, 41 nt, Homo sapiens
gaauagaacacucccccaccccacucugccuuacuauugac

SEQ ID NO: 181467 - RNA, 60 nt, Homo sapiens
gauacagaauaucucuggaaugauacaaguuggggagcuggguggccgagggccagggug

SEQ ID NO: 181468 - RNA, 52 nt, Homo sapiens
ugcuggcaccuggaucuuggaguuuccagccuccagaacuaugagcaauaaa

SEQ ID NO: 181469 - RNA, 51 nt, Homo sapiens
augagggcucagcccucaugaaugggauuagugcccuuuuaaaagaguuug

SEQ ID NO: 181470 - RNA, 51 nt, Homo sapiens
gaggcagcuagccaauguuugaguauggggugccagcagcccguacagaua

SEQ ID NO: 181471 - RNA, 62 nt, Homo sapiens
aagaugcauugguuuuuaguuuggcguugcuguuagcaaagagaauguaggaggugaaggga

SEQ ID NO: 181472 - RNA, 42 nt, Homo sapiens
agcauuccuugggaauaauauaauguguggauacccuuuaaa

SEQ ID NO: 181473 - RNA, 69 nt, Homo sapiens
gcagucauguggaaccuugcuuucuaguccugggaaaaaaagaugucucuaauuacuggcuucaauaaa

SEQ ID NO: 181474 - RNA, 55 nt, Homo sapiens
uuaaaaucgguauuuaaacugaagacauugucauguuuuauuaauuuaacaaagu

SEQ ID NO: 181475 - RNA, 47 nt, Homo sapiens
ccaagaauuggucuuuccuaaaaaugcaacagauaaugcugcuagau

SEQ ID NO: 181476 - RNA, 52 nt, Homo sapiens
ugucaagacucuuugaagacuuucuugaauugcuuucguaaaggucugaaca

SEQ ID NO: 181477 - RNA, 42 nt, Homo sapiens
augaaccucugguuuuaccauaaugcaaugugccacggaaag

SEQ ID NO: 181478 - RNA, 77 nt, Homo sapiens
gacccaugugcuuggcccaggcuauguccucgugagagguacugggguccacggauauguguuguggggcagacagu

SEQ ID NO: 181479 - RNA, 47 nt, Homo sapiens
ucacuuguucuugggaagcagauuaaguagcagaaaguccaggaaag

SEQ ID NO: 181480 - RNA, 47 nt, Homo sapiens
gugaaagaaagagggcccacuuucuaacaggguggagcaaaugagac

SEQ ID NO: 181481 - RNA, 46 nt, Homo sapiens
augaacuuuaaaaaaaaaaaaaaaacuucauuggcuuguccgagug

SEQ ID NO: 181482 - RNA, 36 nt, Homo sapiens
uuaagguuacugucaucaagugauuauagaaggcgu

SEQ ID NO: 181483 - RNA, 46 nt, Homo sapiens
cagugugccuagcuccuccccaggcacgucaguaaaaaagccggac

SEQ ID NO: 181484 - RNA, 46 nt, Homo sapiens
gaaaauagcuauuuuacaugaaaauuuuacaaccgugaagccggaa

SEQ ID NO: 181485 - RNA, 41 nt, Homo sapiens
uggcuaagcacccucuugauuauagagcuauggaguagaag

SEQ ID NO: 181486 - RNA, 29 nt, Homo sapiens
gcuuccgaaggcugcauggcucacggcag

SEQ ID NO: 181487 - RNA, 58 nt, Homo sapiens
gagccggggagugcagucugugagaggcuggaaaugugaaagccaggagcucucaggg

SEQ ID NO: 181488 - RNA, 49 nt, Homo sapiens
gaagggcagugaugggguuauggaggaaguauggcagggaaagcaggag

SEQ ID NO: 181489 - RNA, 42 nt, Homo sapiens
ugaauugauuuuucuugagcagauugauuagauggagcugcc

SEQ ID NO: 181490 - RNA, 45 nt, Homo sapiens
acagggaugagcauuuggacuuuauccagucacaccugcggaggu

SEQ ID NO: 181491 - RNA, 46 nt, Homo sapiens
uugcccugccucugggugacaaugugcugacucauaaccuggggau

SEQ ID NO: 181492 - RNA, 45 nt, Homo sapiens
guguuuuacgugagcacauugauaaaaugaaaauuccaccagaaa

SEQ ID NO: 181493 - RNA, 42 nt, Homo sapiens
auccuugccagagacccucgucauuuuuguugcagacauguc

SEQ ID NO: 181494 - RNA, 45 nt, Homo sapiens
acaacccucaugacuaaacuacaaggagcugagcauggcaaaaaa

SEQ ID NO: 181495 - RNA, 55 nt, Homo sapiens
uuuuagguuaauuguaucauauuuugaagauuucuuguuuuucuuguggugaaac

SEQ ID NO: 181496 - RNA, 39 nt, Homo sapiens
uccggcaagaacauccuggucuucggugagcgccggcgg

SEQ ID NO: 181497 - RNA, 44 nt, Homo sapiens
aauugccuucggguugugcuuuagucuguaaaauucuaaaggag

SEQ ID NO: 181498 - RNA, 53 nt, Homo sapiens
gucaacugaccauaggugcuaaggagaaaaagcaaauaagggagauauaaaua

SEQ ID NO: 181499 - RNA, 56 nt, Homo sapiens
aaaauuugucacagaguucuggaggcuagaagucugggaucagggugccagcaugg

SEQ ID NO: 181500 - RNA, 69 nt, Homo sapiens
acuucccucccucacucuacuucccccuugucuuagucaguuugggcugcuguaacagaauaucauaga

SEQ ID NO: 181501 - RNA, 21 nt, Homo sapiens
ggagcaggaaaucaaagggca

SEQ ID NO: 181502 - RNA, 107 nt, Homo sapiens
aaaggccgaguggaaccaaaacacaggguuuuuuaacgucaagccaaaguccuuggacuugcuuggaggacuguuguagaguguuauguauauugguggggcagagg

SEQ ID NO: 181503 - RNA, 50 nt, Homo sapiens
cugugcuuuaguuuucucuucuauaaauggagauaacuauacauacuuca

SEQ ID NO: 181504 - RNA, 37 nt, Homo sapiens
uuuuguggguugccuggucucaggcaguucuccuugg

SEQ ID NO: 181505 - RNA, 24 nt, Homo sapiens
ccugagaccaggcaacccacaaaa

SEQ ID NO: 181506 - RNA, 46 nt, Homo sapiens
aggaaauuuaccuguucgaggcacaauuccugauaugauugcagau

SEQ ID NO: 181507 - RNA, 121 nt, Homo sapiens
uuggagggagcacaugugcaaaggcccagaagugggaugaagcuugacuuuuguucaagcaucaguaagcaagucagugugauuggagugaaguguaaaagggggaaaagugguaggaagg

SEQ ID NO: 181508 - RNA, 76 nt, Homo sapiens
aauuacagcagaacaaagggucagagagcaugcuggggacaagggaauccgggguugagagacaauuguacauagg

SEQ ID NO: 181509 - RNA, 74 nt, Homo sapiens
aaagaaaagauucuaauaguuggggggcaguaagcuaaauaaacagauaaaaaugcaccaggugcugugaacaa

SEQ ID NO: 181510 - RNA, 46 nt, Homo sapiens
aagaagcuauuaaaaaugugaacacagcacuaaauacaacucaggu

SEQ ID NO: 181511 - RNA, 46 nt, Homo sapiens
aaauggacgaauaccuaaaacguauaaagaaaaagaggacuucaga

SEQ ID NO: 181512 - RNA, 45 nt, Homo sapiens
auacugauauuuucuuuuauuugucucucauuuuuaggaccacag

SEQ ID NO: 181513 - RNA, 46 nt, Homo sapiens
acugaaaauguucucucaguucaggaaauggcuuaucuagucguag

SEQ ID NO: 181514 - RNA, 47 nt, Homo sapiens
gagauuaaauuauuugccuaaggucacauaguuagcaagugacagaa

SEQ ID NO: 181515 - RNA, 69 nt, Homo sapiens
aaauggauuuaaaggggcaaagauuggaggcagugauugcuguuagaaauuuccaguggccuaaguaag

SEQ ID NO: 181516 - RNA, 665 nt, Homo sapiens
ccuuuccccacuccagucuuuuuuuuguuuuuuaagacagaguuucgcucuuguugcccaggcuggaguacaauggcacaaucuuggcucacugcaaccuccaccucccggguucaacugauucuccugccucagccucccaaguaucugggauuacaggcacccgccaccaugcccagcuaauuuuuuuuuuuuuuuuuuugagacggagucucucucuuuugcucaggcuggacugcaguggcgcgaucuuggcucacugcuaccuccaccucccggguucacgccauucuccugccucagccucccgaguagcugggacuacaggcgcccgccaccgugcccggcuaauuuuuuguauuuuuaguagagaugggguuucaccauguuagccaggauggucucaaucuccugaccucgugaucugcccgccuuggccucccaaagugcugggauuacaggcgugagccaccgcacccggccgcccagcuaauuuuuugcauuuuuaguagagacaggauuucaccauguuggccaggcuggucucgaacuccugaccucaggugauccacccgccuuggccucccaaggugcugggauuacaggugugagccacugcaccagguccguccaaucuuuuauuucauucucaugcaggcuuuagg

SEQ ID NO: 181517 - RNA, 46 nt, Homo sapiens
uggacuaguugguuauaugaggaucauuauaaaagaacauccaggu

SEQ ID NO: 181518 - RNA, 46 nt, Homo sapiens
uuuuauaaugauccucauauaaccaacuaguccauauguccuacag

SEQ ID NO: 181519 - RNA, 113 nt, Homo sapiens
auggaaauaugccaaacaugaaaacaugcaaaacaugaaaaugucuuacagcaacuuucuuacuaaauaauagaugcaaagguacauaacugcauuuacauaagcaggucaag

SEQ ID NO: 181520 - RNA, 45 nt, Homo sapiens
agacaucgcuauuuaauucuuguaagaauuccauggcagcuucag

SEQ ID NO: 181521 - RNA, 46 nt, Homo sapiens
gcuccuugagcagcuuucccagcugcgccauggccgcgccugccgc

SEQ ID NO: 181522 - RNA, 46 nt, Homo sapiens
uauguggcagugucccugaugucccaccagacccuggagcacaugg

SEQ ID NO: 181523 - RNA, 46 nt, Homo sapiens
augaaacccuugcugcccauccugcauuggcucaagcacccagggg

SEQ ID NO: 181524 - RNA, 42 nt, Homo sapiens
gcaacagcuugcauggcccauguugauggaauucacuugcac

SEQ ID NO: 181525 - RNA, 45 nt, Homo sapiens
aaagcgcaggcagauuuaauuugcuaaauagacuaacaggaggaa

SEQ ID NO: 181526 - RNA, 21 nt, Homo sapiens
uaaaaaacagugaaauagcag

SEQ ID NO: 181527 - RNA, 29 nt, Homo sapiens
cuuuucuaugcaauauccuaacuuuuuuu

SEQ ID NO: 181528 - RNA, 66 nt, Homo sapiens
augcuaggagguaacuagucuaugccuuaacuccugaccuuuccugcauuaguaaaauuuccuccu

SEQ ID NO: 181529 - RNA, 53 nt, Homo sapiens
cuuuggggguugauucacagcauuuaagcuuucugauuauaccucucaaacau

SEQ ID NO: 181530 - RNA, 24 nt, Homo sapiens
ugcaucucucuugauucuggggcu

SEQ ID NO: 181531 - RNA, 31 nt, Homo sapiens
ccuugcaaauucucgaguggcagcuuccaug

SEQ ID NO: 181532 - RNA, 46 nt, Homo sapiens
ugcaaguggaguggaggguaaggagggcucuggggaagaguuggag

SEQ ID NO: 181533 - RNA, 18 nt, Homo sapiens
ugagagaugagcagggag

SEQ ID NO: 181534 - RNA, 50 nt, Homo sapiens
gcaggccaccccucagcccagcuuuugccuacuuugaagaccucaaggac

SEQ ID NO: 181535 - RNA, 48 nt, Homo sapiens
gcggaaugaaugaaugcauugggccuuagaacacagcagaggcucugg

SEQ ID NO: 181536 - RNA, 42 nt, Homo sapiens
agggcuguuaccguuguuuucuugaaucacucacaaugagaa

SEQ ID NO: 181537 - RNA, 62 nt, Homo sapiens
cugggaggaagcuuuccaagucgaugugacaagaauaaagaucugagcuggaaaguggagaa

SEQ ID NO: 181538 - RNA, 41 nt, Homo sapiens
gcuguggcuuucacaccaaccauuccgcacugcagcauggc

SEQ ID NO: 181539 - RNA, 66 nt, Homo sapiens
gauucgcuccaucaaugacccggagcauccacugacgcuagaggaguugaacguaguagagcaggu

SEQ ID NO: 181540 - RNA, 69 nt, Homo sapiens
ugucaggggcagccaggacuguucccauccuccuggaaugggggaaccuuccuuauccccugcccacau

SEQ ID NO: 181541 - RNA, 43 nt, Homo sapiens
gggcacggagcugggucccagcccccaaccccaccucgcugcg

SEQ ID NO: 181542 - RNA, 44 nt, Homo sapiens
ggccugggcauggagggucauagcugcggucccgguagccuggg

SEQ ID NO: 181543 - RNA, 47 nt, Homo sapiens
acugagcucccaguccagagagaagccagacaauuaaaacaguaaug

SEQ ID NO: 181544 - RNA, 75 nt, Homo sapiens
gcagcagcaugucuggcaaacugagucgcccuccugccuccagcucucuguugagcagagggaaggcaugggggc

SEQ ID NO: 181545 - RNA, 25 nt, Homo sapiens
guccguugagggcugcagucagagg

SEQ ID NO: 181546 - RNA, 45 nt, Homo sapiens
ugagcauuccaggccaagggagugaucaggaaggccaggggaaga

SEQ ID NO: 181547 - RNA, 46 nt, Homo sapiens
augaccagcaagguaggaggagaacuaaguucgacuguguuuggaa

SEQ ID NO: 181548 - RNA, 64 nt, Homo sapiens
ccagauggugaugacugcuacaaagaacaauaauuuggggaaggggagauaguggagaggggag

SEQ ID NO: 181549 - RNA, 43 nt, Homo sapiens
ggguagggucucgcgccagcccucucucccacccagccacuga

SEQ ID NO: 181550 - RNA, 62 nt, Homo sapiens
ggagcuccgccugcagcgccuccaacaccaagcgguagauccuccucugcaacucguccagc

SEQ ID NO: 181551 - RNA, 38 nt, Homo sapiens
gagucagcuggaguugcccaggcccugugagcaagugg

SEQ ID NO: 181552 - RNA, 46 nt, Homo sapiens
gcggggcgccaucccuggccagaccgugcuagagcugggcuggggg

SEQ ID NO: 181553 - RNA, 47 nt, Homo sapiens
gcugaguugcggauggagcucuauagcucaccaggcugguggggaga

SEQ ID NO: 181554 - RNA, 42 nt, Homo sapiens
cauggagcagggcauggcagagugagugucccccaccgccag

SEQ ID NO: 181555 - RNA, 43 nt, Homo sapiens
ggguucuucuggggaugcaguggagggccccacugugggcaug

SEQ ID NO: 181556 - RNA, 48 nt, Homo sapiens
ugggggagggggggguacucccgagagcaggggcagugggggugaggg

SEQ ID NO: 181557 - RNA, 49 nt, Homo sapiens
gcagugagagggggucccuucaauuuggagcaagaagugagaauaaauu

SEQ ID NO: 181558 - RNA, 88 nt, Homo sapiens
ggaaggaugcccuucaguuuucugggaaaagauugggaggagucaguuugagggggcagauagaacacguuccccucaguuuuggaga

SEQ ID NO: 181559 - RNA, 55 nt, Homo sapiens
ggggggccguggccgcgcaccgcucuggaucuggugggggcgguuuuggggaggu

SEQ ID NO: 181560 - RNA, 42 nt, Homo sapiens
cuaccugguggcccuguggauccugguggccagucuggccaa

SEQ ID NO: 181561 - RNA, 58 nt, Homo sapiens
ucgcccaguuccugcaucgcuucuugugggucccaggucccugucuucuccccuggga

SEQ ID NO: 181562 - RNA, 28 nt, Homo sapiens
ccccgcucuccccaacuccaucuguagg

SEQ ID NO: 181563 - RNA, 40 nt, Homo sapiens
acaggcauccugguucugaaaaagcagccuucccuggaga

SEQ ID NO: 181564 - RNA, 54 nt, Homo sapiens
gaugaaauaggguccccgaaggagagaagugggagaccaaaguagggacaagua

SEQ ID NO: 181565 - RNA, 86 nt, Homo sapiens
ccgagcccucgguauugcuggcacccucugcuuucccacucuccuuccugucccgccccucccugcagcucaucucccuaucugag

SEQ ID NO: 181566 - RNA, 45 nt, Homo sapiens
uuccuaagccuccucuuguugcucaccugucccagccccuguuag

SEQ ID NO: 181567 - RNA, 25 nt, Homo sapiens
gcucugacaccauucuaguucuaga

SEQ ID NO: 181568 - RNA, 36 nt, Homo sapiens
agugcgcaugggagaaaaggaaagagagccaaagac

SEQ ID NO: 181569 - RNA, 36 nt, Homo sapiens
gccaaguggugagguaaggagugaagauacaggaga

SEQ ID NO: 181570 - RNA, 45 nt, Homo sapiens
acucugcucuugucucuguccagcugcugugauauuaaccgugga

SEQ ID NO: 181571 - RNA, 46 nt, Homo sapiens
caggugccaagcuguccugaugcagccaccacacaccuaggaccag

SEQ ID NO: 181572 - RNA, 47 nt, Homo sapiens
agguacaggacacaugaacagagguggccuuuugcacaugacagaca

SEQ ID NO: 181573 - RNA, 42 nt, Homo sapiens
aggggaccaggaucucuugcuccacgugccccuuagacccag

SEQ ID NO: 181574 - RNA, 24 nt, Homo sapiens
gccagaggcucaggccugggucua

SEQ ID NO: 181575 - RNA, 73 nt, Homo sapiens
caaaaacagggggugcuguagaccggcugacggacaccagcagauacacgggcucccacaaggagcgcuucga

SEQ ID NO: 181576 - RNA, 33 nt, Homo sapiens
agggagcccagcccuucccacccacagccacga

SEQ ID NO: 181577 - RNA, 51 nt, Homo sapiens
cuggagcugccuggggagaggggcccgucacugucgcccugggccacagag

SEQ ID NO: 181578 - RNA, 55 nt, Homo sapiens
aacccagcgccaccugaccgcgcugagaugaccaagaauccaucuuuccacggac

SEQ ID NO: 181579 - RNA, 32 nt, Homo sapiens
accccuguugccacugauuggaauuccaaggg

SEQ ID NO: 181580 - RNA, 48 nt, Homo sapiens
agggcugggggugggguggggguggggaauggggcugggaauggucuu

SEQ ID NO: 181581 - RNA, 45 nt, Homo sapiens
uauuaccccggccagggccuggggcucauguacuucauccacuac

SEQ ID NO: 181582 - RNA, 42 nt, Homo sapiens
agacaguuggccuuagagagggcaguuuuauugucucagagg

SEQ ID NO: 181583 - RNA, 44 nt, Homo sapiens
gagggggucuucguccauccuuggugggggggggugcccagccc

SEQ ID NO: 181584 - RNA, 91 nt, Homo sapiens
ugcaauugagagccuugggccaggacgcuagaagauagggauguaguugucgauuuuggcgcgguggcgcugggcgauacauucagcgauc

SEQ ID NO: 181585 - RNA, 47 nt, Homo sapiens
gcuaccugcacccucgaagagcagcuuguacuccuggccaggggggu

SEQ ID NO: 181586 - RNA, 46 nt, Homo sapiens
guucuugaccuguucauagucgucagcccgagccagcugcgccagg

SEQ ID NO: 181587 - RNA, 42 nt, Homo sapiens
agucaguuggcagagccuccccaggccagggcuagcgggcac

SEQ ID NO: 181588 - RNA, 48 nt, Homo sapiens
gccaauccacggcugcugcaccagcugccuacuguucccaccugcugg

SEQ ID NO: 181589 - RNA, 44 nt, Homo sapiens
cagucaggcccuggguagccugccuggcccagcaaaagcaacag

SEQ ID NO: 181590 - RNA, 45 nt, Homo sapiens
guaacuguaacuacagggggcaggcaauagcaaggagcccaucaa

SEQ ID NO: 181591 - RNA, 42 nt, Homo sapiens
auccaguuagggucacucugucccccaguggggacagaagag

SEQ ID NO: 181592 - RNA, 40 nt, Homo sapiens
agccaccuacucucuccaguggcuucucuauccccaccug

SEQ ID NO: 181593 - RNA, 51 nt, Homo sapiens
guagguagagccagaggcugccaggcagaaaaaagcuugaggcuggcuaag

SEQ ID NO: 181594 - RNA, 43 nt, Homo sapiens
agugggcuggagggccugaaggcuguggguagagaggugccug

SEQ ID NO: 181595 - RNA, 54 nt, Homo sapiens
ugagugaggggaggagugaguggcugguaggacuggaagccacaaucacccaug

SEQ ID NO: 181596 - RNA, 64 nt, Homo sapiens
cccccuccccccaugccaucugccauuccccauccggaaccuuggcacuaucacccucaacugg

SEQ ID NO: 181597 - RNA, 46 nt, Homo sapiens
acccuucaaguuucaagcuagaucccauguggcaaggccugaggaa

SEQ ID NO: 181598 - RNA, 47 nt, Homo sapiens
gggcuguggagccucugaguggccaccagcacagggacaagggcagg

SEQ ID NO: 181599 - RNA, 68 nt, Homo sapiens
caaaugagguugaggagagagaaaaauucauccucuguccugaagacaaauuuucccucuccuggaga

SEQ ID NO: 181600 - RNA, 36 nt, Homo sapiens
gugaggaaagucaagaagggaaacaaccaaccgaau

SEQ ID NO: 181601 - RNA, 51 nt, Homo sapiens
ggaucaggaauccccucacauccuggccacccuucccuucccuaccaccug

SEQ ID NO: 181602 - RNA, 45 nt, Homo sapiens
cugaaaucuagcaaguccuugucacacugggugagaagaugauag

SEQ ID NO: 181603 - RNA, 31 nt, Homo sapiens
ugcugaggugaugcaaguccuggagaucccc

SEQ ID NO: 181604 - RNA, 53 nt, Homo sapiens
aggagguuuucuagcuguuugacugaacaggugaugguaagauccuguauagu

SEQ ID NO: 181605 - RNA, 49 nt, Homo sapiens
gacucacccucagcgggaggcagguggugugcagcagguaggcucucca

SEQ ID NO: 181606 - RNA, 42 nt, Homo sapiens
gcuccucaccacggcugggacggguuggcggccgcaguaggu

SEQ ID NO: 181607 - RNA, 43 nt, Homo sapiens
gguucuuugggacucuaaugagagagacauuagcaggguggcc

SEQ ID NO: 181608 - RNA, 44 nt, Homo sapiens
cugccccagugucuuccagguggcagacucaggccccuggcucc

SEQ ID NO: 181609 - RNA, 45 nt, Homo sapiens
cugcuuccuuugaguuuuuuaauaaaauaaucucaugcggcagga

SEQ ID NO: 181610 - RNA, 42 nt, Homo sapiens
ggagcuggggguacggcuggcguguggggaccugggggucag

SEQ ID NO: 181611 - RNA, 43 nt, Homo sapiens
uucagccaggcacacgagugcccccugaugcuccugguccucc

SEQ ID NO: 181612 - RNA, 41 nt, Homo sapiens
cauagagcuuuuucugaacaucuaagucuugguugcuaaga

SEQ ID NO: 181613 - RNA, 45 nt, Homo sapiens
uuaccaaccaggcacccguagccggggcugcuccgugggcagcag

SEQ ID NO: 181614 - RNA, 45 nt, Homo sapiens
ccagaaucagcucccgaauccagggccguaggaccagccuccccg

SEQ ID NO: 181615 - RNA, 43 nt, Homo sapiens
aggugaccgucaggcuguuuaaccuucaaacacagggccgcag

SEQ ID NO: 181616 - RNA, 45 nt, Homo sapiens
ccggccauggugaccgauggccugugugucaucucuaguguccag

SEQ ID NO: 181617 - RNA, 46 nt, Homo sapiens
ucucccccauuccucucuugcuacaaauaaggaaacaggcccagga

SEQ ID NO: 181618 - RNA, 44 nt, Homo sapiens
gcuccugcuccauauugguggacaugggaaugguugguguggcc

SEQ ID NO: 181619 - RNA, 48 nt, Homo sapiens
gccuaggaaacccaaauaggguuuggugggccacuuagugggcauggu

SEQ ID NO: 181620 - RNA, 50 nt, Homo sapiens
caggccccauuugguguugggggcaggguggcucugggagaguccagggg

SEQ ID NO: 181621 - RNA, 43 nt, Homo sapiens
agcacuggggcaagggugggaaucaggugacaggccucugagg

SEQ ID NO: 181622 - RNA, 46 nt, Homo sapiens
gcguccaccaagagcaaacagaaccacaguaaauacccugcaccca

SEQ ID NO: 181623 - RNA, 45 nt, Homo sapiens
gcuacccuggcucccccagccucaguccccgacauggccccagua

SEQ ID NO: 181624 - RNA, 47 nt, Homo sapiens
guauugugccacagccacggcuuuugcucgaaugacugaaaccccga

SEQ ID NO: 181625 - RNA, 45 nt, Homo sapiens
aggguggacugagggcccugggaagaccaucugcagugacagugg

SEQ ID NO: 181626 - RNA, 51 nt, Homo sapiens
caugaaaugaccaggcaugagcauggccaguaugcagccacaugcaagaag

SEQ ID NO: 181627 - RNA, 54 nt, Homo sapiens
cugguugcuguggagcagcagugaggguggcacuaguccaggagguaaacagac

SEQ ID NO: 181628 - RNA, 33 nt, Homo sapiens
cagggccguccagaacagagggugguuugguau

SEQ ID NO: 181629 - RNA, 47 nt, Homo sapiens
cucugaauuagcuggagcagcuguucagcaccagggcugugggaaga

SEQ ID NO: 181630 - RNA, 26 nt, Homo sapiens
guggaguuagguaucauugaaacuac

SEQ ID NO: 181631 - RNA, 50 nt, Homo sapiens
caauugggguugagagucauggugguagcagagaggcuggggaggacuuu

SEQ ID NO: 181632 - RNA, 110 nt, Homo sapiens
caaaauccauauaaaaugucuuuguaauucuaggaucguugguguugugacuuggugguggaacagagccuagcccuucugucaugaaggggccagaacaagaugcucug

SEQ ID NO: 181633 - RNA, 72 nt, Homo sapiens
aaagggcuccagagugggucuuguguggucgggucaaguuggaaagaagggacucaucaguggaagagggau

SEQ ID NO: 181634 - RNA, 117 nt, Homo sapiens
uuccuuguuagaagagaagcagaagcucaucaggccagagcacaggaggaugaaccuagcagccccauguggcaggcacugugugccauuccuauuaugggaccauugggaaggaau

SEQ ID NO: 181635 - RNA, 45 nt, Homo sapiens
auguaaagccagcacagaucagcuuuguccucaggaagccugugg

SEQ ID NO: 181636 - RNA, 97 nt, Homo sapiens
uguuuucuccuagucuuuaucauagauaacagcugaguuaguuaucuagguagagagcagagaccaacuucagaagggaaguguuuacacuuagaga

SEQ ID NO: 181637 - RNA, 47 nt, Homo sapiens
aagcagggauuauuuuuagugaugauguaauuugauaccuagaaggu

SEQ ID NO: 181638 - RNA, 46 nt, Homo sapiens
agcaagagacuccgcugccgcgcuccuggagccccaaggacaaaua

SEQ ID NO: 181639 - RNA, 42 nt, Homo sapiens
gggggcggagucagggaugcgccacgcccccgagccuagcgc

SEQ ID NO: 181640 - RNA, 45 nt, Homo sapiens
ccaggccccggcaagauccccacaaggcuggacugagccacuaug

SEQ ID NO: 181641 - RNA, 50 nt, Homo sapiens
augugguugguuuguagucagaaaaggcuuccuggaagacgauuagcaga

SEQ ID NO: 181642 - RNA, 44 nt, Homo sapiens
cuguguacauaggguccucccccuuccuacggguaugcagauga

SEQ ID NO: 181643 - RNA, 76 nt, Homo sapiens
gagucggccuccagcaccccugagucucuccaggccaggcgacaucaucaguuucuugagccagccccagcgccug

SEQ ID NO: 181644 - RNA, 320 nt, Homo sapiens
cuuuacccuucucugagcuaugcagccuuggccugcugcgucuccggccuguauucucuccccuucacucaggcccugggaaaccagcccaguuucuggcaggagaggcagaggaggucaaugccuuugcucugggcuuccugagcaccagcaguggugucucuggagaagaugaaguagagcccuuacacgauggaguugaagaggcagagaaaaagauggaagaagaaggugugagugugagugaaauggaggcaacaggagcacaaggacccagcaggguagaagaggcugagggacacacagaggugacagaagca

SEQ ID NO: 181645 - RNA, 36 nt, Homo sapiens
ggcuggagguuguaaagggguguggugugguggcca

SEQ ID NO: 181646 - RNA, 50 nt, Homo sapiens
aaguaagguuggguuuuccccugcuggccuuuggggaaagcucuccccgc

SEQ ID NO: 181647 - RNA, 46 nt, Homo sapiens
accuccagcccgccgagcuguagacgugggugccuuuuugcgggau

SEQ ID NO: 181648 - RNA, 124 nt, Homo sapiens
aggugcugcucuggguguuuccuguucugggaguggguggaggagagacuuggggagggaggugcugccugggauggaaucugcccauacuacuuccuaccaguuuuagccucacagcaucugu

SEQ ID NO: 181649 - RNA, 68 nt, Homo sapiens
gcgguccaacccuccagacaagagagcaguugcggcagguacacagaacucccccaccuuggauugug

SEQ ID NO: 181650 - RNA, 44 nt, Homo sapiens
ugucagccccacccucuccuugguguuucugcagccccagaauc

SEQ ID NO: 181651 - RNA, 71 nt, Homo sapiens
ugccgauagucuguuggcagaucggcccauauucaggccagugggcacuuggaggaacagacaccucggac

SEQ ID NO: 181652 - RNA, 46 nt, Homo sapiens
acggcuucccccaggaaguugaguggccaaacaaggacgauagcca

SEQ ID NO: 181653 - RNA, 114 nt, Homo sapiens
gaagaggaaaacugagucucagagaggagcagggucuggguggaacccagcgucgacucuguucgaagaggaaaacugagucucagagaggagcagggccugggacucugagaa

SEQ ID NO: 181654 - RNA, 46 nt, Homo sapiens
ugcugccuuucaucucuuucaucuucacuuccaucagagccaggau

SEQ ID NO: 181655 - RNA, 44 nt, Homo sapiens
gugccccggcagccugcuggacucccagaccccauccagccagg

SEQ ID NO: 181656 - RNA, 46 nt, Homo sapiens
gugguaccccaaguuggcugcagaucucuuugccaagcacaggucu

SEQ ID NO: 181657 - RNA, 45 nt, Homo sapiens
ccgaggggcuggcacgauggcggcagcggcagcggcaacccagcg

SEQ ID NO: 181658 - RNA, 44 nt, Homo sapiens
ccgggcuccacaaagggcgcgguaagaaacguacacuuccgagg

SEQ ID NO: 181659 - RNA, 45 nt, Homo sapiens
aagacagggauaaagucucccguggaauccccucccgccucauau

SEQ ID NO: 181660 - RNA, 43 nt, Homo sapiens
ucagcccagauggcuggccaagacagaauccuuuccuggggcu

SEQ ID NO: 181661 - RNA, 55 nt, Homo sapiens
aagugcuagcucacuccaguccgugugaccucgcccaaagccagaggagccagcg

SEQ ID NO: 181662 - RNA, 46 nt, Homo sapiens
caaucugcucccaaauuggcuugucucccauucuggagcgucaccc

SEQ ID NO: 181663 - RNA, 47 nt, Homo sapiens
guccugcgcggugaugcugugcugaauuuucuggaacggaaggcucu

SEQ ID NO: 181664 - RNA, 42 nt, Homo sapiens
cuaugaggagagaaaagaggauucaguaaggggaucaagaaa

SEQ ID NO: 181665 - RNA, 91 nt, Homo sapiens
uugugcaugauauuuggagcaucuggaggagugggaauaguauugggaagaggagggaggaggaaacagcgugagugccuagcugagagga

SEQ ID NO: 181666 - RNA, 46 nt, Homo sapiens
caaacaucaugcacaacaccucaguggcagcagcgcacugcgccca

SEQ ID NO: 181667 - RNA, 48 nt, Homo sapiens
cauuacuuaagucuuuccaaggcaugcgcugguacaacacaaacuucu

SEQ ID NO: 181668 - RNA, 45 nt, Homo sapiens
gcgcggcacaggcuccgaaaccaaccaggagacgcugcgggcuac

SEQ ID NO: 181669 - RNA, 47 nt, Homo sapiens
ccuggaaccacagcuguccugacccagacagugaagccacuaacccu

SEQ ID NO: 181670 - RNA, 46 nt, Homo sapiens
uguucggcuggaaccggucuucuagcaccgccagggccgcguccug

SEQ ID NO: 181671 - RNA, 76 nt, Homo sapiens
ggagcgcuauuuauugcauauuuauuguuuggaugucaccaucagagacgaagggaaggguagccagggagggagu

SEQ ID NO: 181672 - RNA, 46 nt, Homo sapiens
cacgacgcccgccugguucuccuaaacaugccuggcccacccagga

SEQ ID NO: 181673 - RNA, 46 nt, Homo sapiens
gagucugcagugggggcugacaagauccagaugacguggaccaggg

SEQ ID NO: 181674 - RNA, 45 nt, Homo sapiens
ucgcagaugcugcggcagaugagacugaccaagacugagcgggag

SEQ ID NO: 181675 - RNA, 42 nt, Homo sapiens
cuggaggaagugccggaugcgcaucuucacaguggcccagau

SEQ ID NO: 181676 - RNA, 42 nt, Homo sapiens
cugcccugucggcuccuugagggcgggaugaacugcuuugug

SEQ ID NO: 181677 - RNA, 51 nt, Homo sapiens
aauucucagcguauccuacaaggcucuacaugaucugaccauuguauccug

SEQ ID NO: 181678 - RNA, 53 nt, Homo sapiens
cugcguguucacgugacuuccuuccuucucgcggagaccgaguuacgcgauag

SEQ ID NO: 181679 - RNA, 42 nt, Homo sapiens
acggggcgccggcgccgccgcccccgggcucgcggccugcag

SEQ ID NO: 181680 - RNA, 38 nt, Homo sapiens
cguguguguggugaguuaaaaacggauuuaaaucgcug

SEQ ID NO: 181681 - RNA, 47 nt, Homo sapiens
uaacuauuaguagaaguaauacuguaguaguuuuauuagguguuaua

SEQ ID NO: 181682 - RNA, 55 nt, Homo sapiens
gccauaugagguucaaguaacaguggaauuuaagaggagugaguuuguucaggga

SEQ ID NO: 181683 - RNA, 41 nt, Homo sapiens
gacuuucaccuguuggcaauuggggcucuaagauuuaagua

SEQ ID NO: 181684 - RNA, 42 nt, Homo sapiens; identical to SEQ ID NO: 110045

SEQ ID NO: 181685 - RNA, 44 nt, Homo sapiens
cugauaaaguaaaaaaguaacauuuagaguugcuggagugacgg

SEQ ID NO: 181686 - RNA, 88 nt, Homo sapiens
uagggaggaagugcgggaagugauaacuucaguaggcugacauccagagauauguaccagggagggagauagacauccugacacagag

SEQ ID NO: 181687 - RNA, 42 nt, Homo sapiens
cugaaaauagaagugcaaccuaaaacucaucaucgagcccau

SEQ ID NO: 181688 - RNA, 45 nt, Homo sapiens
acagcagaugaucgauauuuacgaccucaugcauuuuaccaggug

SEQ ID NO: 181689 - RNA, 46 nt, Homo sapiens
gguauuuugaaacuccgcaauucagauauagaacuucgaaaaggag

SEQ ID NO: 181690 - RNA, 42 nt, Homo sapiens
uucuuccagaauccaaaaucauuuuucuugaaaaaggacaag

SEQ ID NO: 181691 - RNA, 31 nt, Homo sapiens
agaaugaauuuacuguuaagauacauaguaa

SEQ ID NO: 181692 - RNA, 42 nt, Homo sapiens
aguucaccgcuuucugggccaccaucuccucagcuucagccu

SEQ ID NO: 181693 - RNA, 41 nt, Homo sapiens
ggggugauugguaugguacaggaugguuuuaaagccaugag

SEQ ID NO: 181694 - RNA, 60 nt, Homo sapiens
uacuuauauaaucucgcuuucguaaagacaauagcauuguaacuuucuaaugugcugcca

SEQ ID NO: 181695 - RNA, 45 nt, Homo sapiens
auguauucuauuuuaaaauugauauccuuuuuuugaguuccuucg

SEQ ID NO: 181696 - RNA, 45 nt, Homo sapiens
agcagagaaaccacuuagucaugacugagucuuagcccgaggaag

SEQ ID NO: 181697 - RNA, 56 nt, Homo sapiens
gcaggggugagcaggcaggcuccccucccgaguccugagucccuggauuuaggaag

SEQ ID NO: 181698 - RNA, 52 nt, Homo sapiens
ccaacuucucagcauguuucucuccuuggaccuuggguuuccaacucugcag

SEQ ID NO: 181699 - RNA, 77 nt, Homo sapiens
caggacuccagaugggaagguuuuaagagucacacuggcauggaaggcuuaucugccauucuauuuauagccugaaa

SEQ ID NO: 181700 - RNA, 44 nt, Homo sapiens
augaucuaaaaaccagccuuuuccccagaaggcucugagcacau

SEQ ID NO: 181701 - RNA, 47 nt, Homo sapiens
gaugccuguagcacuagaaaugcuuuccuauuuaaaauaaacauuaa

SEQ ID NO: 181702 - RNA, 45 nt, Homo sapiens
gcucaaauugaaaccuuguguuuuauaaaauggauguuuaguaaa

SEQ ID NO: 181703 - RNA, 43 nt, Homo sapiens
ugaggcuccucaguuuuagugcugaaauaauaaacagugacag

SEQ ID NO: 181704 - RNA, 41 nt, Homo sapiens
aguucagguagaguugaguggcuggcccuggauaguaggca

SEQ ID NO: 181705 - RNA, 42 nt, Homo sapiens
uccccaccaaguucugcaaaaaguggacaauugagagagaug

SEQ ID NO: 181706 - RNA, 46 nt, Homo sapiens
ccagaccccaaagucauccucuguggcaucugucuccaguccuaaa

SEQ ID NO: 181707 - RNA, 46 nt, Homo sapiens
uggcagggcaggugcuuggaugcugcauauggaauucucuucggag

SEQ ID NO: 181708 - RNA, 38 nt, Homo sapiens
uaggaggaaggaggcaggcugcaaagcugguucagcca

SEQ ID NO: 181709 - RNA, 42 nt, Homo sapiens
ccaggccaaaugagggcaaucacauauaaccgaagcccucaa

SEQ ID NO: 181710 - RNA, 57 nt, Homo sapiens
aacagacaaggaaucaucaucguggugccuccucaucaggaaccacaagaguuguug

SEQ ID NO: 181711 - RNA, 47 nt, Homo sapiens
gugagcaggggaggucaccgagccuccacauagucuaguccaagcau

SEQ ID NO: 181712 - RNA, 71 nt, Homo sapiens
uauagcuggagcuaaggccaggagagaguaaugggucggggagagacgugagcaucucaggcugccuggga

SEQ ID NO: 181713 - RNA, 46 nt, Homo sapiens
uggggagacugaggcugcaagagguggaaauggccuugccuauggu

SEQ ID NO: 181714 - RNA, 24 nt, Homo sapiens
cugccugucaucauugacugcugg

SEQ ID NO: 181715 - RNA, 32 nt, Homo sapiens
gucuggucuggucugguuggcaccaccucugc

SEQ ID NO: 181716 - RNA, 86 nt, Homo sapiens
acaccaugguggagagccuugugggcuggggcuacacacggggugaggauguccgaggggcucccuaugacuggcgccgagcccca

SEQ ID NO: 181717 - RNA, 44 nt, Homo sapiens
ugagcuuuucucaggccagacacaagacgagagggggaggggag

SEQ ID NO: 181718 - RNA, 71 nt, Homo sapiens
gcagaugaaaacgggcccuacuuccuggcccuccgcgagaugaucgaggagauguaccagcuguauggggg

SEQ ID NO: 181719 - RNA, 45 nt, Homo sapiens
ugggcaacauguacacgcucuacuuucugcagcggcagccgcagg

SEQ ID NO: 181720 - RNA, 29 nt, Homo sapiens
gagucacugggccugacccaaucacaaug

SEQ ID NO: 181721 - RNA, 45 nt, Homo sapiens
cccuuucagaguuucucugugaguccccuuagagcuuuguuucaa

SEQ ID NO: 181722 - RNA, 44 nt, Homo sapiens
cugcaggagacaacaaccggaucccagucaucgggccccugaag

SEQ ID NO: 181723 - RNA, 42 nt, Homo sapiens
ccaggacaucggcuuugaagauggcuggcucaugcggcagga

SEQ ID NO: 181724 - RNA, 28 nt, Homo sapiens
cuaugguacuggcguccccacaccagac

SEQ ID NO: 181725 - RNA, 42 nt, Homo sapiens
guaccaucgccgucaccaaagcagauuuuagggucacgguca

SEQ ID NO: 181726 - RNA, 80 nt, Homo sapiens
agugcccugcagugccaggccuggcagagccgccaggagcaccaaguguugcugcaggagcugccaggcagcgagcacau

SEQ ID NO: 181727 - RNA, 52 nt, Homo sapiens
uccuugggcccugacuccugugccacaggacuccuguggcucggccguggac

SEQ ID NO: 181728 - RNA, 59 nt, Homo sapiens
aaugagagucuagacucaagggacacuggauggcaagaaugcugcugaugguggaacug

SEQ ID NO: 181729 - RNA, 46 nt, Homo sapiens
aaguaugaaaagcccacaggaauaggggggacacauggccccaggc

SEQ ID NO: 181730 - RNA, 38 nt, Homo sapiens
auaggagccccauccucagcccugugcugacccacuug

SEQ ID NO: 181731 - RNA, 29 nt, Homo sapiens
cccagcuuagugcugggacuagcccagaa

SEQ ID NO: 181732 - RNA, 41 nt, Homo sapiens
cuacaacagccugagugaggaggaaagaggcagcagcagac

SEQ ID NO: 181733 - RNA, 85 nt, Homo sapiens
aggugaaugaugaucaagaaccagaggacauuuacgacgaugaagaugacgagaacagugagaauaacuggcgcaaugaguaccc

SEQ ID NO: 181734 - RNA, 44 nt, Homo sapiens
aacacgaugacuauguguaugacauuuacuacuuggagacggcc

SEQ ID NO: 181735 - RNA, 49 nt, Homo sapiens
cacauaaaggagagggagcuuucccuaauggaacagaucaaggaauuua

SEQ ID NO: 181736 - RNA, 39 nt, Homo sapiens
augauugugagcaggcuuuuagucagcaagcuauuucuc

SEQ ID NO: 181737 - RNA, 42 nt, Homo sapiens
ggagaggggcagguggaugucugggaagagugauccaagcag

SEQ ID NO: 181738 - RNA, 277 nt, Homo sapiens
agagguaagaguccgauagcccugaccucugacccuguguugguccauuugcauugcuguaaaggaauaccagagacuggguaauuuauaaagaaaagagguuuauuuuggcucaugguucugcaagcuguacagaaagcauggugcuggcauucgcuucugcugagggccuccagaagcuuccaaucaugguggaaggcaaaguggggacgugucacagggagagagagggaguaacagagaggugggggaggcaccaggcucuuuaaacagcaca

SEQ ID NO: 181739 - RNA, 49 nt, Homo sapiens
ccggcugcuuuaaugagggcauugaucuuauccuccgugacugucaccu

SEQ ID NO: 181740 - RNA, 41 nt, Homo sapiens
uccucggaaggaccgagcagcuuggcggcagcugagggaag

SEQ ID NO: 181741 - RNA, 32 nt, Homo sapiens
gcgcgagcccaccccgcggacuccgcggccag

SEQ ID NO: 181742 - RNA, 64 nt, Homo sapiens
ggaggaggugggagcgccccucgcucugaggaguggugcauucccggucuaaggaaaguggggu

SEQ ID NO: 181743 - RNA, 42 nt, Homo sapiens
gccucucuccagguggcgccggggcaccgugaacguguagcu

SEQ ID NO: 181744 - RNA, 42 nt, Homo sapiens
ggugagggcgcgcugccggugucccugggcggaguagggagg

SEQ ID NO: 181745 - RNA, 62 nt, Homo sapiens
uacagcucgacugaugaaguauauuugcucugugugcucuagagcuuucuauuggaucagaa

SEQ ID NO: 181746 - RNA, 29 nt, Homo sapiens
uucugauccaauagaaagcucuagagcac

SEQ ID NO: 181747 - RNA, 493 nt, Homo sapiens
caaacuuuguggauuaaauacacccauuuccccuccuuuuuuuuuuuugagacggagucucgcucuguugcccagacuggagugcagugacgugaucucggcucacugcaaccucugccucccagguuccagugauucuccugccucagccucccuaguagcugggacuacaggugugugccuccaugccuggcuaauuuuuguauuuuuaguagagacaggguuucgacuacggccauaccacccugaacgcgcccgaucucgucugaucucggaagcuaagcagggucgggccugguuaguacuaguacuuggaugggagacaggguuucaccauguugguuaggcuggucuacaaucuggaguuuugcucuuguugcccaggcugggcaaacuccuggccucaggugauccgcccaccuuggccucccaaagugcugggauuacaggcgugagccacugugcccggccauuuccccuccuuucugaagga

SEQ ID NO: 181748 - RNA, 45 nt, Homo sapiens
aaagcaaacccagaaaccagcuuugggaucaccuuacaucaucag

SEQ ID NO: 181749 - RNA, 50 nt, Homo sapiens
agacaugaguaauuggggaagugacuuuuaugaguuugagggguaggggg

SEQ ID NO: 181750 - RNA, 64 nt, Homo sapiens
gcaaacagggauuuccauaaccaccuggcagagaggggcaggcagggccccacugggaggaagc

SEQ ID NO: 181751 - RNA, 46 nt, Homo sapiens
ugagcuuuuugcgucucucaucaagcucuuuccaggcuccucugca

SEQ ID NO: 181752 - RNA, 43 nt, Homo sapiens
cccaugguggaagugagaggauuagcagaaagaagaaugaaaa

SEQ ID NO: 181753 - RNA, 92 nt, Homo sapiens
agauuaaagagaaagaaugggggagaaacauucuccaaggccuguuauaaaggaggggcaaaauucuccaaggccuguuauaaaggaggggc

SEQ ID NO: 181754 - RNA, 54 nt, Homo sapiens
ggggcgggaccuccugugcagagacugggagacaggaauaugacagaugguaua

SEQ ID NO: 181755 - RNA, 57 nt, Homo sapiens
cauccaaauauaccaucugucauauuccugucucccagucucugcacaggagguccc

SEQ ID NO: 181756 - RNA, 37 nt, Homo sapiens
gucuauccuccauucguuuguucaguaaugauggagg

SEQ ID NO: 181757 - RNA, 255 nt, Homo sapiens
agagcacugaguggagacagguguguaggaaagaugaaucggaauggagcauugcugggaaguacuagggugaucugagaaggccucacugaagggggacauuugagcaaagacccaagagaggugaaggaucaggccaugugacuagguagggaaggguguucuagacggaggggagggcguucuagauggagggaacagcaaagacacaccccugacacugagcagaagggcaaggucagugaucaaggggca

SEQ ID NO: 181758 - RNA, 42 nt, Homo sapiens
gugugugagaaaggguucggggcgcgugguugguggaaguua

SEQ ID NO: 181759 - RNA, 647 nt, Homo sapiens
gaauagcagcuaauguguauugagcccuuuuuucuuuuucuuuuuaagacagggucucacuuugucacccaagcuggagugcagugcagaucacagcucgcuguagucucgaacuccuagucucaagcaauccucccaucugagccucccgaguagcugggaccauaggcacgugccaccauaccuggcuaauuuaaaaaaauuuuuuguagccgggcgcgguggcucacgccuguaaucccagcacuuugggagguggaggcggguggaucacaaggucaagagaucgagaccauccuggccaacauggugaaaccccgucucuauuaaaaauacaaaaauuagcugggcgugguggcgcaugccuguagucccagcuacuagggaggcugagacaggagaaucgcuugaacccaggagguggagguugcagugagccgagaucgcaccacuacacuccagccuggcgacagagcaagacucccucucaaaaaaaaaaaaaaauuuuuuuuuuguaaagagaucucacuauguugcccaggcuggucucaaauaccuggccucuugccucugccuccuaaagugcugggauuacaggcgcgagccaccgugccuagcccauugagcuuuuauucugugucugacag

SEQ ID NO: 181760 - RNA, 357 nt, Homo sapiens
uggcugaguauuuuuaaaaagugccccaggaggcugggcccgguggcucaugccuguaaucccagcacuuugggaggcugaggcgggcggaucacaugauguugggaguucgagaccugcccgaccaacauggagaaaccccaucucuaaaacuacaaaauuaaccgggcaugguggcgcaugccuguaaucccaucuacucgggaggcugaggcaggagaaucacuugaacccgggaggcagagguugccgugagccaagaucacaccauugcacuccagccugggcaacaagagcaaaacuccaucucaaaaacaaaaacaaaaacaaaaaacccaggaaagucucugugcagca

SEQ ID NO: 181761 - RNA, 55 nt, Homo sapiens
ggaggaagaaaaugugaugauuuucuuuuuaaucaguaagcaaacaguuccuaga

SEQ ID NO: 181762 - RNA, 30 nt, Homo sapiens
cuuggaugaaauagaaauuccaucggacaa

SEQ ID NO: 181763 - RNA, 46 nt, Homo sapiens
cuguagguggagucccaggcguagaccaagaaauggaucugugggu

SEQ ID NO: 181764 - RNA, 45 nt, Homo sapiens
aagucacgcugaauacaguggggcaccaccaccgccccccgcccc

SEQ ID NO: 181765 - RNA, 54 nt, Homo sapiens
uuuugggguguggggaucggguaguguagaagagugguaaaggccugaacaccg

SEQ ID NO: 181766 - RNA, 45 nt, Homo sapiens
agacagaagagagacuggguuauuccucccaucagcugcccagaa

SEQ ID NO: 181767 - RNA, 46 nt, Homo sapiens
aacaaagacaaagaaggcaagguuuucuacagcaucacuggccaag

SEQ ID NO: 181768 - RNA, 47 nt, Homo sapiens
caggauggcugaaggugacagagccucuggauagagaacgcauugcc

SEQ ID NO: 181769 - RNA, 23 nt, Homo sapiens
uccuguuccuuuaggucagggac

SEQ ID NO: 181770 - RNA, 88 nt, Homo sapiens
acgcugugucauccaacgggaaugcaguugaggauccaauggagauuuugaucacgguaaccgaucagaaugacaacaagcccgaauu

SEQ ID NO: 181771 - RNA, 50 nt, Homo sapiens
cacaugcauauaacacaacaauggcuugccaagaaguucuguccguagga

SEQ ID NO: 181772 - RNA, 49 nt, Homo sapiens
aacucuuccaggaaccucugugauggaggucacagccacagacgcggac

SEQ ID NO: 181773 - RNA, 56 nt, Homo sapiens
gcugcugaccuucaaggugagggguuaagcacaacagcaacagcugugaucacagu

SEQ ID NO: 181774 - RNA, 44 nt, Homo sapiens
gucguaaucaccacacugaaagugacugaugcugaugcccccaa

SEQ ID NO: 181775 - RNA, 45 nt, Homo sapiens
cagcacauccacggugacgguggcuguggagguggugagagagac

SEQ ID NO: 181776 - RNA, 49 nt, Homo sapiens
ccguggaugugcuggaugugaaugaagcccccaucuuugugccuccuga

SEQ ID NO: 181777 - RNA, 46 nt, Homo sapiens
caaaguccucggacacuuccacucucuuuucaggaggcacaaagau

SEQ ID NO: 181778 - RNA, 72 nt, Homo sapiens
auuuggagagacacugccaacuggcuggagauuaauccggacacuggugccauuuccacucgggcugagcug

SEQ ID NO: 181779 - RNA, 39 nt, Homo sapiens
uccucccuguccagcucagcccgaguggaaauggcacca

SEQ ID NO: 181780 - RNA, 71 nt, Homo sapiens
auuccucucacagaagaauauaguucgagguucugguaugggggcguugucauucacaucagacaggauca

SEQ ID NO: 181781 - RNA, 65 nt, Homo sapiens
uauucuucugugagaggaauccaaagccucaggucauaaacaucauugaugcagaccuuccuccc

SEQ ID NO: 181782 - RNA, 54 nt, Homo sapiens
ugggucguuguacugaaugguccaguuggcacucgccccguguguuaguucugc

SEQ ID NO: 181783 - RNA, 41 nt, Homo sapiens
guggaguguagggugagcagugagugucaaugacuaaaagg

SEQ ID NO: 181784 - RNA, 43 nt, Homo sapiens
acguugucccgggugucauccucugggggcaguaagggcucuu

SEQ ID NO: 181785 - RNA, 48 nt, Homo sapiens
acaacguuuauuacuaugaugaagaaggaggcggagaagaggaccagg

SEQ ID NO: 181786 - RNA, 37 nt, Homo sapiens
cucaugagaaucuguaggauggcuggggcucagcaga

SEQ ID NO: 181787 - RNA, 76 nt, Homo sapiens
ggacuuugacuugagccagcugcacaggggccuggacgcucggccugaagugacucguaacgacguugcaccaacc

SEQ ID NO: 181788 - RNA, 45 nt, Homo sapiens
uagucaaacacgagcagagaaucauaaggcggggcugugggguca

SEQ ID NO: 181789 - RNA, 46 nt, Homo sapiens
uaugacuacuugaacgaauggggcaaucgcuucaagaagcuggcug

SEQ ID NO: 181790 - RNA, 54 nt, Homo sapiens
augcagaaaucacguugcuggugguuuuucagcucccuucccuugagaugaguu

SEQ ID NO: 181791 - RNA, 56 nt, Homo sapiens
gcuuuaagaaauaagucgaaacuuuucuaacacaaacuuauuagagcuauaaagug

SEQ ID NO: 181792 - RNA, 51 nt, Homo sapiens
uuauuucuuaaagcuuuuuuuuuuuucccaucacucuuuacauggugguga

SEQ ID NO: 181793 - RNA, 670 nt, Homo sapiens
gugcuucugcucauuacuacacuggugugucccucugccuuuuuuuuuuuuuuaagacagggucucauucuaucggccaggcuggagugcaguggugcaaucacagcucacugcagccuuguccucccaggcucaagcuauccuugcaccucagccucccaaguagcugggaccacaggcaugcaccacuacgcaugacuaauuuuuuaaauauuugagacggggucucccuguguuacccaggcuggucucaaacuccugggcucaagugauccucccaucuuggccucccagaguauugggauuacagacaugagccacugcaccugcccagcuccccaacucccugccauuuuuuaagagacaguuucgcuccaucgcccaggccugggaugcagugaugugaucauagcucacuguaaccucaaacucuggggcucaagcaguucucccaccagccuccuuuuuauuuuuuuguacagauggggucuugcuauguugcccaagcuggucuuaaacuccuggccucaagcaauccuucugccuuggccccccaaagugcugggauugugggcaugagcugcugugcccagccuccauguuuuaauaucaacucucacuccugaauucaguugcuuugcccaagauaggaguucucugaugcagaaau

SEQ ID NO: 181794 - RNA, 96 nt, Homo sapiens
uauugggcucuuuuaggguaagaaguuugugucuuugucuggccacaucuugacuagguauugucuacucugaagaccuuuaauggcuucccucuu

SEQ ID NO: 181795 - RNA, 32 nt, Homo sapiens
gccuaaagugcugcagccaaagacagagcgga

SEQ ID NO: 181796 - RNA, 38 nt, Homo sapiens
cuuuucauaguuccgcucugucuuuggcugcagcacuu

SEQ ID NO: 181797 - RNA, 43 nt, Homo sapiens
uccccaagugccugcuuuugaugaugucuacagaaaaugcugg

SEQ ID NO: 181798 - RNA, 94 nt, Homo sapiens
cagaaaaccgagaauauucaaaauuccaaauuuuuuucuuaggagcaagaagaaaauguggcccuaaaggggguuaguugagggguagggggua

SEQ ID NO: 181799 - RNA, 74 nt, Homo sapiens
ggaauugucuugauuuuucggcaguucaagcuauaucgaauauaguucuguguagagaaugucacuguaguuuu

SEQ ID NO: 181800 - RNA, 58 nt, Homo sapiens
aucacuuucuuuguguuccauguuuggguucgaagaucuuaugccacaggaagucauu

SEQ ID NO: 181801 - RNA, 45 nt, Homo sapiens
ucaauccagguaaacccaacccuaggacuccggaaguugcuccug

SEQ ID NO: 181802 - RNA, 46 nt, Homo sapiens
gcaggucugugccaacugggauucugcccaaccaaaagaaaacugc

SEQ ID NO: 181803 - RNA, 48 nt, Homo sapiens
cucuucagaauuagacacugucacuacucacccauuuuaaggcgcacu

SEQ ID NO: 181804 - RNA, 42 nt, Homo sapiens
gugacggcugcugacuggaagaagugugaccugaucgcaaag

SEQ ID NO: 181805 - RNA, 39 nt, Homo sapiens
uuaccuuuuaauuagcacuugaaccguuggaaugacuaa

SEQ ID NO: 181806 - RNA, 34 nt, Homo sapiens
aagaucauccuaucgcuuauugcagagcagcccu

SEQ ID NO: 181807 - RNA, 46 nt, Homo sapiens
caguuuagaguugccacucaagguggcauuaugauuaccaucaaag

SEQ ID NO: 181808 - RNA, 46 nt, Homo sapiens
uggucuccaaaagggguuugagaaugugaggugaucugaggucuca

SEQ ID NO: 181809 - RNA, 194 nt, Homo sapiens
uaaagaaccagaguaaagacccuauaauuuauuuuauuuuauuuuaagagacagagucucacuaucagcccaggcuggacuugaauuccugggcucaagugauucucccaccucagccucccaaguagcugagacaacaggugcacaccaccgugcccagcuuaaaacccuguaauauugaauuucaguuggaa

SEQ ID NO: 181810 - RNA, 34 nt, Homo sapiens
cuggaagccacagggaccaacagagcaggagaga

SEQ ID NO: 181811 - RNA, 59 nt, Homo sapiens
guucuggaugguucuugcuaucaugauguagaugaagaagaugaggauguagacauaag

SEQ ID NO: 181812 - RNA, 78 nt, Homo sapiens
ucagacacuaaaugacuguucagaaauguacuuagaauugaaugaagggucucaaaagagaaguggcggguaccaaga

SEQ ID NO: 181813 - RNA, 41 nt, Homo sapiens
ugugugacuggcugauuacauaccgaguuaggugaggaguc

SEQ ID NO: 181814 - RNA, 42 nt, Homo sapiens
aacacauacccugauccggucauccaagaacucgcuguugau

SEQ ID NO: 181815 - RNA, 103 nt, Homo sapiens
cuggaccacccuccagaaauuugugaauuuugugaggaggcaacacuuagacacaggaaagauuuauuuagacacaggaaagacuuaaacuccucaaaugaau

SEQ ID NO: 181816 - RNA, 41 nt, Homo sapiens
aaaucaguuacuagcuaauuuggugaugaagaacaugaggg

SEQ ID NO: 181817 - RNA, 32 nt, Homo sapiens
aguuuugaaauagauguucaauaaugaguaug

SEQ ID NO: 181818 - RNA, 46 nt, Homo sapiens
aucuccauuuauguccuggaaaagggaagauuucuuuuacauccug

SEQ ID NO: 181819 - RNA, 48 nt, Homo sapiens
aucaaucaaagauugauacauucaaauuugcaucagaauauuuaacaa

SEQ ID NO: 181820 - RNA, 70 nt, Homo sapiens
aguaucuaugugcuagucacagcaacccugcagguuaggaauuauucuccccauuuuacagaugagggaa

SEQ ID NO: 181821 - RNA, 47 nt, Homo sapiens
auguauaaauucagaaaguagaguaauaguugucagaggaugugggg

SEQ ID NO: 181822 - RNA, 47 nt, Homo sapiens
auuucauggcuucuggggcuccuuuaaagucccucaccuccuauuca

SEQ ID NO: 181823 - RNA, 44 nt, Homo sapiens
uauguacgugccuagcgagaaaguuuuauaccacauuucaugug

SEQ ID NO: 181824 - RNA, 43 nt, Homo sapiens
ggguugcuguggguauuuugggaaguuguuaucugcccaggag

SEQ ID NO: 181825 - RNA, 76 nt, Homo sapiens
agggauauuucuccaaaagaacaccauggugguguuguuaccagaagagagaguagaugcuagguguaaucacaug

SEQ ID NO: 181826 - RNA, 367 nt, Homo sapiens
gcuaaagacuaaugagagaaaauaggaauaaacaacaguaagggcccggcacgguggcucaugccuuuaaucccagcacuuugggaggccgaggcagguggaucaccugaggucaggaguuugagaccagccugaccaacauggagaaacccugucucuacuaaaaauauaaaauuagcugggcaugguggcacaugucuguaaucccagcuacucaggaggcugaggcaggagaaucacuugaacccgggagauggagguugcagugagcugagaucacgccauuguacuccagccugggcaacaagaacaaaacuucgucucaaaaaaaaaaaaaaaaaagacuauguuaaacaacaguaagagg

SEQ ID NO: 181827 - RNA, 27 nt, Homo sapiens
acccaccagauuuucugaguugagaac

SEQ ID NO: 181828 - RNA, 46 nt, Homo sapiens
uucuuucucuuagcaaacaauucauuuacccuuaggccucagacau

SEQ ID NO: 181829 - RNA, 61 nt, Homo sapiens
cuuugaaaccaaaauguguguaccugggggcuuguuacacuaguguggugaggguaguuug

SEQ ID NO: 181830 - RNA, 44 nt, Homo sapiens
auaucuuuaaggagacagagaaauaguaaugaauguuugcccuu

SEQ ID NO: 181831 - RNA, 45 nt, Homo sapiens
agugagcccuggaauggggggucucagucugcacaguggacccug

SEQ ID NO: 181832 - RNA, 45 nt, Homo sapiens
agugagcccuggaaugaggggucucagucuacacagugagcccua

SEQ ID NO: 181833 - RNA, 45 nt, Homo sapiens
agugagcccuggaauggggggucucagucugcacagugggcccug

SEQ ID NO: 181834 - RNA, 44 nt, Homo sapiens
agugagcccuggacgagguuccucagucugcacagugggcccug

SEQ ID NO: 181835 - RNA, 41 nt, Homo sapiens
auaguucaaaguaucuaauuaaucagugauggcagagagau

SEQ ID NO: 181836 - RNA, 42 nt, Homo sapiens
uucccugguaaaaggaagauugagaaauagacaaauaaaaga

SEQ ID NO: 181837 - RNA, 47 nt, Homo sapiens
ugcuuguggaugcgucagccaagggccucugugguuguggcagcugg

SEQ ID NO: 181838 - RNA, 28 nt, Homo sapiens
guugccugcuucaaaaacaaaaacaaag

SEQ ID NO: 181839 - RNA, 25 nt, Homo sapiens
cccaggagaaugaugagacagugau

SEQ ID NO: 181840 - RNA, 54 nt, Homo sapiens
uuuucauaggcaaagucuauaaaaaagugaccucuccuuuugaaaccaugguau

SEQ ID NO: 181841 - RNA, 51 nt, Homo sapiens
ccagaggaaguccuaugaugugugggaucccuagagucacagggauuggga

SEQ ID NO: 181842 - RNA, 62 nt, Homo sapiens
caucauuuccauucgccaucuccagugaacuuuccuauuccuaaaauguggccucucuuuuc

SEQ ID NO: 181843 - RNA, 46 nt, Homo sapiens
cccgaugacguggccaagcuccaugcccaguuggcccuagaagagc

SEQ ID NO: 181844 - RNA, 76 nt, Homo sapiens
gaaaaugaggagcagaacuggccacccuuggcugcucaagaggcauuucagaguaggagaugcaguuggagguggg

SEQ ID NO: 181845 - RNA, 38 nt, Homo sapiens
uuggcgaccauguuaauccuagagaaaggccagccuga

SEQ ID NO: 181846 - RNA, 127 nt, Homo sapiens
caucaaaggagagggagacuggaguuaaaaucgaaccauucuaacggcagcacaggaaaguccuuaagccugcuucuucaaacauagcaccuggaaaugguccugauuacacagugcuugucaguaa

SEQ ID NO: 181847 - RNA, 43 nt, Homo sapiens
ccccugcuuauuuucucugauguugcagauugcaaaucuggga

SEQ ID NO: 181848 - RNA, 42 nt, Homo sapiens
guugggaauuuaggaggucauggaugucggaaauaaaggugu

SEQ ID NO: 181849 - RNA, 29 nt, Homo sapiens
ucgggggugcgcccgcgggggcccuccca

SEQ ID NO: 181850 - RNA, 48 nt, Homo sapiens
uccccuccccuggccggccuggaggggcccggagggcggccgggcaca

SEQ ID NO: 181851 - RNA, 51 nt, Homo sapiens
uagaacucccauugugcuauggggagaccaagucucagagaacuggggcaa

SEQ ID NO: 181852 - RNA, 55 nt, Homo sapiens
ggcaguccucccaccucauccucccuaguaacugcgauuacaggcacauacacca

SEQ ID NO: 181853 - RNA, 45 nt, Homo sapiens
uccugggcuccagagggcacucagaaguugugcuaaaccaaguua

SEQ ID NO: 181854 - RNA, 47 nt, Homo sapiens
aaccugcggaaggagguucucccagcccaucugaacacaaccagagg

SEQ ID NO: 181855 - RNA, 45 nt, Homo sapiens
agguucuuugauugauugggaguaccagugaagagggaguuggau

SEQ ID NO: 181856 - RNA, 42 nt, Homo sapiens
cuccagguggaugauuuucccauacaggauaugaugccccac

SEQ ID NO: 181857 - RNA, 102 nt, Homo sapiens
uccgccccgcucgcucccuuccuucccuccgccuuccgucuccacaccgcucccuucccccacacuccuggcccucccaccccggaggccccuccgggcuug

SEQ ID NO: 181858 - RNA, 44 nt, Homo sapiens
gcuggugaguuggggaaggggcgugggaagcggcugcgagagcu

SEQ ID NO: 181859 - RNA, 125 nt, Homo sapiens
gggcgaacaagaccuggucucuacucucggccaguauauauguuggcgggcgucggggggacgggguaggguaagugacagacgucagaccaggcagccagauuaagucaaacccugucguuucu

SEQ ID NO: 181860 - RNA, 46 nt, Homo sapiens
uaaccagucaaacagauuggcuguuucacgaacagauggcacugug

SEQ ID NO: 181861 - RNA, 50 nt, Homo sapiens
cuggaucuuuuggacacaggaagggaaauuguugguauaucagucucaac

SEQ ID NO: 181862 - RNA, 46 nt, Homo sapiens
gcugggcucaauggcgagauuauggaguaugauuuacaggcguuaa

SEQ ID NO: 181863 - RNA, 81 nt, Homo sapiens
uugguugugaagauggaucugugaaacuauuucaaauuaccccagacaaaauccaguuugaaagaaauuuugaucggcaga

SEQ ID NO: 181864 - RNA, 48 nt, Homo sapiens
guauauuuauguguaugucacuuucuuuuuuuguuguccaacucccaa

SEQ ID NO: 181865 - RNA, 45 nt, Homo sapiens
cauugcagcugguuccauagacuacauuaguguguuugaugucaa

SEQ ID NO: 181866 - RNA, 54 nt, Homo sapiens
ucagacaacgucuccaguauucugcugacgugcauuuugggagcuucccaccuu

SEQ ID NO: 181867 - RNA, 22 nt, Homo sapiens
gaugccugcauguaggguauga

SEQ ID NO: 181868 - RNA, 45 nt, Homo sapiens
cacacucaugacgugcgcacuguggcccacagcccaacagcgcug

SEQ ID NO: 181869 - RNA, 50 nt, Homo sapiens
uggucuuucccagugaaccucaucugggcuucuguauuuaccaccacaca

SEQ ID NO: 181870 - RNA, 30 nt, Homo sapiens
gugcuaagguggugcuacuguaucugguac

SEQ ID NO: 181871 - RNA, 42 nt, Homo sapiens
uccuacccugcagauacacucacucacauguuugcuguuuca

SEQ ID NO: 181872 - RNA, 45 nt, Homo sapiens
auuuggggccagagaaauuucaucauccuuaguuuguuagcagaa

SEQ ID NO: 181873 - RNA, 45 nt, Homo sapiens
cuccaaagggauacuccuaucacacacaucaguuuucaucccaag

SEQ ID NO: 181874 - RNA, 46 nt, Homo sapiens
gaucuuuuggaugaaagaacacucguggcaguagaacggccucugg

SEQ ID NO: 181875 - RNA, 24 nt, Homo sapiens
ugucuacccuguugcuuuucacaa

SEQ ID NO: 181876 - RNA, 34 nt, Homo sapiens
ugcccucuaguagcacauaauccguuauuucuca

SEQ ID NO: 181877 - RNA, 51 nt, Homo sapiens
cugggcaaugaccaaggauguugccugaaaagcuaacccuagagauaaaug

SEQ ID NO: 181878 - RNA, 55 nt, Homo sapiens
ugcagcauuauaagaccuuggugcccagaaaaaucuguccuuuuugguaccaaac

SEQ ID NO: 181879 - RNA, 71 nt, Homo sapiens
uuagccaaaacaggccuucaauagguagugguuuucuacauuaucuuccaaaagaccucagguuugguacc

SEQ ID NO: 181880 - RNA, 50 nt, Homo sapiens
uugaaauuuaagucucagaucuucuggauaccaaaucaaaaacccaacgc

SEQ ID NO: 181881 - RNA, 32 nt, Homo sapiens
agaguuaggcaagacuucauggaagaagggac

SEQ ID NO: 181882 - RNA, 42 nt, Homo sapiens
auuguguguaagcgucccuucccagggugucacuuuagacag

SEQ ID NO: 181883 - RNA, 46 nt, Homo sapiens
aaggccaaggagagcauucgagccaagugcgugcaguaccuagacc

SEQ ID NO: 181884 - RNA, 46 nt, Homo sapiens
acgaagcaaagagaaacacggcaagaagccagucaaagagaaccag

SEQ ID NO: 181885 - RNA, 41 nt, Homo sapiens
cuccaaucguaaagaaggccagcucaaaucugccccggguu

SEQ ID NO: 181886 - RNA, 46 nt, Homo sapiens
uggagaagcccaacauacgguggaacgacguggccgggcuggaggg

SEQ ID NO: 181887 - RNA, 58 nt, Homo sapiens
aucggcugggacacagucccaacaaagacaagugaagguggaagggaccugggagagg

SEQ ID NO: 181888 - RNA, 25 nt, Homo sapiens
agacaucaaggcauuggggcuacag

SEQ ID NO: 181889 - RNA, 45 nt, Homo sapiens
cugggcugucgaccaccaguucacguaguuauaguuugauuggau

SEQ ID NO: 181890 - RNA, 24 nt, Homo sapiens
agguaucaugauggcaaagucaua

SEQ ID NO: 181891 - RNA, 42 nt, Homo sapiens
cuuucccaucgcugccgcuagcuuccgcagucgccauugaac

SEQ ID NO: 181892 - RNA, 43 nt, Homo sapiens
aaucuucccucucucaucuaauagcaacccaacucuugaagac

SEQ ID NO: 181893 - RNA, 52 nt, Homo sapiens
cauucauggcuguuuuagaacacagcauggugccuggaacauaaugggagcu

SEQ ID NO: 181894 - RNA, 47 nt, Homo sapiens
aaaccagcuggcugccaggaaugguguaaccuuggcagggucugaag

SEQ ID NO: 181895 - RNA, 50 nt, Homo sapiens
cuuggcgggcaguagggauggugcaguucagacagggaguagaagaagga

SEQ ID NO: 181896 - RNA, 31 nt, Homo sapiens
gagaaaaaauggagucaagggaaagaaaaug

SEQ ID NO: 181897 - RNA, 47 nt, Homo sapiens
ccaagggggaagaaugcaacuggcaggauucgaggagagggcacuuc

SEQ ID NO: 181898 - RNA, 44 nt, Homo sapiens
aguaaggcucugagagauggaagacgcuggucucagaucugagg

SEQ ID NO: 181899 - RNA, 45 nt, Homo sapiens
agucuuccucaggaauaaacaaccgaacaccccagagaccagcuc

SEQ ID NO: 181900 - RNA, 25 nt, Homo sapiens
uagaaugugaaaaggcccaaacauu

SEQ ID NO: 181901 - RNA, 41 nt, Homo sapiens
aaagguacuaauuuccccauuguagagaagagaaacuaagg

SEQ ID NO: 181902 - RNA, 45 nt, Homo sapiens
gaagaaauaauacuuucugcguuucaguuagugcucuuuaugcaa

SEQ ID NO: 181903 - RNA, 45 nt, Homo sapiens
aauacccuccagucuacuugguuucuuacuccccacuuugggcag

SEQ ID NO: 181904 - RNA, 44 nt, Homo sapiens
uauuugacauacuaauauucuuggugauauaacugucagaguua

SEQ ID NO: 181905 - RNA, 27 nt, Homo sapiens
aauuaaacuauagguuuuauaauucag

SEQ ID NO: 181906 - RNA, 50 nt, Homo sapiens
guucauuuuaaaacauugcuuauuuuaacauguaaacguauguugggugg

SEQ ID NO: 181907 - RNA, 53 nt, Homo sapiens
gauugaaacuaaaacuuuuuguaaaguuuuaaacuuugcauuaauauuauaag

SEQ ID NO: 181908 - RNA, 45 nt, Homo sapiens
augaguaaauuauagaauggucuauuaauuuuuccuuuaguuugu

SEQ ID NO: 181909 - RNA, 53 nt, Homo sapiens
agauguucauacucugcauucucaugugcaugauccuuagauuuaaaaagggu

SEQ ID NO: 181910 - RNA, 45 nt, Homo sapiens
agauuuuuaugcuuaacuauuuucuguuagauuucagccaguaaa

SEQ ID NO: 181911 - RNA, 56 nt, Homo sapiens; identical to SEQ ID NO: 110471

SEQ ID NO: 181912 - RNA, 73 nt, Homo sapiens
aacagagggguaagugaaaagcaguuaaccaguaacacaguucagcagcauccaucaacaccgaagaggcaca

SEQ ID NO: 181913 - RNA, 127 nt, Homo sapiens; identical to SEQ ID NO: 110473

SEQ ID NO: 181914 - RNA, 53 nt, Homo sapiens; identical to SEQ ID NO: 110474

SEQ ID NO: 181915 - RNA, 44 nt, Homo sapiens
uaaaauuaccaacuuuuacuagauagaaaauaaaauaaucauag

SEQ ID NO: 181916 - RNA, 348 nt, Homo sapiens
augaauuuauauuuuaaaaggacuuuuacucagccaggugcgguggcucacaccuguaaucccagcacuuugggaggccgaggcgggcggaucaccugaggucaggaguucgagaccagccugaccaacauggugaaaccccaucucuacuaaaaauacaaaaaaaauuagccgggcauuguggcaugugccuguaaucccagcuacuugggagaacugaggcaggggaaucgcuugaacccaggaggcagagguugcagugagccgacaucacgccacuguacuccagccugggcgacaagagcgaaacuccaucucaaaaaaaaaaaaacaccaaaaaaaaaaccg

SEQ ID NO: 181917 - RNA, 40 nt, Homo sapiens
acaucucaauauguauguauuccauuuuuacauuuuagaa

SEQ ID NO: 181918 - RNA, 30 nt, Homo sapiens
uggaaaaccaaaaaggaacuggaguaaaga

SEQ ID NO: 181919 - RNA, 44 nt, Homo sapiens
aggaaugcugaugucgaagccagaauaggaauugcugguuccaa

SEQ ID NO: 181920 - RNA, 42 nt, Homo sapiens
guuaauaucaugaggaaagauggcuccacuuugacacugcaa

SEQ ID NO: 181921 - RNA, 41 nt, Homo sapiens
cagaaaucuuaaagaaaagcuugcauagcuguucagugaaa

SEQ ID NO: 181922 - RNA, 35 nt, Homo sapiens
uuauaagguuggggaaggguuuugcuuuaaauagg

SEQ ID NO: 181923 - RNA, 63 nt, Homo sapiens
cucaccauuugaggaggugaaggaauaauauugcaauugaagagaauaacaaguauagagaau

SEQ ID NO: 181924 - RNA, 46 nt, Homo sapiens
cuuguaagccauuauaaaacacuuggauuuuaccuuaaaagcagug

SEQ ID NO: 181925 - RNA, 46 nt, Homo sapiens
ggaagaucucaugauguucaaccauucacuuacacuccagacccag

SEQ ID NO: 181926 - RNA, 36 nt, Homo sapiens
uuauuaguauguuauuuccauauaguucaagaucca

SEQ ID NO: 181927 - RNA, 38 nt, Homo sapiens
gcuccgcccacuuggagauuggagaauuuagaggauag

SEQ ID NO: 181928 - RNA, 46 nt, Homo sapiens
uacuggauguaauuuagauaagguaaauauuaucccuaaugcccug

SEQ ID NO: 181929 - RNA, 46 nt, Homo sapiens
agagacccugacaacuauucaaacccaggacaucucacagccuggu

SEQ ID NO: 181930 - RNA, 45 nt, Homo sapiens
cagcagucaccacuacaagaacaagcacagacuuuacagcagcag

SEQ ID NO: 181931 - RNA, 45 nt, Homo sapiens
cauccacagucugaaaacacguuaucuaaucaacagcagcagcag

SEQ ID NO: 181932 - RNA, 46 nt, Homo sapiens
aaacucaagguucucucuuucauaguccaaauccuauuguccacag

SEQ ID NO: 181933 - RNA, 46 nt, Homo sapiens
uucccagagucccaugaauaaucuucagacuaacacaguagcccaa

SEQ ID NO: 181934 - RNA, 42 nt, Homo sapiens
caucaaacagugaacaacaagcugcuuuccaacagcaagcuc

SEQ ID NO: 181935 - RNA, 41 nt, Homo sapiens
ugggcucccuuccaccuaauccaaugccucaaagccaacaa

SEQ ID NO: 181936 - RNA, 52 nt, Homo sapiens
agaaccagucaauuuuucaccaacaaaguaacauggccccaaugaaucaaga

SEQ ID NO: 181937 - RNA, 49 nt, Homo sapiens
ucuccucagauucaguugguacaagggucaccuaguucucaagagcagc

SEQ ID NO: 181938 - RNA, 42 nt, Homo sapiens
acuguagucagcuuuuaaccucuggaccagcuacauugccug

SEQ ID NO: 181939 - RNA, 25 nt, Homo sapiens
caaaacaucugaugaguaugcaaaa

SEQ ID NO: 181940 - RNA, 50 nt, Homo sapiens
guuugaguaaacugauagauuuuacucugacugcaaaagagcacaccuau

SEQ ID NO: 181941 - RNA, 29 nt, Homo sapiens
ugauacacuuauaaaacugggaacagcug

SEQ ID NO: 181942 - RNA, 46 nt, Homo sapiens
uaguuuaaauugacagaaaaauuugaauguuuucuucuuaacccag

SEQ ID NO: 181943 - RNA, 41 nt, Homo sapiens
uguguuugcuggagcuuucacucagccaaguguuagaguca

SEQ ID NO: 181944 - RNA, 49 nt, Homo sapiens
auacaaaucuguaaguuauuuuugaauuuucugaacuuuuuucuaagag

SEQ ID NO: 181945 - RNA, 41 nt, Homo sapiens
uuauuguuaucaaaugcuaauuggcaaugccaagucacugg

SEQ ID NO: 181946 - RNA, 123 nt, Homo sapiens
gccucccuucuucccuuccaucucccccuccucccugccuucuuuguuucuccuucccuuauuccucccucccuccuuucucccuuccuuccuuucuuccauucauccuuccuugccuuuuau

SEQ ID NO: 181947 - RNA, 60 nt, Homo sapiens
uaccuuugggauagggcugcuuuccccgugcuaguauuucugugacuguuaguggcacug

SEQ ID NO: 181948 - RNA, 44 nt, Homo sapiens
gauuuuucuaaaaugacuauauaggacuuaagacuuugaaaugu

SEQ ID NO: 181949 - RNA, 57 nt, Homo sapiens
uagcacaucauuuuagaaacgucacauuuuagaaacauucagcuugcuaaccuacau

SEQ ID NO: 181950 - RNA, 45 nt, Homo sapiens
aaauacauaggcaaacuguugggagcugcucuaguuacauuccuc

SEQ ID NO: 181951 - RNA, 45 nt, Homo sapiens
uuguagggauugcuuauuauauuauuuuagcugaugaaccucagg

SEQ ID NO: 181952 - RNA, 44 nt, Homo sapiens
acacugaucaaccacugaacugccuucuuccauuguccugcaau

SEQ ID NO: 181953 - RNA, 45 nt, Homo sapiens
ggaacauuuguauacucgcaacuauauuucuguaaacagcugcag

SEQ ID NO: 181954 - RNA, 43 nt, Homo sapiens
uauauacaguacacagauaccuugaaaggaagagcuaauaaau

SEQ ID NO: 181955 - RNA, 59 nt, Homo sapiens
gaaucuaccugcccuaagggacuuaacuuguuugguaguuagccaucuaaugcuuguuu

SEQ ID NO: 181956 - RNA, 53 nt, Homo sapiens
uuuagggcuaaaguuuuaggguacaguuuggcuagguaucauucaacucucca

SEQ ID NO: 181957 - RNA, 49 nt, Homo sapiens
uuuaacugauucuuaugauuacuaucauggcauauaaccaaaauccgac

SEQ ID NO: 181958 - RNA, 41 nt, Homo sapiens
gggccaucacuugggcaaguccaucccaacugacaaccaga

SEQ ID NO: 181959 - RNA, 46 nt, Homo sapiens
ugacauauagcauugggcacacuccagcagacgcccgaauucaaau

SEQ ID NO: 181960 - RNA, 385 nt, Homo sapiens
ggguggucuguccugaugcagggguguuuguuuguuuguuuguuugagauggagcuucccucuuguugcccaggcuggagugcaguggcgggaucucggcucacugcaaccuccaccuccugaguucaagcgauucuccugccucagccucccgaguagcugggauuacaggcauaugccaccaugcccggcuaauuuuguauuucuaguagagacgggguuucuccauguuggucaggcuggucuugaacuccugaccucaggugaucuacccgccucagccucccaaagugcugugauuaccggugugagccacugugcccggcucugaugcaggguuuugagcacaauuagauccuaagccuaggcuccagguccuucggga

SEQ ID NO: 181961 - RNA, 49 nt, Homo sapiens
gaguuggggauaugauagucagcucaggcuucagauuguaugagaaaaa

SEQ ID NO: 181962 - RNA, 51 nt, Homo sapiens
cucuugcuguggugcuacguggaagugaauggagacugaucucaaaucuga

SEQ ID NO: 181963 - RNA, 95 nt, Homo sapiens
agauugccaaccgggaugcagagaagaaagaagggcaggagaaagaagagagcaaaaaggauaggaaagaggacaaggagaaagauaaagauaag

SEQ ID NO: 181964 - RNA, 43 nt, Homo sapiens
uuggcaaucuuguuguugaugagguugugcagggcgaccacgg

SEQ ID NO: 181965 - RNA, 46 nt, Homo sapiens
cuggaaaaagucgccacaggcaagcugcccaucaaccaccagauca

SEQ ID NO: 181966 - RNA, 39 nt, Homo sapiens
caucuuaguuaagcuucucaauauucuggagaugcaugu

SEQ ID NO: 181967 - RNA, 66 nt, Homo sapiens
cauugacugauaaaacuauaaccuuuuucaaauaaggauuauaauagauauaggauuuuaaaacaa

SEQ ID NO: 181968 - RNA, 47 nt, Homo sapiens
gaaaacauuugaacacgugaccagugaaauuggagcagaggaagcug

SEQ ID NO: 181969 - RNA, 44 nt, Homo sapiens
gaagaaguccaugauguaagucaucuugcuaugaaccugggagg

SEQ ID NO: 181970 - RNA, 34 nt, Homo sapiens
ucucucucuauauauauauauagagagagagaga

SEQ ID NO: 181971 - RNA, 36 nt, Homo sapiens
acucucucucucucuauauauauauauagagagaga

SEQ ID NO: 181972 - RNA, 43 nt, Homo sapiens
uaggucacaguauacuucacagagcacuacaaaucaacagaag

SEQ ID NO: 181973 - RNA, 45 nt, Homo sapiens
caugaguucguugauggcaaugucauucuuguguaguuuagggcc

SEQ ID NO: 181974 - RNA, 51 nt, Homo sapiens
auaguuggcugguaccacacaggcccuaaacuacacaagaaugacauugcc

SEQ ID NO: 181975 - RNA, 42 nt, Homo sapiens
gguaaaggacauaacuacugauguucuuauccuuuuugaggg

SEQ ID NO: 181976 - RNA, 44 nt, Homo sapiens
guaugguuuuuagaccaugauuauuuggaaaacauguauggaau

SEQ ID NO: 181977 - RNA, 44 nt, Homo sapiens
uauccacacugaccaucuguuuucucauucagaaucggcaaggu

SEQ ID NO: 181978 - RNA, 28 nt, Homo sapiens
aucuuuauuccaaaaaagauuucaggau

SEQ ID NO: 181979 - RNA, 38 nt, Homo sapiens
uucuaaguuuuacaagauuguuaguugaauuggcaaau

SEQ ID NO: 181980 - RNA, 44 nt, Homo sapiens
aaucaauuaacccgaguguuaauuaacgucaagucgacgggagg

SEQ ID NO: 181981 - RNA, 42 nt, Homo sapiens
ugcuccucggccagcgccaucuccuccuccauggcagaggcu

SEQ ID NO: 181982 - RNA, 44 nt, Homo sapiens
cgccuguuucacgcuauagaacauggggcccagcuccgccagcc

SEQ ID NO: 181983 - RNA, 46 nt, Homo sapiens
ggacagggcaggguccagcgggaacuccaccaucagccgcccggua

SEQ ID NO: 181984 - RNA, 44 nt, Homo sapiens
cuucugucaucggcccacucguuauauuuguaggagggaguugg

SEQ ID NO: 181985 - RNA, 45 nt, Homo sapiens
ucucgaucucgaguggacagccgauggcuccgcucagaaucccga

SEQ ID NO: 181986 - RNA, 106 nt, Homo sapiens
ugcguucccaaaacucuucgcucacaccacccggaugggauggagucucuacccgagcagaccgauaaugucugaaacagggagagcaacugguaaaggccccucc

SEQ ID NO: 181987 - RNA, 39 nt, Homo sapiens
caccuuuguuuuuccccacaaauuccuaccuaccuucag

SEQ ID NO: 181988 - RNA, 84 nt, Homo sapiens
cuccucucgcucucuccguuucagggaagccagcaaguccaguccgaguaaugaagggcggggagcaggagccuugaagacaug

SEQ ID NO: 181989 - RNA, 34 nt, Homo sapiens
acaccccauacauuccuccccagcccccacaaag

SEQ ID NO: 181990 - RNA, 47 nt, Homo sapiens
cucuugggacccuucugucccggauucuggggcgccggcgcugccac

SEQ ID NO: 181991 - RNA, 61 nt, Homo sapiens
uggaaaaaaaugauugaaaaauuaauguugggcuuuauuucugaagucucauugacaagaa

SEQ ID NO: 181992 - RNA, 42 nt, Homo sapiens
aaauugcaucauuuuugcuaacagacaaaucaaaggcugucg

SEQ ID NO: 181993 - RNA, 52 nt, Homo sapiens
cugccuuauucucuucuccuccuucucuuucccauccuucccucugaagccc

SEQ ID NO: 181994 - RNA, 49 nt, Homo sapiens
ugguacaaaugggaauuauuuccauuucuuucauaaugggcaucuccgu

SEQ ID NO: 181995 - RNA, 57 nt, Homo sapiens
ugacgguaugugaggagugcaaaggcccccaagcccacagccagcuagcucugagga

SEQ ID NO: 181996 - RNA, 50 nt, Homo sapiens
ucugggcugccccaaaugagauaacggaugcauugggcuuaacaguagcu

SEQ ID NO: 181997 - RNA, 496 nt, Homo sapiens
agggagagagagagggagagagagagggagagagagagggagagagggagggggagagagagagagagaaagggagagagagagggagagagagaugaaaaagaucuaaaauguaggggaguccgggggcgguggcucacgccuguaaucccagcacuugggaggccgaggagaguggaucaccugaggucaggaguucaagaccagccuggccaacauggcaaaacccugucucuacuaauacuacaaaaaaauuagccaggcaugguggcagaggccuguaaucccagcuacucggaggcugagacaggagaaucgcuugaacccaggagguggagguuguagugagcugagaacacaucauugcacuccagccuugacaacaagagugaaacuccgucucaaaaaaauaaaauuaaauaaaaugcaggggagagaugaagcacugggagagaggaugugaugacugaggugaagauccucaucuggaagggca

SEQ ID NO: 181998 - RNA, 51 nt, Homo sapiens
ggaaaauggaaggauacuugugagccaauucugggagaagaaagagaaguu

SEQ ID NO: 181999 - RNA, 39 nt, Homo sapiens
ggcaguacaggauugcuguaauaggugcaaucaagcuua

SEQ ID NO: 182000 - RNA, 45 nt, Homo sapiens
uggugagaaauucccaucaggagaccaacaacagucacugcugag

SEQ ID NO: 182001 - RNA, 51 nt, Homo sapiens
acugagugcuuaggaaagggcagguuucugaaagcaacagccauguaaaug

SEQ ID NO: 182002 - RNA, 35 nt, Homo sapiens
gcucaguguccuuugccaauaagauuaaggacaca

SEQ ID NO: 182003 - RNA, 41 nt, Homo sapiens
uuuccugucagagugaucccagguuuccuccuggcccgucc

SEQ ID NO: 182004 - RNA, 28 nt, Homo sapiens
uguugauccugagacuaacaauuggaga

SEQ ID NO: 182005 - RNA, 71 nt, Homo sapiens
ucuuucccggagguuugaagagcugaaaaagaaaacauaggucucuuaaaccaggcaacuuucacguuuug

SEQ ID NO: 182006 - RNA, 32 nt, Homo sapiens
ucagaugcugaggugcuggcaccagcagaugc

SEQ ID NO: 182007 - RNA, 72 nt, Homo sapiens
ugugccagacacacuaccaacugcaucugcuggugccagcaccucagcaucugaagacauugacuuugauga

SEQ ID NO: 182008 - RNA, 46 nt, Homo sapiens
caucagcuacagaugggaaccaaaggaaagaacagaaagcaagcuc

SEQ ID NO: 182009 - RNA, 46 nt, Homo sapiens
ugcaauuucaaucagguaucucuccaccaggauuuuggguggggcu

SEQ ID NO: 182010 - RNA, 41 nt, Homo sapiens
ucaacucagccacuucugacuggagucgaggagcagcccag

SEQ ID NO: 182011 - RNA, 39 nt, Homo sapiens
gcccuagcgcuaacuagagaccgcuaaaucaggagcgca

SEQ ID NO: 182012 - RNA, 43 nt, Homo sapiens
ggcauauaauagaugcccaaugaauguuugcugaaugaaugac

SEQ ID NO: 182013 - RNA, 45 nt, Homo sapiens
aaaacugauuuuccuggagaccuuggcagucagcgacaagcuauc

SEQ ID NO: 182014 - RNA, 42 nt, Homo sapiens
gaaaaacuugauguuucuguaagugugccuugagguuugcug

SEQ ID NO: 182015 - RNA, 42 nt, Homo sapiens
ugaacucugccaguguccccucugccagcuagacugcgggag

SEQ ID NO: 182016 - RNA, 47 nt, Homo sapiens
ugagccuuuggaaguacggcugcagcggcuggaacgagagcgcacgg

SEQ ID NO: 182017 - RNA, 46 nt, Homo sapiens
ggcccccgugcugcuagaagccuuguaggcagaauggugaggagag

SEQ ID NO: 182018 - RNA, 42 nt, Homo sapiens
agccagcuggaugauggcgccuuucaugaaaugggaaggcaa

SEQ ID NO: 182019 - RNA, 45 nt, Homo sapiens
ggcauauggcacaaaguguggaaggugagagguggcaagguuggc

SEQ ID NO: 182020 - RNA, 46 nt, Homo sapiens
gcauagggaaggcuauaaggagacccaaugaacugcagcgaggugg

SEQ ID NO: 182021 - RNA, 45 nt, Homo sapiens
cugcccagccaccacaaccccucgggaccauucagaagcaucacu

SEQ ID NO: 182022 - RNA, 43 nt, Homo sapiens
aucuuugacccaugaaauaauacauuuuaacucagccucuaua

SEQ ID NO: 182023 - RNA, 37 nt, Homo sapiens
cauccccggccccggagccgccccacacccagcgccc

SEQ ID NO: 182024 - RNA, 44 nt, Homo sapiens
uuuuucuugaguuuuccugcuuucauaauuuugagggaaccgaa

SEQ ID NO: 182025 - RNA, 26 nt, Homo sapiens
acucaaugggagguacacacagagac

SEQ ID NO: 182026 - RNA, 41 nt, Homo sapiens
uacagggcuuuauuguacuacugugaaguguaugugugcaa

SEQ ID NO: 182027 - RNA, 46 nt, Homo sapiens
uggggcaaaagucacuaacuggaaagauuaacuugccuucaugauu

SEQ ID NO: 182028 - RNA, 46 nt, Homo sapiens
cccagauuggugaucaacaggggacaggaaugaguagggauggggg

SEQ ID NO: 182029 - RNA, 46 nt, Homo sapiens
uacagcgccugccucucuuuacacacaggagagccauaggcagcag

SEQ ID NO: 182030 - RNA, 40 nt, Homo sapiens
agaguaaugauccuuguaccugcauugccuagagcacuuu

SEQ ID NO: 182031 - RNA, 1652 nt, Homo sapiens
ggggaagacagucacaugggacggaaugucucauugugcuugugaagcuuucaaaguuuaggaugcagacuuuaggucucugagaagagcuuuccacccuguccugcaggaaagagguguugugcggggaaccugcagaacauaaaccugcaaaccaaauuuuccauacauuuucagggacuucacggauccccugaagcucauccauggacuuccauggacuacagguugggaacaguccacagucacaccaguuguaucuuuggaggcuuacuaugcuccaggagccauacuaagcccuuuguauggucguuugguccugacaaccgccucugugauaagugcuguguuguacucuuuccaccuaaaaagaaaaggcaaaaggggaguagaguaacuugcccaggaucacagaguuauugugugauucagaacugcuuagccauaagacagcuguggaaccagugauguuaacuuggucagauuugugauguguauggaauaauuuguaaggaagauucaaaagcacggugaccacuucacaaagaagaaucccacuggucccgugacaugggcuucaucaaggaaagccaucauuaaagagggauccaauucaaguaaugcuuaagauagaaaaaucauggccgggugugguggcucacaccuguaaucccagcacuuugcgaggcugaggugguuggaucacuugaggucaggaguucaagaucagcccagccaacauggugaaacccugucucugcuaaaaauagaaaaauuagcuggguuuuauggugcaugccuauagucccagcuacucaggaggcugaggcaggagaauugcuugagcccgggaggcagagggugcagugagccgaggucaugccacugcgcuucagccugggugacagagcgagacuccaacucaaagaaaaaaaaaaaucuuucggacauagagacucaaaggauuuguggugauaaggaaggugggaagucaagaacaauccccagguuucuggcugagguuucuugugagggugauucugaccccagcugaaguguaaguucagaaggaagugccaacuuaccaggguggugguggcggcacacagugaagacauuauauuuugugcagagaaguuacuuguugaaggucacacaaagaaggcucacagaaacaccuaaagguuggacuagaauugcugauggguggaggucaguaaauuccaggaagacacauccuagcagagaggaguugagcagcagaucccugccagugagcccccaugguuguuagagcaggcugaggugggcagaggguaagccucccagaggcugcagcugcccaggaggggugguugggccugggagugacacgaagcgucccugagugguggagcuugugccaaccacauagcuuagugaugcaaaggggagaguagccggccagugggaaggccggucucccugcuuucccaaauguucuuggagaaacagugaagcuuucggagaaguuggaaaggaugagacuugaaugggagaggguaaggaaaauucuggcuuuccaggaagacccugcagccugggcagcauggagcauccuuggcuggaggugcucaagcagaggcugcacagccccuuguuggggggucugu

SEQ ID NO: 182032 - RNA, 23 nt, Homo sapiens
cccuagggcagcaggaaccuauu

SEQ ID NO: 182033 - RNA, 42 nt, Homo sapiens
uuaccuucccuccccauugcugagacagucugagaagaggcu

SEQ ID NO: 182034 - RNA, 61 nt, Homo sapiens
uaggauuagaggaagaagugaaaggaaaaggcaagguuaaugcagcaguauuuggagggga

SEQ ID NO: 182035 - RNA, 47 nt, Homo sapiens
aaggaacugagugcuauaggaacaacuaagaagaaacugcagggugu

SEQ ID NO: 182036 - RNA, 49 nt, Homo sapiens
aaguccacucagcaggaaauauaaagaaggagaagagcaacaccauuga

SEQ ID NO: 182037 - RNA, 41 nt, Homo sapiens
uucaaugagauaaugcacgaagcaucuuuaaagaacuaggc

SEQ ID NO: 182038 - RNA, 47 nt, Homo sapiens
agguagacagaacacacaguccaugaugaacacuuaauagucaugag

SEQ ID NO: 182039 - RNA, 74 nt, Homo sapiens
uucucuauagaguuguuaucaauuuacaauaacugcagcaauguaaauucaaaugcuuaaaaaucuuuagaaaa

SEQ ID NO: 182040 - RNA, 42 nt, Homo sapiens
cuggaaacuccuuuuaaagaccucagguacuccagguaggua

SEQ ID NO: 182041 - RNA, 51 nt, Homo sapiens
ggcuugauucaagaacauuucauacuuuucauuugcuguaccagggugggg

SEQ ID NO: 182042 - RNA, 111 nt, Homo sapiens
ggcgugagcggcgcgaaauccuucucgggguucaugguggcagcugggggaaccucgcgacuccuuagcccgcggcugccggggccgcgccggggccaggggagucugcgg

SEQ ID NO: 182043 - RNA, 69 nt, Homo sapiens
caauaagacuugcuagcauucgugagagucaggcauaaacaaaaagcuauauaaaaggagcagucaaga

SEQ ID NO: 182044 - RNA, 61 nt, Homo sapiens
gcuucuacuccagccaggccugccuucuuacugcgcccugccuggcccaugcugcaccucc

SEQ ID NO: 182045 - RNA, 28 nt, Homo sapiens
uugaauggcacuuaggaagcuuugaaga

SEQ ID NO: 182046 - RNA, 45 nt, Homo sapiens
ccggcugagucagaucuuaaaaacaguaacaggcacuuuccaggu

SEQ ID NO: 182047 - RNA, 65 nt, Homo sapiens
guuucccuauucugggucucaguuucccuuuguguacaauggaauaaggaacaguggugcuaucu

SEQ ID NO: 182048 - RNA, 45 nt, Homo sapiens
ggcaccgacuccagaaccaggaucugaccaggggaagggaacagg

SEQ ID NO: 182049 - RNA, 42 nt, Homo sapiens
uccacucacauuuugcgaaucucuuugccauugucacccagg

SEQ ID NO: 182050 - RNA, 42 nt, Homo sapiens
gcaagacagcagucaggaucccggaggaguaaggcagcauga

SEQ ID NO: 182051 - RNA, 26 nt, Homo sapiens
ugaaaaaaugcuuaggaaaaccaucu

SEQ ID NO: 182052 - RNA, 74 nt, Homo sapiens
gaugcucguccuccuagugccaaggcccaggcagccuggugucugucugauggaccagggccuggggaaaggug

SEQ ID NO: 182053 - RNA, 42 nt, Homo sapiens
gaccaccccacccacaccugcuccuccuuccagcccuggugu

SEQ ID NO: 182054 - RNA, 47 nt, Homo sapiens
aacucugaaggugcccagcucuugagcacagcuggugacacugacug

SEQ ID NO: 182055 - RNA, 19 nt, Homo sapiens
gcucugcugcgccagcucu

SEQ ID NO: 182056 - RNA, 48 nt, Homo sapiens
gucaccuggguagagaaggaagaaccagagagggaagucauucagaau

SEQ ID NO: 182057 - RNA, 30 nt, Homo sapiens
uuaugugugcugggucccaaggggagcauu

SEQ ID NO: 182058 - RNA, 45 nt, Homo sapiens
auaucuguggaauugagguggggguggagggguguuuuuguuugu

SEQ ID NO: 182059 - RNA, 29 nt, Homo sapiens
gcaacaaggaaggaaaguguugccuaaaa

SEQ ID NO: 182060 - RNA, 33 nt, Homo sapiens
uugaggcucuggagcaccaaucucgaugcacac

SEQ ID NO: 182061 - RNA, 47 nt, Homo sapiens
gagccuccagggauucuuugcuucagccacagaagaaagacacaggg

SEQ ID NO: 182062 - RNA, 46 nt, Homo sapiens
ccacacagcccagucauauggcaggagcaaggggugccccuccacc

SEQ ID NO: 182063 - RNA, 46 nt, Homo sapiens
cagggccaucgagggggccugggucauccgucuggccugcggggga

SEQ ID NO: 182064 - RNA, 40 nt, Homo sapiens
aucagcuucucugugcccgggaggaagagauaaaacauag

SEQ ID NO: 182065 - RNA, 47 nt, Homo sapiens
acagccucggugaguuggggcaagagucucuacugccauagccucgu

SEQ ID NO: 182066 - RNA, 50 nt, Homo sapiens
gccaccgacuucaccuuugcuaggcucccugccuccgaggcuuuccagac

SEQ ID NO: 182067 - RNA, 74 nt, Homo sapiens
aggccacucucuccccgauucugcggcucugcacaggugaggaaugagggaggcagggugggagaagccucugc

SEQ ID NO: 182068 - RNA, 40 nt, Homo sapiens
ugacaucccuguccccagagccagcaggaccuccgcagac

SEQ ID NO: 182069 - RNA, 49 nt, Homo sapiens
caaggaaugaaaccaaauaagaacaggucauuaucacccauuuuuagag

SEQ ID NO: 182070 - RNA, 45 nt, Homo sapiens
ucugaccuccaggagcuuccguucgcugcugaaucucuugagaag

SEQ ID NO: 182071 - RNA, 44 nt, Homo sapiens
gggagacaaggccugggcuuguucugccugcauuagcauggagg

SEQ ID NO: 182072 - RNA, 41 nt, Homo sapiens
ugcaagcauucuccaccaguccucucugcaaggcggcaggg

SEQ ID NO: 182073 - RNA, 43 nt, Homo sapiens
cuccaggcaggugagggggcaccgcacaaagacucacagagug

SEQ ID NO: 182074 - RNA, 58 nt, Homo sapiens
gguggcccuugguagggccuacuucacacuccuccucugugagcauuuaaacccagac

SEQ ID NO: 182075 - RNA, 26 nt, Homo sapiens
gacagccauguggccuggcccaccug

SEQ ID NO: 182076 - RNA, 55 nt, Homo sapiens
ggagacauggccaaggcuggugcucugaacuggcugauacauucccuggcugaca

SEQ ID NO: 182077 - RNA, 42 nt, Homo sapiens
ccaucugucccucugugcaagaggaggugccaucgggcucug

SEQ ID NO: 182078 - RNA, 39 nt, Homo sapiens
ccuccuggugucccagagaagcuggggaaugcugacugu

SEQ ID NO: 182079 - RNA, 75 nt, Homo sapiens
ucacacagggugugcccccuggcaugcaggagacgccugaggauggagucccggacgcagccuaccagggucuuc

SEQ ID NO: 182080 - RNA, 50 nt, Homo sapiens
aggugccuuaggagccagaugugcccagcugugggagagaggggccaggc

SEQ ID NO: 182081 - RNA, 46 nt, Homo sapiens
ggaaaauucuuaaggccucugcgaaugucuggaaggaaccacagga

SEQ ID NO: 182082 - RNA, 62 nt, Homo sapiens
cuuccugccccucagaggcucaaccccaaccacagugagaggaaggauacaacuucuggaug

SEQ ID NO: 182083 - RNA, 86 nt, Homo sapiens
ucauggcgcgagguguggugggaggugguucuuacaugugaagauggggcacucaaucagcugcaccagcuuguccaccucugcga

SEQ ID NO: 182084 - RNA, 43 nt, Homo sapiens
ggcuugaggagaaggugcuuggaguuccuccagggucagggag

SEQ ID NO: 182085 - RNA, 50 nt, Homo sapiens
ggucucugaggcuauagccccccacugggugggcagccagcucugugaga

SEQ ID NO: 182086 - RNA, 33 nt, Homo sapiens
gcccagauguacaguugcaagagaugggggucc

SEQ ID NO: 182087 - RNA, 25 nt, Homo sapiens
aaauccagguggucagcuuccaggu

SEQ ID NO: 182088 - RNA, 49 nt, Homo sapiens
cagggcggcuuagggggccucagaaucucccuccccucccagcccaacc

SEQ ID NO: 182089 - RNA, 44 nt, Homo sapiens
uccagacuuggggcaguuucuaagacagcagcccugccccaugg

SEQ ID NO: 182090 - RNA, 45 nt, Homo sapiens
cagcugggaaugcagcuucguggccuuggaguugaaguccuccca

SEQ ID NO: 182091 - RNA, 42 nt, Homo sapiens
augcgugugagcgccgagccgaugucccucguggccccuggc

SEQ ID NO: 182092 - RNA, 47 nt, Homo sapiens
acuucuuuuugaucucaugccgggcucguuuguacucugcagaaggg

SEQ ID NO: 182093 - RNA, 42 nt, Homo sapiens
cagagcacacagcaacagcgacacaagaagcagcaagaaaga

SEQ ID NO: 182094 - RNA, 42 nt, Homo sapiens
cugcugucagcaccaccaagucgucgaugaugcccugcaggu

SEQ ID NO: 182095 - RNA, 44 nt, Homo sapiens
uccgccacccuuggcacugcuacugcugcugggggcacuagggg

SEQ ID NO: 182096 - RNA, 45 nt, Homo sapiens
cuccgcugcagaguggcgccugagggcugcucaugggagccgacc

SEQ ID NO: 182097 - RNA, 45 nt, Homo sapiens
ccagccccgcgggccugccuugggaggggaugguguccucagagc

SEQ ID NO: 182098 - RNA, 46 nt, Homo sapiens
ccuggcucuggugcuuauggguagggaagaggcagggccccagagg

SEQ ID NO: 182099 - RNA, 40 nt, Homo sapiens
cagagagaaggcaagaggggaggagggggcucaggcaggg

SEQ ID NO: 182100 - RNA, 47 nt, Homo sapiens
accggggcucugguguuggccugagcuccacgggcugagugcucggc

SEQ ID NO: 182101 - RNA, 40 nt, Homo sapiens
caggugaagccccggggcauggugguguuccucguccccc

SEQ ID NO: 182102 - RNA, 41 nt, Homo sapiens
ccagaagcaggucugagccgguggcuugggggucuuucggg

SEQ ID NO: 182103 - RNA, 39 nt, Homo sapiens
accagcuggggaaucuuagguaagauucucucucucucu

SEQ ID NO: 182104 - RNA, 43 nt, Homo sapiens
uugguagcguuuaggcuuagaaguuacuaauuuggagccguga

SEQ ID NO: 182105 - RNA, 45 nt, Homo sapiens
gcccuucucauaccuggaguguggagaccuggcagcgggcgugga

SEQ ID NO: 182106 - RNA, 46 nt, Homo sapiens
ugcaguuacagucaaagauacauugugggcaaaagccaggaggugu

SEQ ID NO: 182107 - RNA, 428 nt, Homo sapiens
gccagaaagccuagaaccaggcgggcacgguggcuaacgccuguaaucccagcacuuuaggaggcugaggcggguggaucaguugaggucaggaguucgagaccagucugggcaacguggugaaacccugucucuacuaaauacaacaauuagcugagcaugguggugugugccuguaaucccaacuacuugagagguagaggcucgagaaucgcuugaacccaggaggcggagguugcggugagcagagaucgugccacugcacuucagccagggugacagagcgagacucugaaucaauccccugcccgcuguaaaacaaaacaaagcaaaccucaaaaacucaaacgaaaaaagaaagccuagaaccagaaugugagcaaguuagggagugcgguugggaggaggccuagagccagacuccggga

SEQ ID NO: 182108 - RNA, 46 nt, Homo sapiens
uucugcacaugguaaaugaacuuuggggcaggggccaagcagaagg

SEQ ID NO: 182109 - RNA, 132 nt, Homo sapiens
ugcacuucucccuagccaugugacagcauacguggcaugucauuccuugugccuuaguuuucucaucuguaagaugggaguaauaugacuucucucacuaaguugggugaagaucuaguggccuccuacaug

SEQ ID NO: 182110 - RNA, 43 nt, Homo sapiens
uacccauauugcugucucaggaagccccuccgcuuggccagaa

SEQ ID NO: 182111 - RNA, 53 nt, Homo sapiens
uagugugaacagaauguuccuguuuuuguaaaagaaaaauggguuuaugcaaa

SEQ ID NO: 182112 - RNA, 90 nt, Homo sapiens
acccuucacaaguguuucuccugcccuuggggcugucuuccuucuccugaaauccagagacuuucuugcucaucccuucucccuuucacu

SEQ ID NO: 182113 - RNA, 63 nt, Homo sapiens
gggcacaggccccgacaucaccccaaggacaacggcagaaguagagagaaacuaccuaccuca

SEQ ID NO: 182114 - RNA, 43 nt, Homo sapiens
gauaagaagauagaaagauuggacacagaugauuuggacgaga

SEQ ID NO: 182115 - RNA, 46 nt, Homo sapiens
acucaccauugguaucugcuuugacuuucucuuccuugaucugcaa

SEQ ID NO: 182116 - RNA, 62 nt, Homo sapiens
uaagaaaagaaaaacuuucuaguaaaagucuagugugaaacuuucagcaccaguauucaggg

SEQ ID NO: 182117 - RNA, 45 nt, Homo sapiens
aaauaugcgcugcaccacgucgcaacgcgggcccuaaccucgcca

SEQ ID NO: 182118 - RNA, 67 nt, Homo sapiens
gcucuagaacagagaaacuugggaaaaggaauguuuggcccaauggaaaauucuggauauauucauu

SEQ ID NO: 182119 - RNA, 59 nt, Homo sapiens
cugcauugagcuuggugagcuuuggucccuagggauucuuuuacugauuuuaguaagua

SEQ ID NO: 182120 - RNA, 47 nt, Homo sapiens
ugucuuuuaaaaagguaagucccacuguuguggaugguucuggaaug

SEQ ID NO: 182121 - RNA, 44 nt, Homo sapiens
aacaauaguaauggacacuucucacaccuggccaaggcuguugg

SEQ ID NO: 182122 - RNA, 45 nt, Homo sapiens
aauucuuguuuugucuccacacccagaaggcaaguuuugucagag

SEQ ID NO: 182123 - RNA, 86 nt, Homo sapiens
uggaguggauggggcagccuccagcuccuguggaaguaauggaauagugguggaaagggaacacagagagggaggcuuccaguaag

SEQ ID NO: 182124 - RNA, 91 nt, Homo sapiens
aaaugaugggggaugguagaaaaaaauuauuuacacaaccuuggaagauuaggcaugaauacacagagauuuaccuuuuggaaguuucauc

SEQ ID NO: 182125 - RNA, 63 nt, Homo sapiens
gggcacaggccccgacaucaccccaaggacaacggcacaaguagagagaaacuaccuaccuca

SEQ ID NO: 182126 - RNA, 43 nt, Homo sapiens; identical to SEQ ID NO: 182114

SEQ ID NO: 182127 - RNA, 70 nt, Homo sapiens
uggcaagaggggccuggcagugaacaugguggacagcaagcacagcaugaacauccugaacagaauccag

SEQ ID NO: 182128 - RNA, 46 nt, Homo sapiens
aagugucugucgucaucaacuuugaucuucccguggacaaggacgg

SEQ ID NO: 182129 - RNA, 50 nt, Homo sapiens
gaacugccagaugcugcuuuucuccgccaccuuugaagacucugugugga

SEQ ID NO: 182130 - RNA, 34 nt, Homo sapiens
aaccuaauucuuuuuauuuugaaauauuucaaaa

SEQ ID NO: 182131 - RNA, 27 nt, Homo sapiens
uacauauucuuuccuucagcuucagcu

SEQ ID NO: 182132 - RNA, 688 nt, Homo sapiens
augaauagaaaugggaggcugggcgcgguggcuuaugccuguaaucccagcacuucgggaggccgaggcgggcagaucacgaggucaggagaucgagaccauccuggcuaacacggugaaaccccgucucuacuaaaaauauaaaaaguuagucgggcaugguggcaggcgccuguagucccagcuacuccggaggcugaggcaggagaauggcgugaaccugggaggcagagcuugcagugagccaagaucacgccacugcacuucagccugggcgacagagcgagacuccaucucaaaaaacaaaacaaacaaacaaacaaaaagaaauggggcuccuggcugggugcaguggcuuacgccuguaaucccagcacuuugggaggccgaggcggguggaucacgaggucgagaguucgagaccagccugaccaacauagugaaaccccgucucuacuaaaaauucaaaaauuagcugugcguaguugcacacgccuguaaucccagcuacuugggaggcugggguaggagaauugcuugaacccaggaggcggagguugcagugagccaagaucguaccacugcauucuagccugggcgacagggcaagacuccgucucaaaaaaaaaaaaaaaaaaaaagagaaauagaaauggggcuccuccauucucaacaaaccaccaauuaa

SEQ ID NO: 182133 - RNA, 38 nt, Homo sapiens
cuccuagggucgccguccccagcuccucccucagaguc

SEQ ID NO: 182134 - RNA, 44 nt, Homo sapiens
uaaaucgcugccggauuucacuugcuguuagaguagaguccauc

SEQ ID NO: 182135 - RNA, 43 nt, Homo sapiens
gcaaagagcaaaguggggucauccaaugggaugguggcagacg

SEQ ID NO: 182136 - RNA, 47 nt, Homo sapiens
acuucuggguauuggcagcucugcucagcuuugccauggggugagau

SEQ ID NO: 182137 - RNA, 45 nt, Homo sapiens
cuuccacgaacaucuucucccugcgcagagccaucaccguagcca

SEQ ID NO: 182138 - RNA, 45 nt, Homo sapiens
gucaccguagaugguuccaauguguagcacauacccuccucggac

SEQ ID NO: 182139 - RNA, 43 nt, Homo sapiens
gagagcaccgcacugcuaagacuguggacagacagugacggug

SEQ ID NO: 182140 - RNA, 45 nt, Homo sapiens
acguucuugccuguggccugugcagacacauccuugccaccaccu

SEQ ID NO: 182141 - RNA, 54 nt, Homo sapiens
ggagccuccuccuuccccacucaguucuuuacauccccgaggcgcagcugggcg

SEQ ID NO: 182142 - RNA, 52 nt, Homo sapiens
cagaaauuuaaggggcacugagacauaggacugcucccaaguguguuccagu

SEQ ID NO: 182143 - RNA, 43 nt, Homo sapiens
gcgggccccggcgcgaggcugaggccgcagcccaccaccaggu

SEQ ID NO: 182144 - RNA, 40 nt, Homo sapiens
gguucagggcugggcggcggcgccccugcggcgggcggcc

SEQ ID NO: 182145 - RNA, 47 nt, Homo sapiens
aucaccugguguacuuguugaaaaauacagcucccuggaguggcagg

SEQ ID NO: 182146 - RNA, 48 nt, Homo sapiens
cuuuaccuccuuuguuaucaguuugugcuuugguuuugcugccaaccu

SEQ ID NO: 182147 - RNA, 49 nt, Homo sapiens
agcuagugagagguggggauauuuucaaacccagaacuguccgccccca

SEQ ID NO: 182148 - RNA, 46 nt, Homo sapiens
agguucugugcuggcauccugagcacugccaggcacuugaccauug

SEQ ID NO: 182149 - RNA, 51 nt, Homo sapiens
cuagaguugucacaucauagagacagaaaguacaauggugguugccagagg

SEQ ID NO: 182150 - RNA, 49 nt, Homo sapiens
uuuucucaaaucucacaccugagccccaacacgugcccucugucuauau

SEQ ID NO: 182151 - RNA, 45 nt, Homo sapiens
guuuuggagcccuccagagcagccgcaccuuucugcgccaccggg

SEQ ID NO: 182152 - RNA, 45 nt, Homo sapiens
cuagcuuugauguaugaucugaagguuccccgcugggacuuccag

SEQ ID NO: 182153 - RNA, 46 nt, Homo sapiens
agcaagacuuucuauaagccagauugguuugacaucguggagucug

SEQ ID NO: 182154 - RNA, 42 nt, Homo sapiens
ugaccuggaugugccugugggccacauugugcauacuggcau

SEQ ID NO: 182155 - RNA, 46 nt, Homo sapiens
ccagcagguccacuguugggccuggcuuaagaaacacaugccgaaa

SEQ ID NO: 182156 - RNA, 46 nt, Homo sapiens
ccagacuccacuuucacucagcaucccgaguagugaaucugcacua

SEQ ID NO: 182157 - RNA, 46 nt, Homo sapiens
caugauucagaccuagaccuuuggccuugguggggagagcccauuu

SEQ ID NO: 182158 - RNA, 35 nt, Homo sapiens
ugccugggcuuugugcacaauuuuucugaggacac

SEQ ID NO: 182159 - RNA, 51 nt, Homo sapiens
uaggucuauaaguguauuaagggacauccuuccauuucauuagagcagcuu

SEQ ID NO: 182160 - RNA, 74 nt, Homo sapiens
uagugauuacugacuuuagugccuaaaccuuuuuggaagguucugguuggcuuguuagaggagcauaugauuag

SEQ ID NO: 182161 - RNA, 69 nt, Homo sapiens
gccaguuuuccgugggccuuccccucccuugaaaugucuuuaauuaccuccccuucaucgucaggccac

SEQ ID NO: 182162 - RNA, 48 nt, Homo sapiens
agcaucucuuucaaaagauguaugucagaauuuccuuugcacaccaag

SEQ ID NO: 182163 - RNA, 50 nt, Homo sapiens
uguuacugagauauguucugaacauaaugugcauuuuuuucuguacagau

SEQ ID NO: 182164 - RNA, 44 nt, Homo sapiens
acagucuguacagcaaaugcugugugagaucuuaggcuuuucac

SEQ ID NO: 182165 - RNA, 76 nt, Homo sapiens
aggauccugacccgugguccucucccgcucccucugcuccaccaggacacauguauaggacacugugcugugugca

SEQ ID NO: 182166 - RNA, 64 nt, Homo sapiens
cuccccugccuccuuagaacacacucuaagucagaacuuaaucuaagaagaaggaagcuggacc

SEQ ID NO: 182167 - RNA, 52 nt, Homo sapiens
ggcucugggguacugaaggugagcugucugggcaaacuauuaagaacaagac

SEQ ID NO: 182168 - RNA, 43 nt, Homo sapiens
agaauagaaaaguuagcucugccaguaucuucaauuacuuauu

SEQ ID NO: 182169 - RNA, 50 nt, Homo sapiens
gcagggugcgagcagcacacacugccucccgccacugccagccggaguga

SEQ ID NO: 182170 - RNA, 60 nt, Homo sapiens
auguaauauauauuuuauuaaccuguuagauguccacaaaguauuauaaaucacgugccu

SEQ ID NO: 182171 - RNA, 97 nt, Homo sapiens
ucccgccucauuccuccaguguggagaugacaagucugggugugagagggagggguccgggcaucaugguucagcguggcacuccuuugguugaguu

SEQ ID NO: 182172 - RNA, 66 nt, Homo sapiens
cagacaagcuccuuugugccucuacguggagaggguguggaaaguuaucacauuaaaagauggagg

SEQ ID NO: 182173 - RNA, 44 nt, Homo sapiens
gagguuugacucacuuugcuuuauuuuucaggcuacaauacagg

SEQ ID NO: 182174 - RNA, 41 nt, Homo sapiens
cccggggcagcaggaucccaggaaccuuccuccuccagggc

SEQ ID NO: 182175 - RNA, 43 nt, Homo sapiens
ucuucugcugagacagugacgcuuuccaguuuccacccuaauc

SEQ ID NO: 182176 - RNA, 43 nt, Homo sapiens
aaagacaggacuuggaggggaagcacaccacccagugugccau

SEQ ID NO: 182177 - RNA, 96 nt, Homo sapiens
ugaucagugggagcaucuguauauuguuccugauuggccugauguguggacggaucaccaagcgagugacacgagagcucaaggacagguagagcc

SEQ ID NO: 182178 - RNA, 42 nt, Homo sapiens
guacuucauacugcuugugcccuggacauuaaacaccacugc

SEQ ID NO: 182179 - RNA, 92 nt, Homo sapiens
gugcugaagaagcagcagcccaagagcagacaggucagguggaggagugccucaaggucaaccugcucaagaucaaaacagaauuguguaaa

SEQ ID NO: 182180 - RNA, 46 nt, Homo sapiens
aaggaugauucagaauuagaaggacaagucaucucuugccugaagc

SEQ ID NO: 182181 - RNA, 34 nt, Homo sapiens
ccagaaguacucguuaacaagucauauugcugau

SEQ ID NO: 182182 - RNA, 46 nt, Homo sapiens; identical to SEQ ID NO: 110878

SEQ ID NO: 182183 - RNA, 54 nt, Homo sapiens
cagcuaagcacccgcugccaccaaaaaguauuuaagcugcaggagacagagaug

SEQ ID NO: 182184 - RNA, 47 nt, Homo sapiens
ugacaucaaaaacuucuguuccgcugugcaauauggcaacgcucagg

SEQ ID NO: 182185 - RNA, 50 nt, Homo sapiens
aggaagccaaggagcacagggugucccugaagugccgcaggcagcuccgu

SEQ ID NO: 182186 - RNA, 67 nt, Homo sapiens
gauuuucgguuuucuuacaaguuuaaaauggccugcaaggaggacguguugaagcuuugcccaaaca

SEQ ID NO: 182187 - RNA, 47 nt, Homo sapiens
gggaccugauggagugucugauacagaacaaacaccagaaggacaug

SEQ ID NO: 182188 - RNA, 47 nt, Homo sapiens
auauucaaauagaagccuugcugaugagagccugugagcccauaauu

SEQ ID NO: 182189 - RNA, 74 nt, Homo sapiens
ccuucaggaccaucuggaugacuuggugguggaguguagagauauaguuggcaaccucacugaguuagaaucag

SEQ ID NO: 182190 - RNA, 36 nt, Homo sapiens
uccugcccuccaggauaagugccugauugaucuggg

SEQ ID NO: 182191 - RNA, 63 nt, Homo sapiens
cagugaauuuaugccucagggagcuguguucucuuguuuauacagacacgccuaccgcacuga

SEQ ID NO: 182192 - RNA, 57 nt, Homo sapiens
ccgcaagugccagggagacgcuucucgucuuugccacacccacgguuggaaugagac

SEQ ID NO: 182193 - RNA, 42 nt, Homo sapiens
caaaguaaauguauugccucagccucuucuccuguguaguca

SEQ ID NO: 182194 - RNA, 65 nt, Homo sapiens
gugaacaccgucucuuagagcugcaguauuucaucucccgggauuggaagugaguauuuugaagc

SEQ ID NO: 182195 - RNA, 45 nt, Homo sapiens
ugaacauacaccaacuuuuauuaaaacuaguauuggaaugaaaac

SEQ ID NO: 182196 - RNA, 45 nt, Homo sapiens
gaagcuugugaaucuguaauccagacagccugcaaacauauaaga

SEQ ID NO: 182197 - RNA, 352 nt, Homo sapiens
caaauucgcuuucuauuauuaaagauuucuaccccaggucugggugugguggcuuacgccuguaaucccagcacuuugggaguucgaggugggcggaucacuugaguucaagaccagccuggccaacguggcgaaaccucauccccacuaaaaauacaaaaguuagccgggaguggugguacaugcccguagucccagcuacuuaggaggcugaggcaggagaaucacuugaacccgggaaguggagguugcagugagcagagaucaugccacugcacuccagccugggugacagagcgaaacucugucucgggggggaaaaaaaaaagauuucuaccccaaaacaccaucu

SEQ ID NO: 182198 - RNA, 49 nt, Homo sapiens
aagggagaaaaauguccuuaguguucuacuacaguagccauccccaguc

SEQ ID NO: 182199 - RNA, 58 nt, Homo sapiens
cccugagaucauccuaagcugucggggggagauugaacaccauuguuccggauuacau

SEQ ID NO: 182200 - RNA, 69 nt, Homo sapiens
agucagcagugagugccagggggagaugcuggauuaccgacgcauguugauggaagacuuuucucugag

SEQ ID NO: 182201 - RNA, 42 nt, Homo sapiens
ucuccuacuuguuaaugugccuggagucagcuguacacagag

SEQ ID NO: 182202 - RNA, 45 nt, Homo sapiens
caucagagccacugauguaagaguuucguuaacucuagcauacac

SEQ ID NO: 182203 - RNA, 66 nt, Homo sapiens
cuccggguggcugagcugucaucggaugacuuucacuuagaccggcauuuauauuuugcuugccga

SEQ ID NO: 182204 - RNA, 46 nt, Homo sapiens
auucacaaggugaggugguaucaugcuuggagaaaggccuggugaa

SEQ ID NO: 182205 - RNA, 48 nt, Homo sapiens
aucuacuauaacagagguaaguugucaaagaauuuuguagacaacuaa

SEQ ID NO: 182206 - RNA, 33 nt, Homo sapiens
auguaccuuucugguacauuucuccccaacagc

SEQ ID NO: 182207 - RNA, 43 nt, Homo sapiens
acuuugacuaggagagauuaaggugaaacaguaguaaccauca

SEQ ID NO: 182208 - RNA, 65 nt, Homo sapiens
uuuggccacauaaugaaaacacauauucuaaacaucauggacucucuuacucaacuucaggaaga

SEQ ID NO: 182209 - RNA, 41 nt, Homo sapiens
ucuaguaaaguauuuaaagucaugauuuauuguaaaauggu

SEQ ID NO: 182210 - RNA, 35 nt, Homo sapiens
uuaaaggguuguucuaaauaaccacuuccagaagc

SEQ ID NO: 182211 - RNA, 47 nt, Homo sapiens
guuguggaagccaaggaaagggaaauuuuaguugugagagucaagaa

SEQ ID NO: 182212 - RNA, 47 nt, Homo sapiens
agcuuuaauaauuuuacugaaaucagaaaguuuuguuugacugaaug

SEQ ID NO: 182213 - RNA, 46 nt, Homo sapiens
aggauuauauauguaccaguuccugauuccauauucauucauggag

SEQ ID NO: 182214 - RNA, 48 nt, Homo sapiens
agaccauacucuuucuaauguaccaugggugguuguagcuaaggacau

SEQ ID NO: 182215 - RNA, 49 nt, Homo sapiens
ggcacaggguugggaggcuggcauauuuaaaagcaaaucccagauacug

SEQ ID NO: 182216 - RNA, 45 nt, Homo sapiens
cuaauacuggugaccaaacaauuaguaguaguuugugguagaaac

SEQ ID NO: 182217 - RNA, 69 nt, Homo sapiens
uugagugacauugauaauuuauaaucaagugacauugauaauuuauaaucuagguuuaaugcugcagac

SEQ ID NO: 182218 - RNA, 32 nt, Homo sapiens
aacugccuguguuugccuguguucugaguagu

SEQ ID NO: 182219 - RNA, 29 nt, Homo sapiens
aguaauuugaaaaaaaaaaaaaagagaga

SEQ ID NO: 182220 - RNA, 49 nt, Homo sapiens
ccccaaggcugucaaggccacaggucuucucuuugcacuggaaaggcag

SEQ ID NO: 182221 - RNA, 69 nt, Homo sapiens
uccacuguguguccgacuccucuuaggcacagugcccacacauuccuuccccccauggagcuuacagcu

SEQ ID NO: 182222 - RNA, 46 nt, Homo sapiens
ccaauacccagcaauuugaugacuuuaagaaaugcuauggggaaau

SEQ ID NO: 182223 - RNA, 46 nt, Homo sapiens
ggagucugaccuacagugauccccgugagcgagaacgcgaccagca

SEQ ID NO: 182224 - RNA, 65 nt, Homo sapiens
ggcggcagcugcuggagucccuguagguuuugagagcuaaaaaugagaaaaaugagugaugucca

SEQ ID NO: 182225 - RNA, 35 nt, Homo sapiens
uguuucuaccgaucuuuguaacccaaagcugcaaa

SEQ ID NO: 182226 - RNA, 46 nt, Homo sapiens
aauuuuuuggagcuuucaaaagccuaccuuuggcauggggggagca

SEQ ID NO: 182227 - RNA, 49 nt, Homo sapiens
cugcccuacuuagguuauauuguuauguucacccaaauauucucuagau

SEQ ID NO: 182228 - RNA, 47 nt, Homo sapiens
ggguacaugugggguuuucuuuagugucagggccaggucaaggaggu

SEQ ID NO: 182229 - RNA, 54 nt, Homo sapiens
acuuggcuaguacagaccuccuuggaacacccacuaaucuauaucauuuccaag

SEQ ID NO: 182230 - RNA, 49 nt, Homo sapiens
guugaauagggaaaaugauuuuuuuuuuuuuucuggacacuuuccuaua

SEQ ID NO: 182231 - RNA, 96 nt, Homo sapiens
ggaauucuuuguuguuaucucucgcucagugggaaauaauggauuguaauuaauauuuguuuuuaaaaaauugaauuauuuuggacaaaacaccca

SEQ ID NO: 182232 - RNA, 115 nt, Homo sapiens
ggauuugagucuuuacucagagcccugauucuuagcagggggcauucgccugguagggaggcuuagaguccugcugaugacucugcccaguccacauacauccucucuccuggau

SEQ ID NO: 182233 - RNA, 45 nt, Homo sapiens
ugccucagaccuugcagcaggaauucucccugaucaaugugcaaa

SEQ ID NO: 182234 - RNA, 42 nt, Homo sapiens
acugaagauacagaucaccagcacacugcaagccauggggag

SEQ ID NO: 182235 - RNA, 77 nt, Homo sapiens
ccucaaaggcaaggcguagaaucagccaguugggagaggcugcugcccucucuguuggaaggcagggagaagauaca

SEQ ID NO: 182236 - RNA, 372 nt, Homo sapiens
aaucauuaagaaaggaguuccaggccaggugcgguggcucacgccuguaaucccagcacuuugggaggccaaggcagguugaucacuugaggccaggaguuugagaccagccuggccaacaugaugaaaccccaucucuaccaaaauauauuaaaaaaaaaaaaauuagccaggugugguggcacgugccuguaaucucagccacccuggaggcugaggcaggagaauuuccugaaccaggaggugcagguuguugcagugagcucagauugcaucacugcacuccagcuugagugacaaagugagacccuaucucaaaauacaaaaaauuaaaaaaaaaaagguguuccaagagcaaauugaggagagaag

SEQ ID NO: 182237 - RNA, 70 nt, Homo sapiens
uugauuuucacuguggggaaggauuucucaaagagguaggaagugagucaggauauuguggccaggggac

SEQ ID NO: 182238 - RNA, 62 nt, Homo sapiens
gauacagaccucgagacaaguuugagugagagauuugagcgcaaauauauuauuugagagug

SEQ ID NO: 182239 - RNA, 46 nt, Homo sapiens
auuuugaaagggaaacaggcagaugcauccauuucugugaguggug

SEQ ID NO: 182240 - RNA, 46 nt, Homo sapiens
uggaauccucaugacagcuuugcacacuauuuugcggcuucgguga

SEQ ID NO: 182241 - RNA, 368 nt, Homo sapiens
auuuauuuauuuuuauuuauuuuuugagauggagucucagucuguugcccaggcuggagugcaguggcucaaucucgagucacugcacccuccaccucccacguucaagcgauucuccugccucauccucccgaauagcugggauuacagguguccaccacaacaccgggcuaauuuuuguauuuuuaguagaguugggguuucaccauguuggccaagcuggucuugaacuccugaccucaggugaucugccugccuuggccucccaaagugcugggauuacaggugugagccaccccgcccagccugucuuuucaauuuagaauguaccagcuugguugcauguagucuugguguggggguaacag

SEQ ID NO: 182242 - RNA, 670 nt, Homo sapiens
agaaacuguugggccaagcaugguggcucacgccuuguaaucuuagcacuuugagaggccagggccggugcaucacuugagcccagggguucgagaccagccggggcaacagagugagaccccaucccuacagaaaaugaaaaacuuagcugagcaugguggcuugugccugugguaccauuuacucaggaggcugaggcaggagaauugcuugagcccaggaguuugaggcugcaacgccacugugcuccagcuggggugauggagagagaccggcccccccgccaaccccaaucuaaaaagcaaaacaacaaaccagcuuuggcagcaguguucauguauaauuuuaugguuuuugagacagaguuuugcucuuguugcucaggcuggagugcaauggcgcaaucuuggcucacugcaaccucuaccucccggguucaagcgauucuccugccuuagucuucugaguagcugggauuacaagcaugcgccacaacaccuggcuaauuuuuuguguuuuuaguagagaugggguuucuccuuguuggucaggcuggucucaaacucccgaccucagaccucaggugaucugcccgccucggccucccaaagugcugggauuacaggcgugagcgaccgugccuggccaauaucuaauuugaauagaaau

SEQ ID NO: 182243 - RNA, 51 nt, Homo sapiens
uccucucaaaggugagcccgcguuugggggugcuccgggcucaaggcuugg

SEQ ID NO: 182244 - RNA, 39 nt, Homo sapiens
caguuuagggagccgggcugcccuuaugccacugagaag

SEQ ID NO: 182245 - RNA, 53 nt, Homo sapiens
uucucccccagggguaccccacuugcugccaaccauccaccccugacccccau

SEQ ID NO: 182246 - RNA, 39 nt, Homo sapiens
auccucagggggcucccuuuccucugcccucagcucuuc

SEQ ID NO: 182247 - RNA, 41 nt, Homo sapiens
gccgggagaugggcacacacacauccguggaguagcccugg

SEQ ID NO: 182248 - RNA, 46 nt, Homo sapiens
ucccugcagagcucucccugcagggaagaaacacacugccaggguc

SEQ ID NO: 182249 - RNA, 45 nt, Homo sapiens
uagcauuuccauuugauuuuuucuugcaguuuccaucucugcuga

SEQ ID NO: 182250 - RNA, 45 nt, Homo sapiens
ggcgaggcaauuuuuaauucuuaagaaccaaaccccaauugagga

SEQ ID NO: 182251 - RNA, 48 nt, Homo sapiens
auaauucagacuugcuuaauaguaauagaagcuaugcaggaaagcaga

SEQ ID NO: 182252 - RNA, 79 nt, Homo sapiens
aagcaagagaaaacccacaguggaguagaauauucugaauacaauaaaaguggaaaagcccucagccauaaagcagcca

SEQ ID NO: 182253 - RNA, 46 nt, Homo sapiens
ucccauaaggccaaccucaucaaacaucagagaauucacacugggg

SEQ ID NO: 182254 - RNA, 54 nt, Homo sapiens
acaccagagaauucauacaggagagcgacccuaugaguguaacgaaugugcaaa

SEQ ID NO: 182255 - RNA, 55 nt, Homo sapiens
aaccuucuuuaagaagucaaaccuuaucauacaucagaagauucacacgggggag

SEQ ID NO: 182256 - RNA, 81 nt, Homo sapiens
acccuaugaauguacugagugcggcaaaacuuucagccagaggucaacucuuagauuacacuugcgaauccacacaggaga

SEQ ID NO: 182257 - RNA, 46 nt, Homo sapiens
aacccugaaacuccagccaggucuuacuguggaaaacuccugccag

SEQ ID NO: 182258 - RNA, 53 nt, Homo sapiens
gagucucaggacguucaucuuuuacuuugucuccaucuuuaccuaacuucuag

SEQ ID NO: 182259 - RNA, 44 nt, Homo sapiens
ggccauggaugaaacccuccccagauauucuuaggucugcccag

SEQ ID NO: 182260 - RNA, 49 nt, Homo sapiens
acaaacggaaguacuugguuccaucugauaucacuguggcucaguucau

SEQ ID NO: 182261 - RNA, 44 nt, Homo sapiens
ccugauccagauuccagcccccaccucuccccugagugugaguu

SEQ ID NO: 182262 - RNA, 45 nt, Homo sapiens
uccucuuucccaguguccuccaccucuacuuccuggugucugaua

SEQ ID NO: 182263 - RNA, 47 nt, Homo sapiens
ccuuaaccuucaugcagugcuugcuggcuucaaagaguggcugggga

SEQ ID NO: 182264 - RNA, 24 nt, Homo sapiens
augaagaucaauuaugucugaggc

SEQ ID NO: 182265 - RNA, 51 nt, Homo sapiens
uucuacccacacacguuuaguuugaagaguaucuauuuuuggaggguucuu

SEQ ID NO: 182266 - RNA, 47 nt, Homo sapiens
acgagaaggaaaaagaugaagauggauucuuauauguggccuacagc

SEQ ID NO: 182267 - RNA, 45 nt, Homo sapiens
uauuggaagguuuuguuuccuuagacuaguaaauuaucauacaga

SEQ ID NO: 182268 - RNA, 81 nt, Homo sapiens
gugaugcauuuauucuggguuaugcuugaaguguuagauggcuaaguauuaaaauuauccaaauuaaauccuuagcaguca

SEQ ID NO: 182269 - RNA, 55 nt, Homo sapiens
cucuccaugugauggcaaagauggccccaucuuuggaguugcuuagcaacucuag

SEQ ID NO: 182270 - RNA, 35 nt, Homo sapiens
ccacuuggagugacuuucugccacucccuuuccuc

SEQ ID NO: 182271 - RNA, 41 nt, Homo sapiens
gagacaggaaguaaauuaaguaaauuagagguuuccaaggg

SEQ ID NO: 182272 - RNA, 36 nt, Homo sapiens
gugcacuguagaaaaaucagaaaauauauuaaaaac

SEQ ID NO: 182273 - RNA, 36 nt, Homo sapiens
uagaaagccaugaauuaaaaaaccaucaagcagauc

SEQ ID NO: 182274 - RNA, 45 nt, Homo sapiens
caauuauacaaaaagcuucccaguagaagaugagcuugugauaga

SEQ ID NO: 182275 - RNA, 42 nt, Homo sapiens
gaaacauggcgacucgaucaaugcccaugccccagccagcug

SEQ ID NO: 182276 - RNA, 42 nt, Homo sapiens
gcguccaauuucauaaacccggucgaugccaccaaccacaag

SEQ ID NO: 182277 - RNA, 45 nt, Homo sapiens
ucauguccagcucguugugauaagugaugaaaggcuuggccacgg

SEQ ID NO: 182278 - RNA, 45 nt, Homo sapiens
aucccagcucaucuaagaaacuucuuauauaugugaugaucuuag

SEQ ID NO: 182279 - RNA, 74 nt, Homo sapiens
uuugaggccaaagugaagaugagguaacauaugcaaacagggagacagcagugugaucucauacggaaugaugc

SEQ ID NO: 182280 - RNA, 47 nt, Homo sapiens
uggaauuggccaugacuugcaacuucacccccucuccucgaagauca

SEQ ID NO: 182281 - RNA, 43 nt, Homo sapiens
ggauuucccugaauccucacauaaaaauagaaagcacagcuag

SEQ ID NO: 182282 - RNA, 28 nt, Homo sapiens
cgauaugaauuuagaauaacuuuaaaaa

SEQ ID NO: 182283 - RNA, 44 nt, Homo sapiens
gaagguaaugggcaccaaccuucuuugaucagaaaaugacuugu

SEQ ID NO: 182284 - RNA, 42 nt, Homo sapiens
ggggccgugcugcuggcccagcccggggaggcgcuggccgag

SEQ ID NO: 182285 - RNA, 52 nt, Homo sapiens
ccacagaauaagagaacuccagauuugccugaagaagaguaugugaaggaag

SEQ ID NO: 182286 - RNA, 71 nt, Homo sapiens
ucugggcuucagacauguugcccugaagcuuuugcuucacaaagcuuuuaguuuuuggcaggacaaguuga

SEQ ID NO: 182287 - RNA, 25 nt, Homo sapiens
aggaauugaagggaugcacaggaau

SEQ ID NO: 182288 - RNA, 46 nt, Homo sapiens
ugauccacccacaccugaggaagacucagaaacacagccugaugag

SEQ ID NO: 182289 - RNA, 32 nt, Homo sapiens
ccauuguuggaauggaacccuugcuauaguag

SEQ ID NO: 182290 - RNA, 42 nt, Homo sapiens
gaccccucccccacaggugacugugcacugcagcagagagaa

SEQ ID NO: 182291 - RNA, 53 nt, Homo sapiens
agcaaaugaacauggcuacauuccaguuaaacuuuauaaaaacaggcagguau

SEQ ID NO: 182292 - RNA, 92 nt, Homo sapiens
ugggguuaaaaaaagugaauuucuuuuugauaaccaaggugaugaucuuaugaaguugaugauggggugugaacggugugagugggggacaa

SEQ ID NO: 182293 - RNA, 46 nt, Homo sapiens; identical to SEQ ID NO: 111075

SEQ ID NO: 182294 - RNA, 35 nt, Homo sapiens
uaggcccagcaauggacgauaaaguagguuaaaag

SEQ ID NO: 182295 - RNA, 123 nt, Homo sapiens
uaaagagaaggcaagagaggaaugcaguguccaccaucccugcagcccuuuggcgccuucccccucccauuaccuugaaguagagggaaaggggacgacagaagaacccuuagaaguaagacu

SEQ ID NO: 182296 - RNA, 50 nt, Homo sapiens
agaaggccucccuuggcugauaccuucugacuguuagugaauaaaggaag

SEQ ID NO: 182297 - RNA, 53 nt, Homo sapiens
gagggaaguccgcugauuguuuuucucuuggugcaacuucgcaccacccuuac

SEQ ID NO: 182298 - RNA, 37 nt, Homo sapiens
aucaucuacauaucaacaaaaaguuggaaaauguugu

SEQ ID NO: 182299 - RNA, 55 nt, Homo sapiens
uugucccuuggaggagagcugccguagagagacagcugagcagaaauacucacaa

SEQ ID NO: 182300 - RNA, 45 nt, Homo sapiens
ggccgcaaggaauguucugaaacaauccauggcacagcugcagag

SEQ ID NO: 182301 - RNA, 46 nt, Homo sapiens
gacgagcgucuuuccaauauuucuuauauugaacauagcaggugcu

SEQ ID NO: 182302 - RNA, 46 nt, Homo sapiens
guaaucagcuugaauuuucuaaaugcaacuucaucauucugcaaau

SEQ ID NO: 182303 - RNA, 45 nt, Homo sapiens
ucugccauuuuuugaccauggaacacauuuugucacggguaagau

SEQ ID NO: 182304 - RNA, 41 nt, Homo sapiens
accugucucguccccaguggcuuuuccagaacuacugccuu

SEQ ID NO: 182305 - RNA, 43 nt, Homo sapiens
gcaccuggaguuggcauucauaagacuuuguaaagagaaaguu

SEQ ID NO: 182306 - RNA, 73 nt, Homo sapiens
agcguucuccaaauuaccaggaaggugaugagcaucacuguugaugccagucuuguggccccauguccacauu

SEQ ID NO: 182307 - RNA, 42 nt, Homo sapiens
uaacccuugcugugguucugccuuggugaacugcuuagcacu

SEQ ID NO: 182308 - RNA, 49 nt, Homo sapiens
ccugucauaguuucucugccuugcuugcaguuucuacuaggcaucucuc

SEQ ID NO: 182309 - RNA, 73 nt, Homo sapiens
ccucuucccuaaccucaccuucccuuaucuggacuaaaggauccagucuccaggggcccaagggugagcacug

SEQ ID NO: 182310 - RNA, 24 nt, Homo sapiens
gaacugggaagaggaaaagacuga

SEQ ID NO: 182311 - RNA, 49 nt, Homo sapiens
agaccuuucuugucucucugaucucuuaucuuccucauauuugccugac

SEQ ID NO: 182312 - RNA, 46 nt, Homo sapiens
gcuuugcugaugcccccugguccaugaccuggugauaaggcauggu

SEQ ID NO: 182313 - RNA, 30 nt, Homo sapiens
agcucccugcccugcucauauggggcaauc

SEQ ID NO: 182314 - RNA, 59 nt, Homo sapiens
cguguuugauguugcugugacggcugcuggcgguggcggaguucccugucucaggaagg

SEQ ID NO: 182315 - RNA, 46 nt, Homo sapiens
ucagacaccugugugucuaccugguggcauuugucucuuuggcugc

SEQ ID NO: 182316 - RNA, 47 nt, Homo sapiens
aaaugggucccaucagccuggcuuggauuugaaugaucauguuggag

SEQ ID NO: 182317 - RNA, 70 nt, Homo sapiens
ucuuacaggacuacccccagugguuugcaaauaaugccccugaaaaagucucagaacgggauggaaaaug

SEQ ID NO: 182318 - RNA, 48 nt, Homo sapiens
gucgaggcccgucgguugagaaacugucccacagaccuucagauccug

SEQ ID NO: 182319 - RNA, 50 nt, Homo sapiens
uugaugaauucaauggguugcacauguccaaggacaagaggaucaaguca

SEQ ID NO: 182320 - RNA, 103 nt, Homo sapiens
ugaaaggauuguagacaagaggaagaacaagaaaggaaaaugggaguaucuuauccgauggaaaggcuacgggagcaccgaggacacgugggagccggagcac

SEQ ID NO: 182321 - RNA, 23 nt, Homo sapiens
aaggacaaacauuuuuaguaaau

SEQ ID NO: 182322 - RNA, 69 nt, Homo sapiens
uugcugaguucaucaagaggaccaucuugaaaauccccaugaaugaacugacaacaauccugaaggccu

SEQ ID NO: 182323 - RNA, 69 nt, Homo sapiens
gggauuuuuugucugaaaaucaacugcagacuguaaauuuccgacagagaaaggaaucuguaguucagc

SEQ ID NO: 182324 - RNA, 39 nt, Homo sapiens
aagcgugcaaguaucagugaugcugcccuguuagacauc

SEQ ID NO: 182325 - RNA, 45 nt, Homo sapiens
cagcaccagaaaguuugggaaguuuuucagaugaguaaaggacca

SEQ ID NO: 182326 - RNA, 42 nt, Homo sapiens
aagaauaaaauucaucuuuuacauaaaauucaaugucaugac

SEQ ID NO: 182327 - RNA, 46 nt, Homo sapiens
cagucuggauucgaauugccuggggaacacaguacacaaagccaaa

SEQ ID NO: 182328 - RNA, 42 nt, Homo sapiens
ccuucacguccuccuccaugcugaggcgcaauacaccgcuuc

SEQ ID NO: 182329 - RNA, 362 nt, Homo sapiens
ugauacaccaguugcccucuauguuuuguuuuguuuuuuucugagaugcaguuucacucuguugcccaggcuggagugcaguggcaccaucuuggcucacugcagccuccgccuccuggguucaagcaauucucaugccuuggccuccuggguagcuggaauuacaggugcccaccaccauacccagcuaauuauuguauuuuuaguuaagacgggguuucaccauguuggccaggcuggucucaaacuccuaaccucaagugauccacucgccuuggcuucccaaagugcugagauuacaggcaugagccacuuugcccgaccugcccucuauguuugcaguuagcagauuaaaugguccc

SEQ ID NO: 182330 - RNA, 70 nt, Homo sapiens
ccaucagucaguuucacgguguugguaagaucagcucaggacugagaccuaagggaaauugccccugugg

SEQ ID NO: 182331 - RNA, 38 nt, Homo sapiens
cuccaugaaucccaccauacacaaggcugggcuagauu

SEQ ID NO: 182332 - RNA, 45 nt, Homo sapiens
uuuacgagagaaaacugagaaaacggucucucagggccucugggg

SEQ ID NO: 182333 - RNA, 46 nt, Homo sapiens
gugugucaaacaucucaaggccuaagaaguuagaauuuccccuaca

SEQ ID NO: 182334 - RNA, 46 nt, Homo sapiens
uagcaguggagacuccuucaguuugggucucugugucagaugaauc

SEQ ID NO: 182335 - RNA, 44 nt, Homo sapiens
uucuacagagcugaacugagacuccaucguguuccaggccagau

SEQ ID NO: 182336 - RNA, 51 nt, Homo sapiens
ggcacaccuucaauaggauuguuucugaucacagauccugcugccccggca

SEQ ID NO: 182337 - RNA, 45 nt, Homo sapiens
uauccuggguuaucuggugggcuccgcgucuucccagggguccuu

SEQ ID NO: 182338 - RNA, 49 nt, Homo sapiens
uuuuuuacugcuugaauuauguauccaaaauaaaaaggaaaagaaaggu

SEQ ID NO: 182339 - RNA, 41 nt, Homo sapiens
uuuccucuucagcucugacuuaaaaacacacuauguuccaa

SEQ ID NO: 182340 - RNA, 43 nt, Homo sapiens
ccacacaaaaggaaucaucuuuaagcuguuuaauuaaccuaau

SEQ ID NO: 182341 - RNA, 50 nt, Homo sapiens
aggagcucccuggggguggggaacagcucuuuuaccgggguggacuggag

SEQ ID NO: 182342 - RNA, 46 nt, Homo sapiens
gccgacuguuuauaaaagaaacggagguugguuugucuucggagca

SEQ ID NO: 182343 - RNA, 42 nt, Homo sapiens
agggaaguauuugugcuaaaccaacagaaaaaagggcugggg

SEQ ID NO: 182344 - RNA, 51 nt, Homo sapiens
ugagccucacugauguuuaagucaccuaaugaugcagcugccuucccccac

SEQ ID NO: 182345 - RNA, 42 nt, Homo sapiens
cacggucaauguagauucccuugcggaauaugagaagagcca

SEQ ID NO: 182346 - RNA, 55 nt, Homo sapiens
aaguccacccccgagcggagaaccguccaggugaucauggagacgcggcaggugg

SEQ ID NO: 182347 - RNA, 64 nt, Homo sapiens
ccuuggguguguugagugaucuagaaggcaggucugguacuuggauauuagaaggcugcccucc

SEQ ID NO: 182348 - RNA, 47 nt, Homo sapiens
gccuuguuggcacugugggcagcaggaaauggcugaaauaacuucca

SEQ ID NO: 182349 - RNA, 43 nt, Homo sapiens
agggcugcugagccugucacucuggcauaagggaggagugugg

SEQ ID NO: 182350 - RNA, 19 nt, Homo sapiens
uauaauuaaagggcaacac

SEQ ID NO: 182351 - RNA, 73 nt, Homo sapiens
agcuaugagacguacggaggggccaaaaguccgcaaggcugugccagaaggugauggguaggcagggagggcu

SEQ ID NO: 182352 - RNA, 48 nt, Homo sapiens
cgccagaaagaagacugcugcuucaccauccuauauggcacucaguuc

SEQ ID NO: 182353 - RNA, 65 nt, Homo sapiens
ugccugggugcgggaguugaagaacccugggggccucccgggcugagcagggaggacacugugau

SEQ ID NO: 182354 - RNA, 75 nt, Homo sapiens
gaugggggcucagccugccugugcugguuuuggucgggcugugcagcacgacacacacacauccagaggugggag

SEQ ID NO: 182355 - RNA, 69 nt, Homo sapiens
uguucccaguuagugguccauaaauaacuguugaccaggcucucucauagagggcugccugagguggga

SEQ ID NO: 182356 - RNA, 42 nt, Homo sapiens
ucuuuaaccaugacagagcugugggcaaaauguagagaaaug

SEQ ID NO: 182357 - RNA, 56 nt, Homo sapiens
aaugacuugcggaguuguguggacuaagugagaugaccauaggaggaagaaagaug

SEQ ID NO: 182358 - RNA, 41 nt, Homo sapiens
ugguagauacucuuauucccacuucauggauggggaggcac

SEQ ID NO: 182359 - RNA, 43 nt, Homo sapiens
cccuggggcaggaacaacugagaggagucugcuaaggcuggag

SEQ ID NO: 182360 - RNA, 28 nt, Homo sapiens
uuccuucucauagccucucuggcuauuu

SEQ ID NO: 182361 - RNA, 45 nt, Homo sapiens
ggcccgaugggaagccggucaucuaccauggcuggacgcggacua

SEQ ID NO: 182362 - RNA, 42 nt, Homo sapiens
gugauccuguccaucgaggagcacugcagcguggagcaacag

SEQ ID NO: 182363 - RNA, 42 nt, Homo sapiens
agugcugaccagcugcccucgcccagccagcugcgggagaag

SEQ ID NO: 182364 - RNA, 23 nt, Homo sapiens
ugcucuggcuuggucccaugcuu

SEQ ID NO: 182365 - RNA, 41 nt, Homo sapiens
gagcacaacaaagacccugccguugugcugcuuauagugua

SEQ ID NO: 182366 - RNA, 46 nt, Homo sapiens
gggugacuaacaacauuuuuggaguuguggcuggagcccaggugac

SEQ ID NO: 182367 - RNA, 45 nt, Homo sapiens
uaugccucugacaggcaguucucugaauuucgaaggcucuugucu

SEQ ID NO: 182368 - RNA, 37 nt, Homo sapiens
ccguaaauacagccagcccuugccagaagugggucug

SEQ ID NO: 182369 - RNA, 56 nt, Homo sapiens
gagacuggcagaagagaggugcaagugggagguacagucuaagcaaagguguggca

SEQ ID NO: 182370 - RNA, 42 nt, Homo sapiens
ggagccgaguaugacaacaacaaguucaagacgacgguugug

SEQ ID NO: 182371 - RNA, 40 nt, Homo sapiens
ggagauuaaaaaugugaccuucuccucccccgacugugag

SEQ ID NO: 182372 - RNA, 46 nt, Homo sapiens
gauagacucauccuuucuggaugcuuuuuggugccagugcaucuuu

SEQ ID NO: 182373 - RNA, 47 nt, Homo sapiens
aguauuuuuagcaccauuuuauuaccuacuguauuuuauuuaagaug

SEQ ID NO: 182374 - RNA, 46 nt, Homo sapiens
gcauguguguuugcauguaggagaacgugcccuauucacacucugg

SEQ ID NO: 182375 - RNA, 41 nt, Homo sapiens
uuauuuucaucuuggacaacuuucuuaacuuauauucuuua

SEQ ID NO: 182376 - RNA, 41 nt, Homo sapiens
ugagacaucaccgccaagcugggcaucggggagauggccga

SEQ ID NO: 182377 - RNA, 47 nt, Homo sapiens
caaugaucuggucagacauggucugaaauuuaucuugcaucugcugc

SEQ ID NO: 182378 - RNA, 44 nt, Homo sapiens
cugcagcagaugcaagauaaauuucagaccaugucugaccagau

SEQ ID NO: 182379 - RNA, 40 nt, Homo sapiens
gccaacaucucauugagccuuuuuccucccgucccugcag

SEQ ID NO: 182380 - RNA, 45 nt, Homo sapiens
ucgcggaccucaugacacaggcugggguggaagaacuggaaagug

SEQ ID NO: 182381 - RNA, 43 nt, Homo sapiens
cucagcaacauucauuuuuauagagaauuaaaauguuauaaau

SEQ ID NO: 182382 - RNA, 45 nt, Homo sapiens
agguugcuaauaauuuauacuggaaucuggcauuuuuccaagcca

SEQ ID NO: 182383 - RNA, 50 nt, Homo sapiens
aaguaugcauucuuaucaccuaguauauaguuaguuuguagagugauuuc

SEQ ID NO: 182384 - RNA, 56 nt, Homo sapiens
aaccgccaaaguuuuaguguuuaauaaugaauagcacaacugaccaagguccaaga

SEQ ID NO: 182385 - RNA, 207 nt, Homo sapiens
uaaaaauuguucauucagaaauaucugucacugcucuguugccaaaacucagaauagaacuuagacguaugucugagucccugagaucacaugcuaaagucgaugaaaaguaaccacugccacugucuugugucagaacuuuuacaguacagaaaauaacagaauagccuucuguaaugaggcguuuguuagaguuuugcaugagau

SEQ ID NO: 182386 - RNA, 48 nt, Homo sapiens
uuuaaaacucaaucagucuuuccuuugagcuagugacuugaaaagaaa

SEQ ID NO: 182387 - RNA, 34 nt, Homo sapiens
gauugucaccacaaagugcuuuuacacaaaaacu

SEQ ID NO: 182388 - RNA, 37 nt, Homo sapiens
ggccgggggucuccugcccggguagggagggccucgc

SEQ ID NO: 182389 - RNA, 41 nt, Homo sapiens
guccgggggcucacggcuccccacugugggcaggcagggac

SEQ ID NO: 182390 - RNA, 41 nt, Homo sapiens
ccgcgggguaaaggguggggguuuggcuuggacaaaacuag

SEQ ID NO: 182391 - RNA, 50 nt, Homo sapiens
uggugguagcuccuuguccagaccaucucuagucagucucagagaaccuc

SEQ ID NO: 182392 - RNA, 31 nt, Homo sapiens
gauuaagaaucuuaauaauaauguauuuuuu

SEQ ID NO: 182393 - RNA, 44 nt, Homo sapiens
cucgauggccuccaccgcacucuccacugagcucagcagcgacu

SEQ ID NO: 182394 - RNA, 53 nt, Homo sapiens
cgcucuguguuucucuaaacacaagggaagaugggcacgucucuauccagggg

SEQ ID NO: 182395 - RNA, 35 nt, Homo sapiens
gagaaagaucaaaaucaagucccuguucaugagau

SEQ ID NO: 182396 - RNA, 23 nt, Homo sapiens
gcaauuggaguccccauacagua

SEQ ID NO: 182397 - RNA, 46 nt, Homo sapiens
ucagggaaguacuccuccucacuguccaccaucagcaaagugccug

SEQ ID NO: 182398 - RNA, 52 nt, Homo sapiens
auccacacagccagaacuuacuucccaaguaagccaguggguuaagaaaaaa

SEQ ID NO: 182399 - RNA, 38 nt, Homo sapiens
uuaaaagggagacaagaacaccugacgagaugacuuaa

SEQ ID NO: 182400 - RNA, 46 nt, Homo sapiens
ugacccguuugauguuuggaugaucuucaaguguuagcagccccgc

SEQ ID NO: 182401 - RNA, 45 nt, Homo sapiens
gaauuccaccuucaaagucaggugggaacagccagggcauggggc

SEQ ID NO: 182402 - RNA, 94 nt, Homo sapiens
guuucagcuaaaagcugcaacauuacuaaucagccaucuuacagucuugcccaacauaaauaaaaguuaaaucccauggccuuuugugguucag

SEQ ID NO: 182403 - RNA, 85 nt, Homo sapiens
ucuuggaaauaaggcuucucucacucaggccgugacgacugaguccuguacuccauuuguaccacagaaccaacguccaaugggg

SEQ ID NO: 182404 - RNA, 44 nt, Homo sapiens
aaaaauggaaaaaaguaaggacaacaaaauaacaccaaaaauau

SEQ ID NO: 182405 - RNA, 50 nt, Homo sapiens
aagguaaagacucuuagguaagaaauuuuaacacagcccaugcagaagag

SEQ ID NO: 182406 - RNA, 46 nt, Homo sapiens
uaguuaaauuuaaggacaacuaaacaaaaugcaggaaaugaaaaug

SEQ ID NO: 182407 - RNA, 47 nt, Homo sapiens
gacacagaugugcacaaggaucagcacugcccagccugaggagggag

SEQ ID NO: 182408 - RNA, 60 nt, Homo sapiens
aaugaacaaaauaccauagaaaucucugaccucacggagcuuaccuuccagugcagggag

SEQ ID NO: 182409 - RNA, 52 nt, Homo sapiens
cauauaaaggcauaacguucaaagaugguauucccguaccuauggguuuuuc

SEQ ID NO: 182410 - RNA, 57 nt, Homo sapiens
aaaaagacaccguucaaauuauagaaauagaaaauaguauuuaaugggauuugagua

SEQ ID NO: 182411 - RNA, 23 nt, Homo sapiens
uuaaguaauugaggauaggaaaa

SEQ ID NO: 182412 - RNA, 51 nt, Homo sapiens
uuaacaauaaaaguaguuguuuguuuccuuuggaagaguuuuguuccagau

SEQ ID NO: 182413 - RNA, 48 nt, Homo sapiens
ccuaauuuaucaaucuaagacauuacuggaccacguaaccuuacauau

SEQ ID NO: 182414 - RNA, 62 nt, Homo sapiens
uuccacgcuuagaucaugucuucagaacuuagaugugaaaaucuacacacugggagaugcug

SEQ ID NO: 182415 - RNA, 44 nt, Homo sapiens
aggaguuggcaaaacuucucaaguggccauccagacucaggcug

SEQ ID NO: 182416 - RNA, 44 nt, Homo sapiens
uacaaaguggaaacugauauuauaguugcggacuucagcagcgg

SEQ ID NO: 182417 - RNA, 46 nt, Homo sapiens
gcauccuaggugcaacagaugggauuggaaaagccuacgcugaaga

SEQ ID NO: 182418 - RNA, 49 nt, Homo sapiens
ugauuucuagugugaauuuuucucugacuaaaccugacaggggguacuu

SEQ ID NO: 182419 - RNA, 36 nt, Homo sapiens
ucccaguccuccuccagacccacuuccuacuaugug

SEQ ID NO: 182420 - RNA, 44 nt, Homo sapiens
ugaauaaugcauccgacuucacagaaaagauuauuuugauuaua

SEQ ID NO: 182421 - RNA, 34 nt, Homo sapiens
acauacugcugacggcccagaacuggcagagaga

SEQ ID NO: 182422 - RNA, 40 nt, Homo sapiens
cacacacguccauucccuacuaaggcccagaccuccuggu

SEQ ID NO: 182423 - RNA, 62 nt, Homo sapiens
cuaucucaugacgcucauggaaccucuuucuuugaucuucuuuuucuuuucucccccucuuu

SEQ ID NO: 182424 - RNA, 47 nt, Homo sapiens
gcccaccagggagaaaagaagccaugagaggcagcgcccgccacccu

SEQ ID NO: 182425 - RNA, 46 nt, Homo sapiens
aauuucgcuaaggaguuugugaucagugaucggaaggagcuggagg

SEQ ID NO: 182426 - RNA, 91 nt, Homo sapiens
gcgcuucaccaccggggaugccaugagcaagagguccaaguuugcccucaucacguggaucggugagaacgucagcgggcugcagcgcgcc

SEQ ID NO: 182427 - RNA, 45 nt, Homo sapiens
cucucugggugggaaggggagggcauccauagucuucaaaucagg

SEQ ID NO: 182428 - RNA, 43 nt, Homo sapiens
auuuuauuucaugagugcauuuugaaauuaaccugccauagau

SEQ ID NO: 182429 - RNA, 50 nt, Homo sapiens
ugggaaugaguccaguuuucuguuggugcagauuuuagagcugauugguu

SEQ ID NO: 182430 - RNA, 48 nt, Homo sapiens
ccauaaaugucaauuacugcgauugccauuuuuguuuuuggaauucaa

SEQ ID NO: 182431 - RNA, 45 nt, Homo sapiens
aaauaugacggcuccaccaucguccccggcgagcagggagcggag

SEQ ID NO: 182432 - RNA, 50 nt, Homo sapiens
ggccgccccggacagugucccgcugcggcuccgcggcgauggccaccaag

SEQ ID NO: 182433 - RNA, 60 nt, Homo sapiens
cccgcuuaguauucacuggaauuucagugcgcugugcucucaaugagaugggcucaagag

SEQ ID NO: 182434 - RNA, 67 nt, Homo sapiens
gcacugagcaucaacaauccacacucaacuaugcgagacuacgagaguaaaacuuugaacacaacac

SEQ ID NO: 182435 - RNA, 48 nt, Homo sapiens
auuguaucuacccacggacucacuaaaacaaaguuuugucuuaccuca

SEQ ID NO: 182436 - RNA, 45 nt, Homo sapiens
cagccugugugccacacagaacuguuccacuguauggaggaagcu

SEQ ID NO: 182437 - RNA, 23 nt, Homo sapiens
caggaagggugccugaugcagag

SEQ ID NO: 182438 - RNA, 42 nt, Homo sapiens
gggaggggaauacuuaguuuccacauaggccaccggcgagga

SEQ ID NO: 182439 - RNA, 40 nt, Homo sapiens
cauguuauuucacaaaaugauuucuuguaucuuaagaaau

SEQ ID NO: 182440 - RNA, 41 nt, Homo sapiens
ugcacuuuggaauacagaggaaugaacuucaucagguggua

SEQ ID NO: 182441 - RNA, 47 nt, Homo sapiens
aaagaagaaggggaguaggguguguagaauaaaaaacaaguuaacau

SEQ ID NO: 182442 - RNA, 97 nt, Homo sapiens
ugacauccuaacuaaucuaaugacaguuguacccuacgguaucaugaacauaaauaagcuauuuggccucugucagagguaguauugauguugugau

SEQ ID NO: 182443 - RNA, 43 nt, Homo sapiens
ggguuuacagcagguccacucggcgguaauacaggagguaggc

SEQ ID NO: 182444 - RNA, 46 nt, Homo sapiens
aucagcaacgagagugggggugacguggacgugaugcccguggaua

SEQ ID NO: 182445 - RNA, 53 nt, Homo sapiens
gggguccugcccgugguuacuaugaauguauugcuguuggaggacaucucgau

SEQ ID NO: 182446 - RNA, 31 nt, Homo sapiens
ugcgugucugugcgugugcgcgcgugugugc

SEQ ID NO: 182447 - RNA, 64 nt, Homo sapiens
cuuccaguuauuuauuuggggucugaaggauaucaacagcucaucugugaccaacagggcaacu

SEQ ID NO: 182448 - RNA, 43 nt, Homo sapiens
uuggcacccaaauccacuccauaugcaacgacgagacgguaag

SEQ ID NO: 182449 - RNA, 69 nt, Homo sapiens
ggagcaaaaccacagagcuaugaaaggcgagguaaggggaauccaaaggagcaccauauggaagagagu

SEQ ID NO: 182450 - RNA, 38 nt, Homo sapiens
aaaauacauguuccuacuuucaaacacuuagggcuucc

SEQ ID NO: 182451 - RNA, 43 nt, Homo sapiens
caauccaaacaugguucaaauuagaauuccauaguggccagag

SEQ ID NO: 182452 - RNA, 49 nt, Homo sapiens
ucaggugaccgauuuucuguuuacacagggagacucagaaagaggagga

SEQ ID NO: 182453 - RNA, 35 nt, Homo sapiens
uuauguuaccuggauuccggggcaagaaugcgugu

SEQ ID NO: 182454 - RNA, 39 nt, Homo sapiens
aagccacacagcuccuggacagagccgggaaggggagga

SEQ ID NO: 182455 - RNA, 48 nt, Homo sapiens
gucaccuggucuacccuggcauuguguagaugagaucacagcggucag

SEQ ID NO: 182456 - RNA, 58 nt, Homo sapiens
ggccuccggggugggccuccacagucauggcggcccccaauuucagguucgccagccc

SEQ ID NO: 182457 - RNA, 62 nt, Homo sapiens
gcccggggaaggucagcucaccuccaggacccaaguccugacugugaugccccuggccgggu

SEQ ID NO: 182458 - RNA, 59 nt, Homo sapiens
guucucuucaugguaggugguggcugaugcccuugaaguuggggucccagaaaguggag

SEQ ID NO: 182459 - RNA, 34 nt, Homo sapiens
cuuauugagcgccuacucuaugcaguaccugcau

SEQ ID NO: 182460 - RNA, 41 nt, Homo sapiens
ggaaugcauguuagggcugcagagaagggauacagcuggga

SEQ ID NO: 182461 - RNA, 43 nt, Homo sapiens
uggacuauguugcuuggaauguucacucuguggauguuugcug

SEQ ID NO: 182462 - RNA, 52 nt, Homo sapiens
ccgaugauguuccagucucacaguggaaaagcguguagggagagggagaagg

SEQ ID NO: 182463 - RNA, 119 nt, Homo sapiens
cugugaccuguccccuucagugagcucgcccuuccuugagaggagggcugcaucaggcacgaguggauggggucuacacccagggcugcggcuuccccugcugaaguuccuguccccca

SEQ ID NO: 182464 - RNA, 48 nt, Homo sapiens
gggagacccccaggacaccacccucgcaggaggguguccucuggagag

SEQ ID NO: 182465 - RNA, 40 nt, Homo sapiens
ccgcuggaauucugggggacgguaggaaacgcuggcccag

SEQ ID NO: 182466 - RNA, 39 nt, Homo sapiens
gacccucgcccccugcacuccuucccccaccccuccagc

SEQ ID NO: 182467 - RNA, 67 nt, Homo sapiens
aguccuguaacauuuuauccgccaacccagacuaaguaucccagcccucuagcacuggcucccugag

SEQ ID NO: 182468 - RNA, 25 nt, Homo sapiens
ggugggagcuuugacacggcgcggg

SEQ ID NO: 182469 - RNA, 38 nt, Homo sapiens
aggaauaggugcaugaaugaaugggugggugaguggau

SEQ ID NO: 182470 - RNA, 72 nt, Homo sapiens
aaaauaaacccagccaaaaaaggaugcgggaaccuccugcaggauccgcaccaugccgucuuguccuggauu

SEQ ID NO: 182471 - RNA, 43 nt, Homo sapiens
guggggcagccaugggugucugccaggcccacggcagucaggg

SEQ ID NO: 182472 - RNA, 38 nt, Homo sapiens
gagcuuggguccacagagagggcaccguguccguggaa

SEQ ID NO: 182473 - RNA, 61 nt, Homo sapiens
acugugugauugcuaucuaagagugggacgcaaccuggagagaugaauuccagaggcaggg

SEQ ID NO: 182474 - RNA, 232 nt, Homo sapiens
cucagagaggccaggguuagcugggugugauggcacaagccuguggucccagcuacucgcgagacugaggcaggaggaucauuugggcccaggagucugaggcugagguaugauugugccacugcacuccagcuugagccacagagcaagaccuugucuuuuuuugguuguuuuuaaaggugggggcggcaagggacagacagcagagggcagaugcugacagaggggacac

SEQ ID NO: 182475 - RNA, 58 nt, Homo sapiens
cugugaguccuggccgggaaacgcuggcggccaccaggcgggcuggcaagggggagau

SEQ ID NO: 182476 - RNA, 43 nt, Homo sapiens
ugcugguuugccccagggcucagaaguagggacgcgcuagauc

SEQ ID NO: 182477 - RNA, 40 nt, Homo sapiens
uuuccuggugugccgggagagcuguuuuuuuaaccugcag

SEQ ID NO: 182478 - RNA, 45 nt, Homo sapiens
ggcugugccgaagccuggccgccuggcuuuaauuccucccccagu

SEQ ID NO: 182479 - RNA, 67 nt, Homo sapiens
uaaccugaugccucccucgcauccauacucccaugcccaccccgugucuggaaucagaaguucagag

SEQ ID NO: 182480 - RNA, 31 nt, Homo sapiens
gccccccaacccagaagauaagacucagggu

SEQ ID NO: 182481 - RNA, 48 nt, Homo sapiens
cccuaaguggcaacccacgaguaugaacacccuccccaauaugaccug

SEQ ID NO: 182482 - RNA, 75 nt, Homo sapiens
ccaggaggaaagagcaacacagcgccuggcccguguagaccuguccucugccacgcucacugagccacggcagga

SEQ ID NO: 182483 - RNA, 45 nt, Homo sapiens
gcaaaggacagcccuugcagguggccaggauccugaccuggaaca

SEQ ID NO: 182484 - RNA, 78 nt, Homo sapiens
gguuguccagagcagcacgugauguaaauaagagggugggggccucgcagaccugguccaccuagaccccuggcucgu

SEQ ID NO: 182485 - RNA, 73 nt, Homo sapiens
gccucgggggcagcagccuugaagugauccccaccaggccuggaggggcaggaggcacgugggcccuggaggc

SEQ ID NO: 182486 - RNA, 37 nt, Homo sapiens
gcaggccauugacacucagcggccuaauccccgcugg

SEQ ID NO: 182487 - RNA, 50 nt, Homo sapiens
aggaggggagagucacucuugccugaagcucccucucccccaggggagga

SEQ ID NO: 182488 - RNA, 43 nt, Homo sapiens
cgcucugagcuggucccuccucggaggguccuuaccgccucgg

SEQ ID NO: 182489 - RNA, 62 nt, Homo sapiens
ucucggccccuucucggggucaccccucucucccagguguagugggagcugcgagaggagaa

SEQ ID NO: 182490 - RNA, 46 nt, Homo sapiens
ggugugugucuggugugaccuucggauguccacaccaggaggggug

SEQ ID NO: 182491 - RNA, 46 nt, Homo sapiens
uggggggcaccacguggugcacgggccgcuggaggcugcaggcggg

SEQ ID NO: 182492 - RNA, 90 nt, Homo sapiens
cuguccucacaguuuguccaccugccaaaugggacaaugaucguucaggcucugcucugaaauagcgccugucucgguagccguggucuc

SEQ ID NO: 182493 - RNA, 61 nt, Homo sapiens
gugaggcugaccgcgagcgggagaaggaacgugagcgcgaacgcgagaaggagcgcgagca

SEQ ID NO: 182494 - RNA, 41 nt, Homo sapiens
agcgugagaaggagcgcgagcgcgagcuggagcgccagcgg

SEQ ID NO: 182495 - RNA, 42 nt, Homo sapiens
agguggccgccugugggagggaggcccgcugcuggcccagga

SEQ ID NO: 182496 - RNA, 45 nt, Homo sapiens
guuggguggucaagccaaaaaguugcaaaaacucuagcuucuaga

SEQ ID NO: 182497 - RNA, 42 nt, Homo sapiens
agaguuuuugcaacuuuuuggcuugaccacccaacagcagaa

SEQ ID NO: 182498 - RNA, 46 nt, Homo sapiens
cgcugucuacccgcuacagcccugaugagaugaacaacagucccaa

SEQ ID NO: 182499 - RNA, 45 nt, Homo sapiens
guugguguugcugcuuccuugucugacaucccaaaggccgcggag

SEQ ID NO: 182500 - RNA, 46 nt, Homo sapiens
ggcugugcugucugcagagcagaaccacaagguugacacguccguc

SEQ ID NO: 182501 - RNA, 48 nt, Homo sapiens
ugacacaaauuucccucucuccaggaguugaggagccagaaacagaag

SEQ ID NO: 182502 - RNA, 67 nt, Homo sapiens
caauugaaucaccguugucauucagcgagcaaccaauguaggauugcccacaguuuuucuuuuuaaa

SEQ ID NO: 182503 - RNA, 79 nt, Homo sapiens
agggggcuguuaaugaucaaguuuuaguguugcuaauggagccuucauguucagauuaagaaauaaugugggagaggaa

SEQ ID NO: 182504 - RNA, 157 nt, Homo sapiens
auaaauaccuaauuacuacauucaacaaauaauauuacaauacaauuaauucaaacaaguacacuuagaacagguuuaauuucacagcaucuaaacugcccccagagugaccgaggcaccgguguuccucccucccaccugcguaugggguuuacug

SEQ ID NO: 182505 - RNA, 55 nt, Homo sapiens
cauaaaaaagauuuuccucuuaacauaauuuaggaagauuuuauuuuuuggaugu

SEQ ID NO: 182506 - RNA, 45 nt, Homo sapiens
agugcuucagacaacaucccgaaggcagacgaaauccggacccug

SEQ ID NO: 182507 - RNA, 45 nt, Homo sapiens
cuguaguggugguggggaugguagcuggaagggagaggaucuaua

SEQ ID NO: 182508 - RNA, 57 nt, Homo sapiens
ucaugaacgaaaggaagaaacuuuuaccccaaugcccagcccuuacuacauggaacu

SEQ ID NO: 182509 - RNA, 53 nt, Homo sapiens
acaaagacagaaaugucgccugcucccuccagaguggauggauguagguaagg

SEQ ID NO: 182510 - RNA, 42 nt, Homo sapiens
cauggacgcugccgaggucgaauuccucgccgagaaggagcu

SEQ ID NO: 182511 - RNA, 36 nt, Homo sapiens
gccgcgaccgcccucuacacccggugucccgcgacc

SEQ ID NO: 182512 - RNA, 33 nt, Homo sapiens
uguagagggcggucgcggcgggcaguggcggca

SEQ ID NO: 182513 - RNA, 36 nt, Homo sapiens
uguauaaagcccugugcuggaguuuuaaagaccuua

SEQ ID NO: 182514 - RNA, 86 nt, Homo sapiens
uuuucgcucccagcuuauauggaucggcgugaccaccccuugccggagguggcccaugucaagcaccugucugccagccagaaggc

SEQ ID NO: 182515 - RNA, 46 nt, Homo sapiens
ccaggaggccuucuccuucuccuucaaugccuucuggcuggcagac

SEQ ID NO: 182516 - RNA, 91 nt, Homo sapiens
cgugaacaugauguggccuggguugguguauccuucagcucuguguuuccuccuucacaagugugguuuuggggagaagugguugaauguu

SEQ ID NO: 182517 - RNA, 51 nt, Homo sapiens
ggagagcuuugcugagaugaacaggggcucgaacgaguggaagacgguugu

SEQ ID NO: 182518 - RNA, 142 nt, Homo sapiens
ugucggggaccuccauaccuugaggcuaugagauagggacugcauuccagaguucaucucaggauuguuuccaggccuuggugaccuggagaacugaagucgugggagguuaguuuauaagccagcaucugauuauucauag

SEQ ID NO: 182519 - RNA, 122 nt, Homo sapiens
aauuuaugugcucaccagucacuuagcgaaagaugacuucgugaagguucgagcaaggauaaggggacucauucauugaaugacugucuggacuguugugaggacugcaucucaacagccag

SEQ ID NO: 182520 - RNA, 58 nt, Homo sapiens
aggcauuuuugcauucugaauagguauauucucguacuuuugguuugaauguggaugu

SEQ ID NO: 182521 - RNA, 75 nt, Homo sapiens
uguugcuaacuuuuuacaaacaaagggcuaauuuuaaaaugucaguguugucaguggucagaaaccguguguuug

SEQ ID NO: 182522 - RNA, 204 nt, Homo sapiens
uaaccugucucacaccguaguguacggcccccucccgcaaagcuuugacaaagaguggguggccaagcagaccaagaggaugcuggacaugaaggugaaccccauccagggcuuagccuccaagugggacuacgaaaagaacgaguggaagaagugagagaugcuggccugcgccugcaccugcgccuggcucugucaccgcca

SEQ ID NO: 182523 - RNA, 50 nt, Homo sapiens
uuaugccaaacaguuguaccacugcuaauaaaugaccaguuuaccugaaa

SEQ ID NO: 182524 - RNA, 46 nt, Homo sapiens
ugcuaaacaguugaugaaaaaaacccuuucauuugcuuuuuuauuu

SEQ ID NO: 182525 - RNA, 27 nt, Homo sapiens
auggaccccgcgucguccggcccgucc

SEQ ID NO: 182526 - RNA, 44 nt, Homo sapiens
gggaaggaaggaagcccuugucuaccacccaggacacagggaaa

SEQ ID NO: 182527 - RNA, 81 nt, Homo sapiens
ccccgcgcgggcugcucccaccucuuucucuccuugcaggcuaccgagacccuggcuggggcggccggcggccccuccggc

SEQ ID NO: 182528 - RNA, 38 nt, Homo sapiens
agccgaugccacacuccacgggugucuuccagaaggag

SEQ ID NO: 182529 - RNA, 57 nt, Homo sapiens
aaaauuuagagaacagcguucaaauuauaugauccucaucagggaaaauaaaucacc

SEQ ID NO: 182530 - RNA, 45 nt, Homo sapiens
aggagucaggcuggggaccuggaggaaaggggccgcagggcucag

SEQ ID NO: 182531 - RNA, 46 nt, Homo sapiens
caaagaggccgcuguauaaugccagcacaauguuccccacauccag

SEQ ID NO: 182532 - RNA, 76 nt, Homo sapiens
agcggugaguuccacgggcagacagacgccagcucagggguaggcugggaggugacgaccccacccccaccccagg

SEQ ID NO: 182533 - RNA, 47 nt, Homo sapiens
ggcucaggucaugugcuucugugagcucccccuacggccuugccccg

SEQ ID NO: 182534 - RNA, 41 nt, Homo sapiens
cuggcccgcagccucucgucaagccugggagcgggcagugc

SEQ ID NO: 182535 - RNA, 17 nt, Homo sapiens
gggaugagaggaugacc

SEQ ID NO: 182536 - RNA, 42 nt, Homo sapiens
ggcgugugugcaaacgaguccuuggaagcucacagcaggcau

SEQ ID NO: 182537 - RNA, 45 nt, Homo sapiens
ugaugaggauguugauagugaugagggugaugaugguaacaguga

SEQ ID NO: 182538 - RNA, 43 nt, Homo sapiens
cgccggagacauguccaggcggaaacagagcaacccccggcag

SEQ ID NO: 182539 - RNA, 46 nt, Homo sapiens
cugcaagucccguccugauaagaucguucugucgggacgggcugaa

SEQ ID NO: 182540 - RNA, 38 nt, Homo sapiens
agccuggugacaccuccuggacccugcaagugucccag

SEQ ID NO: 182541 - RNA, 43 nt, Homo sapiens
uggccugggccucugggcugugccaggagggagcaagagcaca

SEQ ID NO: 182542 - RNA, 42 nt, Homo sapiens
guguuucacugugaugagaaaugcagauagcucggacaggga

SEQ ID NO: 182543 - RNA, 43 nt, Homo sapiens
gguuuccauggcccagacugcuuugggggaggccaguguaccc

SEQ ID NO: 182544 - RNA, 46 nt, Homo sapiens
acaaauuauugguaaccacaggaugacuaauucacuccaagcuuca

SEQ ID NO: 182545 - RNA, 37 nt, Homo sapiens
ggaggugggggugggguguuuucuacucuaccacccu

SEQ ID NO: 182546 - RNA, 43 nt, Homo sapiens
ccacagccgucaccgaguccccguacuguccucauacccccuc

SEQ ID NO: 182547 - RNA, 54 nt, Homo sapiens
gcaggcugcacguuucaucuccugaagugggagcugcuguggcuuccaucugua

SEQ ID NO: 182548 - RNA, 23 nt, Homo sapiens
aggccacggcaccugaagccccg

SEQ ID NO: 182549 - RNA, 55 nt, Homo sapiens
cacauccccaggaggccccaaggagcuggaaggacaggaaccagaacccaggccc

SEQ ID NO: 182550 - RNA, 47 nt, Homo sapiens
gacucccuccuccucccuggagccaccagcccggaugcgaagggaag

SEQ ID NO: 182551 - RNA, 69 nt, Homo sapiens
gggguuggcucagccagcagcgccaagcucugccugguccucggucccccacugcuuccauccccaugg

SEQ ID NO: 182552 - RNA, 41 nt, Homo sapiens
agcccugggcugggacccaggcauucugggugggcuggcag

SEQ ID NO: 182553 - RNA, 24 nt, Homo sapiens
gagccgguggugcaggaugggcag

SEQ ID NO: 182554 - RNA, 41 nt, Homo sapiens
ggguagguggguggauggauggguggguggauaaugggugg

SEQ ID NO: 182555 - RNA, 53 nt, Homo sapiens
ucacagcggaugcugcacagauaggguuuccgauggcuaucggugccaccgca

SEQ ID NO: 182556 - RNA, 46 nt, Homo sapiens
aguggccacugcugguggggccggccagggcccagaggagggacag

SEQ ID NO: 182557 - RNA, 41 nt, Homo sapiens
cccagacccacaggggacaucccugcacugucaccagcccg

SEQ ID NO: 182558 - RNA, 41 nt, Homo sapiens
cgcugccccaggcccugacugaggccgaggccaacacagag

SEQ ID NO: 182559 - RNA, 46 nt, Homo sapiens
ccugggccccaggccccgucgcggacgccgucgccgcgcagccccg

SEQ ID NO: 182560 - RNA, 45 nt, Homo sapiens
cucuuccccggggcccccaagggcgcuacgugcuucgagugcgag

SEQ ID NO: 182561 - RNA, 27 nt, Homo sapiens
ucuucacagguucuggcuccaggcucg

SEQ ID NO: 182562 - RNA, 60 nt, Homo sapiens
uuuucccaaaugggucugaagaaugaccuacucuugcaaaugaguuagcguuguucgaac

SEQ ID NO: 182563 - RNA, 46 nt, Homo sapiens
ggaucccguucagggcucucggccacauccaucgguacccacgguu

SEQ ID NO: 182564 - RNA, 46 nt, Homo sapiens
ggcugcacuuuccucauccuccagaucagaagcccucacccccgcc

SEQ ID NO: 182565 - RNA, 48 nt, Homo sapiens
uccuccccuucgucccccuccuccucgcagggggagcuggucgggccc

SEQ ID NO: 182566 - RNA, 46 nt, Homo sapiens
cucaugcucauccagcucccuggugacugaggaggccucaucccua

SEQ ID NO: 182567 - RNA, 45 nt, Homo sapiens
ucucccacacucugaacaccagccuuccccuccucccugggagug

SEQ ID NO: 182568 - RNA, 48 nt, Homo sapiens
gucagucccacacagagucccuccuuuccagcaccagucuaugucagg

SEQ ID NO: 182569 - RNA, 46 nt, Homo sapiens
uguaccuuuaaccuggccucugaaugguauggaauuggauauuggu

SEQ ID NO: 182570 - RNA, 45 nt, Homo sapiens
ggcucuggaggggguggaggcaaaauuucaucaacuaccggccca

SEQ ID NO: 182571 - RNA, 55 nt, Homo sapiens
gcuguuaggaaacacaaagggagccgucccacccgaccgcagcagcccugcagga

SEQ ID NO: 182572 - RNA, 84 nt, Homo sapiens
uccagggcggaaaucucaguauagaccagucuuccaugagagcagugaggugcagcaggcccggaacagacuuaacaagcuggc

SEQ ID NO: 182573 - RNA, 83 nt, Homo sapiens
gacacagcagagaggaacgcaguggaaagggaucccuggggcuuucucccaccuuccaggguacccugcccagggguaagcag

SEQ ID NO: 182574 - RNA, 42 nt, Homo sapiens
ggggagaccgacaccccgaguuucuucuugggagacuuggau

SEQ ID NO: 182575 - RNA, 30 nt, Homo sapiens
cccacccacaccuccuguuccugccgagca

SEQ ID NO: 182576 - RNA, 48 nt, Homo sapiens
cagccgccugggacaagagagaggccagugaggacagcagggccagga

SEQ ID NO: 182577 - RNA, 57 nt, Homo sapiens
gaggaggaggcugcgguggcggcggggggacccccgggagguccccaggucaacccc

SEQ ID NO: 182578 - RNA, 36 nt, Homo sapiens
uacuccauguauccuuccaccugaggcugggguggg

SEQ ID NO: 182579 - RNA, 69 nt, Homo sapiens
ccgggagcgcaggggcggcagugcgcgccuagcagugucccagccggguucgugucgccauggggcaga

SEQ ID NO: 182580 - RNA, 55 nt, Homo sapiens
auauuuuuuaagaaaacaaucaaaacaagcauugggggauuggggcaaggaugga

SEQ ID NO: 182581 - RNA, 48 nt, Homo sapiens
caaagacagagcaguuacucuucauauugcaauaucuguguuugacua

SEQ ID NO: 182582 - RNA, 48 nt, Homo sapiens
ggauaauauagaaaagaugccaggguuccuaaguaucacaaaagccag

SEQ ID NO: 182583 - RNA, 36 nt, Homo sapiens
ggcugggcagggcagcagccuggguuccucccggcu

SEQ ID NO: 182584 - RNA, 28 nt, Homo sapiens
gagaaucuggaagggccguccuggggag

SEQ ID NO: 182585 - RNA, 46 nt, Homo sapiens
agcuccuacuccuucucacgaguccacuugaucauggucuccggug

SEQ ID NO: 182586 - RNA, 25 nt, Homo sapiens
cgccaagcucaucuuccucuaccgc

SEQ ID NO: 182587 - RNA, 46 nt, Homo sapiens
gaugaggaggccgacuaccucggcgugcguauccagcugcggaggg

SEQ ID NO: 182588 - RNA, 42 nt, Homo sapiens
ccccaacgggcccgaagccaacccugugaagcagcugcagcc

SEQ ID NO: 182589 - RNA, 46 nt, Homo sapiens
gguuggcuucgggcccguugggggcacggauguacuuggggaagag

SEQ ID NO: 182590 - RNA, 50 nt, Homo sapiens
cggggcgcuguggcgcaucaguccccccagccgugcccagaugaagcggg

SEQ ID NO: 182591 - RNA, 42 nt, Homo sapiens
cuguucaccaugagcgcccagcagccguccaucauccccuuc

SEQ ID NO: 182592 - RNA, 46 nt, Homo sapiens
agggugacggugacaucgaugggcugguugacaaccccaaccacgg

SEQ ID NO: 182593 - RNA, 47 nt, Homo sapiens
gcuggugcgcuccgugguugggguugucaaccagcccaucgauguca

SEQ ID NO: 182594 - RNA, 35 nt, Homo sapiens
gaagaagaagaucgucaaguacggcauggguggcc

SEQ ID NO: 182595 - RNA, 98 nt, Homo sapiens
cugucccuguccagcuggauguguguggaggacaucuaugccaacaucuucaucaucaaaugcagccgagagacagagaaggugccugggcccagggc

SEQ ID NO: 182596 - RNA, 54 nt, Homo sapiens
ugaugaugaagauguuggcauagauguccuccacacacauccagcuggacaggg

SEQ ID NO: 182597 - RNA, 44 nt, Homo sapiens
acccaguccaucacugcccgcagcuccaccaggaacggcaccag

SEQ ID NO: 182598 - RNA, 41 nt, Homo sapiens
auccucggcaacuuccucaccaagaaguacaaucaucucaa

SEQ ID NO: 182599 - RNA, 42 nt, Homo sapiens
cuggccauccaccuauggauguucuucauccugcccgccguc

SEQ ID NO: 182600 - RNA, 44 nt, Homo sapiens
ggccgccgagugcuucuguggccaggagagcacaggucaggggg

SEQ ID NO: 182601 - RNA, 43 nt, Homo sapiens
cggcugcagggcuucugccugucccugugagugauggcggccg

SEQ ID NO: 182602 - RNA, 49 nt, Homo sapiens
aggaagagaaagaggcccccacggggagagagaagaggccaagccgcuc

SEQ ID NO: 182603 - RNA, 51 nt, Homo sapiens
uuuagaagaaggaagaaggagggcccagcacggaaaggagcggcagccauc

SEQ ID NO: 182604 - RNA, 42 nt, Homo sapiens
gcagcccccugagcaccggcuaccacacgcgcaguggcagug

SEQ ID NO: 182605 - RNA, 46 nt, Homo sapiens
cgcaguuccuguggaugcuggggcaggcgcuaguggaugagcugac

SEQ ID NO: 182606 - RNA, 41 nt, Homo sapiens
cucagcacccucugcaccacauggcuccggccugcgggagg

SEQ ID NO: 182607 - RNA, 45 nt, Homo sapiens
gguggucccagccaggagguggagccagcagagggccccgaggag

SEQ ID NO: 182608 - RNA, 43 nt, Homo sapiens
ucaccuggaaggcacucugugccgacggccucgggucuucagg

SEQ ID NO: 182609 - RNA, 41 nt, Homo sapiens
acuccggggacuacuuccuguuugaguccgacagugaggaa

SEQ ID NO: 182610 - RNA, 44 nt, Homo sapiens
guccagccagggccgccaccacugccuccguggcggggaggagc

SEQ ID NO: 182611 - RNA, 41 nt, Homo sapiens
uacaggggcuucgcccucuacaacgcugccaaccucaagag

SEQ ID NO: 182612 - RNA, 45 nt, Homo sapiens
gcccugacgugcagguaguaauggcuaaggaagacgcggcgcugc

SEQ ID NO: 182613 - RNA, 49 nt, Homo sapiens
cuuccugcugcugcagcgccgcgucuuccuuagccauuacuaccugcac

SEQ ID NO: 182614 - RNA, 45 nt, Homo sapiens
augcggguggcccccgugacaaacaccaccaccagcaccagccag

SEQ ID NO: 182615 - RNA, 46 nt, Homo sapiens
cucaucaaguggcuguaccugccugauuucuuccgggcccccaacu

SEQ ID NO: 182616 - RNA, 42 nt, Homo sapiens
uaguugggccagaggcgggcaauggccuggcggugccugcgg

SEQ ID NO: 182617 - RNA, 46 nt, Homo sapiens
ggcacccgccagcagcuggaccaggaucugcucggcugccucaagu

SEQ ID NO: 182618 - RNA, 49 nt, Homo sapiens
ugccagcccuuccccaacagcaccaacuugcugcccacggagaucagcc

SEQ ID NO: 182619 - RNA, 46 nt, Homo sapiens
ugaaccugcugcugguggugcugugggccuucgcccugcccuaccc

SEQ ID NO: 182620 - RNA, 42 nt, Homo sapiens
gcagccggcuucucggacguccucucacgcgugcagguguuc

SEQ ID NO: 182621 - RNA, 60 nt, Homo sapiens
gugaaggagagacaacuccaggugaagggggggcaacuccaggugaaggggggacaacuc

SEQ ID NO: 182622 - RNA, 79 nt, Homo sapiens
cugcgggaggagcagcaggagcaucagcagcagcagcaggaggaggaggaggaggaggaggacuccagggacgaggggc

SEQ ID NO: 182623 - RNA, 48 nt, Homo sapiens
ccuccuggccugcauccugcagcugcacuacuuccacaggcccuucau

SEQ ID NO: 182624 - RNA, 44 nt, Homo sapiens
aggcugggggaccugggccuggagcaguucagcguguccgagcu

SEQ ID NO: 182625 - RNA, 42 nt, Homo sapiens
cacgcggacgcagacgcuguugcagagccugggggagcuggu

SEQ ID NO: 182626 - RNA, 45 nt, Homo sapiens
guggugggcagcucagggcgcagguccauggcccacacguagcgu

SEQ ID NO: 182627 - RNA, 46 nt, Homo sapiens
gucucaaggacuucgugggucccaccaacugcuccagcccccacgc

SEQ ID NO: 182628 - RNA, 42 nt, Homo sapiens
agcccgacggcagggcugcaggaagcagcaacgcuggccccu

SEQ ID NO: 182629 - RNA, 25 nt, Homo sapiens
ggccaccaggaagagcaggcugagg

SEQ ID NO: 182630 - RNA, 29 nt, Homo sapiens
gaccgggguccugaggcuggagggugggu

SEQ ID NO: 182631 - RNA, 19 nt, Homo sapiens
ccuauucgucuagcccuau

SEQ ID NO: 182632 - RNA, 57 nt, Homo sapiens
ugcccugcaagucacucuuagccuggugcccuccugggcagggcagugccacaagag

SEQ ID NO: 182633 - RNA, 67 nt, Homo sapiens
ccagcucccuucccagggcacagugggggcauagggucggcuccgucagacauuccgggaccugcgu

SEQ ID NO: 182634 - RNA, 25 nt, Homo sapiens
gcugugugccaggaaguggcuucug

SEQ ID NO: 182635 - RNA, 67 nt, Homo sapiens
gggaggccacacuguccacacagugcccuguaagcccaccgugccucaguuuccccgucugacaagu

SEQ ID NO: 182636 - RNA, 48 nt, Homo sapiens
uuauuacagccuggucagggagucacugggcgucgccauccugugggu

SEQ ID NO: 182637 - RNA, 215 nt, Homo sapiens
aacuagagguccagccuggugauacaugccuguaaucccagcuacucaggaggcugaggcaugagaaucgcuugaacccgggaggcggaguuugcgaugagucgagauugugccacugcacaccagcuugggcgacagagcgagacucugucucgauaaguaaauaaauaaaaauaacaauauaaacuggagaaagacacccgugggugcugaag

SEQ ID NO: 182638 - RNA, 50 nt, Homo sapiens
aacgacacaucauuaaagcaacaugaaagggaguuuugaaaagggaagcc

SEQ ID NO: 182639 - RNA, 18 nt, Homo sapiens
cgggccggcaggguuugg

SEQ ID NO: 182640 - RNA, 26 nt, Homo sapiens
auuccucgcacaaucguggggccagg

SEQ ID NO: 182641 - RNA, 69 nt, Homo sapiens
aaaggggauuucugaggccagagaggccaggaauggcuuccugcaagaugcggcucucacuggacccug

SEQ ID NO: 182642 - RNA, 58 nt, Homo sapiens
cccugcucccuguggguggggcagcucccugccagauuuuuggguaaugauccugcac

SEQ ID NO: 182643 - RNA, 30 nt, Homo sapiens
aaacgucccguucacacugaucguuccauu

SEQ ID NO: 182644 - RNA, 67 nt, Homo sapiens
ugccccuuucgcgaagcacacccggguggcuuggugcugcacggccuggcaccccuacccuuccccg

SEQ ID NO: 182645 - RNA, 73 nt, Homo sapiens
ccggccucugcccuggucugggggaggggacacccccggaggcuguggccuggugucagggcggggcaggggu

SEQ ID NO: 182646 - RNA, 47 nt, Homo sapiens
aagcuccaaauuaaacagcuccaggcaggaagcccgccuucucccag

SEQ ID NO: 182647 - RNA, 30 nt, Homo sapiens
gaacucugggacaggccgggggauccuggg

SEQ ID NO: 182648 - RNA, 42 nt, Homo sapiens
caccaucuacgggaaguccuaagccccccagccaugcccguc

SEQ ID NO: 182649 - RNA, 40 nt, Homo sapiens
gguccucugcagagccaggagcaccaggucuugucaugag

SEQ ID NO: 182650 - RNA, 96 nt, Homo sapiens
ggagcugggggcaagaguccgggcgcugaaggccagugcccaggaugcuggggaguccugcaccccagaggccgagggccgcccugaggagccaug

SEQ ID NO: 182651 - RNA, 48 nt, Homo sapiens
uguggcauggcaggccccaucggagggucucccuggccgaggggccug

SEQ ID NO: 182652 - RNA, 53 nt, Homo sapiens
acaugaugcguaggugaguggccgggggugggcuguggcuguccuggaguugg

SEQ ID NO: 182653 - RNA, 42 nt, Homo sapiens
aucaaaaccguguacccggccuccuaccgcuuccgccaggag

SEQ ID NO: 182654 - RNA, 45 nt, Homo sapiens
gcucaggaggugcuggcccgggcccgcaaccugauuucacccagg

SEQ ID NO: 182655 - RNA, 42 nt, Homo sapiens
acggaucuguggucagccuccaccuucuccucggggguccca

SEQ ID NO: 182656 - RNA, 43 nt, Homo sapiens
agccgggcaggcagccugcaggcucugcucaaggaaggugggu

SEQ ID NO: 182657 - RNA, 52 nt, Homo sapiens
gaagcaggucacuaauguccaugggucuugccuggcuugggugggggacaga

SEQ ID NO: 182658 - RNA, 45 nt, Homo sapiens
ccuggaccugggaggauccacccuggaggaccccacggaccugga

SEQ ID NO: 182659 - RNA, 24 nt, Homo sapiens
aucuaugacuacgagggugacggc

SEQ ID NO: 182660 - RNA, 122 nt, Homo sapiens
ccugaggucaccgggcccgaccccccugggccuggggcagccuccuuccuguaggcgagggcccaagucugggggcagaaccugaguguggauggggcggccaggaagaggccccuuccugc

SEQ ID NO: 182661 - RNA, 47 nt, Homo sapiens
uccuggguaaaucugaaugaaaaacgugcuagucucuuucaugcagg

SEQ ID NO: 182662 - RNA, 39 nt, Homo sapiens
ccuuacuuuaggccagucacaaaagauccuuuugggccu

SEQ ID NO: 182663 - RNA, 32 nt, Homo sapiens
ccgcuucaccaucugcggcaucuuuagucugc

SEQ ID NO: 182664 - RNA, 45 nt, Homo sapiens
ccuugacguccuccagccccggcucagcgacgggcagagcguacg

SEQ ID NO: 182665 - RNA, 45 nt, Homo sapiens
aaccagcagcucggcucugggggaaggggaagguuuugcuuguaa

SEQ ID NO: 182666 - RNA, 45 nt, Homo sapiens
gcgucgacuuugggcgacgggaggccauagucuggggaguaguac

SEQ ID NO: 182667 - RNA, 32 nt, Homo sapiens
augggagagucguagcuggaggcagcaggaac

SEQ ID NO: 182668 - RNA, 46 nt, Homo sapiens
gguccuccuaaugucgacagagaccgagcgguaaagguuuguggag

SEQ ID NO: 182669 - RNA, 59 nt, Homo sapiens
uucucuuucuuggcucgcucucggucguggcucuucuuggaugaagaugaggagugucu

SEQ ID NO: 182670 - RNA, 45 nt, Homo sapiens
uguccuucugccucucagggugcugcuugucagaagacuuccugu

SEQ ID NO: 182671 - RNA, 43 nt, Homo sapiens
cucggcaagucgcuggccucucccaucuugaacccgcucccca

SEQ ID NO: 182672 - RNA, 58 nt, Homo sapiens
cuuuaaaacauuuaucaaauucuuuguccuucugacauuuuuccaggauugauuucuc

SEQ ID NO: 182673 - RNA, 77 nt, Homo sapiens
ugcgccuccucgggcuuggcccugccgucccugcgcuccuugcagcucuccagggcguccuuucugucccgcccggc

SEQ ID NO: 182674 - RNA, 46 nt, Homo sapiens
gugucuuugauucucuucagugauuuuucaucuuuaaagagccauu

SEQ ID NO: 182675 - RNA, 45 nt, Homo sapiens
uuuuagcuuguuuucaguggaaagaucauucucuaacaguauagc

SEQ ID NO: 182676 - RNA, 50 nt, Homo sapiens
cuuguccaguuuggggacagcgcccuccgcgcuggacaggaaggggcucu

SEQ ID NO: 182677 - RNA, 46 nt, Homo sapiens
guccuuguggagucugauaaagaacugaccucugaccaagccgggg

SEQ ID NO: 182678 - RNA, 48 nt, Homo sapiens
ucuuucgcuucuuuuucacuuuauuuuuuuccuucugcugcuuggcau

SEQ ID NO: 182679 - RNA, 44 nt, Homo sapiens
ggaaccggcuagcuacggggaaacaaagcuacagaaccacccag

SEQ ID NO: 182680 - RNA, 49 nt, Homo sapiens
aucuuugguuuuugaggcagaguugggcguucccuucugacacacugua

SEQ ID NO: 182681 - RNA, 42 nt, Homo sapiens
ugcguccaccugacagcugacagagcagaaaggaaggucugu

SEQ ID NO: 182682 - RNA, 41 nt, Homo sapiens
cuggcucgcucccucaccuccuucccgccaucgccacgcuc

SEQ ID NO: 182683 - RNA, 38 nt, Homo sapiens
gagagucggaaaacguugaacuccccagagauguugag

SEQ ID NO: 182684 - RNA, 27 nt, Homo sapiens
cgagcaaaugagacagagcucgaggug

SEQ ID NO: 182685 - RNA, 55 nt, Homo sapiens
auccaaacauuuaugcaaauaagaaagccucugaguaaagggcaagaaucagcag

SEQ ID NO: 182686 - RNA, 48 nt, Homo sapiens
uucaucuacuaugauuacuaugauggggaaaccaccugggggucaggg

SEQ ID NO: 182687 - RNA, 50 nt, Homo sapiens
guacccauccuugacccucaggugacuacuuuuaaaggugcucuccaccg

SEQ ID NO: 182688 - RNA, 22 nt, Homo sapiens
auaaaagcagacggaguaagaa

SEQ ID NO: 182689 - RNA, 335 nt, Homo sapiens
uucuaaggcuaaaauggcuucuaugggggucaggugccauggcucacgccuguaaucccagcacuuugggaggccgaggcggguggaucacgugaggucaggaguucaagaccagccuggccaacacggugaaacaaaaauuagccaggcauuguggcacaugucuguaaucccagcuacucaggaggcugaggcaggagaaucacuugaaccagggagguggagguuggagugagcggacauugcaccauugcauuccagccuggacaaccagcgaaacuccaccucaaaaaaaaaaaaaaaugcuuucuaaggcaauuauuuaguugccugag

SEQ ID NO: 182690 - RNA, 56 nt, Homo sapiens
ggagggagugggaagagcagcagcucagcguccaggcuguucuuucuccugcugcc

SEQ ID NO: 182691 - RNA, 26 nt, Homo sapiens
gaacuuagcucagugaguacuggaau

SEQ ID NO: 182692 - RNA, 41 nt, Homo sapiens
caacuugcucaugaccgacaaggguugugugaagacaggug

SEQ ID NO: 182693 - RNA, 71 nt, Homo sapiens
uuccugagcucagccucaggggaggggcaggagugcaguggggucuuugccagccucccacucccagggag

SEQ ID NO: 182694 - RNA, 46 nt, Homo sapiens
ggccgagcugcuggcgcacaggccucuucuccccggcacuuccgag

SEQ ID NO: 182695 - RNA, 42 nt, Homo sapiens
cgugcagcugcugggcacgcccagugagaacaucuggccggu

SEQ ID NO: 182696 - RNA, 31 nt, Homo sapiens
caccacccacacuguccagaccguuucccag

SEQ ID NO: 182697 - RNA, 74 nt, Homo sapiens
gcccggggcugucccgugcauggguuggcuguggggaccccaggugggccuggcaggacuccagaugaggacaa

SEQ ID NO: 182698 - RNA, 23 nt, Homo sapiens
cugccaaggagagccugggggag

SEQ ID NO: 182699 - RNA, 42 nt, Homo sapiens
uggucacuggggccaagccuccccugagcaucugcuccuggg

SEQ ID NO: 182700 - RNA, 72 nt, Homo sapiens
uguccgaguaccagcaguaccaggacgccacggccgaggaagagggcgagauguacgaagacgacgaggagg

SEQ ID NO: 182701 - RNA, 41 nt, Homo sapiens
gcucgcagcuggagugagaggcagguggcggccggggccga

SEQ ID NO: 182702 - RNA, 36 nt, Homo sapiens
auuuucggggauacuuaauaaaucuauugcugucag

SEQ ID NO: 182703 - RNA, 60 nt, Homo sapiens
gagacccacggggucccaugggcuccaaaccugcccagcaaguuuaagggccgugggcag

SEQ ID NO: 182704 - RNA, 39 nt, Homo sapiens
ccggggcagcgggugcagaccuaggggcaugcgggaagg

SEQ ID NO: 182705 - RNA, 41 nt, Homo sapiens
ggcaucccaguaccagcaccggggcuccugcaggucacgga

SEQ ID NO: 182706 - RNA, 87 nt, Homo sapiens
acccagggacaggccugacucugacuaacaggacucacuggcugccugaggcaagugagguggccgcuaggacggcguggcccugga

SEQ ID NO: 182707 - RNA, 35 nt, Homo sapiens
gagggccaucuggaaacagguuccugcaggggcaa

SEQ ID NO: 182708 - RNA, 34 nt, Homo sapiens
gaaguccuccuuuuuucccaaaggaggagggaaa

SEQ ID NO: 182709 - RNA, 42 nt, Homo sapiens
ugcgguguaauguccguggcugcgguguaauguccgaggcug

SEQ ID NO: 182710 - RNA, 45 nt, Homo sapiens
ugcgguguaauguccguggcugcgguguaauguccgaggcugcgg

SEQ ID NO: 182711 - RNA, 65 nt, Homo sapiens
uguaauguccgaggcugcgguguaauuuacgaggcugcgguguaauguccguggcugcgguguaa

SEQ ID NO: 182712 - RNA, 79 nt, Homo sapiens
gcugcgguguaauguccgaggcugcgguguaauguccguggcugcgguguaauuuacgaggcugcgguguaauguccgu

SEQ ID NO: 182713 - RNA, 296 nt, Homo sapiens
guguaauguccgaggcugcgguguaauguccgaggcugcgguguaauguccguggcugcgguguaauguccguggcugcgguguacuucccgaggcugcgguguacuuuccgaggcugcgguguacuucccgaggcugcgguguaauuuccgaggcugcgguguaauucccgaggcugcgguguaauuuccgaggcugcgguguaauguccgaggcugcgguguaauuuacgaggcugcgguguaauuuacgaggcugcgguguaauguccguggcugcgguguaauguccgaggc

SEQ ID NO: 182714 - RNA, 46 nt, Homo sapiens
ggcugcgguguaauuuccguggcugcgguguaauuuccgaggcugc

SEQ ID NO: 182715 - RNA, 60 nt, Homo sapiens
cuuauaggugauaagcagacgauauuaaacuauaauguguguaaaauguuaggaaaggac

SEQ ID NO: 182716 - RNA, 41 nt, Homo sapiens
cuccggucccccgccccagguccuuccccaccgagacgcgc

SEQ ID NO: 182717 - RNA, 344 nt, Homo sapiens
gaggccagaggugauggcucacgccuguaaucccagcacuuuggaaggccgaguugggcggaucacuugagcucaggaguucaauaccagccuggccaacauggcgaaaccccagcccuauuaaaaauacaaaaaauuaccugggcauggugguacgcuuguagucccggcuacuugggaggcugaggcaugagaauugcuugaacccaggaggugaaguuuacagugagccaagauugugccacugcacuccauccugggcaacagagugagacucugucucaaaaaaagaaaaugaguuuuagaaggagcaagcaggacaguugaaguuugccaagcugaag

SEQ ID NO: 182718 - RNA, 40 nt, Homo sapiens
agccaaggagugccaagggguggcuggcaaccaccagaag

SEQ ID NO: 182719 - RNA, 47 nt, Homo sapiens
cagagggguucuguggcaggaauccuguuuccugacagagcagccag

SEQ ID NO: 182720 - RNA, 28 nt, Homo sapiens
auucucaggaggauguggcacuguguau

SEQ ID NO: 182721 - RNA, 46 nt, Homo sapiens
agaucgugaaguuaccuucuuagaagccuccagauuugcucaagaa

SEQ ID NO: 182722 - RNA, 51 nt, Homo sapiens
auacccuucaaguugcuagcaauugaucuucgaugaaacacaaugacaaag

SEQ ID NO: 182723 - RNA, 42 nt, Homo sapiens
ccucagagaacccguggaugacagaauacaugaggugcuauu

SEQ ID NO: 182724 - RNA, 45 nt, Homo sapiens
uauuugcuagaggaaacaggaaagcggucaaaaguccccaaagau

SEQ ID NO: 182725 - RNA, 42 nt, Homo sapiens
ggggcuuuugaaugaaggaagcggcucucaggaggagcacgg

SEQ ID NO: 182726 - RNA, 48 nt, Homo sapiens
uaucaaugaaauccuuauugccuucuaugggcaggcuucucugggaga

SEQ ID NO: 182727 - RNA, 54 nt, Homo sapiens
auccaacgugacaagcacccuuuccucauccuuuagggggccuaugucagagga

SEQ ID NO: 182728 - RNA, 45 nt, Homo sapiens
cugucacuuuggcgacgcgcagcugggacagcuccaccuucaggu

SEQ ID NO: 182729 - RNA, 30 nt, Homo sapiens
auuauuuucuuauuucuguuuuuuuuuuuu

SEQ ID NO: 182730 - RNA, 112 nt, Homo sapiens
uauagaugaaaaaacggaagcucaggaucagugacuuuauucauuuauguguuuauuuuuguuuacccgauugcaagccaaucagacucuuccuggcuucucugugagaggc

SEQ ID NO: 182731 - RNA, 42 nt, Homo sapiens
cuguauaaguguguccuuauacaaauuuuaggccauaaacaa

SEQ ID NO: 182732 - RNA, 46 nt, Homo sapiens
aguuuguuuugaaagcaaauuaugaauauuauguucagggacaaau

SEQ ID NO: 182733 - RNA, 49 nt, Homo sapiens
uuucaaauccuuaacgcuauuucuuaaacucaaaaccuuuuugguguuu

SEQ ID NO: 182734 - RNA, 47 nt, Homo sapiens
cuuuuaaaauucagauuuguuuuaugacagcaaaaaugagagcaaaa

SEQ ID NO: 182735 - RNA, 53 nt, Homo sapiens
aguaaucgggaaagauaugacaaucuggagauggaauaccuacagaaaagauc

SEQ ID NO: 182736 - RNA, 46 nt, Homo sapiens
aagugguccugguggcauccgaacgguaauaauacgccagcaugag

SEQ ID NO: 182737 - RNA, 47 nt, Homo sapiens
gcaggcugcuagucauuaucgccaaaauagaaacucuuuguauagaa

SEQ ID NO: 182738 - RNA, 50 nt, Homo sapiens
ccaucugugagugcuuacuggagcaugaggagcaagucuugagggaugca

SEQ ID NO: 182739 - RNA, 42 nt, Homo sapiens
gacuccugcagaugucuuuuucagggagguaagaugaguccu

SEQ ID NO: 182740 - RNA, 49 nt, Homo sapiens
cccggcuuucugaccuugucaacacagccauauugauugcuuugaacaa

SEQ ID NO: 182741 - RNA, 38 nt, Homo sapiens
uugcuuucugagaauauguguuugccuuuuugcaaggu

SEQ ID NO: 182742 - RNA, 43 nt, Homo sapiens
gcaguuuuacuuuucggaguaggcucacucauuuuggucugca

SEQ ID NO: 182743 - RNA, 34 nt, Homo sapiens
uuggcuuacuagacugacugcugucuggcaaggc

SEQ ID NO: 182744 - RNA, 45 nt, Homo sapiens
uguauaacgaaagugcugucuaugugugcuccacaggaacuggga

SEQ ID NO: 182745 - RNA, 43 nt, Homo sapiens
auacaaacaugugaauuuaaaaaacauguuuuccuguucaaaa

SEQ ID NO: 182746 - RNA, 51 nt, Homo sapiens
agacacaggagaugggcaauauaaauguucccuucuuuccagcugauguua

SEQ ID NO: 182747 - RNA, 42 nt, Homo sapiens
ucuuguuuaaggcugucaccaaaacauacuagcauggcagga

SEQ ID NO: 182748 - RNA, 66 nt, Homo sapiens
caggcuaccggcaggagccgaccuggcucggcagggcucgguggcucgagcagccgcagcggccag

SEQ ID NO: 182749 - RNA, 38 nt, Homo sapiens
uuuuucuuugcuucauucauucauucauagccgaagau

SEQ ID NO: 182750 - RNA, 77 nt, Homo sapiens
gugcauagaaauaaaagggcugcauuucaucucagcccuuuuauuucuucuaguguacugaugaaacugaagcacag

SEQ ID NO: 182751 - RNA, 63 nt, Homo sapiens
ugugaugucccaagcaguggugcucugaccacuugccauuuagguccuggugccagcgggaag

SEQ ID NO: 182752 - RNA, 27 nt, Homo sapiens
ccagaggcuggggguguggaagggaag

SEQ ID NO: 182753 - RNA, 66 nt, Homo sapiens
gggggcacaggucuggggagggggcacaggucugggagggggcacagguccggggagggggcacag

SEQ ID NO: 182754 - RNA, 82 nt, Homo sapiens
gccuggggagggggcacagguccagggagagggcacuggcccagcgagggggcacagauccagggagggggcacagguccgg

SEQ ID NO: 182755 - RNA, 41 nt, Homo sapiens
ccagggagggggcacaggcccgggagggggcacaggccugg

SEQ ID NO: 182756 - RNA, 44 nt, Homo sapiens
ggauaagcccacuaaggaugauuugggaugagcugugaaucugu

SEQ ID NO: 182757 - RNA, 53 nt, Homo sapiens
uggagaaauaaaagccacagucuuggaaccucccaccuucuuuuggccugagu

SEQ ID NO: 182758 - RNA, 47 nt, Homo sapiens
caggcaucacccgucugcugaaguacgcugaacgggcacaauugcag

SEQ ID NO: 182759 - RNA, 52 nt, Homo sapiens
accacuuuaaugaguuuaugggacaccagcgaagcugcaaacugggucggga

SEQ ID NO: 182760 - RNA, 49 nt, Homo sapiens
ucucccaggacagucccaugggcagagcuagguuuugugaggacuggag

SEQ ID NO: 182761 - RNA, 45 nt, Homo sapiens
ccgguuaguugaggaucagaugugucauacuuuucucagagggga

SEQ ID NO: 182762 - RNA, 44 nt, Homo sapiens
auucuuuucauggcacauuuuggaaucuagcagcugaauuucag

SEQ ID NO: 182763 - RNA, 79 nt, Homo sapiens
agucuggugggaaaauuacuagccauggcuuauuucugauuuggguuauauacagaaaccuuucuuauuuuagucacag

SEQ ID NO: 182764 - RNA, 46 nt, Homo sapiens
gaaauugaccccauuaaaaagaaagaccuucaucacagcaauggag

SEQ ID NO: 182765 - RNA, 77 nt, Homo sapiens
ggggaggauuugaaugaagaguugcaguacagcagugaauaccuguauagaauccugaagccuccugcagccugaau

SEQ ID NO: 182766 - RNA, 61 nt, Homo sapiens
uccgcuccgggcaggacccuuacgcccgcaacaaguucaaccagguggagagugauaagcu

SEQ ID NO: 182767 - RNA, 23 nt, Homo sapiens
acuuacuggucaugccggguguc

SEQ ID NO: 182768 - RNA, 45 nt, Homo sapiens
gauuuaguuuuguucucuggcaggcaguuaaaauagggcagguca

SEQ ID NO: 182769 - RNA, 38 nt, Homo sapiens
uguacucuggaguuguuaaauguuaaugguagaaccua

SEQ ID NO: 182770 - RNA, 42 nt, Homo sapiens
ggaaaauugagaaagugcgaguucuuagaaaugaucgacgag

SEQ ID NO: 182771 - RNA, 75 nt, Homo sapiens
uuaacugucagcauggggcacaguccagggucucucaccagcauccgucauuugagcuuaaagagguuagagaug

SEQ ID NO: 182772 - RNA, 108 nt, Homo sapiens
gcagugacuccauuccugaaguuuacugcagcucacaaaucacuaaugguauuugggcaaacagaaaaggacccuugggacacagcaacacaguuuuugccuuuagcu

SEQ ID NO: 182773 - RNA, 37 nt, Homo sapiens
acuacuccucucuuuguauuuuaggacaggacucggg

SEQ ID NO: 182774 - RNA, 42 nt, Homo sapiens
uacgacaugaugauggauguguggggaggagagaaccuaggu

SEQ ID NO: 182775 - RNA, 45 nt, Homo sapiens
cucagagaucucguuccgcguguggcagugugguggcagccugga

SEQ ID NO: 182776 - RNA, 47 nt, Homo sapiens
cgggcucucuuauaaagcugcagggcugccgagaaaaugacagcaga

SEQ ID NO: 182777 - RNA, 47 nt, Homo sapiens
ggagccaagagccuaagccagcuucuagucuaacccugauuucacaa

SEQ ID NO: 182778 - RNA, 47 nt, Homo sapiens
ggagcuuucgugcacacaguauaaaaaauuaauuagaaccacagacu

SEQ ID NO: 182779 - RNA, 45 nt, Homo sapiens
ccggcccuuucgcagcaguggaaguucacgcucaaccugcagcag

SEQ ID NO: 182780 - RNA, 93 nt, Homo sapiens
gcuuccgggagaaggggccagagcccgguggggccaguuucucacagagggaggagguggccuuuguccccuggagcccgaucagccaguugg

SEQ ID NO: 182781 - RNA, 46 nt, Homo sapiens
gcgucagaauccaccuugcgugcugugcguaucugugaaccuggag

SEQ ID NO: 182782 - RNA, 44 nt, Homo sapiens
ucugagcccugcacgcugggccuucagaauuaauggccagcagu

SEQ ID NO: 182783 - RNA, 60 nt, Homo sapiens
accugugcgaggcuguggagugcaggccagagcagggugugcguagcccccagcacccag

SEQ ID NO: 182784 - RNA, 76 nt, Homo sapiens
cucucuuguuuuuuuucccagacaggguaaaugacagugaguaaaaugaguuaauuaaaacuguugcuguuuccaa

SEQ ID NO: 182785 - RNA, 67 nt, Homo sapiens
auuggauuauguauguguuuauuuugugaaccaguuucacuuucagguauaagaacauucagaaagu

SEQ ID NO: 182786 - RNA, 44 nt, Homo sapiens
aacacagacucuucuccacguugucuuaagaaacucuaguucug

SEQ ID NO: 182787 - RNA, 41 nt, Homo sapiens
cguuucugauacugauggaagagucuuauaagaaggugaaa

SEQ ID NO: 182788 - RNA, 46 nt, Homo sapiens
acugauggcaaguggaaaagaaguagcaggaaaaauucccaaaggg

SEQ ID NO: 182789 - RNA, 45 nt, Homo sapiens
aaucuuauccuuaguuuauuacuuuuauaauuuaaugccacucuc

SEQ ID NO: 182790 - RNA, 46 nt, Homo sapiens
cauuaaauuauaaaaguaauaaacuaaggauaagauuaaguugcag

SEQ ID NO: 182791 - RNA, 85 nt, Homo sapiens
aaggauggguucaccgugaacacaaaaguucccagccuuaaagaccaagggaaggaauaugauggauucacaaucacgauuacag

SEQ ID NO: 182792 - RNA, 74 nt, Homo sapiens
uuuacuguugcuucucuuaacuuccaguccaucaauuaaaaaaaaaaauuggcaauauuaaguuaacuaaauuu

SEQ ID NO: 182793 - RNA, 46 nt, Homo sapiens
auccucacaacauacugauagcacuagguauggucucaaucuuaca

SEQ ID NO: 182794 - RNA, 36 nt, Homo sapiens
uuaaaaaagugcuguugguuuucuuuuccucuaaaa

SEQ ID NO: 182795 - RNA, 46 nt, Homo sapiens
gcuggaaguucgggaagcccuggaaaagguacacaaaguagaagac

SEQ ID NO: 182796 - RNA, 68 nt, Homo sapiens
ucugggagugaguuuaaaaggaaaagaucagaagggauagaaaugugaggaaaagaguauuccgagug

SEQ ID NO: 182797 - RNA, 81 nt, Homo sapiens
gccaccuucccucagguacgugguugucccauuaggccagagagcaccagaacgaaaaguagguggacauguuuagugggg

SEQ ID NO: 182798 - RNA, 56 nt, Homo sapiens
gcacaaccgaaggguagauugcagauguuuuccuagggcgucagucuuuaaggagu

SEQ ID NO: 182799 - RNA, 48 nt, Homo sapiens
cacauuaauuuaaucagguacgaaccuuuugugcaucuuucuucuuuu

SEQ ID NO: 182800 - RNA, 56 nt, Homo sapiens
cauuggaggucaugcaagccgugcagcguacauggaccaacucgaaaguucgaaug

SEQ ID NO: 182801 - RNA, 42 nt, Homo sapiens
gcugaaugauccucucccaggccagaaggcuagcccugagua

SEQ ID NO: 182802 - RNA, 41 nt, Homo sapiens
gagccauauaaugaagugugccaguauaugaaagggcucag

SEQ ID NO: 182803 - RNA, 75 nt, Homo sapiens
gaagcuauugaauccuucaaagaagcuuugaagcagaaaguugacuuuauugaugcauauaaaagucuagggcag

SEQ ID NO: 182804 - RNA, 42 nt, Homo sapiens
cuaugaauuaucuaaucagguguaaaauuaucuaaagucaug

SEQ ID NO: 182805 - RNA, 51 nt, Homo sapiens
gaauggagacagggagccaauuagggaguugcugcaguaguuggagcaaga

SEQ ID NO: 182806 - RNA, 45 nt, Homo sapiens
cagagacacuuuauuaguuugagcuuucauuaucucuugcuccaa

SEQ ID NO: 182807 - RNA, 81 nt, Homo sapiens
ccucaggagacauuuugaaaggcaaacuacaacagaguuugguggcugccuggguaugggagaugagggagaagaaagggu

SEQ ID NO: 182808 - RNA, 97 nt, Homo sapiens
cuugguuaauguucuugccacccacccaagcucuucagcuuaaaagcuuccuacccuuucuucucccucaucucccauacccaggcagccaccaaac

SEQ ID NO: 182809 - RNA, 39 nt, Homo sapiens
uuucuccuuccaugucuauaaaguggaaacaauucuacu

SEQ ID NO: 182810 - RNA, 47 nt, Homo sapiens
ugggaguuuuuuaagaaaagcgauugugagaaaaacaaagguuuaau

SEQ ID NO: 182811 - RNA, 69 nt, Homo sapiens
accauuaaaauagacaaauuaucggacacagauuagagucuuccauggucuuuagcucuguccucuaug

SEQ ID NO: 182812 - RNA, 46 nt, Homo sapiens
ggacauuaagaaugcugagcuugcucuguucgaacugagccgagua

SEQ ID NO: 182813 - RNA, 357 nt, Homo sapiens
agcaucuuguauguagggaauuauuaaaugauucugauuucuaggguaugaagugaagcugggugugguggcucacgccuguaaccccagcacuuugggagguugaagcaggaggauugcuugaacccaggagcuugagaccagccugggcaauaaagugagacccccaucucaacaaaaaaauuuuaaaauuagccuggugugaucgugcacuccuauagccucagguacuugaaaggcugaggugggaguuugagcccaggaguuugaggcuguagugagcuaggcuugcaccacuguacucuagcaugggugacagagugagacccugucuuuaugaaaagaaaaaaaaaaaag

SEQ ID NO: 182814 - RNA, 46 nt, Homo sapiens
gcuuaugucuugauuggcaguggucuguaugaugaagcaauacggc

SEQ ID NO: 182815 - RNA, 44 nt, Homo sapiens
uugguuagaugcauagcaggaagacaggaugguaaggaguagag

SEQ ID NO: 182816 - RNA, 44 nt, Homo sapiens
cugggaaaacaauaccuuuuuuuuuuaguugagaugagacguca

SEQ ID NO: 182817 - RNA, 49 nt, Homo sapiens
cagcaggaauauuuaugaaaaaaauugguuuggccgauuuauauucuaa

SEQ ID NO: 182818 - RNA, 36 nt, Homo sapiens
gagaucugauucauuaggcauuggagaacacagcag

SEQ ID NO: 182819 - RNA, 47 nt, Homo sapiens
ugcguuguagggauucuuuagaggaagauuuuucucuuuucaggaua

SEQ ID NO: 182820 - RNA, 44 nt, Homo sapiens
ggcauguuugucuucugcuucuaaacuguuagauccuugaggau

SEQ ID NO: 182821 - RNA, 47 nt, Homo sapiens
ccaaguauuguccagauccccagccuuagacuugugaugcuguccaa

SEQ ID NO: 182822 - RNA, 67 nt, Homo sapiens
aggcuuccccuguuaccggccaccucaggaucauucggaucaugccccauucuuuaccuacuugcag

SEQ ID NO: 182823 - RNA, 45 nt, Homo sapiens
uuggaauuucugacaaaucuuauuuuauucagauagcagucugau

SEQ ID NO: 182824 - RNA, 42 nt, Homo sapiens
aaaaugcggccaaucgaggcuucaaguaagucacagcagcau

SEQ ID NO: 182825 - RNA, 45 nt, Homo sapiens
gugccucaaacucauuaaaguauuuguucuuacaucaaauuuuca

SEQ ID NO: 182826 - RNA, 54 nt, Homo sapiens
ugagguuaguagaacugccauuauuugauuuuaugaaugagcuccuggggcucu

SEQ ID NO: 182827 - RNA, 74 nt, Homo sapiens
gugugcugggauaugcagcuaugaagggaaggguggaauguguuccauccgucucagcgaaccccuuuugaagu

SEQ ID NO: 182828 - RNA, 45 nt, Homo sapiens
uauuugucacuaauaacgacaaagaccgagaagggcaugguccag

SEQ ID NO: 182829 - RNA, 56 nt, Homo sapiens
gaaaaccuguggaggcacuuacauaaaaaucaaggaaccagagaauuacucaaaaa

SEQ ID NO: 182830 - RNA, 49 nt, Homo sapiens
gccagacaggucuuaaauuguauauuuuuuggaaaaguuuauauacucu

SEQ ID NO: 182831 - RNA, 58 nt, Homo sapiens
ucacuuuccuaggcuuuuuagcaaaaccuaaagggugguauccauauuuugcgugaau

SEQ ID NO: 182832 - RNA, 42 nt, Homo sapiens
aaaauaacaucaaucuauuuuuguaaaccuguucauacuauu

SEQ ID NO: 182833 - RNA, 49 nt, Homo sapiens
ucauuucaucucucccuuuuuuauaucaaguuugaauuugggauaauuu

SEQ ID NO: 182834 - RNA, 61 nt, Homo sapiens
gcagaagcucucuggugcuuagugaaugaaugaaaauuuuuuuuuuuuuuaccuugcaggu

SEQ ID NO: 182835 - RNA, 106 nt, Homo sapiens
uuauccgggcaauggaacggguuauguacgucauguugauaauccaaauggagauggaagaugugugacauguauauauuaucuuaauaaagacugggaugccaag

SEQ ID NO: 182836 - RNA, 42 nt, Homo sapiens
ccuauaaauguuaauguagaauagccuuaucuuaucuacaaa

SEQ ID NO: 182837 - RNA, 46 nt, Homo sapiens
uagcaaaaaucuauccugaauaugaaaagaaaugaagccacaagga

SEQ ID NO: 182838 - RNA, 24 nt, Homo sapiens
gcaauaaauuggauuagucuacgu

SEQ ID NO: 182839 - RNA, 539 nt, Homo sapiens
caucacuauauuguguacuuucccgcauccuagccauucugauugagggaaaugagaugacaaggguuauuuauuuagauaaauuuagaaaucugggggugaaaaguugaggaaguuuuugcuuguuugccuuaauuaucucagguaaguacauagaaaauaucuccaucuagugaauaagaaaauugggacuggccaggcgugguggcuuaugcauguaaucccagcacuuggggaggcugaggcagguggauuaugaggucaggaaaucgagaccauccuggcuaacacggugaaaccccgucucuacuaaaaauacaaaaaaaaaaaaaaaaauuagucgggcgugguggcgggcgccuguagucccagcuacucgggaggcugaggcaggagaauggcgugaaccugggagguggagcuugcagugagccgagauugcgccacugcacuccaaccugggcaacagagcgagacuccgucucaaaaaaaaaaaaaaggaaaauugggacuaaaauaauggcugagagaggugagca

SEQ ID NO: 182840 - RNA, 43 nt, Homo sapiens
uuuauauaguuucugauuauaaaaauaauacagugcuccaaag

SEQ ID NO: 182841 - RNA, 46 nt, Homo sapiens
ugcuaacacucagugaacugcccucagcugauccucugcccuguac

SEQ ID NO: 182842 - RNA, 44 nt, Homo sapiens
uauuuauccaccugaauuaugcgccugucaguauacuguuaaca

SEQ ID NO: 182843 - RNA, 56 nt, Homo sapiens
gacgaccugauacgccacuguaacgggaagcugggcagcuacaaaaucaauggccg

SEQ ID NO: 182844 - RNA, 49 nt, Homo sapiens
acuucccugugugcugugagccagcggaaccacuuguacaaugccagau

SEQ ID NO: 182845 - RNA, 25 nt, Homo sapiens
aggaaaaacaagacaaggccguucu

SEQ ID NO: 182846 - RNA, 49 nt, Homo sapiens
ggauaagguacuuagauuauuucuugcaagaaaacguugcagggagcau

SEQ ID NO: 182847 - RNA, 61 nt, Homo sapiens
gauccaaaauauaaaaaaguacaaaugaaccauguuagaaaggagguuaaguuaacaugag

SEQ ID NO: 182848 - RNA, 34 nt, Homo sapiens
uccauuuuuccagcuagaucccuuuugggcaacu

SEQ ID NO: 182849 - RNA, 23 nt, Homo sapiens
accaugugaaaggucagccagac

SEQ ID NO: 182850 - RNA, 42 nt, Homo sapiens
auuugccagaaaaccagcuccuggauagggcuuucccucgca

SEQ ID NO: 182851 - RNA, 43 nt, Homo sapiens
agagaggugaauuuuacuuucaggaagggaaacagaguuaaaa

SEQ ID NO: 182852 - RNA, 61 nt, Homo sapiens
aacuuuauguucucaucuccuguuuugcugucuguugccuggucauucaacucccugaagu

SEQ ID NO: 182853 - RNA, 64 nt, Homo sapiens
uuaaauguguccuuguccugucacuuggacaguuugaggaaaaggcagagagagacaggcuggg

SEQ ID NO: 182854 - RNA, 41 nt, Homo sapiens
ugugcugaagacaucagggaaauuguucagcgauuaguagu

SEQ ID NO: 182855 - RNA, 35 nt, Homo sapiens
gugaaguucagcuucauuacgcugggugcgaagaa

SEQ ID NO: 182856 - RNA, 46 nt, Homo sapiens
uugggugacuucaaaaggccacaugcgugccuuggaaucccaagac

SEQ ID NO: 182857 - RNA, 45 nt, Homo sapiens
uuaauggucuuuacuuggaauaugcgcuguaggugccaaauaaau

SEQ ID NO: 182858 - RNA, 46 nt, Homo sapiens
ucgggauccuuuauugcaaagcaggccagagcacagaggaagagau

SEQ ID NO: 182859 - RNA, 43 nt, Homo sapiens
ggcucagauugcugguaguaagauuaagagcucugauugcaug

SEQ ID NO: 182860 - RNA, 48 nt, Homo sapiens
gaaaaccuugguccaguagcagucagcauccggagagagaagguggaa

SEQ ID NO: 182861 - RNA, 48 nt, Homo sapiens
cugcuacaggcuuuagagggcaauacuuucuuuuagugguucaaagau

SEQ ID NO: 182862 - RNA, 46 nt, Homo sapiens
ggaggaccucaacuccaaagagaaccuggaugccgaugagggugau

SEQ ID NO: 182863 - RNA, 56 nt, Homo sapiens
ugcacauuaugauguccagagcauuuuguuuaauaucaacgaagccauggcuacga

SEQ ID NO: 182864 - RNA, 45 nt, Homo sapiens
cagagccucuucaaaguucaaggaucccccuagaaucaugcaguc

SEQ ID NO: 182865 - RNA, 31 nt, Homo sapiens
uggaaauggguguuugggaaguagaggacac

SEQ ID NO: 182866 - RNA, 49 nt, Homo sapiens
uauaguuuuaguaauuaugcuuaggccuuugauccauuuuuaguuaauu

SEQ ID NO: 182867 - RNA, 46 nt, Homo sapiens
aagagccugucuguaaaaaguggauuauguaauuauuucuccagaa

SEQ ID NO: 182868 - RNA, 57 nt, Homo sapiens
uggguuucacacuaauuaugaauugagacaaguauguacagagguuggaagcaaaug

SEQ ID NO: 182869 - RNA, 49 nt, Homo sapiens
uacuccugcagugcugggcuuguuaucugccuucagguaggggcguuag

SEQ ID NO: 182870 - RNA, 74 nt, Homo sapiens
cuucucagcacaugccggcaauguuucauuuagcugacaaucuuuugugucuucacugugccaggcaucuuguu

SEQ ID NO: 182871 - RNA, 53 nt, Homo sapiens
uuuaucaguugacguggagauugcaguauaccuccccaggaacugguagacgg

SEQ ID NO: 182872 - RNA, 62 nt, Homo sapiens
aaaagguuuaguaaucgcuaagccuccauaucaagagucaccugaggccuuugccgaaguac

SEQ ID NO: 182873 - RNA, 56 nt, Homo sapiens
gugcuaucguauguuccucaaccucuggaaaacuccaucgaacacuggggagagaa

SEQ ID NO: 182874 - RNA, 94 nt, Homo sapiens
aaugucugagaaaguuuuguggggaauauggggcuuuuaggcgcaaaggaugcuguuuauuuuggguaaggggacgucuugauagaagggacag

SEQ ID NO: 182875 - RNA, 42 nt, Homo sapiens
uggaaaaauaaauaggagauauugcuaguggccugguugccu

SEQ ID NO: 182876 - RNA, 46 nt, Homo sapiens
cucugaaauauaaacagcuaaauuauuuuccaauuuggucaaggaa

SEQ ID NO: 182877 - RNA, 46 nt, Homo sapiens
aucuuaauguaaaaauuguauuucacaagccaguauaauuuuagug

SEQ ID NO: 182878 - RNA, 56 nt, Homo sapiens
uaauuuaaaucaauuaaauaucuuguuuuauaaggcuauuuaaugacaugggaaaa

SEQ ID NO: 182879 - RNA, 59 nt, Homo sapiens
aaauaaucacaaguggucuaaaagauuuauguauaaggauacccaauguaauauuuguu

SEQ ID NO: 182880 - RNA, 32 nt, Homo sapiens
gcuugcuucguucuugcuugauaauuuaucua

SEQ ID NO: 182881 - RNA, 59 nt, Homo sapiens
ggucauauucugugcucccuaaauugagaugaacuaauuugaccuacauuacaacauuu

SEQ ID NO: 182882 - RNA, 51 nt, Homo sapiens
uuuuugccaauaacuuaaucauggaaggauuccgggaaccucccgagcaau

SEQ ID NO: 182883 - RNA, 45 nt, Homo sapiens
cagauuuucaaucacuuaugcugaagagaacuggcuggcaaaaug

SEQ ID NO: 182884 - RNA, 40 nt, Homo sapiens
uguucuugcaugugauguaaauggaaucaugcaguaugca

SEQ ID NO: 182885 - RNA, 30 nt, Homo sapiens
uagcaaaggcuuagcacaucuguacuuccc

SEQ ID NO: 182886 - RNA, 41 nt, Homo sapiens
accguaacuuaguucuuucugagauaagcuguggagcagag

SEQ ID NO: 182887 - RNA, 87 nt, Homo sapiens
uaugguagguuucaauaaaucaugaugaaaggaaagaaugaaaagacagaaaggaagaagggagagagggagggaacuaaagaaggu

SEQ ID NO: 182888 - RNA, 77 nt, Homo sapiens
uggcuucuaugaugcuuacuguaguuaaagcuguguaauauggauuuggaagguguuuuuuuuuuucucccccucac

SEQ ID NO: 182889 - RNA, 86 nt, Homo sapiens
ugucuuaauuuuucagauaaucuuaauucuccacagcccaaaacauguuucucuuucuccaucuguuucuuuaaaauuuuuauugg

SEQ ID NO: 182890 - RNA, 53 nt, Homo sapiens
uaaugcuuguaaagugccuuggccccuggcuccuaggaggugcucagcagagc

SEQ ID NO: 182891 - RNA, 41 nt, Homo sapiens
cacaauuugguuuguguuugccagggagcugggguccggag

SEQ ID NO: 182892 - RNA, 45 nt, Homo sapiens
ccggggugaggaucucuggcauguccgggggagcagcuucugccc

SEQ ID NO: 182893 - RNA, 49 nt, Homo sapiens
acugagguguggcacuaggaagcaaugcugccuggguuguucucugagg

SEQ ID NO: 182894 - RNA, 27 nt, Homo sapiens
cgacugcagcaguggcccagggcaaag

SEQ ID NO: 182895 - RNA, 41 nt, Homo sapiens
auuucuuacuaaauaccauuuuauuucauuucuucacagau

SEQ ID NO: 182896 - RNA, 35 nt, Homo sapiens
aaaacaaaacaaaagugcauguguuuauaacaggu

SEQ ID NO: 182897 - RNA, 52 nt, Homo sapiens
gccaugugccuuaaacauauuacuauauauuuuccccuuuaauaaacacuuu

SEQ ID NO: 182898 - RNA, 86 nt, Homo sapiens
aagaguguaaaaaaaaagacugaugggucaauuccauguucagcuggccaugccagagagaugaaauaaaaggaaagcccagggag

SEQ ID NO: 182899 - RNA, 45 nt, Homo sapiens
guuaaauauucccuuccauuguuuacaagccagacacugccugag

SEQ ID NO: 182900 - RNA, 63 nt, Homo sapiens
gaacuuuaaaauguuaaggugauguuuguaagcaagaaaaaaacuuuacccuaaucacaaccc

SEQ ID NO: 182901 - RNA, 45 nt, Homo sapiens
guuuaacuuuuugcuggcuuccccauucacucaacaucaacccaa

SEQ ID NO: 182902 - RNA, 46 nt, Homo sapiens
cagggcaucaaauucuucaacacuuaacacuuuacacacaguccag

SEQ ID NO: 182903 - RNA, 45 nt, Homo sapiens
ggugugauauuuuuucaacaggaaagagaggcacacccauugauc

SEQ ID NO: 182904 - RNA, 46 nt, Homo sapiens
uggaaaugugcucauaguuuugcaacauagcucacaggcucagaaa

SEQ ID NO: 182905 - RNA, 50 nt, Homo sapiens
uuguuuuucucuacucaucaaaggcagcaacagcugcccccauggguuag

SEQ ID NO: 182906 - RNA, 44 nt, Homo sapiens
guuaaaugaagaaaugccacgagacuucagaaacaccacuaugg

SEQ ID NO: 182907 - RNA, 133 nt, Homo sapiens
gauacuguagaagaacgaggaauauugagucuuccauacugagccuguuuuaaaugggcuuggcuuguuaauaggcgcagcagguuugaagacugggggguguuuccagagaucccaagaugauuucagaaug

SEQ ID NO: 182908 - RNA, 48 nt, Homo sapiens
ucagaguuccuccugcaaucaagcagaggcagcagggggcaggcccag

SEQ ID NO: 182909 - RNA, 23 nt, Homo sapiens
agcugugggccagauuucgccca

SEQ ID NO: 182910 - RNA, 46 nt, Homo sapiens
ggcuuggagaaaacuuuggcuuggcguauguuuggagaagugaacu

SEQ ID NO: 182911 - RNA, 56 nt, Homo sapiens
ccagaaauguaauugccaaacacuauucauccccaucuuaaguuuuacaaggugau

SEQ ID NO: 182912 - RNA, 64 nt, Homo sapiens
uccuugggaacuggagugcaguaugagcugggugucacuuggcucugaacauacuggcuuugcu

SEQ ID NO: 182913 - RNA, 51 nt, Homo sapiens
auuggucagugacuaaccaggcagcuaagaagucuuaggcagcagcccaga

SEQ ID NO: 182914 - RNA, 73 nt, Homo sapiens
ugauuaucuugugaaacgaugagaguaaguugcaaccuugugacugaaaacuugaaaagaguggagcaggugg

SEQ ID NO: 182915 - RNA, 43 nt, Homo sapiens
uuuagagggcacauuuugcuguaaaucuggaaauuugauagac

SEQ ID NO: 182916 - RNA, 95 nt, Homo sapiens
uccugaaacauaguuacauaguuaaacuguacauaugacauggcuuauguuaaaaauacccagugcucaguuuugaaagauaggcaaaaaaaaaa

SEQ ID NO: 182917 - RNA, 78 nt, Homo sapiens
gaaaaguguauuuugauagagaacuuuucauucuauaaauacacuaugaguuacuaaaauaucauggauuuuguuuau

SEQ ID NO: 182918 - RNA, 44 nt, Homo sapiens
cucagagcuuggcugaagaugauguggaaugagaaacaaauguc

SEQ ID NO: 182919 - RNA, 52 nt, Homo sapiens
ugcaauugcuguguguggacagccacagcaguuacugcaggucuuacagcaa

SEQ ID NO: 182920 - RNA, 29 nt, Homo sapiens
auucugauugcuguaucaauagauuuaga

SEQ ID NO: 182921 - RNA, 180 nt, Homo sapiens
uuaucugauccagaauuuagccuuuucauuacauuguacuucauuuauuucaucaacagugcuaagaaguuucuaaaaaauauucuaucuuuaaaguucagcuaugaaauugaaauuaucaaauugacaaacgugagaaccguaauuuacucaauaaucucaaaaguagauuugaaguag

SEQ ID NO: 182922 - RNA, 61 nt, Homo sapiens
aguaacugaaggaaugugagcuaggaauauacuccucaacuccuucaucuaaucuucagau

SEQ ID NO: 182923 - RNA, 47 nt, Homo sapiens
agaugcugaagcuguucagaaguucuuccuugaagaaauacagcuug

SEQ ID NO: 182924 - RNA, 46 nt, Homo sapiens
aaaucuacaauaauggcauccgaaaauauuguaacgugcguagacg

SEQ ID NO: 182925 - RNA, 75 nt, Homo sapiens
auguuuauuaugcuuuugguaacuuauauuucuaagggcauaggaaaacagauugagacaugcaccaguauguau

SEQ ID NO: 182926 - RNA, 56 nt, Homo sapiens
cagcuuacuguaugaacaauaauuaaggagcaagaugagggccucaagacauuugc

SEQ ID NO: 182927 - RNA, 165 nt, Homo sapiens
ggcuuuccaagguaauagucugguuucuguuuaaauuauauauuuuguagaaauauuauuuuaaaaucuguaauuggaaauguaauuaaaauguaauuggaaaaagcuaguugauacuggacauugcuuuuuuauuuuaaaauacagcuuauuuuuaggaguagg

SEQ ID NO: 182928 - RNA, 85 nt, Homo sapiens
gugucacauuuccuacagcucauugaccagaacaugucauaugcucuugacagaucacagggagggauagauuccuagaguuaga

SEQ ID NO: 182929 - RNA, 44 nt, Homo sapiens
agaauacuguuuuacauucagaccuugaauuucuagggccaggu

SEQ ID NO: 182930 - RNA, 44 nt, Homo sapiens
ugcuuccaagauaugagugaaugcuauagaaauugcaggggagu

SEQ ID NO: 182931 - RNA, 50 nt, Homo sapiens
uacuucgaccgcaaaagacgaagugaccccaacuucaagaacaggcuucg

SEQ ID NO: 182932 - RNA, 53 nt, Homo sapiens
cuacaacugcaccuauccaaaagaugucccaguucuuucuucauacuaauuaa

SEQ ID NO: 182933 - RNA, 41 nt, Homo sapiens
cauggccgugaggauugugagagacaaaaugacaggcaucg

SEQ ID NO: 182934 - RNA, 45 nt, Homo sapiens
uucauccugaucagaaaaauauuaaugccuauguuguguuuaagg

SEQ ID NO: 182935 - RNA, 35 nt, Homo sapiens
caggccaaauagugagagauaaagagauacagaga

SEQ ID NO: 182936 - RNA, 25 nt, Homo sapiens
uuuuuauaugguuguaaggaguuau

SEQ ID NO: 182937 - RNA, 61 nt, Homo sapiens
uaucauugcuggaauccuaggcauucucuuccuaugucccaucauacacauuaguauggga

SEQ ID NO: 182938 - RNA, 53 nt, Homo sapiens
gauguucugaaggucagcuaauguguauuuuuuuuuuuaauuuuagaagcuga

SEQ ID NO: 182939 - RNA, 111 nt, Homo sapiens
ugucagucaaagaaagaaaauucaaaucaaccaagaagaagagagauuaaagaaugagagaacuguguuuguugggaauuugccuguuacauguaauaagaaggugaguuu

SEQ ID NO: 182940 - RNA, 60 nt, Homo sapiens
aagaaauucaccagaaacaagggcagaaaaggaaaaauucucaaccugguguuaaaguag

SEQ ID NO: 182941 - RNA, 31 nt, Homo sapiens
agcaaaccaucaaaaaaacgaaacggaauga

SEQ ID NO: 182942 - RNA, 46 nt, Homo sapiens
gaagaagaagaugaugaugaugaauaaguugguuguagcgcaguuu

SEQ ID NO: 182943 - RNA, 46 nt, Homo sapiens
ucugugccucgcugaggaaaaauaacuaaacaugggcaaaggagau

SEQ ID NO: 182944 - RNA, 66 nt, Homo sapiens
cagaccuuuucugacauucuuuaauguuucuuuuccauagaccuguggcaugaauauagaaugcag

SEQ ID NO: 182945 - RNA, 42 nt, Homo sapiens
caaguacauguuacuccuaaauguacuuguaucaagccacaa

SEQ ID NO: 182946 - RNA, 44 nt, Homo sapiens
guuaaaauugcccuuucaugucugccuacgccugaaaacgucag

SEQ ID NO: 182947 - RNA, 81 nt, Homo sapiens
gcguccggggcccggcgcggugggcucgggccugcuguuccgcgacucccgcugggccucucccgcgggcuggcggggccu

SEQ ID NO: 182948 - RNA, 59 nt, Homo sapiens
gccgcgcggaaaagguaggggccggcgggccucgggugugggagcgcgggccgcggccu

SEQ ID NO: 182949 - RNA, 80 nt, Homo sapiens
ggucccggcgcggcccggccggcggcuuuaagugcugccgcgcacaggagaccggaggccgcggcccgcgcucccacacc

SEQ ID NO: 182950 - RNA, 49 nt, Homo sapiens
guacuguuucgauucccauuuuccgagugaagaaacugaggcacaggga

SEQ ID NO: 182951 - RNA, 43 nt, Homo sapiens
agaaaugauuaaggaacuucaguuggcaguuaccuguucauuu

SEQ ID NO: 182952 - RNA, 43 nt, Homo sapiens
guaguauaguguucugucugaaaacauauucauuaauauucug

SEQ ID NO: 182953 - RNA, 48 nt, Homo sapiens
augcuuaagcgugugcauaucaccucaugaaacgugugugugcaugag

SEQ ID NO: 182954 - RNA, 54 nt, Homo sapiens
ugcuguagaaguacauguaucugaauuuauaaauugcauuuauuuuggguacag

SEQ ID NO: 182955 - RNA, 25 nt, Homo sapiens
ugcagaucccuauauggaggaugau

SEQ ID NO: 182956 - RNA, 46 nt, Homo sapiens
uuguggucacccucucaccucagugaacagcaccuccuagccagaa

SEQ ID NO: 182957 - RNA, 46 nt, Homo sapiens
uugaagcuauaggcugugcaugcaaacaccaaaggaggguguggag

SEQ ID NO: 182958 - RNA, 57 nt, Homo sapiens
auuggucacauuucuuugugguaauuuauuuucagauaccugaucagagaagcaguu

SEQ ID NO: 182959 - RNA, 58 nt, Homo sapiens
uuggcuugugugguuuuggaacacguuguguaggagaugaggccugagcuuggaaugg

SEQ ID NO: 182960 - RNA, 39 nt, Homo sapiens
agguucuuguuuuagaaggccaugauuaaugaguuggag

SEQ ID NO: 182961 - RNA, 33 nt, Homo sapiens
uacuguaugcacuccaccacagacaggauggag

SEQ ID NO: 182962 - RNA, 37 nt, Homo sapiens
guucccaacuucuuuccuccucacagggaaaggcaaa

SEQ ID NO: 182963 - RNA, 64 nt, Homo sapiens
gccaaaugaauuauuuguaaaauuguuuaaaaaaauuaauaaauaaugaguguguauuuaaaag

SEQ ID NO: 182964 - RNA, 38 nt, Homo sapiens
caucagggaagacauguuaacaaauaguuagaagugaa

SEQ ID NO: 182965 - RNA, 30 nt, Homo sapiens
gaaccuuugcaguaaauucuguauuugucu

SEQ ID NO: 182966 - RNA, 48 nt, Homo sapiens
caucugucauuaaacuguuuccagcugcuggccuuguucucucagcug

SEQ ID NO: 182967 - RNA, 42 nt, Homo sapiens
ggauacagucacaagugauauguaagcaaaacugcaagcuca

SEQ ID NO: 182968 - RNA, 38 nt, Homo sapiens
auaagacaaacugaaaaagucuugucuucuagaaccuc

SEQ ID NO: 182969 - RNA, 65 nt, Homo sapiens
uggauucuggggcucugguauggaaguuauuuucgcaguguaggugcaaggugagggaaccagau

SEQ ID NO: 182970 - RNA, 42 nt, Homo sapiens
gauuggacugaucaguucaguuugcuguguguuugcucaaac

SEQ ID NO: 182971 - RNA, 44 nt, Homo sapiens
ugcaagaagaucuuuugagaacaugagaguguguaagugaacag

SEQ ID NO: 182972 - RNA, 44 nt, Homo sapiens
gaugaaaauagauguuuaaaagcaaaugccaaaucauguggaga

SEQ ID NO: 182973 - RNA, 42 nt, Homo sapiens
uucugggaaagguauuacuuucuuggaaaugauuguuuuuua

SEQ ID NO: 182974 - RNA, 51 nt, Homo sapiens
cacgaugugaugauuuagaagccuuaaaaaagaaggguugcccuccagaug

SEQ ID NO: 182975 - RNA, 49 nt, Homo sapiens
agaggauauuacucagauccaaccacagcaguugguuuugcgauuaaga

SEQ ID NO: 182976 - RNA, 44 nt, Homo sapiens
uaggggagccacagacauuuacauuaaaauucaagagagcugaa

SEQ ID NO: 182977 - RNA, 50 nt, Homo sapiens
gauuuggagaauguaaaaagucuuggaacagaucugaugaaugaaaugag

SEQ ID NO: 182978 - RNA, 46 nt, Homo sapiens
auuucauucaucagaucuguuccaagacuuuuuacauucuccaaau

SEQ ID NO: 182979 - RNA, 29 nt, Homo sapiens
acauagaugaauuuuuuaaacaaugcaaa

SEQ ID NO: 182980 - RNA, 45 nt, Homo sapiens
caguucuguucacuugugcaaggguuccugagcuuagcugguguu

SEQ ID NO: 182981 - RNA, 50 nt, Homo sapiens
gaacugcaccagcccauuuagcuacaaaaaugugcucagucuuacuaaua

SEQ ID NO: 182982 - RNA, 83 nt, Homo sapiens
caguuuucuucucacugucuuugaaagacacaucuuucuccugugucuuaguaauucaaaaagagagaacuuuuuaagcucua

SEQ ID NO: 182983 - RNA, 63 nt, Homo sapiens
aggccuaguuagaggcagcccagagaaugcccuccccacaacgagcugcuaacaggcucacac

SEQ ID NO: 182984 - RNA, 74 nt, Homo sapiens
ugguaaaacaaugccaccaaguuucccaucuccagcaaagugaaacccggcaucuguggaaaacaccagcagcc

SEQ ID NO: 182985 - RNA, 46 nt, Homo sapiens
cugcugguguuuuccacagaugccggguuucacuuugcuggagaug

SEQ ID NO: 182986 - RNA, 48 nt, Homo sapiens
agucacucugccuuuauugaaaauaaauauuggcaaagcauucaaguu

SEQ ID NO: 182987 - RNA, 52 nt, Homo sapiens
ugcucaccuuguccagaaacugagugaaaauaauauucagacaauuuuugca

SEQ ID NO: 182988 - RNA, 46 nt, Homo sapiens
uaucugcaaauucuagcaauguaauucaguugaucauugaugcaua

SEQ ID NO: 182989 - RNA, 84 nt, Homo sapiens
agucccuuuccucagaagucauuuuggaaaacggcaaauugucagaaggcguaacaauaaguuacaaaucuuacugcaagaacg

SEQ ID NO: 182990 - RNA, 46 nt, Homo sapiens
caauggaaauauuggaacauuuucuuccauuuuccccuguuccauu

SEQ ID NO: 182991 - RNA, 55 nt, Homo sapiens
gggugaauggaacaggggaaaauggaagaaaauguuccaauauuuccauuggaga

SEQ ID NO: 182992 - RNA, 98 nt, Homo sapiens
caauuugaaauuagcauaacuucaaauaaguguccaaaaaaggauucugacagcuuuaaaauuaggccucugggcuuuacggaggaaguagagguuau

SEQ ID NO: 182993 - RNA, 100 nt, Homo sapiens
ucuucaguacaucugugaaugugaaugccaaagcgaaggcaucccugaaagucccaagugucaugaaggaaaugggacauuugaguguggcgcgugcagg

SEQ ID NO: 182994 - RNA, 50 nt, Homo sapiens
ccagauacagaaucagugcagucaguguccaugagcauuauguguucuaa

SEQ ID NO: 182995 - RNA, 46 nt, Homo sapiens
cuccauuguuacugcagauuucugaacuguuuucuuuccugcagua

SEQ ID NO: 182996 - RNA, 74 nt, Homo sapiens
gaaaacaguucagaaaucugcaguaacaauggagagugcgucugcggacaguguguuuguaggaagagggauaa

SEQ ID NO: 182997 - RNA, 79 nt, Homo sapiens
uacaaaugaaauuuauucuggcaaauucugcgagugugauaauuucaacugugauagauccaauggcuuaauuugugga

SEQ ID NO: 182998 - RNA, 59 nt, Homo sapiens
ugacuguucuuuggauacuaguacuugugaagccagcaacggacagaucugcaauggcc

SEQ ID NO: 182999 - RNA, 59 nt, Homo sapiens
ggggcaucugcgaguguggugucuguaaguguacagauccgaaguuucaagggcaaacg

SEQ ID NO: 183000 - RNA, 74 nt, Homo sapiens
caugcacacaggaauguuccuauuuuaacauuaccaagguagaaagucgggacaaauuaccccagccgguccaa

SEQ ID NO: 183001 - RNA, 96 nt, Homo sapiens
ccugauccugugucccauuguaaggagaaggauguugacgacuguugguucuauuuuacguauucagugaaugggaacaacgaggucaugguucau

SEQ ID NO: 183002 - RNA, 49 nt, Homo sapiens
ugcaaggccaauaagaacaauuccagcaaccacaccagcuacaauugga

SEQ ID NO: 183003 - RNA, 67 nt, Homo sapiens
uacugcugauauggaagcuuuuaaugauaauucaugacagaagggaguuugcuaaauuugaaaagga

SEQ ID NO: 183004 - RNA, 65 nt, Homo sapiens
uguuuuacauaugagaaaacugagacacauaaggguuauguaacuugaccgaguucccacggcug

SEQ ID NO: 183005 - RNA, 48 nt, Homo sapiens
uuuucucaagaaaaaguagaaauuaacaauugaaauaaaugaaugagc

SEQ ID NO: 183006 - RNA, 50 nt, Homo sapiens
cuucugcauuauguauuuaauacauuguagagaugguucugcagcuacca

SEQ ID NO: 183007 - RNA, 79 nt, Homo sapiens
uguuguagggugaaaauccuauuuauaagagugccguaacaacuguggucaauccgaaguaugagggaaaaugaguacu

SEQ ID NO: 183008 - RNA, 100 nt, Homo sapiens
gcccgugcaaaucccacaacacugaaugcaaaguagcaauuuccauagucacaguuagguagcuuuagggcaauauugccaugguuuuacucaugugcag

SEQ ID NO: 183009 - RNA, 42 nt, Homo sapiens
cauuuucaaaaccugcacaugaguaaaaccauggcaauauug

SEQ ID NO: 183010 - RNA, 44 nt, Homo sapiens
auguuuuauuauuuugaaaauaauguuguaauucaugccaggga

SEQ ID NO: 183011 - RNA, 67 nt, Homo sapiens
ccuuuucuuccuggacuauugaaaucaagcuuauuggauuaagugauauuucuauagcgauugaaag

SEQ ID NO: 183012 - RNA, 47 nt, Homo sapiens
cuguuauuuugcuauuugccuguuagacaugacugaugacauaucug

SEQ ID NO: 183013 - RNA, 52 nt, Homo sapiens
aauacguuugaaauaguugaucuacaaaggccaugggaaaaauucagagagu

SEQ ID NO: 183014 - RNA, 44 nt, Homo sapiens
ugcuaaaaaguccuugauuuagcacuauuuacauacaggccaua

SEQ ID NO: 183015 - RNA, 64 nt, Homo sapiens
ucuucuaaucuuuuaauguauuuguuugcaauuuugggguaagacuuuuuuuaugaguacuuuu

SEQ ID NO: 183016 - RNA, 41 nt, Homo sapiens
uacagugcuauuuacugaaguuauuuauuaaauaugccuaa

SEQ ID NO: 183017 - RNA, 41 nt, Homo sapiens
uauguuuucgugcuugauagcaaacccaaguaauaaugaaa

SEQ ID NO: 183018 - RNA, 45 nt, Homo sapiens
uccaacaaggccacugccccaaccaggaagcucucagugauacau

SEQ ID NO: 183019 - RNA, 46 nt, Homo sapiens
ggcuggcaaagaagaaggcacacgcauggugagaauccggccugag

SEQ ID NO: 183020 - RNA, 72 nt, Homo sapiens
auaauaccaugugagaacucuagagauagagguccaugcuagguguuaaugaaaacguugaagaaggccacc

SEQ ID NO: 183021 - RNA, 36 nt, Homo sapiens
agaaaaaaaaaaaagacaaaaaauaaaaaauaaaaa

SEQ ID NO: 183022 - RNA, 54 nt, Homo sapiens
ugaaggcugccauugauacacauugccuguaacaucacucugugugugugugug

SEQ ID NO: 183023 - RNA, 38 nt, Homo sapiens
ggagagacaagcuaguuuucuuaugcaaauguuuauca

SEQ ID NO: 183024 - RNA, 47 nt, Homo sapiens
uuguggaguuuuugaaggcuuugccaagugguucaauaguggcugau

SEQ ID NO: 183025 - RNA, 50 nt, Homo sapiens
uuaaaaauggaaagagggaagaggagaaaaaauagugacugcaugacuau

SEQ ID NO: 183026 - RNA, 46 nt, Homo sapiens
uuuugauaugagcauucauagucuuuauucucagaagggcugagga

SEQ ID NO: 183027 - RNA, 32 nt, Homo sapiens
aauuuugaauucagcacuuuauucuugauaag

SEQ ID NO: 183028 - RNA, 45 nt, Homo sapiens
acucauuuaugucugggcaauggaacaagaauauaauaagcagaa

SEQ ID NO: 183029 - RNA, 45 nt, Homo sapiens
gucgagacucggcaucuucugucccccgcauuaaugacucucagg

SEQ ID NO: 183030 - RNA, 50 nt, Homo sapiens
auucaaaugucuccuguuggcugacaucacagaugugguguuggcuccuc

SEQ ID NO: 183031 - RNA, 56 nt, Homo sapiens
ugaagauaauaguuuuuuaguaaagugcuacuaaauguaguaaaucauguaggauu

SEQ ID NO: 183032 - RNA, 42 nt, Homo sapiens
agacugcaguugcaggugggugagcuccggggucugagggag

SEQ ID NO: 183033 - RNA, 25 nt, Homo sapiens
ucagauggcuucagccacagcugcc

SEQ ID NO: 183034 - RNA, 46 nt, Homo sapiens
augaaagaugaaauaaucccgugucaucguuguguguuagcagcau

SEQ ID NO: 183035 - RNA, 44 nt, Homo sapiens
gaaaucacagaugaagugcaggucuaccacagcaacaggucuga

SEQ ID NO: 183036 - RNA, 52 nt, Homo sapiens
gacagcaaggcauagagacaacauagagcuaaguaaagccaguggaaaugaa

SEQ ID NO: 183037 - RNA, 48 nt, Homo sapiens
gaaauaucuagaaaacuacuacgaccucaaaaaagaugugaaacaguu

SEQ ID NO: 183038 - RNA, 48 nt, Homo sapiens
ggaagcuggacuccgacacucuggaggugaugcgcaagcccaggugug

SEQ ID NO: 183039 - RNA, 42 nt, Homo sapiens
cuacaggauugugaauuauacaccagauuugccaaaagaugc

SEQ ID NO: 183040 - RNA, 65 nt, Homo sapiens
gacuccacucacauucuccaggcuguaugaaggagaggcugauauaaugaucucuuuugcaguua

SEQ ID NO: 183041 - RNA, 80 nt, Homo sapiens
uggaaauguuuuggcccaugccuaugccccugggccagggauuaauggagaugcccacuuugaugaugaugaacaaugga

SEQ ID NO: 183042 - RNA, 54 nt, Homo sapiens
cucacucacagaccugacucgguuccgccugucucaagaugauauaaauggcau

SEQ ID NO: 183043 - RNA, 50 nt, Homo sapiens
agccaacugugauccugcuuuguccuuugaugcugucagcacucugaggg

SEQ ID NO: 183044 - RNA, 69 nt, Homo sapiens
cuugaaccugaauugcauuugaucucuucauuuuggccaucucuuccuucaggcguggaugccgcauau

SEQ ID NO: 183045 - RNA, 105 nt, Homo sapiens
aagaggcauccacacccuagguuucccuccaaccgugaggaaaaucgaugcagccauuucugauaaggaaaagaacaaaacauauuucuuuguagaggacaaaua

SEQ ID NO: 183046 - RNA, 48 nt, Homo sapiens
gaugagaagagaaauuccauggagccaggcuuucccaagcaaauagcu

SEQ ID NO: 183047 - RNA, 83 nt, Homo sapiens
ucuucacaguuggaguuugacccaaaugcaaagaaagugacacacacuuugaagaguaacagcuggcuuaauuguugaaagag

SEQ ID NO: 183048 - RNA, 85 nt, Homo sapiens
aauaugggcacuuuaaaugaagcuaauaauucuucaccuaagucucugugaauugaaauguucguuuucuccugccugugcugug

SEQ ID NO: 183049 - RNA, 49 nt, Homo sapiens
aggggaagcacucgugugcaacagacaagugacuguaucuguguagacu

SEQ ID NO: 183050 - RNA, 41 nt, Homo sapiens
ugccagucugcucugccuauccucugaguggggcagcaaaa

SEQ ID NO: 183051 - RNA, 62 nt, Homo sapiens
aagaaaggacaguaaucucauuguuaaaaaaauccaaggaaugcagaaguuccuuggguugg

SEQ ID NO: 183052 - RNA, 56 nt, Homo sapiens
aggugacagggaagcuagacacugacacucuggaggugaugcgcaagcccaggugu

SEQ ID NO: 183053 - RNA, 42 nt, Homo sapiens
cuccaggauugugaauuauacaccagauuugccaagagaugc

SEQ ID NO: 183054 - RNA, 65 nt, Homo sapiens; identical to SEQ ID NO: 183040

SEQ ID NO: 183055 - RNA, 70 nt, Homo sapiens
cuggggcucuuucacucagccaacacugaagcuuugauguacccacucuacaacucauucacagagcucg

SEQ ID NO: 183056 - RNA, 46 nt, Homo sapiens
aaccccuggugcccacaaaaucuguuccuucgggaucugagaugcc

SEQ ID NO: 183057 - RNA, 46 nt, Homo sapiens
aacccugaaccugaauuucauuugauuucugcauuuuggcccucuc

SEQ ID NO: 183058 - RNA, 47 nt, Homo sapiens
gacaaggaaaagaagaaaacauacuucuuugcagcggacaaauacug

SEQ ID NO: 183059 - RNA, 80 nt, Homo sapiens
agauuugaugaaaauagccaguccauggagcaaggcuucccuagacuaauagcugaugacuuuccaggaguugagccuaa

SEQ ID NO: 183060 - RNA, 46 nt, Homo sapiens
ucaguggaucaucacaguuugaguuugaccccaaugccaggauggu

SEQ ID NO: 183061 - RNA, 50 nt, Homo sapiens
ugguuaauuuuuccugcauguucugugacugaagaagaugagccuugcag

SEQ ID NO: 183062 - RNA, 26 nt, Homo sapiens
cugccaguauucuuaguuaaauguuc

SEQ ID NO: 183063 - RNA, 65 nt, Homo sapiens
cuguaaacuagucagccauggcagccuuaauauaccucugcugacucuaaggagacccuacuuac

SEQ ID NO: 183064 - RNA, 39 nt, Homo sapiens
gggagcuacagagacaugacauaaauaucaccaugaggu

SEQ ID NO: 183065 - RNA, 54 nt, Homo sapiens
ggcuuaacuggggauagagaauuuucuuccaguguggcuugcucacauggcugg

SEQ ID NO: 183066 - RNA, 52 nt, Homo sapiens
caacaaguguuucacagaacacaucucagauaucaacauccacaaugaccgu

SEQ ID NO: 183067 - RNA, 42 nt, Homo sapiens
gaccuuuuuuuuccuaugcugcaaguaguuaaaugccacauu

SEQ ID NO: 183068 - RNA, 70 nt, Homo sapiens
uguaaguuuugaauggccaggacuuuuuaaaaaaaauuguuggugcacaucuuuaauuaugauagaauau

SEQ ID NO: 183069 - RNA, 52 nt, Homo sapiens
aaauuuuuaauugaguguaaacacaccuaacuuuaagaaaaagaaccgcuug

SEQ ID NO: 183070 - RNA, 55 nt, Homo sapiens
gauuucucauuagauacuaggcuuugugaggucuuacauauauuuaaguucaagu

SEQ ID NO: 183071 - RNA, 48 nt, Homo sapiens
uucuauaucaugaaaucaggacaaauacaauuuuugaacuuuugggag

SEQ ID NO: 183072 - RNA, 40 nt, Homo sapiens
guagcauucagaauaacggguggaaaugccaacuccagag

SEQ ID NO: 183073 - RNA, 42 nt, Homo sapiens
ccgccugcgaggucaccagcucuuggugccuguuuggccccg

SEQ ID NO: 183074 - RNA, 30 nt, Homo sapiens
gaugugugagugugagugugugugugugug

SEQ ID NO: 183075 - RNA, 45 nt, Homo sapiens
ugacugaucacugagaauuucaaacuggacaggccgaucacccau

SEQ ID NO: 183076 - RNA, 46 nt, Homo sapiens
ccuaaaccauauagcgcaaucuuugugcuuccuuuuugaagcaaaa

SEQ ID NO: 183077 - RNA, 46 nt, Homo sapiens
uacuuuuuuauugacaaacauucgauagagccuuucaucuggaaug

SEQ ID NO: 183078 - RNA, 28 nt, Homo sapiens
gcacagggugacaaaugaaucuaacagc

SEQ ID NO: 183079 - RNA, 41 nt, Homo sapiens
aaaacucuuugacaauacugugggugccuaccggagcuugu

SEQ ID NO: 183080 - RNA, 46 nt, Homo sapiens
cauuaaagcuguaugccuacacugaaaagagggcuaacuaugagac

SEQ ID NO: 183081 - RNA, 54 nt, Homo sapiens
guaaucauaaggguccugaaaagcacaagagggaggcagaugggagcuggaagg

SEQ ID NO: 183082 - RNA, 44 nt, Homo sapiens
uaauucuuaguagugacauuucgggaaggcugcugucuuguaga

SEQ ID NO: 183083 - RNA, 43 nt, Homo sapiens
cauuugauacauacauuugccauaucuucaucuaacuuaagua

SEQ ID NO: 183084 - RNA, 141 nt, Homo sapiens
augucguaauaguugauguagacccugcggggggaggaggccggacucagcggguggcucagucccgggccuggccgcgcgccgccgccccucccccgccccuccgcgacuccgcguaccuguccgggcugaugcgcaggc

SEQ ID NO: 183085 - RNA, 241 nt, Homo sapiens
gugcaccgcgauguacugcgaggaaagggcgcggucagcccgccccagcgaccucgucgggccccgaacguccacuucgggcccgagccaccguccuccccccgccccgccccccagcuccguucaggagucgccuccccagcucccagcgcggaaccccucguccggugggcaccccccucuuccuguccccucccggcaaaccugggggggcuugccgguggccugcgccagcugcugg

SEQ ID NO: 183086 - RNA, 46 nt, Homo sapiens
aagugcuuugaaaugcagaaguuuauguacaguuguauauacagua

SEQ ID NO: 183087 - RNA, 48 nt, Homo sapiens
uuugguuuuucuccacaguucguaauggaccugaaaguggcagcaaga

SEQ ID NO: 183088 - RNA, 45 nt, Homo sapiens
ugcaaccauugacagcuuagcaagccgaauugaggauccucagau

SEQ ID NO: 183089 - RNA, 45 nt, Homo sapiens
guccucaagcuuuugauaaaaaugaaauuaauucauuacagucca

SEQ ID NO: 183090 - RNA, 42 nt, Homo sapiens
uuaaaggaaaaaacaaauuaauauauagcuuuuucaccaguc

SEQ ID NO: 183091 - RNA, 46 nt, Homo sapiens
uacuguccucuugauguccaaauuccuagugauuuagaggggucug

SEQ ID NO: 183092 - RNA, 49 nt, Homo sapiens
aauuugugugcaagaacuuuaauucuuucuuugggguagucacucauga

SEQ ID NO: 183093 - RNA, 49 nt, Homo sapiens
uuuaggugaguaagggauacacugaguuuuaaauaagcugcuaucagaa

SEQ ID NO: 183094 - RNA, 37 nt, Homo sapiens
uauuuaaaaaagucuacuccuaaguauuagcguauuu

SEQ ID NO: 183095 - RNA, 26 nt, Homo sapiens
uucaaauccccucuucaagaugguug

SEQ ID NO: 183096 - RNA, 51 nt, Homo sapiens
auuguaauauuuuugccaguaucuuacuaauucuguguuauaccugaaaua

SEQ ID NO: 183097 - RNA, 84 nt, Homo sapiens
auuuuucaagcaugaaguacacaacugaaacucaaauuuuuauuccuuccacagaaaacacuagagaaacuucgagccaaaaau

SEQ ID NO: 183098 - RNA, 85 nt, Homo sapiens
cucuaaggcaccaaaggggucuaagguaggguuaauuuuuuuuuuuuuuuuagugauucacuuuuugcaguguuugucucuaauu

SEQ ID NO: 183099 - RNA, 75 nt, Homo sapiens
acaccuguaccagggagcuuacaagaagcauuuauaaagaggaaaaaaucauuuauggagagaucccaccagagg

SEQ ID NO: 183100 - RNA, 80 nt, Homo sapiens
gccaaguuggaaguuuuaccuaaacuuauucccagauauugaaaaaugacuucagaacaacugguaauuuuacuagggga

SEQ ID NO: 183101 - RNA, 54 nt, Homo sapiens
uaccaguauugcugaaauggauuuugcaaauuuaacccuagaagagaagagcga

SEQ ID NO: 183102 - RNA, 47 nt, Homo sapiens
ucaaauuaucgggucaauauauauuaacuugcuuaggcuagugcagu

SEQ ID NO: 183103 - RNA, 51 nt, Homo sapiens
aauguuaaauagauagaaaccgaccuggauuacucuggucugaacucacau

SEQ ID NO: 183104 - RNA, 138 nt, Homo sapiens
cuaagauuuuucauucgaugaguguaaggaaugcuauagcgaugaaaguagggauaauaaguaggagaagguuaauuauagguauauuguuaaugagaggaguugaaccucugauuauaaaguuuuaagucuuaugca

SEQ ID NO: 183105 - RNA, 45 nt, Homo sapiens
gauaauggcuagggugaccucauuugaaauugucugggccacagc

SEQ ID NO: 183106 - RNA, 45 nt, Homo sapiens
uagggguaaugaugguaggagcagucagaggaguucuugcauugu

SEQ ID NO: 183107 - RNA, 41 nt, Homo sapiens
gaacccuguuaauggagguaaaccuccuagagauaguagaa

SEQ ID NO: 183108 - RNA, 41 nt, Homo sapiens
gggaagaaugguauggguuuuguguuuuugaauugucauuu

SEQ ID NO: 183109 - RNA, 48 nt, Homo sapiens
uugaauugcaaauucaaaggagaagcuucaguccugcuggggcuuccc

SEQ ID NO: 183110 - RNA, 58 nt, Homo sapiens
acuguucagcugguuccagugccagcuucuacuauugaggaugcaaguggaagcagaa

SEQ ID NO: 183111 - RNA, 46 nt, Homo sapiens
ggagcaagaagauggucagauccacagaggcuucuucaugugcuag

SEQ ID NO: 183112 - RNA, 48 nt, Homo sapiens
uuugauguuuugaugucaaaaauagugauagcuuaacacuaauguggc

SEQ ID NO: 183113 - RNA, 40 nt, Homo sapiens
aguuugcuccucuucauuuguaucccaggugccuguugcu

SEQ ID NO: 183114 - RNA, 46 nt, Homo sapiens
ucuauugagaaaacccagaaagaauugguuuugucaaaaccaugua

SEQ ID NO: 183115 - RNA, 55 nt, Homo sapiens
gccaucauucuagcuagacaagaagcucgggaagaauuacuuuuacaucagagug

SEQ ID NO: 183116 - RNA, 46 nt, Homo sapiens
gagugacaguaccauucccuuaagccauccuaagaucccaagaugu

SEQ ID NO: 183117 - RNA, 118 nt, Homo sapiens
uauccaccuuaaagugaucaucuuugucggccuuuaguucacaaccgaaaagauaguucuggggccucagggggcucauguccauguccaucgaaucuuccaucggguggcggcacgc

SEQ ID NO: 183118 - RNA, 44 nt, Homo sapiens
cagcuacuaagugcuguccacuaauaugcacuggcccugaacca

SEQ ID NO: 183119 - RNA, 45 nt, Homo sapiens
uuuuacuuuuuucuguggaaccuugcuaccaccuccaggggcaga

SEQ ID NO: 183120 - RNA, 42 nt, Homo sapiens
ccauucugauuugacuuuugugcauuuuuggcuggaguaucu

SEQ ID NO: 183121 - RNA, 46 nt, Homo sapiens
uuguuuaaacuauuuucuuaaagagacuuccuccacugccagagau

SEQ ID NO: 183122 - RNA, 71 nt, Homo sapiens
uaggugaaggacgggaaaugaucagugaauugaaauuuugauugacaaagaagugagaugauuccuugcgu

SEQ ID NO: 183123 - RNA, 52 nt, Homo sapiens
uuuuggcacacagguaaauugauagcguuauuuaaaauaagaccauugauac

SEQ ID NO: 183124 - RNA, 40 nt, Homo sapiens
gauauucuacuuuaauauagaauacaggggaaagacugac

SEQ ID NO: 183125 - RNA, 47 nt, Homo sapiens
gguggucagcaguacuaguuacagcagagaaauuccaauaaguauau

SEQ ID NO: 183126 - RNA, 45 nt, Homo sapiens
uucaaguaaacugauugagugaauggaaggagaagaaaauggaga

SEQ ID NO: 183127 - RNA, 46 nt, Homo sapiens
uugcguaagccagauguuggaucugucaucuuuaaauauuucuuaa

SEQ ID NO: 183128 - RNA, 36 nt, Homo sapiens
cauaagagaaguaaagauugaugguguaguggggag

SEQ ID NO: 183129 - RNA, 124 nt, Homo sapiens
cauccuugggaaggggauugaggaaucaguaucaaaaugaugccccuccuccagcuaucccgugguaaagcagguccccuuacccaccuuccaaaauucuccauccucaaagccuucuccauga

SEQ ID NO: 183130 - RNA, 53 nt, Homo sapiens
auuaccuccauuuuacaaaugaggagauggagguuuaaaaagauuaucuugcu

SEQ ID NO: 183131 - RNA, 57 nt, Homo sapiens
ggagcuaugugaauuaaaacccaaauuucaggaacacaucauucaagccccuaagcc

SEQ ID NO: 183132 - RNA, 52 nt, Homo sapiens
uauuuugguauauuaauaaugguaauaagguuucaaaauucuccagcccaga

SEQ ID NO: 183133 - RNA, 45 nt, Homo sapiens
agcacuugauaaacuuaaacugucaucagggaaugaagaaaauaa

SEQ ID NO: 183134 - RNA, 44 nt, Homo sapiens
aagaacuuuaaacaaaagggugauaguaauuugauaauuaguag

SEQ ID NO: 183135 - RNA, 72 nt, Homo sapiens
gggggcaauagcauuaaguuuaguagaugcuaacauacugaguuuuauguucuugugaaauaucuuaaggag

SEQ ID NO: 183136 - RNA, 24 nt, Homo sapiens
ucuuaauaugacuuucucaaagga

SEQ ID NO: 183137 - RNA, 42 nt, Homo sapiens
cuguguauaucauucuggaguaccuauuuuccaugaggggua

SEQ ID NO: 183138 - RNA, 53 nt, Homo sapiens
uacauucuuagcccaagagggcuguacaaaagggaaacacauguggacuaaaa

SEQ ID NO: 183139 - RNA, 46 nt, Homo sapiens
gaugcagugggcaagccuugaacugccugcagcuaaaaagcaggaa

SEQ ID NO: 183140 - RNA, 47 nt, Homo sapiens
cauuucucccuacugguaggaaccauaguuguguccuauacuugaag

SEQ ID NO: 183141 - RNA, 47 nt, Homo sapiens
cauaauugcaguauuucuuuguauuucucuguuaagcaaagaaauau

SEQ ID NO: 183142 - RNA, 44 nt, Homo sapiens
gaucgugguugugcuuaaacaaauguccaaaaaggagagauugg

SEQ ID NO: 183143 - RNA, 44 nt, Homo sapiens
gacugcgguggaggugaaaccgaugucagccagggacagauugg

SEQ ID NO: 183144 - RNA, 393 nt, Homo sapiens
uagagagcuggccaggcgcaguggcucaugccuauaaucucagcacuuuggaaggcugaggcagguggaucacgaggucaagagaucgagacuauccaggccauccaggccaacauggugaaacccugucucuacuaaaaauacaaaaauuagcugggcauggugguacaccccuguaaucccagcuacucaagagccugaggcaggagagucgcuucaaccagggaggcagagguuacaguuagccaagaucaugccacugcacuccagccuggcgacugagcgagacuccaucucaaaaaaaaaaaaaaaaaaaaucaauagcuuucacuguuuccuuggguucuuggaauggagauaaacccuuuuuauguaagauguuugauguaagau

SEQ ID NO: 183145 - RNA, 51 nt, Homo sapiens
aagaacuuacacucugaugaugcuccauaaaguuaaaggcaugugggagaa

SEQ ID NO: 183146 - RNA, 41 nt, Homo sapiens
guaagaaauguggaaaagccuucacagaacgcucagaucuu

SEQ ID NO: 183147 - RNA, 33 nt, Homo sapiens
ggaaauaaguugagaaagcacucacagucugcu

SEQ ID NO: 183148 - RNA, 42 nt, Homo sapiens; identical to SEQ ID NO: 112668

SEQ ID NO: 183149 - RNA, 100 nt, Homo sapiens
ccccugccucagcuuccucaggcuucccggcggcuccugaggcucgcaguccccacaacagggcgggccggggccguuaccccggggacgacgcggaaga

SEQ ID NO: 183150 - RNA, 27 nt, Homo sapiens
aggcugacaguucgccugggugacaug

SEQ ID NO: 183151 - RNA, 71 nt, Homo sapiens
uagcuaagagcagagcuuucgggugugaaguaccugaguacaguuccugccuuccccugugugugccugga

SEQ ID NO: 183152 - RNA, 44 nt, Homo sapiens
cgaguguacuacuucaaccacaucacuaacgccagccaguggga

SEQ ID NO: 183153 - RNA, 69 nt, Homo sapiens
aggguccgcugcucgcaccugcuggugaagcacagccagucacggcggcccucguccuggcggcaggag

SEQ ID NO: 183154 - RNA, 47 nt, Homo sapiens
uuaacuucuugaacauucgugaacaccuguuuugugcacagugcugg

SEQ ID NO: 183155 - RNA, 53 nt, Homo sapiens
agcaaguguguguaugcagucuugugcacgugccaggucaggaggaauggcua

SEQ ID NO: 183156 - RNA, 68 nt, Homo sapiens
ccaccagcccuggccuccuccgccuccuggagagucagagccgaugggcuaguuugggccacacaggg

SEQ ID NO: 183157 - RNA, 33 nt, Homo sapiens
cucuucuugggugugggugaggacaggugugac

SEQ ID NO: 183158 - RNA, 42 nt, Homo sapiens
augcuccccacaaccccucuccucacacauaccugcaugcgc

SEQ ID NO: 183159 - RNA, 42 nt, Homo sapiens
ccccacucccuguccauccccaguuggggcugcgaccgccag

SEQ ID NO: 183160 - RNA, 46 nt, Homo sapiens
uaccuaacagcgacauucucauuuggguuuuggccacugcacagac

SEQ ID NO: 183161 - RNA, 46 nt, Homo sapiens
auguuagucugccugcccauccuuguuuguaacaaaagccacaaac

SEQ ID NO: 183162 - RNA, 45 nt, Homo sapiens
guugguuucguucccaauauggccccgguauccgaguucccggag

SEQ ID NO: 183163 - RNA, 50 nt, Homo sapiens
ucaucaguuuauucucagauuugagaugcaaauuaugcccuauggccugg

SEQ ID NO: 183164 - RNA, 53 nt, Homo sapiens
cgccaggccauagggcauaauuugcaucucaaaucugagaauaaacugaugaa

SEQ ID NO: 183165 - RNA, 45 nt, Homo sapiens
uuguagauuucaucugcuuccuccuuagggaaggcugggauauga

SEQ ID NO: 183166 - RNA, 91 nt, Homo sapiens
cuugguccccaaaccaccuggcauggcaaggugagccuggggagguggggggcagggggaggggauuugcagagcugggcugaggcaggaa

SEQ ID NO: 183167 - RNA, 70 nt, Homo sapiens
gccucaccuccccaccccuugaacccccaugcaaugagcuucuaacucagagcugaugaacaaaagcccc

SEQ ID NO: 183168 - RNA, 55 nt, Homo sapiens
ccauuccagguggcauacugcagucuggcucuuucuccccucccuccccacccaa

SEQ ID NO: 183169 - RNA, 56 nt, Homo sapiens
augccaccuggaauggggugagaggaggcuggacccuugggccagggaaccccagc

SEQ ID NO: 183170 - RNA, 80 nt, Homo sapiens
uggaaaggagaaggaaugacuguccgugaugagcgaagucacaucccauuggcuccauagucacagguaacgaaaaauac

SEQ ID NO: 183171 - RNA, 48 nt, Homo sapiens
ggguuugaacugggccccgucugcuucagcagcugagaguguccgggg

SEQ ID NO: 183172 - RNA, 45 nt, Homo sapiens
ugucgucugguugaaagacagcuccucuccauuggugccaaggaa

SEQ ID NO: 183173 - RNA, 46 nt, Homo sapiens
ugcugagugccacagcucgccagaacuucaccuacuccugccagaa

SEQ ID NO: 183174 - RNA, 45 nt, Homo sapiens
gcccgggcgcuccgcagugccgggaggacgccgcagcugcuccag

SEQ ID NO: 183175 - RNA, 57 nt, Homo sapiens
gguuuggggucucucugugggggaacuggaggcuugucuaggguucggggucuuccu

SEQ ID NO: 183176 - RNA, 45 nt, Homo sapiens
uaccuuuucccccuuggggccagugucucccuucagcccugggag

SEQ ID NO: 183177 - RNA, 47 nt, Homo sapiens
cuucaggccacaugggucgagaaggcagagaaggggagaaaggugcc

SEQ ID NO: 183178 - RNA, 41 nt, Homo sapiens
ggcauagaugguuccccaggggagaagggagacccugguga

SEQ ID NO: 183179 - RNA, 54 nt, Homo sapiens
aagacagaguugggaggggugaugaggguacgugagaauuugggauggggcugg

SEQ ID NO: 183180 - RNA, 42 nt, Homo sapiens
cuccagggggaccuuucuugccuggggguccagcagcuccag

SEQ ID NO: 183181 - RNA, 41 nt, Homo sapiens
agggugagcgaggggacgcuggagacccagggccuccagga

SEQ ID NO: 183182 - RNA, 43 nt, Homo sapiens
cagggcugccuggaggaguuggucagccaggcgccguggguga

SEQ ID NO: 183183 - RNA, 43 nt, Homo sapiens
cggcgccuggcugaccaacuccuccaggcagcccuggagugcc

SEQ ID NO: 183184 - RNA, 45 nt, Homo sapiens
gacgucuccgaccuccccuuucucucccggagggccuggcagccc

SEQ ID NO: 183185 - RNA, 41 nt, Homo sapiens
cacaggggcugccaggcccuccgggagagaaaggggagguc

SEQ ID NO: 183186 - RNA, 75 nt, Homo sapiens
gggcgccggggacccccaggccucuuugggcagaaaggagaugacggagucagaggcuuugugggggugauuggc

SEQ ID NO: 183187 - RNA, 28 nt, Homo sapiens
cugcccaaagaggccuggggguccccgg

SEQ ID NO: 183188 - RNA, 44 nt, Homo sapiens
gggaugugggugcccccggacacaaggggaguaaaggcgauaaa

SEQ ID NO: 183189 - RNA, 47 nt, Homo sapiens
ccucugggacccccuggagcugcugggccuucuggcgaggaagggga

SEQ ID NO: 183190 - RNA, 42 nt, Homo sapiens
uauuauaccugauucaucaccccuguucucagggcuccccug

SEQ ID NO: 183191 - RNA, 46 nt, Homo sapiens
gaccuacuggcuuaaagggugauaagggccccccagggcccguggg

SEQ ID NO: 183192 - RNA, 59 nt, Homo sapiens
gggccuccaggccccccuggaccuccuggugaacaaggucuuccuggccuggaaggcag

SEQ ID NO: 183193 - RNA, 48 nt, Homo sapiens
uucucucuuacaauucauuuucagggaaagacagggcagccaggccug

SEQ ID NO: 183194 - RNA, 46 nt, Homo sapiens
gaucuauuggauuucccgguccccugggacccauaggagagaaagg

SEQ ID NO: 183195 - RNA, 46 nt, Homo sapiens
uucccuuucucuccuaugggucccaggggaccgggaaauccaauag

SEQ ID NO: 183196 - RNA, 35 nt, Homo sapiens
agagggcugccuuguaggaggcuggggcuguagag

SEQ ID NO: 183197 - RNA, 41 nt, Homo sapiens
uaaauggucaggaguggcugacuuuguggaggccuaggaga

SEQ ID NO: 183198 - RNA, 46 nt, Homo sapiens
cuaccuuagguccagggcguccuggauaaccugggaggccuggcac

SEQ ID NO: 183199 - RNA, 44 nt, Homo sapiens
gcggggcaggcuggcgaggaggggcccccaggcucagcugggga

SEQ ID NO: 183200 - RNA, 35 nt, Homo sapiens
cugggggccccuccucgccagccugccccgccugc

SEQ ID NO: 183201 - RNA, 41 nt, Homo sapiens
ggcaaccggggccuccagggggagaaaggcgagaaggugag

SEQ ID NO: 183202 - RNA, 42 nt, Homo sapiens
agacucaguccccugcucuaaagcagccaggauagucccaag

SEQ ID NO: 183203 - RNA, 42 nt, Homo sapiens
ggagcagagggaccuccagggcccacuggccaggcuggggag

SEQ ID NO: 183204 - RNA, 41 nt, Homo sapiens
ggugacuuuggccauguggggcaacccggucccccaggaga

SEQ ID NO: 183205 - RNA, 42 nt, Homo sapiens
ggccgcccuggagcagauggagcucggggccucccaggggac

SEQ ID NO: 183206 - RNA, 35 nt, Homo sapiens
gcaucaugaucacagugcccggugggccucggauc

SEQ ID NO: 183207 - RNA, 42 nt, Homo sapiens
agaucuggaacugaguccgagauggauauucugcugcccgga

SEQ ID NO: 183208 - RNA, 45 nt, Homo sapiens
gaaggagaugauuccaccaugggcccugacuuccgggcagcagaa

SEQ ID NO: 183209 - RNA, 101 nt, Homo sapiens
ggugaaccagaaaccccucguccucggcggaaggggaagggaaaagggaggaagaaagggcgaggucgcaaggggaagggcaggaaaaagaacaaggaaau

SEQ ID NO: 183210 - RNA, 45 nt, Homo sapiens
agcauagcuggacucacugugcuggggacccaggaccuuggggaa

SEQ ID NO: 183211 - RNA, 46 nt, Homo sapiens
ucuccuaggugaccccuuccgcccccucccccagcaggucaaccuc

SEQ ID NO: 183212 - RNA, 26 nt, Homo sapiens
gaagccaggccccucggggaccccag

SEQ ID NO: 183213 - RNA, 56 nt, Homo sapiens
gucagauggaggagaucaggauaggcagugggagaaggucaggggguagucagagg

SEQ ID NO: 183214 - RNA, 35 nt, Homo sapiens
aggggggacccggcgcgcuggcuccgcccuggcuc

SEQ ID NO: 183215 - RNA, 53 nt, Homo sapiens
ugcgcccgucgguccagcagccgcgcagggcagggggcggugccucggggccg

SEQ ID NO: 183216 - RNA, 52 nt, Homo sapiens
ggugggcacaccuguuaccuuauugcucagauggggaaacugaggcuuaggg

SEQ ID NO: 183217 - RNA, 25 nt, Homo sapiens
ugagagccagguguguggccucagu

SEQ ID NO: 183218 - RNA, 48 nt, Homo sapiens
ggucauucauaucucgguuugagcucauaucuuauaauaacacaaagu

SEQ ID NO: 183219 - RNA, 45 nt, Homo sapiens
cggauucuggugaggaaaugggagaggcaggccucuuauucuggu

SEQ ID NO: 183220 - RNA, 45 nt, Homo sapiens
ugcucaggaucagaaagugugugaccccgaggggcccagccacug

SEQ ID NO: 183221 - RNA, 46 nt, Homo sapiens
gaggcauauguguucaucaugagagauaggggaagggggggucugg

SEQ ID NO: 183222 - RNA, 45 nt, Homo sapiens
cuucugcugagacgcugugauugcucuguccaaaguaaacgcccu

SEQ ID NO: 183223 - RNA, 70 nt, Homo sapiens
uaacagggcucagugggggagcucaggcucccgguccuguucugggguccccgggccgcaguggccuccc

SEQ ID NO: 183224 - RNA, 37 nt, Homo sapiens
gcugcagugucauccgcgggccgaucugaggggacga

SEQ ID NO: 183225 - RNA, 37 nt, Homo sapiens
gccuggagggcaugaagaaggcacgggucggggguag

SEQ ID NO: 183226 - RNA, 54 nt, Homo sapiens
uccuguucaucaucguccucacccaacuccaggcucgccguccuugaagggauc

SEQ ID NO: 183227 - RNA, 40 nt, Homo sapiens
ugccaagucuccagggcggaagcggaagcggugggaaaug

SEQ ID NO: 183228 - RNA, 80 nt, Homo sapiens
agcuagcacguuugaagcuagacacuccgugugucugucuguguuuguucagaacugagucacgugaguugauccccaug

SEQ ID NO: 183229 - RNA, 45 nt, Homo sapiens
ucagacuggcgcgaucugcccaacaucgaggugcggcucucagac

SEQ ID NO: 183230 - RNA, 47 nt, Homo sapiens
uccgaccugccggaggugcggaauggagccucggcacuggagaucuc

SEQ ID NO: 183231 - RNA, 67 nt, Homo sapiens
cccacugacggugggguuguccguccuucucccccacaggccggucaguacggcguggcccagacua

SEQ ID NO: 183232 - RNA, 45 nt, Homo sapiens
cuucagcggcaugaaccgcuucaauucgcgcaccuacuccaaguu

SEQ ID NO: 183233 - RNA, 44 nt, Homo sapiens
acucugaggaucggguuuagccucuggccucucucccccaggga

SEQ ID NO: 183234 - RNA, 42 nt, Homo sapiens
caccguggaguauggggaggaccugcccgagugcguccaggu

SEQ ID NO: 183235 - RNA, 45 nt, Homo sapiens
agaacacccacaaguccacuccagcgagcuaccacgcagacauca

SEQ ID NO: 183236 - RNA, 46 nt, Homo sapiens
ugaggcaaaaagaaauccccaggguccuggagcagcucgaggaccu

SEQ ID NO: 183237 - RNA, 46 nt, Homo sapiens
ucacgcccacugguucugcgcugggacagacacaguccucggggcc

SEQ ID NO: 183238 - RNA, 52 nt, Homo sapiens
acagaacaagaaucgcaucucuugggucggagaagccgucaagguaacccuu

SEQ ID NO: 183239 - RNA, 77 nt, Homo sapiens
ugaaggaggcagaugacgaugaggaagucgaugauaacaucccagagaugccgucacccaaaaaaaugcaccagggg

SEQ ID NO: 183240 - RNA, 76 nt, Homo sapiens
uuaggugugucagcagccugagugugggaaauguaaagccugcaaggacaugguuaaauuugguggcaguggacgg

SEQ ID NO: 183241 - RNA, 75 nt, Homo sapiens
ccaccaccaagcuggucuaccagaucuucgauacuuucuucgcagagcaaauugaaaaggaugacagagaagaca

SEQ ID NO: 183242 - RNA, 74 nt, Homo sapiens
uaggcgagcccaggcgaggcggcagaccaucaggcauucuaccagggagaaggacaggggacccacgaaagcca

SEQ ID NO: 183243 - RNA, 102 nt, Homo sapiens
gaaccgcuucacagaggacucccuccugcgacacgcgcaguuugugguggagcagguggagaguuaugacgaggccggggacagugaugagcagcccaucuu

SEQ ID NO: 183244 - RNA, 56 nt, Homo sapiens
uuccugcagagcaauuccgacucgaccuaugaggaccugaucaacaagaucgaggu

SEQ ID NO: 183245 - RNA, 77 nt, Homo sapiens
uggaucccagucccgaguaugcgcccauauuugggcugaugcaggagaagaucuacaucagcaagauugugguggag

SEQ ID NO: 183246 - RNA, 46 nt, Homo sapiens
ggccccauaaaugaaugguggaucacuggcuuugauggaggugaaa

SEQ ID NO: 183247 - RNA, 53 nt, Homo sapiens
ggaugucugcugagugggcgcuuagagcgccuccuggguuugggaugugaguc

SEQ ID NO: 183248 - RNA, 63 nt, Homo sapiens
caaaaccaaucuaugaugaugacccaucucuugaagguaaggaauaguccgggauuauguuug

SEQ ID NO: 183249 - RNA, 53 nt, Homo sapiens
cccacagacccacccucccaagugcauucagugcgggcaguaccuggacgacc

SEQ ID NO: 183250 - RNA, 50 nt, Homo sapiens
ucugaaacaauuaaacaaacgaucuugugauuuuuuuuuuucccccagaa

SEQ ID NO: 183251 - RNA, 47 nt, Homo sapiens
cccccaaagaaccguaagaauuuauucuugacauuaucgaaagcaga

SEQ ID NO: 183252 - RNA, 66 nt, Homo sapiens
acuaucuggguguaaaacacucucuuagccuuuaauccucuuuuguuuucccuguguaggaggaga

SEQ ID NO: 183253 - RNA, 46 nt, Homo sapiens
aaaagaaccugaaaaaguaaauccacagauuucugaugaaaaagac

SEQ ID NO: 183254 - RNA, 63 nt, Homo sapiens
acagaaacugaaggaggagccggacagagaagccagggcaggcgugcaggcugacgaggacga

SEQ ID NO: 183255 - RNA, 46 nt, Homo sapiens
aaaccaaagaaccguaagugcagcgaaccugccuuugugcuuuguu

SEQ ID NO: 183256 - RNA, 58 nt, Homo sapiens
gaagagucugaaagagccaaaucggaugaguccaucaaggaagaagacaaagaccagg

SEQ ID NO: 183257 - RNA, 46 nt, Homo sapiens
gcugaaccuucaccuagccccaggauuacaaggaaaagcaccaggc

SEQ ID NO: 183258 - RNA, 54 nt, Homo sapiens
caagaagugaagcccguagagugggaauggcagaugccaacagcccccccaaac

SEQ ID NO: 183259 - RNA, 42 nt, Homo sapiens
ucaguuaugugacuuggaaaccaaauuacguaaagaagaauu

SEQ ID NO: 183260 - RNA, 42 nt, Homo sapiens
ggaacuuuaaccgugcauugcagcgcagggcccgggaagcgu

SEQ ID NO: 183261 - RNA, 48 nt, Homo sapiens
gaguugcuccugccugggaacaaccggaagguguaugaacugagcaau

SEQ ID NO: 183262 - RNA, 45 nt, Homo sapiens
agacacucagugauaugauucaggcaagugcaucauguuacucgc

SEQ ID NO: 183263 - RNA, 34 nt, Homo sapiens
ugggcagugaccguauucaagaagggaaggacag

SEQ ID NO: 183264 - RNA, 45 nt, Homo sapiens
aggggaccguggucuguucccuggacgggcuguucccagucucgg

SEQ ID NO: 183265 - RNA, 44 nt, Homo sapiens
aaugugccaggcuugggggaacccauugcccgagcucaaguguc

SEQ ID NO: 183266 - RNA, 46 nt, Homo sapiens
gcaccuaccucugucgggccaggagcacucaaggggaggucacccg

SEQ ID NO: 183267 - RNA, 39 nt, Homo sapiens
gcaggccucagcacguaccucuauaaccgccagcggaag

SEQ ID NO: 183268 - RNA, 55 nt, Homo sapiens
gccucuuccucggccuucccauauugguggcaguggugccacacugaacagagug

SEQ ID NO: 183269 - RNA, 67 nt, Homo sapiens
ccaugguaccugcacaccuaaaacacuaggccacgcaucugaucuguagucacaugacuaagccaag

SEQ ID NO: 183270 - RNA, 45 nt, Homo sapiens
ucauuuguuauuuuaccagcuauuuauugagugucuuuuauguag

SEQ ID NO: 183271 - RNA, 78 nt, Homo sapiens
cugguaaugguuacagguucagagauuacccagugaggccuuauuccucccuuccccccaaaacugacaccuuuguua

SEQ ID NO: 183272 - RNA, 42 nt, Homo sapiens
agaucacgggcugccagaagucgcgggguccagcagcaaacu

SEQ ID NO: 183273 - RNA, 45 nt, Homo sapiens
ccaucauagcccccagcagcauagauacaguugugcaggacgcag

SEQ ID NO: 183274 - RNA, 44 nt, Homo sapiens
gcugaauuaaggcgguuugucccgucaaagccccccacggcaua

SEQ ID NO: 183275 - RNA, 56 nt, Homo sapiens
gugccgcggcgaguggcacaggcuggcagccaugggcugagugcccgggacccaag

SEQ ID NO: 183276 - RNA, 38 nt, Homo sapiens
ggggcuggcuucuuguggggugauacaggggcuuccuc

SEQ ID NO: 183277 - RNA, 52 nt, Homo sapiens
ccggccccaucaagcugccaucaagggcuggcagcugccucugugggccggc

SEQ ID NO: 183278 - RNA, 46 nt, Homo sapiens
uacguugaaguugggguccucacagugcagcuccugcuggcuccag

SEQ ID NO: 183279 - RNA, 40 nt, Homo sapiens
accugcaugagcuggucgugcugggcagggucgaagucgu

SEQ ID NO: 183280 - RNA, 45 nt, Homo sapiens
uggguaggucuugaccuaggcgcaaucagaaaagcccacaagggc

SEQ ID NO: 183281 - RNA, 43 nt, Homo sapiens
ucugaggagucguccacagccagcuggacugggggaccgugga

SEQ ID NO: 183282 - RNA, 42 nt, Homo sapiens
ugucuccugcagagagggccauaggucucaggccagccccag

SEQ ID NO: 183283 - RNA, 47 nt, Homo sapiens
ccuggagucugugauuggaagucuccccgucugaguucuccucauca

SEQ ID NO: 183284 - RNA, 45 nt, Homo sapiens
uguucuguuauagaagguggcaucuuucugauaaaugcggggguc

SEQ ID NO: 183285 - RNA, 45 nt, Homo sapiens
gucgcuugaguccgacucggagcuggagucgcugcugcugucucg

SEQ ID NO: 183286 - RNA, 40 nt, Homo sapiens
ccgccgccgcccuccugccacagcccgccggggucugccc

SEQ ID NO: 183287 - RNA, 45 nt, Homo sapiens
ggaagagaguuaacggccgagcgcgggagcgaggccggcaaggga

SEQ ID NO: 183288 - RNA, 43 nt, Homo sapiens
ucuugcaacagguguccugcucuguaaaacgguuguggugagg

SEQ ID NO: 183289 - RNA, 25 nt, Homo sapiens
uuggaggguccugaggccugaagag

SEQ ID NO: 183290 - RNA, 46 nt, Homo sapiens
gacccugucggucucugcuucaaucuccugccggacuucaucaaag

SEQ ID NO: 183291 - RNA, 43 nt, Homo sapiens
ggaggcuggucgcccacaggcaccuuggugauacccgggaggu

SEQ ID NO: 183292 - RNA, 30 nt, Homo sapiens
cgcaggacaggagacagagagaagagaaga

SEQ ID NO: 183293 - RNA, 51 nt, Homo sapiens
cccccuuugaauaugcaaaguuaggguuguggguaaaucagggaagagcag

SEQ ID NO: 183294 - RNA, 42 nt, Homo sapiens
gcccuaucugcacacccaggcccugggagcagcgaggcccug

SEQ ID NO: 183295 - RNA, 63 nt, Homo sapiens
uuccaugacugaaugacaaccaggugagggaaaacagggagacaggcugucggugcuccccca

SEQ ID NO: 183296 - RNA, 114 nt, Homo sapiens
augagcagacaggacucucacaguuguuuggagcaggcagugaccccuggcaucuggccauucacgggcugccugguggugggugagggggcugaggccagcagccccugugag

SEQ ID NO: 183297 - RNA, 55 nt, Homo sapiens
aagagcgcugugcacaagcucggcaagugucugaguuucuuuguuucuguuggau

SEQ ID NO: 183298 - RNA, 46 nt, Homo sapiens
uggggggauccgaacuggccgagaugggaucugaggcggggcuggg

SEQ ID NO: 183299 - RNA, 57 nt, Homo sapiens
gccaggacagaccggcccccgagggggcagccagacaggugggaggggccucccacg

SEQ ID NO: 183300 - RNA, 51 nt, Homo sapiens
ccuauaacaaagggugguguggccugggcauuggagucaauaaauuauggu

SEQ ID NO: 183301 - RNA, 63 nt, Homo sapiens
ugccaggaagggggccuggaagaccaccugccccggccccucuccugcaggggccccacacag

SEQ ID NO: 183302 - RNA, 46 nt, Homo sapiens
aguuaguaaaauugagugggauuaugagugugagccagggaugguc

SEQ ID NO: 183303 - RNA, 37 nt, Homo sapiens
ucaccagagagcuggaagagcucaaggagauugaggc

SEQ ID NO: 183304 - RNA, 42 nt, Homo sapiens
gaggcuggggaggaggacacccgucugaaggccagccuccua

SEQ ID NO: 183305 - RNA, 42 nt, Homo sapiens
ccagagccuucucaaugcgaaggagcaggugcaccagggagg

SEQ ID NO: 183306 - RNA, 44 nt, Homo sapiens
gugguggagcggcugcuggaaacgcaagacggugccgagaagca

SEQ ID NO: 183307 - RNA, 101 nt, Homo sapiens
uguaccuaaggacuugccugaguuuaucgcugaaaaucuuguaucccaggaaucccuucaguccugggcaaaccaggaugguugguuacccuagacacgaa

SEQ ID NO: 183308 - RNA, 47 nt, Homo sapiens
ccccauuggggagggguggaggaaggacauguacccuuucaugccua

SEQ ID NO: 183309 - RNA, 43 nt, Homo sapiens
gggauugugugguuucgggagguccgcgggugugugugugugu

SEQ ID NO: 183310 - RNA, 57 nt, Homo sapiens
gcaccuugucucuccccugugacuguuggugugaauaagagacuguuagugugugug

SEQ ID NO: 183311 - RNA, 41 nt, Homo sapiens
ugagcccuaaagcgcuggggacuggggguagccuuggggga

SEQ ID NO: 183312 - RNA, 46 nt, Homo sapiens
ccacgaagacaaagcaggggaugauggagaaacuccucuucagaug

SEQ ID NO: 183313 - RNA, 50 nt, Homo sapiens
aggacuccagcugaggccacagaggcagagauacagagauggagaaacau

SEQ ID NO: 183314 - RNA, 42 nt, Homo sapiens
ccugaccucucucuucucucuccgccaccucuccccgcccug

SEQ ID NO: 183315 - RNA, 44 nt, Homo sapiens
ugccucuugggucagagagcuggugagggucuuccaugcuggga

SEQ ID NO: 183316 - RNA, 43 nt, Homo sapiens
gcagcaggggcgugggcagcagcagcuuccggccacguccacc

SEQ ID NO: 183317 - RNA, 63 nt, Homo sapiens
ggggcaagcccuacuuaaguaggggauuaggagagagugggugagagguggagaggccgcaca

SEQ ID NO: 183318 - RNA, 34 nt, Homo sapiens
uucccacagcccuaauaaauaacagaaggguuug

SEQ ID NO: 183319 - RNA, 58 nt, Homo sapiens
ucaccgcuggaacgcgaccccaaacaucaggcugggauaacaacgccuccaaaucgag

SEQ ID NO: 183320 - RNA, 24 nt, Homo sapiens
uuucagggagucugggacaugcua

SEQ ID NO: 183321 - RNA, 73 nt, Homo sapiens
uuggggccccaagcuggguagcaggagguugucagauacccuguucagggccaagguggggguggaguggggu

SEQ ID NO: 183322 - RNA, 85 nt, Homo sapiens
ucccguccaugucaucauccagcuccuugaaggcaucagccgccagcuccugcuccuguugggccuuggcagcagccagcugcuc

SEQ ID NO: 183323 - RNA, 54 nt, Homo sapiens
uccagcuccgggugagucugcagcucagucaccgagacccugcgggggcguggc

SEQ ID NO: 183324 - RNA, 48 nt, Homo sapiens
gauggcggcccagacgcggucguagaaagagguggcgucugucugugu

SEQ ID NO: 183325 - RNA, 57 nt, Homo sapiens
cuugggcuccgucaagucaggggcagaaggugcuggaaggucggugggcagugccug

SEQ ID NO: 183326 - RNA, 42 nt, Homo sapiens
uggccggcugcgggggugacaguggcgguggggccuccuggg

SEQ ID NO: 183327 - RNA, 42 nt, Homo sapiens
ugguggagcgguuggggcccugccagcagcccgugccuugcu

SEQ ID NO: 183328 - RNA, 44 nt, Homo sapiens
uccccacuaggagggguggcagggacagggcugggggugguggg

SEQ ID NO: 183329 - RNA, 45 nt, Homo sapiens
aaaucacgacagaguccauguuggaggugauaaaaaacuguaaaa

SEQ ID NO: 183330 - RNA, 33 nt, Homo sapiens
guuucuuuuuucggcuaaaaagaaugcagagau

SEQ ID NO: 183331 - RNA, 55 nt, Homo sapiens
cccaccccgccugcccucccacccccuccccgggcagcagagagagagagagaga

SEQ ID NO: 183332 - RNA, 45 nt, Homo sapiens
auggaggcauacacucucacaacucacugucucaacucacugucc

SEQ ID NO: 183333 - RNA, 44 nt, Homo sapiens
ggaguuugguccauccuugcccuugggaaacccaugucauggag

SEQ ID NO: 183334 - RNA, 93 nt, Homo sapiens
ggugggacucuagcaucgaaggugucaucuggaaacaggaagguggaaacuugguggggaggggacagucucucaggccugaggugggacacu

SEQ ID NO: 183335 - RNA, 46 nt, Homo sapiens
gcagcauuggcgacaucgaguccugcaaguugguucgggacaagau

SEQ ID NO: 183336 - RNA, 23 nt, Homo sapiens
aggugggggggggcccggccggc

SEQ ID NO: 183337 - RNA, 37 nt, Homo sapiens
agcgaggcagggaacgagggaugccccugggcccagc

SEQ ID NO: 183338 - RNA, 40 nt, Homo sapiens
ugcuugcuaaagaaggaggagaaggaggagccaguagccc

SEQ ID NO: 183339 - RNA, 41 nt, Homo sapiens
ggccagcggagcggccgccacgggugagggggccuggcccc

SEQ ID NO: 183340 - RNA, 36 nt, Homo sapiens
cgagggcacgggcuguggcccgaggaggcgguggac

SEQ ID NO: 183341 - RNA, 59 nt, Homo sapiens
accaccaggaagaagacgacaaccugcagcgacagcagcagggccagagcuagucugag

SEQ ID NO: 183342 - RNA, 42 nt, Homo sapiens
cacauugacuucaucuaccuggcccugcgcaagaugcgggag

SEQ ID NO: 183343 - RNA, 46 nt, Homo sapiens
ugaugggggacuucagcccuaguggcauuuucggagcguuucaaag

SEQ ID NO: 183344 - RNA, 39 nt, Homo sapiens
ccgcaaauaccacugaagaggacacgcucugcacccccc

SEQ ID NO: 183345 - RNA, 44 nt, Homo sapiens
uggaagagacccgggucgccuccggagcuucaaaaacaugugag

SEQ ID NO: 183346 - RNA, 45 nt, Homo sapiens
gaagacgaaaggaaacaaggugaacgugggagugaaguacgcaga

SEQ ID NO: 183347 - RNA, 46 nt, Homo sapiens
cgccaggucuacgaccccaaguacugucugacucccgaguacccag

SEQ ID NO: 183348 - RNA, 45 nt, Homo sapiens
aguggguacccccaggaccagaagcucccccagcaaagcccccag

SEQ ID NO: 183349 - RNA, 32 nt, Homo sapiens
aagacguacauacacacucacacgcacccuaa

SEQ ID NO: 183350 - RNA, 41 nt, Homo sapiens
gacagcugucaaucacaagcccuuaaauaaagcagccagcg

SEQ ID NO: 183351 - RNA, 53 nt, Homo sapiens
guguguguguguguguguguguguguguguguguguguguagugggugugcgu

SEQ ID NO: 183352 - RNA, 47 nt, Homo sapiens
caugaccaccuuggcaaugucucugcccagauugcauacucuaagau

SEQ ID NO: 183353 - RNA, 36 nt, Homo sapiens
auggugccaccccugcccugcgcuuuguagccgugg

SEQ ID NO: 183354 - RNA, 58 nt, Homo sapiens
acuuccuggaaaagggaagcccguugguguuuaugugugggauggagagagggcaggg

SEQ ID NO: 183355 - RNA, 45 nt, Homo sapiens
cgcagggacugaagggacuccugaauguccgcgggacgugucgcg

SEQ ID NO: 183356 - RNA, 46 nt, Homo sapiens
cauacaaauuuuuugagguuauccucauugauccauuccauaaagc

SEQ ID NO: 183357 - RNA, 87 nt, Homo sapiens
cguguucgccgugguggccgaaaacgcccaguuccuaagggugcaacuuacggcaagccuguccaucaugguguuaaccagcuaaag

SEQ ID NO: 183358 - RNA, 41 nt, Homo sapiens
cagguuacaucagagaacucacacaggggaaaaacccuaug

SEQ ID NO: 183359 - RNA, 46 nt, Homo sapiens
cucauuauccaucagagaauucacacaggggaaaagcccuauggau

SEQ ID NO: 183360 - RNA, 51 nt, Homo sapiens
gucaugauagauuuuucuggcaaauuguaaucaccaacagcaacacaucaa

SEQ ID NO: 183361 - RNA, 55 nt, Homo sapiens
uucugagaccuaagucaauuugugugaugggauaaggggugauaauugaugggau

SEQ ID NO: 183362 - RNA, 99 nt, Homo sapiens
aggugaggguggcgugcagguggugcugugucgaggagggaacgggcaagaggagcagagccagugagugcaggcauuucuuaguuugguccuaaugga

SEQ ID NO: 183363 - RNA, 32 nt, Homo sapiens
agaaagaaaacuuucgagaaggaaggcauggu

SEQ ID NO: 183364 - RNA, 49 nt, Homo sapiens
acuacauacaaugaggacaccaguaugauaggggguaggauaaugcugu

SEQ ID NO: 183365 - RNA, 64 nt, Homo sapiens
ucugacucagagugacaaggaugugacuuguucaacauucucuucucaaacacugaccaaggaa

SEQ ID NO: 183366 - RNA, 53 nt, Homo sapiens
cagaugaagauaggagcagcuccaguuccucugaagguaaagagaaacacaag

SEQ ID NO: 183367 - RNA, 45 nt, Homo sapiens
cccauguaugacaucauacgagacaauaaacgacaugaaaaggac

SEQ ID NO: 183368 - RNA, 50 nt, Homo sapiens
gggugacaaagaaugcccuuucuuuaucaaaggcaaccaaaaguuagagc

SEQ ID NO: 183369 - RNA, 42 nt, Homo sapiens
cucaugcaccaacuaaaggacuuuggaugccacuggggaaag

SEQ ID NO: 183370 - RNA, 39 nt, Homo sapiens
ugauguguuauguuuacauuaacaugguugauaagguuu

SEQ ID NO: 183371 - RNA, 41 nt, Homo sapiens
gaacauacuucaguuuucuaaucuguauuuaguaguuaaau

SEQ ID NO: 183372 - RNA, 32 nt, Homo sapiens
cgcgccgcggggguugcccgagcggcgcugcg

SEQ ID NO: 183373 - RNA, 52 nt, Homo sapiens
ugaaauaaacaaacacuaggagcacaaaguguaugagauucugugaguacuu

SEQ ID NO: 183374 - RNA, 62 nt, Homo sapiens
ggaagaugaggaagaugaagaggaugaggaggaggaggaagaugaagaagaugaagaagaag

SEQ ID NO: 183375 - RNA, 62 nt, Homo sapiens
uaauauugaggaagaaaugaaaagacagguugcggaaagauauauaugacauaccauaaaua

SEQ ID NO: 183376 - RNA, 81 nt, Homo sapiens
ugaggaaaugaauggacacaggaacuacuggguaacaaaauacuaauaaagggcugcgauugugugaguuucuacuguagc

SEQ ID NO: 183377 - RNA, 52 nt, Homo sapiens
cccccacucucuguggaggaugauuuugagaaacuaacaugggagauuucag

SEQ ID NO: 183378 - RNA, 43 nt, Homo sapiens
uuuucugagccguguuagaauggaagcuacagaggcuucaguu

SEQ ID NO: 183379 - RNA, 62 nt, Homo sapiens
gcuccagaaacuaacacugacgaaacaccaaagaaagcucaaguuuccaagucucuuaagga

SEQ ID NO: 183380 - RNA, 45 nt, Homo sapiens
cagucaauauaaagcaaggugaauguuugcauuuuggaauaaaaa

SEQ ID NO: 183381 - RNA, 46 nt, Homo sapiens
acugugaagcugcacuaggcaaugaaacuguuugcacauuauggca

SEQ ID NO: 183382 - RNA, 40 nt, Homo sapiens
uauuucuacuucuggacugccucaauaucaagggcugaga

SEQ ID NO: 183383 - RNA, 52 nt, Homo sapiens
cucuuugagcuuggcuguuugugguucuuucauggguuuauggcgggcugcc

SEQ ID NO: 183384 - RNA, 46 nt, Homo sapiens
acaaggcugguggccgcgcggcugaugguccgcaaugcagcagugg

SEQ ID NO: 183385 - RNA, 46 nt, Homo sapiens
gagugaugcugccucucuucugaccuccgcuaagaaacagggagau

SEQ ID NO: 183386 - RNA, 41 nt, Homo sapiens
ggcuucggaggggucuacauacaaacagaugugggcggguc

SEQ ID NO: 183387 - RNA, 44 nt, Homo sapiens
uugacuuugcugcccgagagauggcuccaaauauggcagagugg

SEQ ID NO: 183388 - RNA, 74 nt, Homo sapiens
gaagugaagaaacuuggggcuugguuguuguuggguugguugguuuuuaaucauaacaguaggucauaaaagca

SEQ ID NO: 183389 - RNA, 87 nt, Homo sapiens
ugagaaggaccaaggacagaaccgagaagaguuuaggggcagguuaugcgagauggaaauggcgcagauaacggagggaaggauuug

SEQ ID NO: 183390 - RNA, 46 nt, Homo sapiens
uaaaguccccugcagcgugaccaugucgagaccccggaagaggcug

SEQ ID NO: 183391 - RNA, 45 nt, Homo sapiens
uggaaacaauauauagucuaauauauagacuaggaaaucaacucu

SEQ ID NO: 183392 - RNA, 29 nt, Homo sapiens
caaaacaaaagcuuugaaucaucugccug

SEQ ID NO: 183393 - RNA, 67 nt, Homo sapiens
uacugcugcuggaaugggcgagacauugcugcaaagaagucaagcuuuuuucagacaaaagguguga

SEQ ID NO: 183394 - RNA, 47 nt, Homo sapiens
ugauuaaagaaagccccuguggcuuuggaggcauugugcccacgguc

SEQ ID NO: 183395 - RNA, 49 nt, Homo sapiens
agcagaaccgaggaaggcaagguuguuucccccacgcuguguccugugu

SEQ ID NO: 183396 - RNA, 31 nt, Homo sapiens
ugcaggaagugguguuguggcggaaggguga

SEQ ID NO: 183397 - RNA, 44 nt, Homo sapiens
aaucauuuacauucuucauuggcucuuuagccaucccucaggaa

SEQ ID NO: 183398 - RNA, 352 nt, Homo sapiens
accucggccgggcacgguggcucgcgccuguaaucccagcacuuugggaggccaaggcgguuagaucacgaggucaggagaucgagaccauccuggcuaacauggugaaaccccaucucuacuaaaaauacaaaaacaauuagcugggcgugguggcagaugccuguagucucagcuucuugggaggcugaggcagaagaauugcuugaacccaggaggcggagguugcagugagucgagaucacacuacugcacuccagccugggcgacagagcgagacucugucucaaaaaacaaacaaaaaaagcucacuugugcagggccagguucuaggaagcaccagggagcuggg

SEQ ID NO: 183399 - RNA, 54 nt, Homo sapiens
accaagcaaggaaaauaacaucacuuggugagaauguugggcaugccaggggau

SEQ ID NO: 183400 - RNA, 60 nt, Homo sapiens
uggugguaccuuaccaguaugugaaagauaacccagaaugucuucugccccagacagugu

SEQ ID NO: 183401 - RNA, 32 nt, Homo sapiens
cccucccccagcgccgacagccggccggggag

SEQ ID NO: 183402 - RNA, 51 nt, Homo sapiens
agccuugcccucaagaaccccaacaagcggcuggagcaccagggcaucaag

SEQ ID NO: 183403 - RNA, 45 nt, Homo sapiens
aaauccuucugaacgaugcagagaguaggaagcgggccgagcaca

SEQ ID NO: 183404 - RNA, 50 nt, Homo sapiens
ugccgaccgcuggagcgccggccgcgcucucccugcgcaugcgcagcgag

SEQ ID NO: 183405 - RNA, 42 nt, Homo sapiens
cuaacagcguuuuucccgccucguuuuucuucaaugggggaa

SEQ ID NO: 183406 - RNA, 52 nt, Homo sapiens
guuucuucuuaaaggcucugcugaucgguguugcaguguccauuguggagaa

SEQ ID NO: 183407 - RNA, 29 nt, Homo sapiens
cucggacagagcuagacacucauucagaa

SEQ ID NO: 183408 - RNA, 46 nt, Homo sapiens
gcuguacuggcccugaucacguugggcaucugcugugcauacagac

SEQ ID NO: 183409 - RNA, 25 nt, Homo sapiens
ugugaaguuaggaguuauggugucc

SEQ ID NO: 183410 - RNA, 53 nt, Homo sapiens
aauucccugcauaguuuuccaugugucgcuugcuugaaggaacggcugccaga

SEQ ID NO: 183411 - RNA, 45 nt, Homo sapiens
ugcccacggauuccagagccaaucccagauuucgcaauucuucuu

SEQ ID NO: 183412 - RNA, 42 nt, Homo sapiens
ugaggucguugcucgaaaugaccgcaaggaaauugaugagau

SEQ ID NO: 183413 - RNA, 46 nt, Homo sapiens
ggacuaggcugacagacccggcucuccgcucccuucggcgccaggu

SEQ ID NO: 183414 - RNA, 44 nt, Homo sapiens
ggucgggguaacugcuccgggaccgcggggcccaaggccggucu

SEQ ID NO: 183415 - RNA, 51 nt, Homo sapiens
uaaagaagugccaucuuuuucuuucuguaccagagaaaaagcagaagggga

SEQ ID NO: 183416 - RNA, 40 nt, Homo sapiens
auuagaagccuccuaaguaaugagggaacccucuuuacaa

SEQ ID NO: 183417 - RNA, 42 nt, Homo sapiens
cgaaagaaaucacugcaagcugcuaguaccaccuuaugugcc

SEQ ID NO: 183418 - RNA, 45 nt, Homo sapiens
gugcuggcaacacugaacauuugcauauagcuggcugcugcuaga

SEQ ID NO: 183419 - RNA, 42 nt, Homo sapiens
aacaauguagcuuuugcgcuuucuccgggauucucggcagac

SEQ ID NO: 183420 - RNA, 50 nt, Homo sapiens
augcucacuucacuucugccaaaaguccauucuuuauaacuuuuuuggca

SEQ ID NO: 183421 - RNA, 46 nt, Homo sapiens
ugugcugcuuuagguucugaauacgggugaaucgcaccccgcaggu

SEQ ID NO: 183422 - RNA, 46 nt, Homo sapiens
ucagguuaauuaucacuuucauuauaacucuggacaccuuaacagc

SEQ ID NO: 183423 - RNA, 53 nt, Homo sapiens
aguuucucauuagucuuaauaauuuuuuucucccagauuuaugagucauagau

SEQ ID NO: 183424 - RNA, 60 nt, Homo sapiens
caugucuaugaggaauauuaaaacuaagcauacucccacaggcuuuaaacucaaacuaug

SEQ ID NO: 183425 - RNA, 44 nt, Homo sapiens
gagaagcauaaugagaaagucagacugagguaauaagaccagaa

SEQ ID NO: 183426 - RNA, 63 nt, Homo sapiens
uaaaaaaaaaaucuuuaaacuggccuuuauuacauggucacacauaaaguugcaguuaggaaa

SEQ ID NO: 183427 - RNA, 41 nt, Homo sapiens
gcaggaccuuagcaagccccaccccaagucuucauccacuu

SEQ ID NO: 183428 - RNA, 36 nt, Homo sapiens
cauguugucaaacuccuccuggagaaguguauggua

SEQ ID NO: 183429 - RNA, 31 nt, Homo sapiens
ugucauuugaacauuauauuugagugugaua

SEQ ID NO: 183430 - RNA, 45 nt, Homo sapiens
gauaaagguugucagauuuauuuuuuaaaguacuuaaccagaguu

SEQ ID NO: 183431 - RNA, 54 nt, Homo sapiens
acacugguaacauucuaguaucaaggagaauuccauucaucaugacauucacau

SEQ ID NO: 183432 - RNA, 35 nt, Homo sapiens
gaagcugaacaagacacagccccugcugucaagga

SEQ ID NO: 183433 - RNA, 26 nt, Homo sapiens
cuuuccacagaugcugguccucagug

SEQ ID NO: 183434 - RNA, 42 nt, Homo sapiens
cuuugccucccauucugugguugugguggugguaagaaggag

SEQ ID NO: 183435 - RNA, 23 nt, Homo sapiens
acuauugagagagagagagagaa

SEQ ID NO: 183436 - RNA, 32 nt, Homo sapiens
uaauaaaauacacugaacaugucagcaagagu

SEQ ID NO: 183437 - RNA, 42 nt, Homo sapiens
aagacacauugacacuguagacuucauucaguccagugugag

SEQ ID NO: 183438 - RNA, 44 nt, Homo sapiens
gcuggcaacaagaucaacugugggcccgcccuuaccuggaugga

SEQ ID NO: 183439 - RNA, 131 nt, Homo sapiens
aaguuuaacugaaauaauagcuuaguucggugguuuuuauacuuuuucuuuuaauccaguggaauuacuaaucaaacagaaucaugcgcagaaccucagugcaagaaaaaguaaccauggagcugcccuga

SEQ ID NO: 183440 - RNA, 48 nt, Homo sapiens
guguuuaaauuauacugugacucucuuucuuuucuuaaacuucuggga

SEQ ID NO: 183441 - RNA, 60 nt, Homo sapiens
cgugauaaaaaguagaugaguaauugcccgaggagcagugaugggaggauagggggaagg

SEQ ID NO: 183442 - RNA, 53 nt, Homo sapiens
ggacaguauaaauaaggcaaagaaaccagaagcaauguugugcuuuuggggga

SEQ ID NO: 183443 - RNA, 27 nt, Homo sapiens
uaaguuggcaacagagguaucaacaua

SEQ ID NO: 183444 - RNA, 28 nt, Homo sapiens
acaugcacucaaauuuuuaggcaauugc

SEQ ID NO: 183445 - RNA, 45 nt, Homo sapiens
uauuacaaauaaagcauuguugaaggggauaaaaaucaagaaaau

SEQ ID NO: 183446 - RNA, 42 nt, Homo sapiens
cccuucuguuucuugugugucaaguguuuaaaagagugcagg

SEQ ID NO: 183447 - RNA, 59 nt, Homo sapiens
gauaaccuccagaaccauuuagcauugggaaaguuaaucaguuauugauaguucuggaa

SEQ ID NO: 183448 - RNA, 53 nt, Homo sapiens
ucuuuuuuuuuuuuuuuuguuuucaguuuggauacuuucuguuguccuaucau

SEQ ID NO: 183449 - RNA, 42 nt, Homo sapiens
uucuucaauucucguauuuuucuuuucucgcauaaagcuaaa

SEQ ID NO: 183450 - RNA, 44 nt, Homo sapiens
uaaacccauaugcccuuuagucagugcugggaguagcccccuaa

SEQ ID NO: 183451 - RNA, 51 nt, Homo sapiens
ucaggaggaaggccagguuggcuagagcagugggugaagacauaagaugag

SEQ ID NO: 183452 - RNA, 46 nt, Homo sapiens
auagguagaagaagaggggcuggcaguggcuguugaaaugagccag

SEQ ID NO: 183453 - RNA, 56 nt, Homo sapiens
caucucucugccuuagucuccucaucuauaagaugagauaauaauagaacugccuu

SEQ ID NO: 183454 - RNA, 63 nt, Homo sapiens
ucaauaaauacauaauuggguuaacacaguucaguauuauuauuuaguagaaguauugaaucu

SEQ ID NO: 183455 - RNA, 45 nt, Homo sapiens
uuaaguauugaucuuaaaacuuguaccacaacaagagguaaggag

SEQ ID NO: 183456 - RNA, 61 nt, Homo sapiens
uggaagauagaaaucuaaaaugucuuagguuaaguuuauauuuaagaaaauuagagcagga

SEQ ID NO: 183457 - RNA, 51 nt, Homo sapiens
ugaaguuagacaaaaagaauuaaaaggauuggaagggaagaaucaaaugug

SEQ ID NO: 183458 - RNA, 62 nt, Homo sapiens
agaugucuaaucuuguguagaauagcccaucuaguguucuaucuaggccauaaguuacucua

SEQ ID NO: 183459 - RNA, 7888 nt, Homo sapiens
ggauucacucacuacuguauaauaggggaggggcaaaggaagauggccaaauaaaaggcuccacugauuguuuccccuugaggagcaccaaauuucacaacuauacgcauaaaaaaauacccucaaagaaaccaaaaaucaggugagcacucauaguaccugauuuuaccuuccuauugcugaaagaagcacuagagaggguaagaaaaacagucuuaaaucaccuuugccacccccucccccauccccugguaguggcccuguggcacagagagagaaucugugcucucucuugagggagaacuuaggaauuuugggacuuugccuugaauccagugcugcccugucacaguggaaagcaaaaccagcuugaacuuaggugaugccuacccauggaggggccauuuagacagcccuagacagaggggaaaucugucccagccgucagaacuuagcugcaacaagccucaccacugcaagcuaaagugcucuggggccuugaauaaauuugaaaagcagucuaggccgcaaggacugcaacuccuaggcaagucuuaaugcugaacugggcccagagccaauggacuugaggggcacaugaccuacugagacaccagccaggguggcuaagggagugcuugugccaccucuccccuuacccuaggcaggacgguuugugacuccaaaacagaucccuucuuucugcuugggaagagaagaaggaaaauuaaagaggacuuugucuugcaucuuggauaccagcucagccaugguaggaaagggcacuggugagaguugugaggcccccauucuagccuagcuccuggaccacauuucuagauacaccuggggccagaagggaacccacugccuucaagggaaggacucagucuuagcaggccucaucaccugcagacuaacaagcccucggacccugaauaaccagcagugauaccuggguaguaugccaugggccaugggugagacucugagauaugcuggcuucaagugaaagccagcuuauuccuagcugugguggcuauggugaaagacuccuucugcuugggaaaaguaaaggggacuuugucuugcaccuuagguaccagcuuggccacagugggauagggcaccaugcagacucuuggggacucugauucuaggccuuggcucuuggucagcauuucuagacccgcccugggccagaggggagcccacugccgugaaggauaaguuccaggccuggcagcauucgccacaagcugacaagagccuuugggccuuaagugaacaucaaugguaaccuggcaguacucccuguggcccugugguggugguggccaugggauggggcuccucugccuauggaaaggggagagaagaguaggaaagacugugucucaugguuugagugccagcucagcugcaauauaguagaacaacagguagauuucugaagcuuuugacugcagucccuggcuccuggacaacaucucuggacccaccuagggccugggggaacucacugccuugaaaggaacaacacagcuuggcuggcuuuaccaccugcugauuauacaguccuagguccuugaacaaacacaggcaguagccagguagcaguuacagugggcuuugggcaagacccagugcugugcuggcuuuggguuugacccagugccgucccaguggugguggccacaggggugcuuguuucaccccagcuccagguagcuuaucacagagacagagagagacuuuguuuauuugggagaaaguaagagaagaaaacaaaagucucugaccgguaauccagagaaugcuucuggaucuuaucgaagaccaccaaggcaguaccucuacaaaucugcaggaacuacagcauuauugaauugggguguccacuaaugcagauacagcuugcauugugaugcagaucacaacacccaacuucuuuugaauaccuggaaaacuuuccuaagaaggacagguacaaacaagcccagacugaagacuacaauaaauaccugacucuucaaugcucagacacugacaaacauccacaagcaucaagaccauccaggaaaacgugaccccaccaaaugaaguaaauaaggcaccagggaccaacccuagaggugugugaccuuucagacagagacuucgaaauagccauuuugaggaaacucaaagaaauucaagguaacacagaaaaggaagucagaauucuaucagauauguuuaagagauugaaauaauuaagaagacucuagcaaaaguucuggaguucagaaaugcaaucgaaauacugaagaauauaucagaauauauuaauagcagaauugaucaagcagaagaaagauuaguaagcuugaagacaggcugaaaauacacaaaggagacaaaaggaaaacgaauuaagcaugccuauaagaucuagaaaauagucucaauugggcauaucuaaguuacuggccuuaaagaggagacagagaaagagauagggguagaaaguuuauucaaagagauaguaacagagaauucccaaaaugaaagauaucgcuauccaaacacaagaaguuuacaaaacacuaaacagauuuaacccagaaaagacuaccucaagacauuuuaauaauaauacugccaaaggucaaggauaaagaaaggauacuaauagcagcaagaaaaaagaacauacaauggagcuccaguauaucuggcagcagacuuuucaguggaaaccuuacagauugagagagaaugaguggcaugacauauuuaaagugcuaaaggaaaaaaacuuugcccuagaguaguauaucuggugaaaauauccuucaaacaugaagaaguaguaaagacuuucccagacaaaugaaagcugaggaauuucagcuuguagaccuguccuauaagaaaugcuaaagggaauacuucagucagaaagaaaacgacauuaaugaacaauaagaaauuauaugaagauacaaaacucacugguaauaguaaguacacagacauggaauauuauaacacuaacugugguguguaaacugcucuuaaguagaagacuaaaugauaaaccaauaaaaaauaauaacuagaacuuuucaagauguagacaguauaagauauaaauagaaacaacaaaaaguuaaaaacagaggaugaaguuaaagcauacagucuguuaguuuucuuuuugcuuguuuaucuaugcaaacaguguuguuaccagcuuaaaaaugaguauaagguaguauuugcaagccucaugauaaacucaaauccaaaaauauacaaugcauacacaaaaaguagaaaguaagaaauuguaucauaccaccagagaaaaucaccuuuacuaaaaggaagacaggaaggaaggaaagaaggaaaagaagaccacaaaacuaccaguaaacagauaacaaaaugguuggaggaagucugaacuuaccgauaauaacaucaaauguaaauggacuaaacucuucaauaaaagacauagaguggcugaauggaugaaaaaacaagacccaguggccugucgccuauaggaaacacacuucaucuauaaagauacacagagacugaaaagaaagggauggaaaaagauauuccaugucaauggaaaccaaaaaagagcaggaguagcuauacuuacauaagacaaaauagauuucaagacaaaaacuauaagaagagacaaagaaugucacuauaugguaauaaaggggucaauuuagccaaaagauauaacaacuguaaauauauaugcacccaacacuagagcacccagaaauaucaagcaaauauuguuagagcuaaagagagagauagaucccaauacaauaauagcuggagacuucagcaucccacuuucagcauuguacagaucuuccagacagaaaaucaacauaggaccuaaucugcacuauagacuaaauagaccuaauaaauauuuacaggacacuucauccaacagcugcagaauacauauucuucuccucagcauguggauuauucucaaggauagaccacauguuaggucacacaaaucugaaaguauucaaaaaaaaaaaaaaaaaaaaggaaagcauugaagugauaucaggcaucucuggccacaacagacuaaaauuagaaaucaguaacaaggaauuuuggaaacuauacaaacacauggaaauuaaauaauauacuccugaaagacggugagucaaugaagagauuaagaaggaaauugaaaaaauuucuggaaacaaaugauuacagaaacaacauaccaaaaccuaugggauacaauaaaagcuguacuaagagggaaauuuauagcuauaaguaccuacaugagaaacaagaaaaacacccuagcaauguauuuuaaagaauuagaaaagcaagaauaaaccaaacccaaauuaguagaagaaaaagcaauaaugaaagaucagggcagauacaaguuaaacugaaaauaaaacaacaaagaucaacaaaagaaaaaguugauuuuuugaaaaguuaaacaaaauugacaaaccuuuagccagacuaaggaaaaaaaaagaagacccaaauaaagaaaaucagauaugaaaaaggagacauugcaacugacacugcagaaauucaagggaucauuaguggcuauuaugagcaacuauaugccaguaaauuggaaaaucuagaauaaguggauaaacuccuagacauguucagccuaccaagaucaaaccaugaagaaauccaaaaccugaacagaccaauaacaaauaaugagaucaaaauuauaauaaaaagucucccagcaaagaaaagcccaggacucaauggcuuaacugcugaauuuuaccaaacauuuaaucaaagaagaacaaguaccaauuguacucuaacuauucagaaaauagaggagagaguacuuccaaacgaauucuacaaagccaauauuacacugauaccaaaacaaaugacacaucaaaaaaagaaaacuacaggccaauaucacugaugaauauugaugcaaaaaauucucaaaauacuagcaaacugaauucaauaacacauuaacaaggucauucaucauggccaagugggauuuaucccagggaugcaaggauaguucaacauacauaaaucaauacaugcgauacaucauaucaacagaaugaaggacaauaccauaugaacauuucaauuaaugcugaaaaagcauuuaauaaaaauucaacaucccuuggccgggcacgguggcucacgccuguaaucccagcacuuugggaggccgaggcgggcagaucacgaggucaggagaucgagaccaaggugaaaccccgucucuacuaaaaauacaaaaaguuagccgggcguaguggcgggugccuguagucccagcuacucgggaggcugaggcaggagaauggcgugaacccgggaggcggagcuugcagugagccgagaucgcgccacugcacuccagccugggugacagagcgagacuccgucucaaaaaaaaaaaaaaaaaaaaaucaacaucccuucaugauaaaaccccucaaaaaauauauauagaaggaacaugugucagcauaauaaaagccauauacuacagacccauagcuagcaucuuacugaauggagaaaauuuggaagucuuuuaacaucaggaacaugacaaggaugcccacuuuuaccacucuucuuuaacauaguauuggaaguucuggcuagagcaaucagaaaagagaaagaaauaaagggcacucaaauugaagaagcagcagccaaauuauccuuguuugcagauaauaugaucuuauauuuggagauccuaaauacuccaccaaaaaacuauuugaacugauaaaacaaauucaguaaaguggcaaauacaaaauuaacaugaaaaaaucaguagcauuucuguaucccaacagugaacaaucugaaaaagaaaucaagaaagcaaucccauuuauaguagcuacaaauaaaauaaaauaccuaggaauuaaccaaagaaaugcaagaucuuuaugaugaaaacuauaaaacacugaugcaagaaauggaagagaacacaaauaaauggaaagguauuccacguucauggauucggagaguccauauuguuaaaaauguccauauuacccagaccaaacuacagauuuagugcaauuccuaucaaaauaccaaugacauacuucacaggaauagaaaaaaauauacuaaaauuuauauggaacuaaauaauagccauagcaauccuaagcuaaaagaacaaaacuggaggaaucacauuaccugacuucagauuauauuacagaguuacaauaaccaaaacagcaugacauaaaaacagacacauggaccaacggaacagaauagagaacccagaaacaaauccacacaccuacagugaacucauuuuuaucaaaggugccaagagcauacauuggggaaauaacagucucuucaauaaauagugcugggaaaacuggauauccaugugcagaagaaugaaacuagaccccucuuucucaccuuauauaaaaauuaaguccaaauggauugaagacuuaaaucuaagaccucaaacuauaaaacuacuaaaaaaaaaugggaaaaaucuccaggacaauuagagggggcaaagauuuguugaguaacaccagacgagcaugggcaaccaaggcaaaaauggacagugggaucacaucaaguuuaaaagcuucugcacagcaaaagaaacaaucaguaaagugaaaagacaacccacagaaugggagaaaauauuugcaaacuacccaucugacaaaggaugaauaacuggaauauauaaguagcucauacaacucaaaggaaaauaauaauuugauuaacaaaugggcaaaagauccaaauagccauuucuuaaaagaaggcauacaaauggcaaguagguguauaaaagauacugaacaucauugaucaucagagaaaugcaaauuaaaacuacaaugagauguuaccucacucuaguuaaaauggcuuuuauccaaaagacaggcaguaacaaauguggagaaaagggaacccuuuuacacuguuggugggaauguaaauuaguacagccacuauagagaauaguuugaggguccucaaaaaacuaaaaauagaacuacuauacaauacagcaguccuacugcuggguauauacccaaaagaaaggaaauucguauauagaagagauaucugcacucccauguuuguuguaucccugcucacaauagccaagauuuguaagcagccuaaguguucaucagcagaugaauggauaaagaaaaugugguacauauacacaaugggguaguauucagccauaaaaaaauaaugagauucagucauuugcaacaacauggauggaacuggacaccauuauauuaagugaaauaagccaagcacagaaagauaaacuuuguacauucucacuuauuugugggaucugaaaauccaaacaguugaaaucauggagacagagaguagaaggaugguuaccagaggccagaaaggguaauaagccaaugguggggggguggggaauagggaugguuaauggguacaaaaaauagaaagaaugaguaagaccuagcauuugauagcacaacaggcugacuacagucaaaaauaauuuaaacguacauuaaaaaauaacuaaaauacuauaauuggacuuuuugcaacacaaaggauaaaugcuugaugggauggauaccccauuuacccuggugugauuauuacacauugcaugcuuguaucaaaauacguacccauaaauauauauaccuacuguguacccaugaaaauuuuuuuaaauguauaguaggcuucaguaagacucuca

SEQ ID NO: 183460 - RNA, 46 nt, Homo sapiens
uacguucuuacgaacauucaugaagucucguccaacaaaacagaag

SEQ ID NO: 183461 - RNA, 234 nt, Homo sapiens
uggaaaaaaaacugucagaguuuugagacauaaaaugccaaaaucaaucuuccaauuuuuuuuguuuuuaaagagacagggccuugauuuguugcccacgcuggagugcaguggcgugaucauagccgacugcagccuugaauuccugggcucaggcaguccucccagaguacugggacuacaggcaugugccaccacaccuggcuaauuuuuauuuuucauuuuacuuuugua

SEQ ID NO: 183462 - RNA, 50 nt, Homo sapiens
uaaaaugaagaaaaaaugauuauauauuauauacauaauugugaggagag

SEQ ID NO: 183463 - RNA, 44 nt, Homo sapiens
uugaguguauuaaacauuauaucacaguuauuuguagaacugau

SEQ ID NO: 183464 - RNA, 35 nt, Homo sapiens
augcuaggugauagauaauaccucugugugugcau

SEQ ID NO: 183465 - RNA, 46 nt, Homo sapiens
gcucaggucaauucuccaauugugacggaaaauaaauauaucgaag

SEQ ID NO: 183466 - RNA, 72 nt, Homo sapiens
uaacaaccuuugauauggguuuucaaggagaaguagggauucaccuaacugacaggagacuaagaaugguau

SEQ ID NO: 183467 - RNA, 95 nt, Homo sapiens
uucaggagaugggagcagagugaaaagaagccagcugagggcugaaugcuggagagaagcaauguuuaaaggugggaaaggaagaauugucauga

SEQ ID NO: 183468 - RNA, 88 nt, Homo sapiens
cuaaauugcugucaaaaugugcaguauaacacauuauguaauagaguacuaaauugcugucaaaauguacagcuaaucacucucaaaa

SEQ ID NO: 183469 - RNA, 46 nt, Homo sapiens
gacccagaagacccagaucuuccagugaugcacugucugccucuuu

SEQ ID NO: 183470 - RNA, 47 nt, Homo sapiens
uggggaaccgcuguaacuccuaugauaaucugccucaugacaaugag

SEQ ID NO: 183471 - RNA, 43 nt, Homo sapiens
cuucaguucccuuagacucagagaagucugaugaucauguaag

SEQ ID NO: 183472 - RNA, 45 nt, Homo sapiens
gcaguucaaauuaucauuccuuugucacugcuucauccaccucug

SEQ ID NO: 183473 - RNA, 46 nt, Homo sapiens
ggcuauuucucucccaacgaccauaauguagucagcaugccuccgg

SEQ ID NO: 183474 - RNA, 55 nt, Homo sapiens
gaggaagaacaccucacucagucaaucgucccacccccuaaaccagagaggaguc

SEQ ID NO: 183475 - RNA, 45 nt, Homo sapiens
ugugcuguaccaguaccaaccacacggcaagcgccagagcagugu

SEQ ID NO: 183476 - RNA, 48 nt, Homo sapiens
ugaaacacuuuuccggcaucuuucccuuucuaauguugugggguggaa

SEQ ID NO: 183477 - RNA, 43 nt, Homo sapiens
ugaguggggacggaggaguagguuaccacauuuggagcaguaa

SEQ ID NO: 183478 - RNA, 46 nt, Homo sapiens
gcccugucagucacccauuuaggauguuggcaaaguacugcuugag

SEQ ID NO: 183479 - RNA, 43 nt, Homo sapiens
gaccuugaaucuccagaaagaucugggauaauuuaaaugugag

SEQ ID NO: 183480 - RNA, 44 nt, Homo sapiens
gcaccaagagauuauuuaaugggcuauuuaauuaagggguagga

SEQ ID NO: 183481 - RNA, 49 nt, Homo sapiens
cccagacgccuacaacaagaagcagaccauucacuacuaugagcagauc

SEQ ID NO: 183482 - RNA, 61 nt, Homo sapiens
gguagggggcggggggugguaacauauuuaacuaauagagagagagugcaaggaagaggag

SEQ ID NO: 183483 - RNA, 68 nt, Homo sapiens
agccagcgacggcacaauagauccuuucugugcuucaaaucucugaccuccguuucugaucuugacac

SEQ ID NO: 183484 - RNA, 47 nt, Homo sapiens
cugagguccccauuuccuugcuggcugucagcuggaggcugggggcc

SEQ ID NO: 183485 - RNA, 48 nt, Homo sapiens
gggggaaaauuuugcuuccaggcucauucuugugguugaaauaauucg

SEQ ID NO: 183486 - RNA, 44 nt, Homo sapiens
gugaucuuaucuugaaacacuagucugaacgaguuauaagaguu

SEQ ID NO: 183487 - RNA, 57 nt, Homo sapiens
cuucauggagauugcagcugacaaacugcugagccugccaaugcaacagccacggaa

SEQ ID NO: 183488 - RNA, 58 nt, Homo sapiens
aacagccuccccucaucugggaugucaauccuaaacagauucggauucucaaccccuu

SEQ ID NO: 183489 - RNA, 46 nt, Homo sapiens
agcucacugggagaugccaucaacaaguacgauguggucaucaggu

SEQ ID NO: 183490 - RNA, 42 nt, Homo sapiens
gugcccaaguucugagccugacucggguaccagggucagggg

SEQ ID NO: 183491 - RNA, 39 nt, Homo sapiens
cuggucgucauggugugguauuccaucucccgggaagac

SEQ ID NO: 183492 - RNA, 37 nt, Homo sapiens
uacugaugauaguguuuccaguuuguuuguuuuuuuu

SEQ ID NO: 183493 - RNA, 41 nt, Homo sapiens
cuaugccuucaggcucugaguguggaugcagcugggccugu

SEQ ID NO: 183494 - RNA, 51 nt, Homo sapiens
gggcauggggggcgggggcagagaggaggaggacugagaaguggguguauu

SEQ ID NO: 183495 - RNA, 43 nt, Homo sapiens
gugacagcuucggggaccugcaagcugacagagucuccaggag

SEQ ID NO: 183496 - RNA, 33 nt, Homo sapiens
gagggcaggagacgagggccagagaggaggaga

SEQ ID NO: 183497 - RNA, 68 nt, Homo sapiens
uuccuagaagcagguuggaggcucucagcccuucccuccaugcauggccuuggauacagcuugcagcc

SEQ ID NO: 183498 - RNA, 23 nt, Homo sapiens
ggagggaagucaugcaagggacu

SEQ ID NO: 183499 - RNA, 56 nt, Homo sapiens
agaaggaugaaagggagggaagaaaugauggaggugggcuuuacuaauggcagggg

SEQ ID NO: 183500 - RNA, 77 nt, Homo sapiens
cugaccaggaaagacugccucugacccucuuagcagacagagcccaggcaugggagcacucuggggcagccuggcuc

SEQ ID NO: 183501 - RNA, 39 nt, Homo sapiens
ccugcccagccauaugggugcaauggccugccugagagg

SEQ ID NO: 183502 - RNA, 45 nt, Homo sapiens
gauguuguucuccuggaucuucucucccaaguaaaagcggguaaa

SEQ ID NO: 183503 - RNA, 54 nt, Homo sapiens
acaucgaaguuggauagcguguguguguguguguguguguguguguggggugug

SEQ ID NO: 183504 - RNA, 76 nt, Homo sapiens
ggcagucaaggcugaagagccugacuaggaggcuuggucuucagccgcucagcaaugaggaaaaauaggggcauuu

SEQ ID NO: 183505 - RNA, 43 nt, Homo sapiens
agggaacaagguuaccaccuuguugugaaaguucauggaauag

SEQ ID NO: 183506 - RNA, 46 nt, Homo sapiens
ggaccuccgguucaaccccucgggcuaccucuugcuggcuucagaa

SEQ ID NO: 183507 - RNA, 56 nt, Homo sapiens
uuggggugguuaccccuccuuuagcccagaguggggagcagcccagcuagcaaggu

SEQ ID NO: 183508 - RNA, 82 nt, Homo sapiens
cuauuggcugaagaagcuggagagcagacgaggugcuauucgagugcuagugguggaacgggaccacacggugaggucuggg

SEQ ID NO: 183509 - RNA, 41 nt, Homo sapiens
cugcaagacaccagccaccugccucccgagcacucggaugu

SEQ ID NO: 183510 - RNA, 67 nt, Homo sapiens
ggggugugccagggccucuugguccaaggccuggaagacccaaguggggaugacagugcaguugaau

SEQ ID NO: 183511 - RNA, 45 nt, Homo sapiens
gggaguacuguaauccaacacuucuuuguuagcacagccacccag

SEQ ID NO: 183512 - RNA, 49 nt, Homo sapiens
guagaguuuugagcagccccuucgucaucagagcugcugcaguccagau

SEQ ID NO: 183513 - RNA, 47 nt, Homo sapiens
cuguaauaagacugagucuguaggcagagugaagggggugccugagu

SEQ ID NO: 183514 - RNA, 48 nt, Homo sapiens
cuggggaccugcaggcuguguauccuagggagaggugccauucaagac

SEQ ID NO: 183515 - RNA, 53 nt, Homo sapiens
gcccuuuucuuggaggcugucaagcauaaaucugaccuagaacauuucaugcu

SEQ ID NO: 183516 - RNA, 45 nt, Homo sapiens
gguugggcuauauguguguugugcagguccucgagugggcucagg

SEQ ID NO: 183517 - RNA, 31 nt, Homo sapiens
acuaaguuucaggguagaaggaaaugaaggu

SEQ ID NO: 183518 - RNA, 82 nt, Homo sapiens
aguucaucaagaaaaggguggggacgcacauccgugccaagaggaagcgggaggagcugagcaagguacuggcugccaugag

SEQ ID NO: 183519 - RNA, 49 nt, Homo sapiens
cccagcagaggauggaagcccugggaagucaccggccucacugagguug

SEQ ID NO: 183520 - RNA, 86 nt, Homo sapiens
cuaacgugagggcgccugaggccgugugcaaagcuggacacccuggcagugccggugccucugcuggggcaacacugccuccacuc

SEQ ID NO: 183521 - RNA, 45 nt, Homo sapiens
accaagcuuuuaggugauaaagaauaaaagagggaagggaagagu

SEQ ID NO: 183522 - RNA, 60 nt, Homo sapiens
uaaaaauuacuguugaacaucuuaaauauuuuucuauauuuucuacuuucauagccauau

SEQ ID NO: 183523 - RNA, 41 nt, Homo sapiens
gagaaacaauaaacucauuuucaaagugaauuuguuagaaa

SEQ ID NO: 183524 - RNA, 51 nt, Homo sapiens
uguguugagaacauagcagaaaccacuuccuugguuucuccuuuguggaaa

SEQ ID NO: 183525 - RNA, 43 nt, Homo sapiens
uuuuaugaagcguuuauuaaaugacuugugugacagcauaaug

SEQ ID NO: 183526 - RNA, 48 nt, Homo sapiens
ccugccuuuuacagccgaggugcucgguggagucauggcagugcccuu

SEQ ID NO: 183527 - RNA, 60 nt, Homo sapiens
guuuagaauaguuguucgugguugaaagacuuggauaaauguggaugagauagaagggga

SEQ ID NO: 183528 - RNA, 102 nt, Homo sapiens
gggagaaaguuagcauugacuagcgcaggggauuggagagacuccugcggaggggcgguuucggaggguggaggaaugguaccaggagguucccguuguggg

SEQ ID NO: 183529 - RNA, 125 nt, Homo sapiens
agcgcugcauuuggauuccugcaguggugggcaaaggacaguccggugaggaagggcggccgguagaguagggaagguuucuaaagaaggaguucggggucuagauuagugagggagggcauggu

SEQ ID NO: 183530 - RNA, 37 nt, Homo sapiens
agccaggaucucuccccgacugcaaagcagcccuggg

SEQ ID NO: 183531 - RNA, 40 nt, Homo sapiens
agccucacaccggaugccacuucauauuugggcccagagc

SEQ ID NO: 183532 - RNA, 44 nt, Homo sapiens
cggccaggagcgaagcccgcagccccgccuggaagcgcagcgcg

SEQ ID NO: 183533 - RNA, 41 nt, Homo sapiens
cucaauaaauuuuuauugaaugaauaaaugugggaccagaa

SEQ ID NO: 183534 - RNA, 43 nt, Homo sapiens
uuacagacaguuuugucauaacccuuugcauugcagcaccuag

SEQ ID NO: 183535 - RNA, 119 nt, Homo sapiens
gaauugucuggaaguuuugucuugggcaguaugggcugggccaaaugaaaugauuuuuauaauucuaaacagguuaccaaaugaaaugucauggcuuuacuuuggucaauuaaaggggg

SEQ ID NO: 183536 - RNA, 97 nt, Homo sapiens
ugauaugcuucgcacugagcacaucacauuuaggacguugaagauuuuuuuuuuuuuuuuuuuuuaauaugcaguuuguaagaacaaaacuggaugg

SEQ ID NO: 183537 - RNA, 48 nt, Homo sapiens
gcuugauguccuggaggaagcauauaccacagaacauuggcuggucag

SEQ ID NO: 183538 - RNA, 696 nt, Homo sapiens
ugauauuauugucauauuaccuuuauuuuuguuguuugcauauuuuuuugagacaggguuuuugcucugacacccaggcuggagugcagugguacaaucauggcucacugcagccuugauuuccugggcugaaggaguccuccugcuucagccucuugaguagcugggacuaaggugcacaccacaaugccuggcuguuuuuaaaacuuuuuguagagaugaggucucacuauguugucugggcuggucuggaacuccugagcucaagcaaucuucuugucauggccuccugaaguacugggauuacagaccugagcuacugcaccuagcuauuguuauuuuuguuuuguuuuguuuuguuuuuugagaugaagucuuguucuguuacccaggcuggagugcaguggcacgaucuuggcucacugcaaccuccaccuccccgguucaagcgauucuccugccucagccucccgaguagcuagaauuacaggugugcucuaccauccccagcuaauuuuuuuuuuuuuuuguauuuuuaguagagacauuguuucacuauguuggccaggcuggucucgaacuccugaccucaaguaauccacccaccucggccucccaaagugcugggauuacaggcaugagccaccgcacccagccuguuauuuuauauaugaggaaauugagguacaaauaggu

SEQ ID NO: 183539 - RNA, 50 nt, Homo sapiens
cauguacaagauguguuacuaucgcuuuggacagguuuacacagaagcca

SEQ ID NO: 183540 - RNA, 49 nt, Homo sapiens
agauaucaacaaguuucuuuggaugguccggauuggagggagcacagau

SEQ ID NO: 183541 - RNA, 39 nt, Homo sapiens
uuagaaauacuaaccugcuuuaacuccagcaacuuuugu

SEQ ID NO: 183542 - RNA, 43 nt, Homo sapiens
cccuagcuaaucuauaggaccaaucucaguuguggcuuaaguc

SEQ ID NO: 183543 - RNA, 45 nt, Homo sapiens
guauuuuauacuuacaguacaucuuaauuuggacuagccacauuu

SEQ ID NO: 183544 - RNA, 42 nt, Homo sapiens
ggcguccacagaggaaaaagccuaugagaucaugagggagcu

SEQ ID NO: 183545 - RNA, 46 nt, Homo sapiens
auguccuggugggauuauggcuaucagauuacagcuauggcaaacc

SEQ ID NO: 183546 - RNA, 52 nt, Homo sapiens
uacuccagaggugaagauuugggaggggugggaauuguggguuaggggcaaa

SEQ ID NO: 183547 - RNA, 46 nt, Homo sapiens
ucuucuccguccauuguacuaucugcccgugguggggauggcagua

SEQ ID NO: 183548 - RNA, 42 nt, Homo sapiens
guuggcaccuguuaugugcauucucucuggcauuggagucuc

SEQ ID NO: 183549 - RNA, 17 nt, Homo sapiens
gauuguuagaggaggga

SEQ ID NO: 183550 - RNA, 81 nt, Homo sapiens
aacaacauccccaucauugcuucugugucugagcaucagcccacaaccugguccucauacuauuuugaccugcagcuccuc

SEQ ID NO: 183551 - RNA, 56 nt, Homo sapiens
ggauuaccugcgcagcaaguugaauccacaacaauuugaaguucuuuuccggagcg

SEQ ID NO: 183552 - RNA, 58 nt, Homo sapiens
caucagagcacauggcagccuuuggggucuuuggucucugccagauccaugccuuugu

SEQ ID NO: 183553 - RNA, 27 nt, Homo sapiens
aucagaguuaaaauuuccagucuucuu

SEQ ID NO: 183554 - RNA, 46 nt, Homo sapiens
ccuacuguacuguuuacugccugggcacuauacuuucuaugcagau

SEQ ID NO: 183555 - RNA, 57 nt, Homo sapiens
uuaauuccucuccacguccucgugcugaugcucacaggccguuucucucaccggauc

SEQ ID NO: 183556 - RNA, 45 nt, Homo sapiens
cuguaguuccuggauauaucucccgaucuguggcuggcuccuaug

SEQ ID NO: 183557 - RNA, 61 nt, Homo sapiens
uccaaugauguacagauauuguuagggguagagacuuacgagcuuggggagauugguagcc

SEQ ID NO: 183558 - RNA, 89 nt, Homo sapiens
uuccacaucaccaucgacauucggaaugucuguguguuccuggccccucucuucuccuccuucaccaccaucgucacguaccaccuuac

SEQ ID NO: 183559 - RNA, 46 nt, Homo sapiens
ugguacccuuugggacgaaucauuggaggaacaauuuacccaggug

SEQ ID NO: 183560 - RNA, 47 nt, Homo sapiens
uuuccuuaugagaaaagcagugcuuuaguugagacaagcauggagau

SEQ ID NO: 183561 - RNA, 41 nt, Homo sapiens
augaaggcaaaauaaaaggaauauaaaagucagggcuaugg

SEQ ID NO: 183562 - RNA, 51 nt, Homo sapiens
cgaagugcaggaggcaaaacucuaaauggggguggagagcagagcuuaggg

SEQ ID NO: 183563 - RNA, 66 nt, Homo sapiens
aaauccacugggaggcugggcgagugugugugggguggcugggggaggaggaggaggaggcaagag

SEQ ID NO: 183564 - RNA, 44 nt, Homo sapiens
cgaggcaggggagcugccuucgguacauaauuugaaggggcacu

SEQ ID NO: 183565 - RNA, 46 nt, Homo sapiens
agccugaagggcaacgccaaagcccuguccacggucacggccauca

SEQ ID NO: 183566 - RNA, 36 nt, Homo sapiens
aagaagagauugagguugaaucugagagaagacugu

SEQ ID NO: 183567 - RNA, 51 nt, Homo sapiens
uguuuggucuccaguagugaugggcacuacaggaaggggagggcuguggaa

SEQ ID NO: 183568 - RNA, 44 nt, Homo sapiens
uggaccccuucccaugugcccccuguugcacuccccagggcgug

SEQ ID NO: 183569 - RNA, 55 nt, Homo sapiens
ucguccagaccacaggcuggcccucuguggugaccuguguuggcaacugguucgg

SEQ ID NO: 183570 - RNA, 49 nt, Homo sapiens
auggagaccugggcagaaggaauagcacgagcaaguagggcaaauguga

SEQ ID NO: 183571 - RNA, 78 nt, Homo sapiens
aacuguggcggcuccaugacagagguggccaucauguguucuaggagcuccgaggucauuacucaguccaagcugagc

SEQ ID NO: 183572 - RNA, 47 nt, Homo sapiens
guggguauggacuaggacccuuuaagaauggcccugcgugcacauau

SEQ ID NO: 183573 - RNA, 57 nt, Homo sapiens
gcuuccucucccuggcaguccucccugccccagcugugguugacuuggccucguccu

SEQ ID NO: 183574 - RNA, 46 nt, Homo sapiens
cccuacagauacccccacugaggcggaguuccccaaacagguagug

SEQ ID NO: 183575 - RNA, 39 nt, Homo sapiens
cucucucaaaucuuacuuuccuguugacugcaaagaggu

SEQ ID NO: 183576 - RNA, 31 nt, Homo sapiens
ucaacaaacuguauuacaugauccaugauug

SEQ ID NO: 183577 - RNA, 42 nt, Homo sapiens
ccuuagaggcggucaaccauuggagcaguccguuuggucugc

SEQ ID NO: 183578 - RNA, 45 nt, Homo sapiens
agcugucucuaaccuucagacucaucuaacccugacugccuacuu

SEQ ID NO: 183579 - RNA, 41 nt, Homo sapiens
cccaucuuaaaaaccaaccaacuagaaaaaaaagaagagag

SEQ ID NO: 183580 - RNA, 78 nt, Homo sapiens
agcaguauauucagcuugagaaauacccccaggaucaugcagccacagacugcagaaagacaggcaggagggaacaau

SEQ ID NO: 183581 - RNA, 53 nt, Homo sapiens
uggaagugguccacgacccuuaggaaaccuaaaagaaaucuccccaaggcaga

SEQ ID NO: 183582 - RNA, 46 nt, Homo sapiens
aggaaagcgcacugaggcugcggaggcagagcugcaugcugggugc

SEQ ID NO: 183583 - RNA, 91 nt, Homo sapiens
cucuucugcuacuuccucuuccccccacccuucccccuuucaguaccaggauucuuugggcggugagugccagagggccccagucacccag

SEQ ID NO: 183584 - RNA, 48 nt, Homo sapiens
cgcaggggcagggugcauuuuccccggcugggaggggugagggugggc

SEQ ID NO: 183585 - RNA, 45 nt, Homo sapiens
cccaacccuuagcucccuccacgcccccugcaccuccaacccgcc

SEQ ID NO: 183586 - RNA, 40 nt, Homo sapiens
uccgcgggagugggguaggaauagagcccugagggacagg

SEQ ID NO: 183587 - RNA, 39 nt, Homo sapiens
ugugccugacaguuccauaggaaguagggacuucuggga

SEQ ID NO: 183588 - RNA, 40 nt, Homo sapiens
uccagcccccauagcuacugaaggaaaacugcuggccugg

SEQ ID NO: 183589 - RNA, 46 nt, Homo sapiens
uauuucuauugccauccuccuugaauuuauuccuugccaccaacaa

SEQ ID NO: 183590 - RNA, 34 nt, Homo sapiens
aaucugaauauucuguuucuaaacacuaccuugc

SEQ ID NO: 183591 - RNA, 45 nt, Homo sapiens
aacaccaucuauaggugcaugaaaggagcauuuuagugauuuugc

SEQ ID NO: 183592 - RNA, 66 nt, Homo sapiens
agcaaaagaauaugauagauauuuuagaaaguucgcuguggcagcacuguggaagauggauuggag

SEQ ID NO: 183593 - RNA, 47 nt, Homo sapiens
uacuggauccuaugaagccuggaggaccuuucgaagugauggcacaa

SEQ ID NO: 183594 - RNA, 65 nt, Homo sapiens
ggagaugucuggcucuguagugggcagaguaacaugcagaugacuguguuacagguaauuugcag

SEQ ID NO: 183595 - RNA, 69 nt, Homo sapiens
agucucagcaauaauacacaguguuggugaugaagaaggaaaagaaggaggaauaagggggcaacaagg

SEQ ID NO: 183596 - RNA, 45 nt, Homo sapiens
auucuauauagguuaagaacuuagaaggaguauuguuuucucuag

SEQ ID NO: 183597 - RNA, 23 nt, Homo sapiens
uccagggggauagaaaggacuca

SEQ ID NO: 183598 - RNA, 37 nt, Homo sapiens
aguguuguaagugcugggcaauauucuuuagccucag

SEQ ID NO: 183599 - RNA, 45 nt, Homo sapiens
uucuccagucugagaaagagccuaccagggaauuaugcaagagag

SEQ ID NO: 183600 - RNA, 41 nt, Homo sapiens
cauguaaaaaaaaaguaucuuuucccccaguaauaguaaua

SEQ ID NO: 183601 - RNA, 46 nt, Homo sapiens
gacuugcuuucauggaccaugucucauucacgcugggaagcccugu

SEQ ID NO: 183602 - RNA, 69 nt, Homo sapiens
ccauggaaagccgggaacauaccagauaauguuaguguugaauauuguugaugagagaaaucagaagau

SEQ ID NO: 183603 - RNA, 81 nt, Homo sapiens
cuggagggacaguuggucuguaaggaaagaggaacuggcuucauagaagugcuaaguuugaaaugaugguugcagugacua

SEQ ID NO: 183604 - RNA, 44 nt, Homo sapiens
caauauuauuccccaaauauucuggugcuacuuggaugccugag

SEQ ID NO: 183605 - RNA, 46 nt, Homo sapiens
auagaaagccucauugaauggcuuucagcuagcacauggcuguuuc

SEQ ID NO: 183606 - RNA, 177 nt, Homo sapiens
aaggccacauaggccagcuaguguucauguguucuuuauaaaauuucucccauccaaguacuaaccaggcccgacccugcuuagcuuccgagaucagaugagaucaggcgcguucagggugauauggccguagacgucuuuacaaaauuccugacaggugguuacugaaucucucua

SEQ ID NO: 183607 - RNA, 33 nt, Homo sapiens
gaaacuuuacuacuaucagauaauugaagacag

SEQ ID NO: 183608 - RNA, 36 nt, Homo sapiens
aaaagguuuaaggauaauccauuuggaagaagaaaa

SEQ ID NO: 183609 - RNA, 38 nt, Homo sapiens
gcaggggcugggacuugauauuccuugaauuaggauca

SEQ ID NO: 183610 - RNA, 54 nt, Homo sapiens
ugggcacuucaugcuggcauauauucgaguacugcaauagcccacgggguagau

SEQ ID NO: 183611 - RNA, 41 nt, Homo sapiens
auacgcugggguugguauggaucagcaagaggcugcugcua

SEQ ID NO: 183612 - RNA, 46 nt, Homo sapiens
cugcagccuguacuuccccuucaguuagagccugaagcuggaggag

SEQ ID NO: 183613 - RNA, 51 nt, Homo sapiens
gcagcaagcgcagugcagccugagcggugcuaagguggagaggggagcgag

SEQ ID NO: 183614 - RNA, 42 nt, Homo sapiens
cuauccuacugaccaucuuccccuccaccuccagguacagcc

SEQ ID NO: 183615 - RNA, 45 nt, Homo sapiens
cuuaaagaaaaucauauauggggucacaccaucuucacgguaguc

SEQ ID NO: 183616 - RNA, 41 nt, Homo sapiens
cugugccuacaauaacagacaucaccagcucauuggccuag

SEQ ID NO: 183617 - RNA, 46 nt, Homo sapiens
aauaacagaggucugugaagaacaauuuagaaaggaaaaaguacuu

SEQ ID NO: 183618 - RNA, 45 nt, Homo sapiens
uaauuuuuuuuuaauucccugcuaaagacguuuucauuagucuua

SEQ ID NO: 183619 - RNA, 46 nt, Homo sapiens
aacauucuccucugaaauacacuuccucggaaguuggaguauaaac

SEQ ID NO: 183620 - RNA, 45 nt, Homo sapiens
ggaacucacagaagggaaaaauaggucaaaaacagacagcuugca

SEQ ID NO: 183621 - RNA, 42 nt, Homo sapiens
agguuucccaagaaaaaauacauaggagugugaagucgagug

SEQ ID NO: 183622 - RNA, 41 nt, Homo sapiens
cuaggcuguacugaguguuuccucuacacagugauggccug

SEQ ID NO: 183623 - RNA, 46 nt, Homo sapiens
aggaaaagaggcagcuggagcucugguuugucuguuagcccagcga

SEQ ID NO: 183624 - RNA, 42 nt, Homo sapiens
ccgugacaguggagaaccacaugucaaugaaggacagguugg

SEQ ID NO: 183625 - RNA, 46 nt, Homo sapiens
acaugagagcuacaaguacugaaggcuuuugaucuuccuugagugg

SEQ ID NO: 183626 - RNA, 46 nt, Homo sapiens
aacaaccaccucguugacauaggugcuggugcaggaaagcuggagg

SEQ ID NO: 183627 - RNA, 40 nt, Homo sapiens
aggcuuaaagaaaaggauagauuaaaaccuaaaaagaaag

SEQ ID NO: 183628 - RNA, 48 nt, Homo sapiens
caauaauaagcccauugccugcaaggguuaauauguaggugagaaaga

SEQ ID NO: 183629 - RNA, 41 nt, Homo sapiens
gauagugaggaucaagaacucgguggugcccacgaagaagu

SEQ ID NO: 183630 - RNA, 42 nt, Homo sapiens
ccccaccaucaugaccagcaaacucugccugcagcuggcccu

SEQ ID NO: 183631 - RNA, 45 nt, Homo sapiens
uuugguggccaguggcugaaggaauucguaggauugcggacagaa

SEQ ID NO: 183632 - RNA, 45 nt, Homo sapiens
uaguauuuagcacagacaccaccuuauuaaucuuaaaggaggagu

SEQ ID NO: 183633 - RNA, 46 nt, Homo sapiens
ccuuuauuuauacuauuagaaacaaggaggugaagggagccuuaag

SEQ ID NO: 183634 - RNA, 65 nt, Homo sapiens
gaugagaacauucauuguucagaaaaacaaaaauuagacugacaccuuucugaaggaacacagcc

SEQ ID NO: 183635 - RNA, 69 nt, Homo sapiens
gcagcgcuagaucccaggcucucaauuagaggcugggcuuagaacuguugcuuuuucucuauccacgcu

SEQ ID NO: 183636 - RNA, 55 nt, Homo sapiens
caguuguuuuaaguacgcuuucuuaauuuugcgaacaaaauauucagaccuaagu

SEQ ID NO: 183637 - RNA, 84 nt, Homo sapiens
cugcucucauuugacagccagaguuaaacuagauguaugcaaucucuacaacaaacauagucaaugccaaucagauagucagag

SEQ ID NO: 183638 - RNA, 75 nt, Homo sapiens
uauacagcaucucuauugaauauuugggccauaauguaacagccuaggaugcugagauuuacucaagagcugagg

SEQ ID NO: 183639 - RNA, 70 nt, Homo sapiens
agaggugucaucuuggacaagucacggcagcucauguugagucuugggaugauucuuuaucuaaagguag

SEQ ID NO: 183640 - RNA, 58 nt, Homo sapiens
auuuguuacaagagguuccaaagaaagacaauaagguauagagaaagggaagacagga

SEQ ID NO: 183641 - RNA, 76 nt, Homo sapiens
auuuuugccaccuaaguuucccccccgccccuucauaaaagugauauuugaguagugaggggagaaauggcucaaa

SEQ ID NO: 183642 - RNA, 44 nt, Homo sapiens
uugguacacugaguuugccucagauugucuccugccaguuacag

SEQ ID NO: 183643 - RNA, 46 nt, Homo sapiens
gaggcacuuaugaaguaggauuaaaugaaaguguuggaauacagau

SEQ ID NO: 183644 - RNA, 50 nt, Homo sapiens
aacuguuaaccgcucuuuuccaaugcugcugcuguucuuuaaaacgaaag

SEQ ID NO: 183645 - RNA, 45 nt, Homo sapiens
aaauagugauuagaacugaaauuauuauauuuagcagauauuuau

SEQ ID NO: 183646 - RNA, 82 nt, Homo sapiens
uccccaagaaacuggagcuucccugaggguuucgugaaguaacguacccaagagcccuuguaaaggauaaagcccucugcag

SEQ ID NO: 183647 - RNA, 47 nt, Homo sapiens
gagauuucuggugcuuguuuugcauuuacuuuggcagccuaggaaga

SEQ ID NO: 183648 - RNA, 58 nt, Homo sapiens
uguuuucacgcagcacuagguacaagagauuccacaguauggauccuacaacguaugc

SEQ ID NO: 183649 - RNA, 48 nt, Homo sapiens
gcuuaauaaaaggacuucuaguaucuuaaaaguuugagaaccgacguc

SEQ ID NO: 183650 - RNA, 78 nt, Homo sapiens
ucagacaucaaauaaauggaacuacaauacuaauuauuuauccagacaaagcuuuccaaaccccaccccaacuccuac

SEQ ID NO: 183651 - RNA, 42 nt, Homo sapiens
uggacuguaaagcucugagggcagggauaugcugugcccagc

SEQ ID NO: 183652 - RNA, 50 nt, Homo sapiens
uaacucuauccaucuuucagagcucaguuuuuccaagaugccuucccugg

SEQ ID NO: 183653 - RNA, 46 nt, Homo sapiens
cuuucaaugggaguggcagucauggaaggaaggagagguagcaggg

SEQ ID NO: 183654 - RNA, 44 nt, Homo sapiens
agcuggucccugcuaccucuccuuccuuccaugacugccacucc

SEQ ID NO: 183655 - RNA, 77 nt, Homo sapiens
gcuuacuguaaggauuaaauguauuacuaaagccuaugagcauuaaauguauuacuaucuuugcuuagaagagugau

SEQ ID NO: 183656 - RNA, 53 nt, Homo sapiens
agagaagggaaccgguuuggagacuuaagcgggggaauuggcaguauuuguga

SEQ ID NO: 183657 - RNA, 50 nt, Homo sapiens
cccgcaaauccagccuuccagcaaauagucccccuccacaucacacagau

SEQ ID NO: 183658 - RNA, 43 nt, Homo sapiens
ccugaucugugugauguggagggggacuauuugcuggaaggcu

SEQ ID NO: 183659 - RNA, 46 nt, Homo sapiens
cugcccuuggguugcucauauaccaugagccccauggauuaggggg

SEQ ID NO: 183660 - RNA, 48 nt, Homo sapiens
ggaacccacggcucaacauucaaagaagggaaaaccaaagccaugacc

SEQ ID NO: 183661 - RNA, 49 nt, Homo sapiens
ccaccugcagcucuccuugcugccugcuucccuagcugaccagccagga

SEQ ID NO: 183662 - RNA, 60 nt, Homo sapiens
ccagagggacccagacaaggaggggaaacuccaguuucaauggagcaggcaaggaggagc

SEQ ID NO: 183663 - RNA, 42 nt, Homo sapiens
ccucuuccugguguggacgcugcucugccggugcccccagau

SEQ ID NO: 183664 - RNA, 59 nt, Homo sapiens
ccauacaugaauucuauuucuuuuucuccagccacauggcuuaguuucagagcuuugau

SEQ ID NO: 183665 - RNA, 66 nt, Homo sapiens
gcuacggguagccucguauuuugucccuguugaaggucauacaauagguggacuccucuaggagau

SEQ ID NO: 183666 - RNA, 46 nt, Homo sapiens
uccaagacauauucuccauagaacucuuucuguguuggguccagau

SEQ ID NO: 183667 - RNA, 48 nt, Homo sapiens
ggacaccauauuuuucaccuaaucccucaauuuuauugguggggaagg

SEQ ID NO: 183668 - RNA, 54 nt, Homo sapiens
guuuguuuuccuauuagagguuuccauuuccauccauuuaucuuuuacuugaaa

SEQ ID NO: 183669 - RNA, 50 nt, Homo sapiens
gacugcguaucucuugccuuucuugugguuuucaccugcaacuuaauaau

SEQ ID NO: 183670 - RNA, 38 nt, Homo sapiens
uggggcaaauacauagcuagcucaggugaugaaaucuu

SEQ ID NO: 183671 - RNA, 85 nt, Homo sapiens
gaucucaucaggucuggggauuggaaaugcugcucaagagagggaaaauaggauaucacgauuggcucaacaauucccuguguua

SEQ ID NO: 183672 - RNA, 46 nt, Homo sapiens
gccuucuacacaauggggagauuuuuacaaaggguuuugagauggc

SEQ ID NO: 183673 - RNA, 44 nt, Homo sapiens
uuucgagggagucucccugaccugcucagaucugacauuaccuc

SEQ ID NO: 183674 - RNA, 80 nt, Homo sapiens
gggagggagcagcuugacaagguccacaugaagcagccuugagauuuuucgcccacuuccauuucuccucagcaucaaag

SEQ ID NO: 183675 - RNA, 62 nt, Homo sapiens
aguuuccaaauccccuuacucauacgaccccugugaaggggggugugaagggguuggugggc

SEQ ID NO: 183676 - RNA, 41 nt, Homo sapiens
ucucccugucaugcuuuaaccccauacccugugcuccacuu

SEQ ID NO: 183677 - RNA, 382 nt, Homo sapiens
gagucuaacauuauagguuauauuccauuuuuaaaaaucaacuuuuauucuacucaaaauuuuuuuuuuuugagacagagucuugauggagugcaguagcaugaugucggcucacuacaaccucugccucccagguucaagugauucuccugccuuaaccucccgaguagcugggauuauaggcgugugccaccaugcccagauaacuuuuguauuuuuaguagagacgggguuuugccauguuggccaggccggucucgaacuccugaccucaagugauccgcccacgucagccucccaaagugcugggauuacaggccugaggcacugugcccagccaaaaaaauuuucuuacauucccuuuuauaugacuggugggaga

SEQ ID NO: 183678 - RNA, 44 nt, Homo sapiens
cagauucagaugagcauuuuccuuauacaauaccaaacaagcaa

SEQ ID NO: 183679 - RNA, 55 nt, Homo sapiens
uuauuaguuauucagacagucaagcagaacccacagccuuauuacaccugucuac

SEQ ID NO: 183680 - RNA, 46 nt, Homo sapiens
cugacuuaacuucauuugucauaagguuuggauauuaauuucaagg

SEQ ID NO: 183681 - RNA, 46 nt, Homo sapiens
uuuccgugcuggaaaacacccacacaagaguagguggugccaagau

SEQ ID NO: 183682 - RNA, 50 nt, Homo sapiens
ucauuuaaaauuaggaacucaccaaaaacuguguuggugggguucauugc

SEQ ID NO: 183683 - RNA, 44 nt, Homo sapiens
gguaggugaauucaacuaccauauagguagcaaagguucaaacu

SEQ ID NO: 183684 - RNA, 52 nt, Homo sapiens
acuuggaccuugggccugccagcaucauucaccaccauaaagggccaauguu

SEQ ID NO: 183685 - RNA, 45 nt, Homo sapiens
auuccuucauagagagaaucgaucucaauacuggccugggugcug

SEQ ID NO: 183686 - RNA, 42 nt, Homo sapiens
cugccuuucagguacaauuuuuguguaauaaaagccagugca

SEQ ID NO: 183687 - RNA, 43 nt, Homo sapiens
uaaaacaagcugugcuuuuuuucuucugccuuuaaaaugccac

SEQ ID NO: 183688 - RNA, 44 nt, Homo sapiens
uuauuuuucuaagacacagaaauguauuuaauaaaaaccucgag

SEQ ID NO: 183689 - RNA, 39 nt, Homo sapiens
cuuugccaaaaacugauuccuagguuucauuuucaaguu

SEQ ID NO: 183690 - RNA, 63 nt, Homo sapiens
uuucuagugaagcagagaccuggccugcgccaccucucccgacaccagggagcaacccugagc

SEQ ID NO: 183691 - RNA, 47 nt, Homo sapiens
caccucuaacaugcuaauauauccuguggaucuccaagccaguagau

SEQ ID NO: 183692 - RNA, 45 nt, Homo sapiens
aauuacacguucaccguccaagcaagaugccuuuuuggcaaccag

SEQ ID NO: 183693 - RNA, 49 nt, Homo sapiens
aagggacauguaacaaagcggaaaauuccagcagcaguaagcaaaagga

SEQ ID NO: 183694 - RNA, 46 nt, Homo sapiens
aagagcuugacuacuucacuccacaacaagacggucauugucagua

SEQ ID NO: 183695 - RNA, 42 nt, Homo sapiens
gcuauguggugaaccuuuucugggcauuugacacccacaagc

SEQ ID NO: 183696 - RNA, 48 nt, Homo sapiens
uguggaccaaccuuagcuucaggaaaacagugguaaaaaaagaucgau

SEQ ID NO: 183697 - RNA, 73 nt, Homo sapiens
ggagugugcaucaguuugauuuggaagugcgacgggauggaugauugcggcgauuauucugaugaagccaacu

SEQ ID NO: 183698 - RNA, 51 nt, Homo sapiens
cuccgucuccugagcacaggcugccgcuccuuauuucucagcaucuggaug

SEQ ID NO: 183699 - RNA, 47 nt, Homo sapiens
gagugauaucguugauuuauguucuggcucaagcuucuuauucauuc

SEQ ID NO: 183700 - RNA, 28 nt, Homo sapiens
uggguaugugacggggacaacgacugca

SEQ ID NO: 183701 - RNA, 35 nt, Homo sapiens
uggugugccagauugaggcaugagagggaagugag

SEQ ID NO: 183702 - RNA, 41 nt, Homo sapiens
agggggcuuauucaaggugacacaauuaguuugugucagaa

SEQ ID NO: 183703 - RNA, 56 nt, Homo sapiens
auugagcuucucuaaucguaguuucauagauaaagguauuucugucacuuauuuag

SEQ ID NO: 183704 - RNA, 46 nt, Homo sapiens
cgcccaggacagcaagggcuuuguggacuuuaucggagaagcaguu

SEQ ID NO: 183705 - RNA, 61 nt, Homo sapiens
gcauguggggaagcuggcauggccaggaaacugguuugaguuauggagaaugggcaugggc

SEQ ID NO: 183706 - RNA, 63 nt, Homo sapiens
aacuugggcaggcccuagcaaagagcucuggagagugucuggggugaaccaagcagaggugga

SEQ ID NO: 183707 - RNA, 37 nt, Homo sapiens
ugcgaugcggaagugucauaugcauguaggaugggca

SEQ ID NO: 183708 - RNA, 46 nt, Homo sapiens
ucuggacagacuggggagaccugaagccugggauuuaucggagcaa

SEQ ID NO: 183709 - RNA, 34 nt, Homo sapiens
ucgcagaugggucaggucagggaaauaggcaggc

SEQ ID NO: 183710 - RNA, 79 nt, Homo sapiens
aauucuggccuggagacaguagaagcuuuggcuuuugaaccccucagccagcugcuuuacuggguagaugcaggcuuca

SEQ ID NO: 183711 - RNA, 49 nt, Homo sapiens
gagcuuaguuacaaagcuucagugacuaauggucucucgucaacaagau

SEQ ID NO: 183712 - RNA, 44 nt, Homo sapiens
gccuugcccuguggguucuacuuacaggagaacgagaggguaug

SEQ ID NO: 183713 - RNA, 65 nt, Homo sapiens
gcaucaauauuugcagacagcaguguuuugagaccaugugucugcaacagucagguguagaggca

SEQ ID NO: 183714 - RNA, 94 nt, Homo sapiens
uuugugcauggcuaauuggcacaggagauagaagagagcaagugccucagaggaggaacugguacuuuuauugugacuauugaaaggaaggaga

SEQ ID NO: 183715 - RNA, 45 nt, Homo sapiens
ccccaugccacaugcuucaauggagaggacuuugacaggccggug

SEQ ID NO: 183716 - RNA, 42 nt, Homo sapiens
ucaccaucugaugagcgggggaaugaguguuugcugggacac

SEQ ID NO: 183717 - RNA, 49 nt, Homo sapiens
ccucaugcaguuccuggcacauaagaaguuuaaauauaugucugcugaa

SEQ ID NO: 183718 - RNA, 59 nt, Homo sapiens
uugcauuauagaaugauggaucuggcagaauggagaggauggauucaguggagagagac

SEQ ID NO: 183719 - RNA, 47 nt, Homo sapiens
ggagcugccugugcccacuguggcucugugauguuucugagccagau

SEQ ID NO: 183720 - RNA, 42 nt, Homo sapiens
agagguauuuugcuucuuccccugcugcucugaaaagcaaga

SEQ ID NO: 183721 - RNA, 21 nt, Homo sapiens
cuguauguggugaacgcaaau

SEQ ID NO: 183722 - RNA, 45 nt, Homo sapiens
gagucuacauugcuacucugauuaaugguucuaugaaugaggaga

SEQ ID NO: 183723 - RNA, 61 nt, Homo sapiens
gcaugugagguacaggaagacaggcuucugcuuagaaguaaaagauaaaacuccaggaauc

SEQ ID NO: 183724 - RNA, 47 nt, Homo sapiens
agcagugggcggucucggagcaccacacccaucaaggggugguggag

SEQ ID NO: 183725 - RNA, 48 nt, Homo sapiens
acaguacauuucugaaaggaugcacaagagcuguuagccacugggcac

SEQ ID NO: 183726 - RNA, 65 nt, Homo sapiens
uugacaacauugacgaacauuccgaaagggcuuggcaggugcuaggaagucagaggaguggagag

SEQ ID NO: 183727 - RNA, 55 nt, Homo sapiens
uggaaaagaagagaacaugccaccacccgcccacacaugcacacagaggaucuga

SEQ ID NO: 183728 - RNA, 46 nt, Homo sapiens
ggaaagcuaaaaauuuacaugguccggagcuugagauuggcaagac

SEQ ID NO: 183729 - RNA, 24 nt, Homo sapiens
uuuaucugcuuaagaaacuauaaa

SEQ ID NO: 183730 - RNA, 57 nt, Homo sapiens
gucaaggauauuaguuuggcaaaaaucugugaaacuuguagauccuguaugauugga

SEQ ID NO: 183731 - RNA, 41 nt, Homo sapiens
guguccuugggcuuauccugcaggauugcuugacuucuagg

SEQ ID NO: 183732 - RNA, 46 nt, Homo sapiens
uaaugaggcuucugcagaguuuagagauuuaccugagaugcugggg

SEQ ID NO: 183733 - RNA, 36 nt, Homo sapiens
gaccccaguaaguagaggagagcugucaggagcccu

SEQ ID NO: 183734 - RNA, 56 nt, Homo sapiens
acugucuggguuggguguguugagaagcagguguugggaaguugucucagggacug

SEQ ID NO: 183735 - RNA, 99 nt, Homo sapiens
cauaucuuaauuugaacauacuaauggauacuugguuccuguguuggagagacguggggaaggggaagggccuuuggggaccgggagaagcaugcuucc

SEQ ID NO: 183736 - RNA, 48 nt, Homo sapiens
ugacauuugcauaguuuucuauccccacucugguucaagagugcagau

SEQ ID NO: 183737 - RNA, 34 nt, Homo sapiens
agccugccugcuggcuccccuguccugcgcgcau

SEQ ID NO: 183738 - RNA, 48 nt, Homo sapiens
agauucuuucuggcuuugauauuuuccucauuuuuuuuuugccaacug

SEQ ID NO: 183739 - RNA, 84 nt, Homo sapiens
auucaucucauuucagagaugaguaucuugaagcuugaaaaggugaagugacuuacccguaguuagacaggugguaaaccggag

SEQ ID NO: 183740 - RNA, 79 nt, Homo sapiens
cgcuugcucuuaggccuuucgcuaauguuaauguucuauguggagccguuuugugaggaauggcuuauuuugguugaga

SEQ ID NO: 183741 - RNA, 50 nt, Homo sapiens
aaaacugccugugaguuucaguuaggcaggagcuccuagcuugacucagg

SEQ ID NO: 183742 - RNA, 57 nt, Homo sapiens
ggccuucaaucucuagaggagaaaaaugaagcaguggauguggaaaguugguuagag

SEQ ID NO: 183743 - RNA, 48 nt, Homo sapiens
uguaggaacauuucauugucagauuuuggucuguuccuccuuagagau

SEQ ID NO: 183744 - RNA, 45 nt, Homo sapiens
uuuuagaagccagggaguauucaguguccugauuugagacugaaa

SEQ ID NO: 183745 - RNA, 46 nt, Homo sapiens
aggccuagaggcgauguuaaggccaccaccuucagggagaagagaa

SEQ ID NO: 183746 - RNA, 38 nt, Homo sapiens
acaauaaauuauaugguccuacuuuuagccuuaagcca

SEQ ID NO: 183747 - RNA, 41 nt, Homo sapiens
ugggcuuucugccacaaguucuaucuggugcagacccuuca

SEQ ID NO: 183748 - RNA, 39 nt, Homo sapiens
auuuuucuucucuguggcugccuuccuaugccauuguug

SEQ ID NO: 183749 - RNA, 44 nt, Homo sapiens
ccuuaauacaauuuuauucaacuuuauaaaugaagaaacuggag

SEQ ID NO: 183750 - RNA, 77 nt, Homo sapiens
agaauaaauuuuuuaaaggcaggaaggaaguguuugaaccaugugucaacaagcuuuacugucaaagcaggcuuuug

SEQ ID NO: 183751 - RNA, 79 nt, Homo sapiens
auacauuguguuguuaaauaauuucauuuaaaaaaugcaucacuuuguguguuuuuauauugcuaaaaccauaaggcca

SEQ ID NO: 183752 - RNA, 61 nt, Homo sapiens
uagagauagaggguacacagaaaaaucguauaaguaaaacuaacaucguuaacauuauuua

SEQ ID NO: 183753 - RNA, 36 nt, Homo sapiens
auaagcuauuuauguaaaaucaauaaaaguugauca

SEQ ID NO: 183754 - RNA, 69 nt, Homo sapiens
uguuugaaguuacaaaccuguaauuuuuuuguaaaggaaauaauugccaaauaccuaggcccauugcug

SEQ ID NO: 183755 - RNA, 99 nt, Homo sapiens
uaugugaaucuggauauauuuaaaaaaagaaauuugaugcccagauaauauauuaggcacuacugauuuuuuaguuaaauugaugcacuacacuuuuga

SEQ ID NO: 183756 - RNA, 47 nt, Homo sapiens
auaucaccaugauuuaauccagaucugggauuauguagcuaaacauu

SEQ ID NO: 183757 - RNA, 56 nt, Homo sapiens
aucgucuuccuacacauaggaggcucauucucuggacacacuaucaccuauuacau

SEQ ID NO: 183758 - RNA, 52 nt, Homo sapiens
auaaaguacuacaucaguguggaaaaaaauucugauacauuagcagcuaugu

SEQ ID NO: 183759 - RNA, 44 nt, Homo sapiens
gcagccauucaggaaauggcuguaagaaugaaaaauuauucaau

SEQ ID NO: 183760 - RNA, 45 nt, Homo sapiens
ucuuugacuauaauuauggacaauauuucacuuugugggauagga

SEQ ID NO: 183761 - RNA, 41 nt, Homo sapiens
agauaauguguaaagauggguuuuaggaagauuaauaugaa

SEQ ID NO: 183762 - RNA, 377 nt, Homo sapiens
aagaaguuaguuauugccgggcgcgguggcucaauccuguaaucccagcacuuugggagaccgagguaggaggaucacgaggucaggaguaugagaccauccuggccaacauggugaaaccccaucucuacuaaaauacaaaaaauuagcggggugugguggugcacaccuguagucccagcuacucaggagggugaggcaggagaaucccuugaaccugggaggcagagauugcgccacugcacuccagccugggcgacagagcgagacuccgucucaaaaaaaaaaaagaaaaaaaaagucaguuauucagaagaaggaacaaaaaauuauauacuagaguaaugaauuggcugggcuuugaaaaauggauauga

SEQ ID NO: 183763 - RNA, 44 nt, Homo sapiens
gcuauuauuuugucuucgaucaugcauuaaugaaacauccacaa

SEQ ID NO: 183764 - RNA, 3905 nt, Homo sapiens
ugauccuggcccaugaccaaugucuaauuccaaccugauaggcccuucucuuuaagauucucaagcaaucagauguaaugaacauuuauugcguguauguauacauauacaugcacaaguauuuaacuuugauuuuauauauauuugaaaguuuacugaauuuuucuuuuaaaaagagaauacauuguuuauugucuguaccagucuauuuuccauuugucauuuguuacuccauacauaauuacauaaauuguuaauauacaaaugaauuauaauaccauuuacaguauguacuuaucccacuuaaugugaauauucacauuuucuaaacaaauauuugauaugagcuggucauggugacucaugccuguaauccuagcacuuugggaggcugagguggguggauugcuugaguccaggaguuugagaccagccugggcaauauaaugagcccuuguccauacaaaaaaauuuuuucuuaauugacugggcaugguggugcccaccuguaguaccagcuccucaggaggcugagucagaaggaucacuugagcccgggaggcagagguugcagugagcugagauuacacuacugcacuccagccugaaugacagagcaagaccuugucucuaaaugaauaaauaaauaauaaaaaagaaccaaaacccccaaauauuugauuuauuuaaugacagggagaaguuuugaccuuugcaaaauguauuuauaggaauuuugaauuccgaaauaacaucugaugccaaauguuuuaaguaagaaugguaguagaccuguauuauaaaaaaggagauggugacuuccaaaacagcagaguaagaaucucugaaaaucucuucuuuauaaaaagcaacaaaacacugacagaaguugucagaaucagcuuuuuuagagcucuaggaauuaaaacuuuaugaguuaaagcuuuacaauaaucuuagcagccuuuauuugagaaaaguaguugaaucucaguaagaacaaugagcuuuggacauuuuccguccuuuaccaucucccuuuugcugacuucaugguagccuugaaaacuaagccuuacaacacaguaacuaugaaaaacagcagccuggauggaagguacagaauagguuugcagccucaccaaaggccacaacccagaaaaucaucaccacuugaucucucuggcaauucucaaggcuuguguuuauaugaccugucuuagagcuuguucaauaucauccugucccaggguguuuugucaaggagagucauuauuuacacauaacaggucuuagaggcacuauuaucagcuggcacuaacaaaagccugaccaaaaauacuuaaaagggaauacugagaaaugagauaucccuagggggcuuugaaaagcucuguuuuccugagaaucuagaaugauucccaugagcagggcuguugcacauacccaagaaaggggagaaggcccuaauuuccccuuuggcugaccuugaggguuuacgcaagcaguaaguucaggccagucaauuuuagagugacaacuaaaguauugaaagcauggcccaacacagcaccuuggcaaaggcugggggacuuaacugguucaaagcacuuaagaaaaucacuccagucauuaguaagagacuuguagcugcacacaacaaauaaaacagguauguaauuaguucagagaauuacuuaacgcacagcaacaacaaaagcaacuuaaagcccuggggcagggugggcgguggugcauacaaucugauuucaagaguuaccccaucauauuacuuaaaauaucccauuuuccauaaaaaauuaaaaaacacaaacaggaaaguauggccuguacacacaaaaaggcaaucagucaguagaaacucucucucagaaagcccagauguuggacuuacaaggcaaagacucuaaaucagcuacuacaaauauaaaagaacuaaggaacaccacguuuaacuaacuaaaaggaaguauuagaacaguuucuucccaaguagagaauaucaauaaagugauaaaaguuuuuuuuuuuuuuuuuuaaagaaccaaauggaaacgcagguguugaaaaguacagugacugaaacugucuugcuuaacagcagauuugagccaacagagcacagaacuggaagauaggucaauugagauuaaacagcugggaagagaaagaaaaugaagaaauacaaacagagacuuggggacacugucaugcauuuccacauaagcauaaugagaguccuaaaaggagaagagagaaagucauagaaaguuuaagaaagaguggccccagacucaccaaauuugaugaaaaacuuuacacauccuagaaguucaacaguauaggguugggguuuauuuuuggggugcugaaaauguucugaaacuugauagugguaaugauugcauagcucugagaaugcuaaaaaacuagucaaucauauacuuuagugaauuuuaugguaugugaauuauaucucaauaaaccuguuucuuuaaaaacaaaaaaaggaggagcaugauauuuauguagggauggaaagaucuccaagauauauauucaauuaagaaaaaggaacuucaugguguauauaguaugccauguuuuguaaggagggagagaaaaauuugucaucauuccaucuuacauuaacaaacaccguaaggauucucaggaaacuaauagauauggucacccagagagguggaaaugaaaugacggugugguuuacagugacauggauggaagcaaggcuuugcauuguaugucuuuuccugucaguuucucauuuucuuaaaucccugugggaauuuaguggagaaaucucauagggaaucuagugaaggaaauaggcuacaaagaaguaaauaaguauuuucagaauuuuccuuaccugugggcuauuuuguuucaugaauugauguuuauuaacguggcccaauauguaggagauaaaggccguuugaacaccugaaaucuauuguggguaggcaauuugcagauuggcuucuuguucaaaaauuucaguucaagugagagacauuuuagaugcugaacacguuuucuugugcgaacaaugcaaugagggaugagugagucgaucauaaaugauagauuccauagucagaucacaaaagcugaccacaauaucaccgaacuguauuguaacaggaccaugaguauagaauggacuuaaauauguacugaacugacuaauguuuuuuagaguuuaagcaucugaaacaggaguuggcaaacuaucuguaaauggccagguaguaaaugccuucgguucaacgggccauacugucucuguugcagugauacuauaagcccaccuuuguagcagaaaagcagccacagacaguauguaaacaucugggugucgcuguguuccauaaagauuuuuacaaagcaggcucugaguuuggcccgugggcugcaauuuaccaacucccgaucuggaauauugauuagagguagagaaauaaauguauuccaguucuuaacaccaagaauacaucuuccuuuguucugucaaugggagugucagaagaacagauagucccaauucuaugguugugguggcagcauggauaucuuuuagggaauuuaucuuaggugucagugcugaagcaaaaaucucugaaguaugaauccuugaaggagagagaugagcugaaacuuguagcugaaagaggaaacuauuugucugaguaccuaguccccugcauucccaucuuuaccacuugccaugcugccauaggacgcgguagggaaugacacugaaauggaauuccaucugggcuugugccacuuagcagcuugaugaccuuuccugggccucaguuucucuaacugagcuuuagcauccccauacauag

SEQ ID NO: 183765 - RNA, 50 nt, Homo sapiens
gcauuauguaaauaaucauugcuuaagcagaaauauauuaauaagacaga

SEQ ID NO: 183766 - RNA, 55 nt, Homo sapiens
uaauccugaugcuucuguucggcacuuuuugggugauggggacauugcugaaagg

SEQ ID NO: 183767 - RNA, 62 nt, Homo sapiens
ucacuaaugaggugaugauaccuaaucucuuuaauuauaccauacauuuaauggcccaaacc

SEQ ID NO: 183768 - RNA, 686 nt, Homo sapiens
gguuuucccaaaguagaguuguuugcaauauccacaguaucuagaaaauaacaagugguagugaggaaacagaaauuaauaaauaaaaguuauagauuuuaggacaauucauacuauagaaggcuugaguuuauaaagauguuugguuacucauuucucucuuucuucuagaggaaccaaaaacccacugaacugagaacuaggagucuaggaugggcccugggucuucuaucaaaaauacguguugggcuaagaguagaccugcagucuuccccccugacaauuaauaccaggauuaguugucuuuugggugaggccuuucuaagguguagcaaaaugacacuauuaucuacuagcagaaguucacuggguuaucuuggguuccauggaauauugagugugacuuaacauauuaaugcaauaaacaggauaacugccacuuuaaagagcagcaccauucuaugacgucauccauauguaaucaacagagcccaucuugauaaguaaaacuuuauaaugaucucuugccucucugcaguuccccaaaggcuugggugaggcaaaugcacagaacaggauucugggcggacuggagcaccugccuccacucuucccagggucuguggggcccacugagccaccccaucccacagcccucaggcagccuuacccauuuugccacaugc

SEQ ID NO: 183769 - RNA, 44 nt, Homo sapiens
ccuucaccccaccacaggucacuggaagcaaaggagccuuaaaa

SEQ ID NO: 183770 - RNA, 46 nt, Homo sapiens
gugggggugaaccauuuuccauccucagucuguauacacuucacca

SEQ ID NO: 183771 - RNA, 85 nt, Homo sapiens
ugugacaguccucauggaagacucuugaacaagugucgcaacagaacagcuccccuccgucccggcacaccucacacucauccag

SEQ ID NO: 183772 - RNA, 42 nt, Homo sapiens
caggacacaucugccucuccaggaccucagauuccugacaac

SEQ ID NO: 183773 - RNA, 46 nt, Homo sapiens
ugaauuccagauuuuuagugcaaaguauuuaucauuucuaccagaa

SEQ ID NO: 183774 - RNA, 61 nt, Homo sapiens
gccccgaggcugccuguggggcgaguggagaccucccaucacugagacagaucacagacca

SEQ ID NO: 183775 - RNA, 59 nt, Homo sapiens
gcagcugugucucugggaugaggaucccuacccaggcuagggugggagcaaccuggcgg

SEQ ID NO: 183776 - RNA, 54 nt, Homo sapiens
ccuggccugguaccccugcaugcucaaguacugccacagccgcgaccggcccac

SEQ ID NO: 183777 - RNA, 53 nt, Homo sapiens
uucgaggcucugcccaaggccucagagcaggcggagcugccucgcugcaggca

SEQ ID NO: 183778 - RNA, 42 nt, Homo sapiens
ugugugccgaggccguggaugccaucuacacccgccaggagg

SEQ ID NO: 183779 - RNA, 75 nt, Homo sapiens
caggcccucugcuuugucacccagcugcagcacaaugagaucauccccagugaggccauggccaagcuccggcag

SEQ ID NO: 183780 - RNA, 45 nt, Homo sapiens
gacccgucucaggagcacugagucagcagcacaguggggcgcagu

SEQ ID NO: 183781 - RNA, 34 nt, Homo sapiens
gaaggcuggggcgcuugcagcaggaggauccugg

SEQ ID NO: 183782 - RNA, 37 nt, Homo sapiens
cucacucgccgggguggcaccuucaagccugagcccc

SEQ ID NO: 183783 - RNA, 48 nt, Homo sapiens
ugcacaccccacuguaggagaauguucuuggugaggaagaggaagguc

SEQ ID NO: 183784 - RNA, 36 nt, Homo sapiens
caagucagugaucagucuacacugucccaugcugcc

SEQ ID NO: 183785 - RNA, 45 nt, Homo sapiens
uuauccugguagacgagacaggagccaucugagaagcucugaaag

SEQ ID NO: 183786 - RNA, 39 nt, Homo sapiens
ugaaacucaggcgagcacauggagagauucccugcuacc

SEQ ID NO: 183787 - RNA, 60 nt, Homo sapiens
uauuauccauagacugcauuauaauucuguaaaaauauacacuuauaaagagaaaaaugu

SEQ ID NO: 183788 - RNA, 53 nt, Homo sapiens
ccugugaucugggcuaaugacugaugcuaaugacauggagaaccccaaaugag

SEQ ID NO: 183789 - RNA, 40 nt, Homo sapiens
gaggcgaaggggcaugacucgugcaacuugcggcgggcau

SEQ ID NO: 183790 - RNA, 71 nt, Homo sapiens
cccagcaaaaucaguccugggcagaaucaguccugggcaguccugaggagggaagcugagucuuggacuuc

SEQ ID NO: 183791 - RNA, 208 nt, Homo sapiens
cuugacacauuguauagguguaguaaugcuuugugaauuaaagcagggguagaagagugucgaggugauggauagcccagcccugauuugauauuuugauaccugccuacaauguauaauuaucaaaucagggcuggaagcucauguacccccaaaauauguacaacuaugauauaucaauuaaaaauccaaaaaaauaaaagcaagg

SEQ ID NO: 183792 - RNA, 47 nt, Homo sapiens
aauggggaacggccauaaaagagaagguggaggugaccuuuagcaag

SEQ ID NO: 183793 - RNA, 49 nt, Homo sapiens
cuggggagauuugccaggaggaaccauugucuuggagaagagguggcaa

SEQ ID NO: 183794 - RNA, 42 nt, Homo sapiens
aaauggacuugcucuucagcagaagggauugagaugaaacca

SEQ ID NO: 183795 - RNA, 46 nt, Homo sapiens
uuggaaagagaaagccacacaguucacuggcucuuggcagcaaugg

SEQ ID NO: 183796 - RNA, 42 nt, Homo sapiens
cuggucccuguguccucagaaaugggacagaccuccugcccc

SEQ ID NO: 183797 - RNA, 50 nt, Homo sapiens
aaccucauguaagacaccucacuuuucugggucuuaauuucaacaucuac

SEQ ID NO: 183798 - RNA, 25 nt, Homo sapiens
cccaaggcaguggagagcgaccggg

SEQ ID NO: 183799 - RNA, 32 nt, Homo sapiens
agagucaaggggcuauauugaugcaacugugg

SEQ ID NO: 183800 - RNA, 43 nt, Homo sapiens
cucccucucaggccccucaccccacaugccccugcccggcggg

SEQ ID NO: 183801 - RNA, 32 nt, Homo sapiens
gggaaagcccagggaccuggauguguccacag

SEQ ID NO: 183802 - RNA, 46 nt, Homo sapiens
ucaggcccuccuauguucaaagaaaagccaggagaaccaggcccag

SEQ ID NO: 183803 - RNA, 48 nt, Homo sapiens
ugcgccgagauacugggacccugggggugcaggaacacgcaauccaug

SEQ ID NO: 183804 - RNA, 38 nt, Homo sapiens
agcaucugcuaugugccagaugcugcacugggcacugg

SEQ ID NO: 183805 - RNA, 42 nt, Homo sapiens
cggaauaaaaacaauaaugacugcuauaaaagacaaggccag

SEQ ID NO: 183806 - RNA, 64 nt, Homo sapiens
aagaaggggcaggaugacaagguccugguggccaccugcaccucagccaaugggaagccuccca

SEQ ID NO: 183807 - RNA, 61 nt, Homo sapiens
gugugguauccugggaaacucgguuaaaaggugaggcagaguaccaggagauccggaaccc

SEQ ID NO: 183808 - RNA, 46 nt, Homo sapiens
uaccacauggaccgcuucaaggaaagccucacucucaacgugcagu

SEQ ID NO: 183809 - RNA, 65 nt, Homo sapiens
cugaaguucccuuguucuaagucccgcucuccugaccucacccucuucaaacaucccuugcccca

SEQ ID NO: 183810 - RNA, 42 nt, Homo sapiens
cugaugcuaaccccccagccacugaguaccacuggaccacgu

SEQ ID NO: 183811 - RNA, 45 nt, Homo sapiens
aauggcucucuccccaaggguguggaggcccagaacagaacccuc

SEQ ID NO: 183812 - RNA, 46 nt, Homo sapiens
ggcagggaccuacaucugugaggccaccaaccccaucgguacacgc

SEQ ID NO: 183813 - RNA, 41 nt, Homo sapiens
cacaucuggaaagggaaaugaggagugacuggggcagggca

SEQ ID NO: 183814 - RNA, 43 nt, Homo sapiens
gagcccccacuuccccacugucuuggccagccagggaccccag

SEQ ID NO: 183815 - RNA, 45 nt, Homo sapiens
uaggcagcuauugcaaucaauaauccagaugaaagaugagaguau

SEQ ID NO: 183816 - RNA, 48 nt, Homo sapiens
gcuggugcgcccaagagguagggggaggggugcggcuucuccccaguu

SEQ ID NO: 183817 - RNA, 46 nt, Homo sapiens
uuccaccucauucccccuuuaagcugagaauggggucugccuauag

SEQ ID NO: 183818 - RNA, 40 nt, Homo sapiens
ccccagcucaaagugccucaguuccuccaucugcucccag

SEQ ID NO: 183819 - RNA, 85 nt, Homo sapiens
gcccaugggaaggacccugggauggagaggcaggcuucgcggcccuucaugccugcccacugggauuccaguuaacucaccccag

SEQ ID NO: 183820 - RNA, 41 nt, Homo sapiens
guuaggggagaaaauuguggagucuuuccagccacagggca

SEQ ID NO: 183821 - RNA, 42 nt, Homo sapiens
uucuugcucgccgccugcugcugcuguccucgcgucgcgggu

SEQ ID NO: 183822 - RNA, 48 nt, Homo sapiens
uugcagccaguuugcagccgggauucuagaguaucccgggagcagcac

SEQ ID NO: 183823 - RNA, 66 nt, Homo sapiens
aggggcuacucuggcccugacucaagucaccccccaagacgagcgcaucuucuugugccagggcaa

SEQ ID NO: 183824 - RNA, 41 nt, Homo sapiens
uccaggucaacccccugggcaucccugugaacaguaaggag

SEQ ID NO: 183825 - RNA, 46 nt, Homo sapiens
cauuccucaagucaucugguacaagaauggccggccucugaaggag

SEQ ID NO: 183826 - RNA, 46 nt, Homo sapiens
ucagucgucccagacuguggagucgagugguuuguacaccuugcag

SEQ ID NO: 183827 - RNA, 41 nt, Homo sapiens
gccugcccggaaggaacacagugggcgcuaugaaugucagg

SEQ ID NO: 183828 - RNA, 45 nt, Homo sapiens
cugugaggcagagaguagccaggaccucgaguuccaguggcugag

SEQ ID NO: 183829 - RNA, 45 nt, Homo sapiens
uaccaaccucucaccucccucccuccucccagcacgcuacccccg

SEQ ID NO: 183830 - RNA, 45 nt, Homo sapiens
aacggugaccaagcaccacccucccgcaaugcuaaggcacccaca

SEQ ID NO: 183831 - RNA, 43 nt, Homo sapiens
uugugugcccaccccaaggcccaccuucccccaccgcccccag

SEQ ID NO: 183832 - RNA, 53 nt, Homo sapiens
cucccaaccaaggcuguuaucagagggagaccgagugagugguuaccaaggag

SEQ ID NO: 183833 - RNA, 43 nt, Homo sapiens
ccucguaucaguuacuuagggaauccucacaacagccccauga

SEQ ID NO: 183834 - RNA, 46 nt, Homo sapiens
ggacuuaugauucaauaagaaauaaggagcuucuaggcucaucugu

SEQ ID NO: 183835 - RNA, 59 nt, Homo sapiens
ggcuuuuuauguucaaauggaaucuacauuuuaacagaagguauuagcagaguggugga

SEQ ID NO: 183836 - RNA, 42 nt, Homo sapiens
agaagacgacaacugugcugagugagagcaguggccccagca

SEQ ID NO: 183837 - RNA, 40 nt, Homo sapiens
aaccuggguacucccaccuccuccacuccacgccccagca

SEQ ID NO: 183838 - RNA, 43 nt, Homo sapiens
guguagcugaacucgacaaccccaugcagcagaaguggaccaa

SEQ ID NO: 183839 - RNA, 46 nt, Homo sapiens
gagaagccacccaugaugccccaggcucagccagccauccccagac

SEQ ID NO: 183840 - RNA, 42 nt, Homo sapiens
gcccagaucucagccuaacggugcuucccaagcuucaggcca

SEQ ID NO: 183841 - RNA, 45 nt, Homo sapiens; identical to SEQ ID NO: 113679

SEQ ID NO: 183842 - RNA, 44 nt, Homo sapiens
uaugugcaaaauguuggauguguguuuauaugcauuuuucuggg

SEQ ID NO: 183843 - RNA, 47 nt, Homo sapiens
gugggcauaaacuggggaacccuauggcuucucuuccccucccggau

SEQ ID NO: 183844 - RNA, 49 nt, Homo sapiens
agggcccgcgccgcggccggccgccaggccuccccaugccaccacaaag

SEQ ID NO: 183845 - RNA, 85 nt, Homo sapiens
uccccucgcccgccuucgccgcccggccucgaguccccgcccgcccccgcucccgucccgcaccgccugccgcgucggccucggg

SEQ ID NO: 183846 - RNA, 56 nt, Homo sapiens
ccgacgccgccccauuucccuuccagcaaacucaacucggcaauccaagcaccuag

SEQ ID NO: 183847 - RNA, 51 nt, Homo sapiens
aacccuuccacgacuagaaccuuaggcauuggggaguuuuagauggacuaa

SEQ ID NO: 183848 - RNA, 29 nt, Homo sapiens
guugugccagcccaugcgcugcaggccag

SEQ ID NO: 183849 - RNA, 45 nt, Homo sapiens
agcaacucuccacagcggggaaaccucaacacccggcuucggaag

SEQ ID NO: 183850 - RNA, 49 nt, Homo sapiens
auucagcccucagaggaagacguggagcuucugccauuggacaacaggg

SEQ ID NO: 183851 - RNA, 50 nt, Homo sapiens
gugcucaauacauauuugucaaaagaaggaaaggaaagaagguaguaagu

SEQ ID NO: 183852 - RNA, 42 nt, Homo sapiens
aacuccucucgguuugcaaacuguuacauuagccaccaaccu

SEQ ID NO: 183853 - RNA, 41 nt, Homo sapiens
agagcuggggccgcaggagcggaggcaagagguagcggggg

SEQ ID NO: 183854 - RNA, 41 nt, Homo sapiens
ccuuugugugggcgcugcugggaugauuagagaaugguuug

SEQ ID NO: 183855 - RNA, 46 nt, Homo sapiens
caagagcacagccaccaaggcccaacagacucgccuccucggccuc

SEQ ID NO: 183856 - RNA, 46 nt, Homo sapiens
gucauagugcccacagcagacuucggcaucugagugguuaaaugug

SEQ ID NO: 183857 - RNA, 51 nt, Homo sapiens
cggaggaaaacaccggugaucgugacccugaaagaaaaugaaagauucuuu

SEQ ID NO: 183858 - RNA, 46 nt, Homo sapiens
ggguuaucugccugcuuccccaggaggugcuggaaguaacguagcg

SEQ ID NO: 183859 - RNA, 47 nt, Homo sapiens
gcaccuccuggggaagcaggcagauaacccccauguagcucuuuacc

SEQ ID NO: 183860 - RNA, 46 nt, Homo sapiens
aaccaugcccaacacuuccucaggugagaacugcagcugccugagg

SEQ ID NO: 183861 - RNA, 45 nt, Homo sapiens
gaaguguugggcaugguucucaauuauucucguucucuagcugaa

SEQ ID NO: 183862 - RNA, 47 nt, Homo sapiens
aguggcgguguugucauugaugagcugcagcacuuugaggccagcca

SEQ ID NO: 183863 - RNA, 28 nt, Homo sapiens
caccgccacugcccucagcuaugguguc

SEQ ID NO: 183864 - RNA, 46 nt, Homo sapiens
cucaaauuccacacgagucacuuuugccuugaaguccacaucaucc

SEQ ID NO: 183865 - RNA, 42 nt, Homo sapiens
aggcaaaagugacucguguggaauuugaggaguugugugcag

SEQ ID NO: 183866 - RNA, 65 nt, Homo sapiens
cccuccagagugccgaaaugagucuggugagcgaguaggggaaggcgggaaugccccguaggaaa

SEQ ID NO: 183867 - RNA, 45 nt, Homo sapiens
cggguccccagaguucaggaggugcugcugaaggccgugggcaag

SEQ ID NO: 183868 - RNA, 45 nt, Homo sapiens
cuuuaaaggcuuugcugagcgcagcugccugguacacugccccca

SEQ ID NO: 183869 - RNA, 46 nt, Homo sapiens
agcgguuaaaggugaugacuuugcguugaggguagggccccauccg

SEQ ID NO: 183870 - RNA, 42 nt, Homo sapiens
gcucccagaaucugaccacagugaagcuaaaaggggugggug

SEQ ID NO: 183871 - RNA, 43 nt, Homo sapiens
agcugucacccaccccuuuuagcuucacuguggucagauucug

SEQ ID NO: 183872 - RNA, 46 nt, Homo sapiens
acuacgaguccaagggcaucaaggcucacuucaaccuggaugagag

SEQ ID NO: 183873 - RNA, 45 nt, Homo sapiens
cuucugcgcuguccucuaccagugucucaaauacagacuccaccu

SEQ ID NO: 183874 - RNA, 46 nt, Homo sapiens
ggugugguaccgccuccaaacaggcuggaaaugguguugccaaguu

SEQ ID NO: 183875 - RNA, 46 nt, Homo sapiens
guaccacaccagaugccaaggagaaugguacugauacuguccaggu

SEQ ID NO: 183876 - RNA, 61 nt, Homo sapiens
gaggaagaggagagcccugcagaggggagcaaggacgagccuggggagcagguggagcuca

SEQ ID NO: 183877 - RNA, 53 nt, Homo sapiens
cccuuagguucagggggugggggcugagagccauccuccacuggggccucagc

SEQ ID NO: 183878 - RNA, 61 nt, Homo sapiens
cccaguggaggauggcucucagcccccacccccugaaccuaagggagaugcaaccccugag

SEQ ID NO: 183879 - RNA, 45 nt, Homo sapiens
ggaccugccugacuugccagaggauaagcuggcucagucggugca

SEQ ID NO: 183880 - RNA, 41 nt, Homo sapiens
agcccgaguaccaggaaguguccacagaggagcagcgugag

SEQ ID NO: 183881 - RNA, 46 nt, Homo sapiens
aggguguuggagccaccacaguggugaggggccucucaggacaugg

SEQ ID NO: 183882 - RNA, 45 nt, Homo sapiens
gggacccgggcagagccaccccucaaugccagugccagugaccag

SEQ ID NO: 183883 - RNA, 45 nt, Homo sapiens
uucuaggccagacugaagaugcagagcccauuucagaaccugaga

SEQ ID NO: 183884 - RNA, 76 nt, Homo sapiens
aaccacagagguacugcagaaggaaccagugagcugucccucccuuccccuucuccacaccuccaaaucacagggg

SEQ ID NO: 183885 - RNA, 44 nt, Homo sapiens
ggacccaucagccacuggcagccauucucuuccuacccacaggc

SEQ ID NO: 183886 - RNA, 43 nt, Homo sapiens
guggcugaugggucccggugaugggaaggguaucagguugcug

SEQ ID NO: 183887 - RNA, 44 nt, Homo sapiens
cucccuuccucucccaccaugcgaugagcauccuuucaggccag

SEQ ID NO: 183888 - RNA, 59 nt, Homo sapiens
cccuggguuuccuuggcuuccugcagcaaauugggcaguucucugccccuugccuaaaa

SEQ ID NO: 183889 - RNA, 41 nt, Homo sapiens
ccaauuugcugcaggaagccaaggaaacccagggggaaagg

SEQ ID NO: 183890 - RNA, 55 nt, Homo sapiens
agccacguagagugguuggcauggggugccagcaucgugcaagcucugucauaau

SEQ ID NO: 183891 - RNA, 45 nt, Homo sapiens
cccugggcugaccaaaaugugcuuucuacugugagucccuauccc

SEQ ID NO: 183892 - RNA, 45 nt, Homo sapiens
cccugacccuccuccuucauccacaggccugccucagagagaggg

SEQ ID NO: 183893 - RNA, 42 nt, Homo sapiens
gccuagggagcccguccuccaguauuccgucuguagcaggag

SEQ ID NO: 183894 - RNA, 45 nt, Homo sapiens
agacagacacauucaaauugcacugcuaccagacacugacaggua

SEQ ID NO: 183895 - RNA, 45 nt, Homo sapiens
cuggccaucaauggcauggacgugaauggcagguacacggccgac

SEQ ID NO: 183896 - RNA, 46 nt, Homo sapiens
cagugcgcaagugcagcagguggcugcacggggggcgcgggaggag

SEQ ID NO: 183897 - RNA, 43 nt, Homo sapiens
uccuccugcucgccaguuggagaugcagagggggcgggcaggc

SEQ ID NO: 183898 - RNA, 45 nt, Homo sapiens
uccccacucccucaacccagguacccgccuggccuggccuguggu

SEQ ID NO: 183899 - RNA, 36 nt, Homo sapiens
gggggcuugcuaguaccaggccaggggcccuugagg

SEQ ID NO: 183900 - RNA, 46 nt, Homo sapiens
cugcaucagauaguugggcuucccacauuccagccacagugcccag

SEQ ID NO: 183901 - RNA, 53 nt, Homo sapiens
gcauccucucuucuaagaucugcugucuucagacuccuuccaaggucucaaac

SEQ ID NO: 183902 - RNA, 59 nt, Homo sapiens
ugacgugaccaagaaggaggccacuccacucugccccaccuagggucccuagggagagg

SEQ ID NO: 183903 - RNA, 48 nt, Homo sapiens
acgaacugcgagggaggcuuuccggggacgcccccgcccccgcccccg

SEQ ID NO: 183904 - RNA, 45 nt, Homo sapiens
auccaugggcccccgcagcugcgcacccauuccagguggccacug

SEQ ID NO: 183905 - RNA, 42 nt, Homo sapiens
auguccugggacauggcuugguagggucccuggccuccagag

SEQ ID NO: 183906 - RNA, 78 nt, Homo sapiens
caagugccccaugcccggugagcccaucugauuaauacugauggugagguccgaaggccgccugccuagcccccgguu

SEQ ID NO: 183907 - RNA, 44 nt, Homo sapiens
gaaggcaagggcaccaucugugagggagucuggggugacuugag

SEQ ID NO: 183908 - RNA, 88 nt, Homo sapiens
gagacuugagccugcugggcgagccagugggugaacggacacugagggaggagccgaggaccuggggcgacuugagagguccuggcgg

SEQ ID NO: 183909 - RNA, 48 nt, Homo sapiens
aaugguaggcugggguucaugaggccgcugggaggguuggcgggaggu

SEQ ID NO: 183910 - RNA, 45 nt, Homo sapiens
guccccugugcguugggaugcaguggaauguuggagcccagaggg

SEQ ID NO: 183911 - RNA, 42 nt, Homo sapiens
ggggucguucagcacugaugccaccccagggagcacacccgg

SEQ ID NO: 183912 - RNA, 37 nt, Homo sapiens
agcuccagcaaugcggacacgaggagacaggagcaga

SEQ ID NO: 183913 - RNA, 46 nt, Homo sapiens
ggcaccugcccaccuggccagccgccugcagggaggggugggagag

SEQ ID NO: 183914 - RNA, 46 nt, Homo sapiens
aagcgcuggaccuggccgauggugggccgagaggacagcaccaggc

SEQ ID NO: 183915 - RNA, 52 nt, Homo sapiens
uugggggggucuugggccagggguggagggcucaagggcacagggcccaggc

SEQ ID NO: 183916 - RNA, 42 nt, Homo sapiens
uggccucguugguaggacacgggcccgagucgcgaggcuugg

SEQ ID NO: 183917 - RNA, 46 nt, Homo sapiens
cuauuguuugcuacuaauggagcgguugcuggcucauauugcgcag

SEQ ID NO: 183918 - RNA, 45 nt, Homo sapiens
ggaagggguaggaggaauauuuccuucucugagaaaaagcugcag

SEQ ID NO: 183919 - RNA, 38 nt, Homo sapiens
aagaaucagcacucguaagcuaguguauuuuauauaag

SEQ ID NO: 183920 - RNA, 45 nt, Homo sapiens
agagaacccuguuauaaugggucuguccagucaaaauggucagcu

SEQ ID NO: 183921 - RNA, 25 nt, Homo sapiens
uaaguagguuagcaaaauuuagacu

SEQ ID NO: 183922 - RNA, 45 nt, Homo sapiens
guagcaaagguugaucauguccagaugauaguauuggaugaggua

SEQ ID NO: 183923 - RNA, 46 nt, Homo sapiens
uauugaggagcagcugggaacagaaauuaaaccuauuccgagcaac

SEQ ID NO: 183924 - RNA, 51 nt, Homo sapiens
gcuccucucuuuguggguuuuucaucuuuuauuuuggaacuaugaagacuu

SEQ ID NO: 183925 - RNA, 65 nt, Homo sapiens
ugcacuaacugcugguuuuuaaaaaauguuuucuggggaaaggggacaaggaaggaaaagaaaga

SEQ ID NO: 183926 - RNA, 66 nt, Homo sapiens
agagaaggggagaaacccuaaaaagagaagaaucuuaaugaacacacaagcuugucaaugauuuca

SEQ ID NO: 183927 - RNA, 46 nt, Homo sapiens
augcuaugagaccauucagaauaucaucuuuuagacacagcccgag

SEQ ID NO: 183928 - RNA, 25 nt, Homo sapiens
uuuuuuuuggaugaagguugcuggg

SEQ ID NO: 183929 - RNA, 43 nt, Homo sapiens
uuuuuuuuaauguuuuuaauucccuuuuaacccaguguacuag

SEQ ID NO: 183930 - RNA, 43 nt, Homo sapiens
gggcccucauaauaagcauuguuacuauuggaaguuguuuuca

SEQ ID NO: 183931 - RNA, 46 nt, Homo sapiens
ucuagguaucuuuaaauuuguuauuguggaaucauuuuccugccag

SEQ ID NO: 183932 - RNA, 50 nt, Homo sapiens
gagggagcuagccuggcaccuggacucugcccauccacagcugacagauu

SEQ ID NO: 183933 - RNA, 110 nt, Homo sapiens
guuccacugagaagugaacagugggaacucaaaauuucagaaacauugggggaagggaaaauuggcuuucucuuaauuggcagauguuccaguggggggggggggggcuc

SEQ ID NO: 183934 - RNA, 45 nt, Homo sapiens
ugaauuaugucucccuuugcuuagaccaagguuguugaaaaccag

SEQ ID NO: 183935 - RNA, 36 nt, Homo sapiens
gauucccagucccagcccagaaucucaaaaguaaaa

SEQ ID NO: 183936 - RNA, 64 nt, Homo sapiens
cuauugguauuggaugaaccuucuacaaagcagucagacccuacggugcucucacucugguuaa

SEQ ID NO: 183937 - RNA, 60 nt, Homo sapiens
ccuagaagaugcagaaaagaaucccaaagccauugacacguggauugagagcaucucuga

SEQ ID NO: 183938 - RNA, 46 nt, Homo sapiens
agagauugauugcagccuggcagaguacauugacaugaucuguggu

SEQ ID NO: 183939 - RNA, 91 nt, Homo sapiens
gaaguucuucuucguuucagccauucuagacaucccugucuacaagagucggauccagucccuccaucugcucuuuucccucuacucagaa

SEQ ID NO: 183940 - RNA, 32 nt, Homo sapiens
ucucgcugaaggcaagaaagcauucacuccuu

SEQ ID NO: 183941 - RNA, 46 nt, Homo sapiens
guuggaccaugugugaucagacugcuaucugaauaaaauaagauuu

SEQ ID NO: 183942 - RNA, 45 nt, Homo sapiens
gguuugguggccacugagguguugaugugguuuuaugucggagag

SEQ ID NO: 183943 - RNA, 48 nt, Homo sapiens
auauuucucuuugggacaacaaaauguugauaugaauaccagauacuu

SEQ ID NO: 183944 - RNA, 65 nt, Homo sapiens
aguacaaaaagccuaaacaauugcuaguuuuagagccuacauccugggaagugugguuguuuuuc

SEQ ID NO: 183945 - RNA, 22 nt, Homo sapiens
acuacugcagucucacaacuac

SEQ ID NO: 183946 - RNA, 46 nt, Homo sapiens
uuuuugaacguugacuuugcuuucuguccuagacggauucuaagau

SEQ ID NO: 183947 - RNA, 49 nt, Homo sapiens
auucggccucauuacaugugguguuguucucaguggaguauuuggaagu

SEQ ID NO: 183948 - RNA, 47 nt, Homo sapiens
auguauacucagagagggggcauuccaucagauuaggcauggugcug

SEQ ID NO: 183949 - RNA, 58 nt, Homo sapiens
ucauaguuuaauaugaggaggaaaagauguauguagggaaguggcauuugaugagagg

SEQ ID NO: 183950 - RNA, 64 nt, Homo sapiens
uaaaucuccgauuuuuggaaugguuagagagauggaaagaaaaauuagaaguguaaucaaggaa

SEQ ID NO: 183951 - RNA, 54 nt, Homo sapiens
ucuaggcugacaucuugcauggcagggguauggaaacaaggagcaagaaagggg

SEQ ID NO: 183952 - RNA, 43 nt, Homo sapiens
auuuugaaacauuccaggaagguuacuucuugucaaacuugcc

SEQ ID NO: 183953 - RNA, 42 nt, Homo sapiens
gaaaacugaaggaaauguuaaagguuuuuuaauggugcaagu

SEQ ID NO: 183954 - RNA, 47 nt, Homo sapiens
aaaaauuagacuuuaaaaaguuaucuugguacaacaccguguguaua

SEQ ID NO: 183955 - RNA, 48 nt, Homo sapiens
aaacucuuuuccugaaacuuuuuaugaauggcuauggcaccauuaaug

SEQ ID NO: 183956 - RNA, 72 nt, Homo sapiens
ccagcagcuuccuaguuaacaacccccaugcugccuccagucuuugucuguauucuucuguauuuaaccuuc

SEQ ID NO: 183957 - RNA, 29 nt, Homo sapiens
ccaaacccaaucuaguaggauguucucau

SEQ ID NO: 183958 - RNA, 22 nt, Homo sapiens
ggagacuguugggcccuuauuc

SEQ ID NO: 183959 - RNA, 45 nt, Homo sapiens
aaaugaaauuauauuauuucaacuacuaaaacuucccgccacccu

SEQ ID NO: 183960 - RNA, 41 nt, Homo sapiens
aaagcuaggguguuaaugcagaauaacuuuuuagaaaaaaa

SEQ ID NO: 183961 - RNA, 42 nt, Homo sapiens
caagauaaagauucagcaaauugagaaggaucgaggugaaug

SEQ ID NO: 183962 - RNA, 45 nt, Homo sapiens
cccauguauccuauccuaagauacaugugggggacagauaccuau

SEQ ID NO: 183963 - RNA, 46 nt, Homo sapiens
aaccucacuguguccaauacccgaacaguucuucucaccccagaga

SEQ ID NO: 183964 - RNA, 46 nt, Homo sapiens
uuacucuguggcugagauuagccgcucauuccgaucacagcaggaa

SEQ ID NO: 183965 - RNA, 44 nt, Homo sapiens
guuugcggcaauccaaaaagagcagcugaagcaacaaucuggua

SEQ ID NO: 183966 - RNA, 47 nt, Homo sapiens
cuggauggaggauaccuuaaagugaaaugacagaccaggagaauaac

SEQ ID NO: 183967 - RNA, 68 nt, Homo sapiens
gcauuccagcugaacguuuuagccuuuuuaguuucagcuauccacaaaucaagccaccgaguccagcu

SEQ ID NO: 183968 - RNA, 35 nt, Homo sapiens
uauugaauauuaaacaaaauauuuagguuucauuu

SEQ ID NO: 183969 - RNA, 24 nt, Homo sapiens
gucugcuuuuugacuugagauccu

SEQ ID NO: 183970 - RNA, 43 nt, Homo sapiens
uguguaugacuggugauauggaggagcacugugcuggcuccag

SEQ ID NO: 183971 - RNA, 38 nt, Homo sapiens
acuuaaauggcgauccgaaguuaccauaggaaccuggc

SEQ ID NO: 183972 - RNA, 24 nt, Homo sapiens
gaagcugagcacagaugaccugaa

SEQ ID NO: 183973 - RNA, 38 nt, Homo sapiens
cagccucccgugucccgucuccuccccucuccgcccug

SEQ ID NO: 183974 - RNA, 50 nt, Homo sapiens
ccuggggggaggcaggaggcacaugugaggguccccagagagaagggagu

SEQ ID NO: 183975 - RNA, 29 nt, Homo sapiens
cucaggagggccuuggccuggcacggcug

SEQ ID NO: 183976 - RNA, 56 nt, Homo sapiens
ugagaacucucccaguugcccuuggugggguuuccaccuggcuuuuggcuacagag

SEQ ID NO: 183977 - RNA, 46 nt, Homo sapiens
aggaccgugacagucucagggaccaaucccugccucugcccaucag

SEQ ID NO: 183978 - RNA, 45 nt, Homo sapiens
cccugggaagggagaaacagcagggaagaggggcaauacaacagg

SEQ ID NO: 183979 - RNA, 100 nt, Homo sapiens
augggaagggguguaggccuuggcucuguggguaugaggaugcauugaggggagggaggggauaauguguuuccugaaacagagacagagucaggucaac

SEQ ID NO: 183980 - RNA, 55 nt, Homo sapiens
cccuaaaagggagacaauaugaaauugugcaaagugcccuguaggcugaaacaug

SEQ ID NO: 183981 - RNA, 48 nt, Homo sapiens
ucugaguccagucuccuccucgacuccucucuggaacauugcuggcug

SEQ ID NO: 183982 - RNA, 40 nt, Homo sapiens
aaugccggaaaggugagcaggagccggagugcugggaugg

SEQ ID NO: 183983 - RNA, 49 nt, Homo sapiens
ucuccuugguagcuaaggcuguaucuuguucaccuacuuauccuuugca

SEQ ID NO: 183984 - RNA, 41 nt, Homo sapiens
auugggggacugguguucgcugugguccucuucucgguugg

SEQ ID NO: 183985 - RNA, 47 nt, Homo sapiens
uuuuaauuuaaauuauccuccuccucagccucuggaaccugaggcgg

SEQ ID NO: 183986 - RNA, 65 nt, Homo sapiens
uuguuagugaacuguggacucgcuuucccaggcaggggcugagccacauggccaucugcuccucc

SEQ ID NO: 183987 - RNA, 44 nt, Homo sapiens
cuuccaaccuucccugcuucugagacuucaaucuacagcccagc

SEQ ID NO: 183988 - RNA, 43 nt, Homo sapiens
agguggggcucccuaggccccuccccucuucaaggggucuaca

SEQ ID NO: 183989 - RNA, 40 nt, Homo sapiens
agcccggagcccuugccccugcccgcgccgccgcccgccg

SEQ ID NO: 183990 - RNA, 46 nt, Homo sapiens
ggggcagggcuacuacguggagaugaccgugggcagccccccgcag

SEQ ID NO: 183991 - RNA, 39 nt, Homo sapiens
gggcaggacagaagccaaauccaggcccugagcaaacag

SEQ ID NO: 183992 - RNA, 46 nt, Homo sapiens
ugaggcccucuaugacaaggagggcaugaggcugcaauaagaugga

SEQ ID NO: 183993 - RNA, 45 nt, Homo sapiens
aacaaggaucucaggauacgggggccugaaagaggaugguggcag

SEQ ID NO: 183994 - RNA, 40 nt, Homo sapiens
auggcuuuauuuaaccucucugacuuuuugucagggaaca

SEQ ID NO: 183995 - RNA, 55 nt, Homo sapiens
guguuggcuuguaauuuuucuacagaucuuaccugggcucacccauguggcugca

SEQ ID NO: 183996 - RNA, 48 nt, Homo sapiens
agaugggugaaguugcuuacucacucuaggucucacuuuccuucucug

SEQ ID NO: 183997 - RNA, 63 nt, Homo sapiens
cuuuagcugaaagccuuguuaugcaagaauauaggcgucuucccucuuuagccaugaggccca

SEQ ID NO: 183998 - RNA, 57 nt, Homo sapiens
cuugagcucagauggcaggauguguaggggauaaguagauaaaccugcaaguggaga

SEQ ID NO: 183999 - RNA, 49 nt, Homo sapiens
cugugauauuccagggugagcugaugauagcuuggccuagggacagcaa

SEQ ID NO: 184000 - RNA, 95 nt, Homo sapiens
cugagcgcuuugguugugaagggagaggagagaggggacuggaggcggaugugagauuaaggaaguuuuuuguuuuguuuuuguuuuaaugaaga

SEQ ID NO: 184001 - RNA, 32 nt, Homo sapiens
cuguaaaugucaacaggaagaauucagauuug

SEQ ID NO: 184002 - RNA, 64 nt, Homo sapiens
ugcucaaggugacagggucagggccugcaccaaaacugaggucaguugauuucacuggacugag

SEQ ID NO: 184003 - RNA, 46 nt, Homo sapiens
cagcaguaacuuugcagugggugcugccccccaccccuuccugcau

SEQ ID NO: 184004 - RNA, 46 nt, Homo sapiens
ucuucuugccagggaaggggaagggcgaaaaaaagacagugaccag

SEQ ID NO: 184005 - RNA, 41 nt, Homo sapiens
aaugguuccuuuucucggggagcuugacggagccagagggc

SEQ ID NO: 184006 - RNA, 42 nt, Homo sapiens
cuguacacaggcagucucugguauacacccauccggcgggag

SEQ ID NO: 184007 - RNA, 46 nt, Homo sapiens
acaagagcauuguggacaguggcaccaccaaccuucguuugcccaa

SEQ ID NO: 184008 - RNA, 94 nt, Homo sapiens
cuccccacccaccaaaugccucugccuugauggagaaggaaaaggcuggcaagguggguuccagggacuguaccuguaggaaacagaaaagaga

SEQ ID NO: 184009 - RNA, 49 nt, Homo sapiens
gagggaguacaaagacagggaauagugggaucaaagcuaggaaaggcag

SEQ ID NO: 184010 - RNA, 39 nt, Homo sapiens
ucuuaaaugaagugcccacuaagaaguuccacuuaacac

SEQ ID NO: 184011 - RNA, 27 nt, Homo sapiens
cugccuggauuucuuccuauuaggcua

SEQ ID NO: 184012 - RNA, 61 nt, Homo sapiens
ugcaugucuuuuaucauugcaggccaguggacagagggagaagggagaacaggggucgcca

SEQ ID NO: 184013 - RNA, 47 nt, Homo sapiens
cuuaaccuucugggggagggggauuagcuagacuaggagaccagaag

SEQ ID NO: 184014 - RNA, 24 nt, Homo sapiens
aaccucacuaagcagcuacuccug

SEQ ID NO: 184015 - RNA, 44 nt, Homo sapiens
uaucccugaccaacagggauaagcccccagguggagugugggcc

SEQ ID NO: 184016 - RNA, 46 nt, Homo sapiens
uuccuccccgucaccuuccaggcuuuccaggugcacagcccagcuc

SEQ ID NO: 184017 - RNA, 47 nt, Homo sapiens
ucccuggccugggcagggcgagcuggguucccuagaguucugcuaga

SEQ ID NO: 184018 - RNA, 46 nt, Homo sapiens
cuaaacacacucucucuucauuucugggcaaauuacaguucagaug

SEQ ID NO: 184019 - RNA, 45 nt, Homo sapiens
cguccgccucuucgcucaacauaaaaccaggucgcuggcuuagag

SEQ ID NO: 184020 - RNA, 32 nt, Homo sapiens
cuaugaguaagaaagcaagucuucuguggcag

SEQ ID NO: 184021 - RNA, 43 nt, Homo sapiens
aaucuuaagcauuaaaaaaaauucaaccaacuagcucagaaga

SEQ ID NO: 184022 - RNA, 50 nt, Homo sapiens
gggagaagcgggcuggggguagccuggaugugggccaaguccacuguccu

SEQ ID NO: 184023 - RNA, 48 nt, Homo sapiens
aacugcaccugggcagcuccucccugugcccccagccucagcccaacu

SEQ ID NO: 184024 - RNA, 46 nt, Homo sapiens
ggccucccaggccggcaugacaggcuacggacgaccucggcagauc

SEQ ID NO: 184025 - RNA, 46 nt, Homo sapiens
agcgcaggagcauaagagggaauucacagagagccagcugcaggag

SEQ ID NO: 184026 - RNA, 42 nt, Homo sapiens
agcagauggagcagguggcucaguuccugaaggcggcugagg

SEQ ID NO: 184027 - RNA, 41 nt, Homo sapiens
gagcuggaggagcggcugguggaguggaucauagugcagug

SEQ ID NO: 184028 - RNA, 66 nt, Homo sapiens
ggcugagccuggccuggaugggcagugcugugacaagugucuaggauggccggguauccugcacag

SEQ ID NO: 184029 - RNA, 28 nt, Homo sapiens
ugaacucuguuccgugugagcugcugcg

SEQ ID NO: 184030 - RNA, 43 nt, Homo sapiens
gccuccacagcugugggcaccccagugccuaccuuagaaaggg

SEQ ID NO: 184031 - RNA, 54 nt, Homo sapiens
ccucaccccuucccuuccuucuuuccaggcccuuagucuugccaaaccccagcu

SEQ ID NO: 184032 - RNA, 44 nt, Homo sapiens
aggggcccugagcuccuuugugucauagaccggucacucugucg

SEQ ID NO: 184033 - RNA, 42 nt, Homo sapiens
accgggacugcauccuccucgacuucuuugacgaccacgaca

SEQ ID NO: 184034 - RNA, 65 nt, Homo sapiens
cuuaucaugcgccccaaugauuucgcuuccuacuuguuggccauuggcaucugcaaccugcuccu

SEQ ID NO: 184035 - RNA, 45 nt, Homo sapiens
ggaccgcauggugcugcuggucaugggcaacgucaucaacugguc

SEQ ID NO: 184036 - RNA, 45 nt, Homo sapiens
cgugcucuacacagacugcauccggcagugcagcgggccgcucua

SEQ ID NO: 184037 - RNA, 55 nt, Homo sapiens
cacaucaucgccacccugcuccucagcacgcagcucuauuacaugggccggugga

SEQ ID NO: 184038 - RNA, 42 nt, Homo sapiens
ugccuggccauugucaucuucuucucugugcugggcguggug

SEQ ID NO: 184039 - RNA, 46 nt, Homo sapiens
uguacaugaucgccggacucugcaugcugaagcucuaccagaagcg

SEQ ID NO: 184040 - RNA, 45 nt, Homo sapiens
gauggaggggcugcucagugcuugcuaucaugugugccccaacua

SEQ ID NO: 184041 - RNA, 46 nt, Homo sapiens
uccugcucaucauccugcaacgggagaucaaccacaaccgggcccu

SEQ ID NO: 184042 - RNA, 45 nt, Homo sapiens
accauugcugucuucuaugcccuuccuguggugcagcuggugauc

SEQ ID NO: 184043 - RNA, 45 nt, Homo sapiens
gagaauguuucuggaucuaccgauggucugguugacagcgcuggc

SEQ ID NO: 184044 - RNA, 46 nt, Homo sapiens
ucucuggcuccugcuuucagaccugggauauagggugugcccugaa

SEQ ID NO: 184045 - RNA, 48 nt, Homo sapiens
ccuuucuaccccuucgcagaagguacauuuugugcccugggccuggcu

SEQ ID NO: 184046 - RNA, 42 nt, Homo sapiens
ggagcaguucagcuucaauaccacagcagcacagccccaggu

SEQ ID NO: 184047 - RNA, 42 nt, Homo sapiens
acgaacccugugucagccccccaccaagaaugagucggagau

SEQ ID NO: 184048 - RNA, 347 nt, Homo sapiens
gaagaucacuuuaucuuuuuuuuuuuuuuuuuuuuuuugagaccagucucacucuguugcccaggcugaagugcaguuuugugaucucagcucacugcaaccuccgccuucccgguucaagcgauucuccugccucagccucccaaguaguugagauuacaggcgccugccaccauacccagcuaauuuuuguauuuuuaguagagauggggcuucaccauguuggccaggcuggucucaaacuccugaccucagaugauccuccugccuuggccucccaaagugcuacaagcgugagucaccgcacccggcugucauuuuauagagggagaaguugaggcuuagag

SEQ ID NO: 184049 - RNA, 45 nt, Homo sapiens
agcuuccagcaucucaccaggaccagaacuuuaaccccggccuga

SEQ ID NO: 184050 - RNA, 106 nt, Homo sapiens
agcugggaccccuucccguagccagcauccccucccuccccgcccccucccggccgcccccuccccugcggggacccugggagccucuucggggcucuugggaggg

SEQ ID NO: 184051 - RNA, 64 nt, Homo sapiens
gauagauggugcgaaggggaucccgaggagacacgauuaguggaggaggcaaugaggaaaaugg

SEQ ID NO: 184052 - RNA, 53 nt, Homo sapiens
ucuuccagcccuuggauacaccaaaauauugauaaaaucuguuacagacaggg

SEQ ID NO: 184053 - RNA, 28 nt, Homo sapiens
uuuuuuccccuuguaggaaauggucugg

SEQ ID NO: 184054 - RNA, 359 nt, Homo sapiens
uaauuuauguuuuuaaaacguggcuggaugugguggcucaugccuguaauuccagugcuuugggggggcaugaggcaggaggaucacuugaggccaggaguucaagaccagccugggcaacauagugagaucccaucucuacaaacaauuuaaaaauuagcugggugugguggugcgcaccuguagccucagcuacuugggagguggaggcgggaggaucacuugauccugggagucugaggcuguggugaacuauggacacaccauuguaucccagccugggugacagagugaaacccugucucaggaaaacaaaccaaaagaaaaacagcaacucaugcugguuauuuuaugguuaa

SEQ ID NO: 184055 - RNA, 46 nt, Homo sapiens
ucccagaaguugaaacggaaagagaagcagacucauugccuguuga

SEQ ID NO: 184056 - RNA, 46 nt, Homo sapiens
guuagaauuugugugaacugagcugaauuugguaaugagucagugg

SEQ ID NO: 184057 - RNA, 64 nt, Homo sapiens
auccuuaaaagaagcaugguacccauuagcagucacugcuuauuucuucaaccucucuucucag

SEQ ID NO: 184058 - RNA, 51 nt, Homo sapiens
gcacaagugucuuuaauuuugauucucuaguuucuuaauuuauauaguugu

SEQ ID NO: 184059 - RNA, 42 nt, Homo sapiens
cuuauuaguagauauuaucucuuguugauuuguuacccuuga

SEQ ID NO: 184060 - RNA, 56 nt, Homo sapiens
augauuugggcugaaagaguagaaggaaugcuaaggaaaaugagcauuggagaugu

SEQ ID NO: 184061 - RNA, 27 nt, Homo sapiens
uaaaagaccacagagcaggagacaagg

SEQ ID NO: 184062 - RNA, 66 nt, Homo sapiens
uucuugccuggcuuagaugguucauuguugaaacuaaacuggaacuagguuugaucagagggccaa

SEQ ID NO: 184063 - RNA, 46 nt, Homo sapiens
uaguaaagugcauuuagguuuccuccaaguuuuuucaugguuugau

SEQ ID NO: 184064 - RNA, 46 nt, Homo sapiens
uauauaaaugaaaauauaaccuuugcagugauuaaaacuuguaaug

SEQ ID NO: 184065 - RNA, 45 nt, Homo sapiens
uuauaauuuuaauauggaagcuguuuugggaacucuugugggcau

SEQ ID NO: 184066 - RNA, 42 nt, Homo sapiens
aaagggaaaauuacauaugaauggaagaauagagaauggaaa

SEQ ID NO: 184067 - RNA, 116 nt, Homo sapiens
uucuucuuugagcuaaucagaaccagccccuugccuucaacuacaguuuacaucauaaugacuccuaaaucccauaucucugcugaguuuugggaaccaguucuaacaccauacua

SEQ ID NO: 184068 - RNA, 45 nt, Homo sapiens
uaagauucugcuuccaaaauagcucucuaauuuguuaccuccccu

SEQ ID NO: 184069 - RNA, 47 nt, Homo sapiens
uuucucuuagaugcuggccaggaauuuguuugaacaaauugaaaugg

SEQ ID NO: 184070 - RNA, 48 nt, Homo sapiens
aauuuaauuuuuuuccuaccacaugccaauugaaacagaagaauuugu

SEQ ID NO: 184071 - RNA, 48 nt, Homo sapiens
gaagaaauggcagaagacccauuagcuuuuggagucuguuccuuugag

SEQ ID NO: 184072 - RNA, 43 nt, Homo sapiens
acaucagcaauucucauucugccccgagcugccuauugcugag

SEQ ID NO: 184073 - RNA, 41 nt, Homo sapiens
uguccugagggggaggugagagagggggacacgguguccug

SEQ ID NO: 184074 - RNA, 47 nt, Homo sapiens
gggaggugagagagaggaggacacaguguccggagugggcggugaga

SEQ ID NO: 184075 - RNA, 45 nt, Homo sapiens
gggaggugagagaggaggacacaguguccggagugggaggugaga

SEQ ID NO: 184076 - RNA, 40 nt, Homo sapiens
gaguugauagagaggaagaauugcaaaaagagcagagggc

SEQ ID NO: 184077 - RNA, 45 nt, Homo sapiens
gggaggugagagaggaggacacaguguccagagugggaggugcga

SEQ ID NO: 184078 - RNA, 39 nt, Homo sapiens
ggaagggacggacaagcuuguaggugugaugagaaauca

SEQ ID NO: 184079 - RNA, 91 nt, Homo sapiens
ggggagaugacagagggggacacaaguguauggaggggggagauuagacucaggaagggacggacaagcuuguaggugugaugagaaauca

SEQ ID NO: 184080 - RNA, 52 nt, Homo sapiens
gguaacuguauagagaaagacauauugaagauuaugaauucuaagcagugua

SEQ ID NO: 184081 - RNA, 47 nt, Homo sapiens
acgucggaaguucaaacagaucgucacagcugucuauuuuugucacu

SEQ ID NO: 184082 - RNA, 68 nt, Homo sapiens
uucuggaggucagaaguccaagcugggucucacagggugaaaguuaaaacagcagcaagggcuguucc

SEQ ID NO: 184083 - RNA, 47 nt, Homo sapiens
aaaacucagauuaggaaguauaaaagauucauguuuucuguaugcca

SEQ ID NO: 184084 - RNA, 48 nt, Homo sapiens
aucuucaaaacauuccacgcagaaagaagaacaaugcaaaggccugag

SEQ ID NO: 184085 - RNA, 42 nt, Homo sapiens
gauuuaagguaccauggaaaauuuugaccuuaaugcagugag

SEQ ID NO: 184086 - RNA, 25 nt, Homo sapiens
uauugccuuagagacacugagaaca

SEQ ID NO: 184087 - RNA, 52 nt, Homo sapiens
ugugcggugcccugccauuugauggaagcacacugcagaaucugcgggcccg

SEQ ID NO: 184088 - RNA, 63 nt, Homo sapiens
agacgccauauucuccaguuuuccuccuguccucuggaagcaccuucuccaucuucucuacca

SEQ ID NO: 184089 - RNA, 40 nt, Homo sapiens
agugucaggugaaggaaguuuagagucugucccagagucc

SEQ ID NO: 184090 - RNA, 73 nt, Homo sapiens
uguugguguuagaucccaauaagcgccucuccauggagcagaucugcaagcacaaguggaugaagcuagggga

SEQ ID NO: 184091 - RNA, 46 nt, Homo sapiens
gcuaugaacaucagcguuccccaggugcagcugaucaacccagaga

SEQ ID NO: 184092 - RNA, 41 nt, Homo sapiens
ggaacauucuggcuccacagacugagauagcuuuaaagggg

SEQ ID NO: 184093 - RNA, 26 nt, Homo sapiens
gaagcuccuaccuggcuuuccuggag

SEQ ID NO: 184094 - RNA, 41 nt, Homo sapiens
agugccugugaaugaaacauccucuccacuuuccuuuccuu

SEQ ID NO: 184095 - RNA, 45 nt, Homo sapiens
aucccugccaccagcccuuuucacacugcagcuagaguaagcugg

SEQ ID NO: 184096 - RNA, 42 nt, Homo sapiens
aacagaagacuacccagaaaaugucauuucuguaagcaccau

SEQ ID NO: 184097 - RNA, 48 nt, Homo sapiens
uguuuuuuccuuugagggaaguugaaauaaaaugguuuucaugggcuu

SEQ ID NO: 184098 - RNA, 29 nt, Homo sapiens
uuacuggagaccugccuucuccuccccua

SEQ ID NO: 184099 - RNA, 51 nt, Homo sapiens
acauggcuuucugaggggaucagaaacauguccauuucagaaaacauugaa

SEQ ID NO: 184100 - RNA, 46 nt, Homo sapiens
uucaagcccaccccccaaccaccccaacaaccaucucuucaggcag

SEQ ID NO: 184101 - RNA, 53 nt, Homo sapiens
aaacaucacgcuuguuagauggaagaagggauuagauuuuucuggguucauau

SEQ ID NO: 184102 - RNA, 47 nt, Homo sapiens
aaagagccuuaaaagacacagcaaacaaaccaaaacacugaggccuc

SEQ ID NO: 184103 - RNA, 49 nt, Homo sapiens
aaguggauggguuuggaauuggacaugguaaguguuacaugcugguuag

SEQ ID NO: 184104 - RNA, 37 nt, Homo sapiens
auguuuucuuccagaggugauauacuuucuuuuuuuu

SEQ ID NO: 184105 - RNA, 45 nt, Homo sapiens
uuccggcccaucagcgccgaggacgaggagcagcagcccaccgag

SEQ ID NO: 184106 - RNA, 45 nt, Homo sapiens
aaggagcucacuauuauuucucugaagaagggaaucuuggugagc

SEQ ID NO: 184107 - RNA, 68 nt, Homo sapiens
aguguagcgcacucccugguccuggauccugccugccgacuggaucuccguguuguuccagccacagu

SEQ ID NO: 184108 - RNA, 45 nt, Homo sapiens
cgaaaggagcagucuggacccuguggaguggcgagagggagagac

SEQ ID NO: 184109 - RNA, 41 nt, Homo sapiens
uuuaagaucagaguauuugggcuguucgcauguagcuagaa

SEQ ID NO: 184110 - RNA, 36 nt, Homo sapiens
uguagcaaacaagccugaaguugacggguggugaca

SEQ ID NO: 184111 - RNA, 53 nt, Homo sapiens
cagggaacaguuuuguggaaaacccacaugcuccucagaaagaugaugcccug

SEQ ID NO: 184112 - RNA, 75 nt, Homo sapiens
guagugugugaucaccagggcaucaucuuucugaggagcauguggguuuuccacaaaacuguucccugagggauc

SEQ ID NO: 184113 - RNA, 25 nt, Homo sapiens
gaagcaccagcagagaagccagaag

SEQ ID NO: 184114 - RNA, 49 nt, Homo sapiens
aauuagccuagagaagaaaaguuagagauucuauaacuuguuuaagaca

SEQ ID NO: 184115 - RNA, 43 nt, Homo sapiens
gaacucaauagagcugucugaaaauagaaugagcugccuuaga

SEQ ID NO: 184116 - RNA, 48 nt, Homo sapiens
ccaugguggggaggacaucuggucugagucagagaucugugcacacuu

SEQ ID NO: 184117 - RNA, 42 nt, Homo sapiens
aacuuccaaaauaaggucaaguaacacaauaggcucacacuu

SEQ ID NO: 184118 - RNA, 98 nt, Homo sapiens
aaaguuacaccuggaguuuguuguugguuuugaguauauaaaauacugacuuugaacaggaaaggagucuccugaggggagaccgaguccagcacaag

SEQ ID NO: 184119 - RNA, 24 nt, Homo sapiens
agauugaaaagaguagaucaggca

SEQ ID NO: 184120 - RNA, 43 nt, Homo sapiens
ucagacacuucacccccaaggagggcccgucaugauucuccag

SEQ ID NO: 184121 - RNA, 42 nt, Homo sapiens
uucaggugcaucuccuaggagaguccgucaugauucaccaga

SEQ ID NO: 184122 - RNA, 36 nt, Homo sapiens
auaagaauggaauuucuuugggaaaguuuugaaaag

SEQ ID NO: 184123 - RNA, 67 nt, Homo sapiens
uuacagucaguggucacuugggaauagaaugccauauucuaccuguuggucuuaaaaguuguuucug

SEQ ID NO: 184124 - RNA, 69 nt, Homo sapiens
uggggcuaaaacuggguugguguuaacugacauacagcgagaacagcaggagcucaaggaacaggauca

SEQ ID NO: 184125 - RNA, 50 nt, Homo sapiens
uugaaacucgaacguuuagagcaaaggaggaaagcagaaaaggacucaga

SEQ ID NO: 184126 - RNA, 50 nt, Homo sapiens
cccagagccggcaacagcaacaaaauguggaggaugcaaugaaagagaug

SEQ ID NO: 184127 - RNA, 46 nt, Homo sapiens
agugguccagcaccuccucccaacagauuuaauaucuggccuggau

SEQ ID NO: 184128 - RNA, 46 nt, Homo sapiens
uuugaacagaagcgcuuugccaggcuugccagcaagaaggcagugg

SEQ ID NO: 184129 - RNA, 35 nt, Homo sapiens
guugucugugcuaauaauuggagcccacacagacc

SEQ ID NO: 184130 - RNA, 46 nt, Homo sapiens
gggggaaacguuuccaugacaaccuccccccacuuccuacauccga

SEQ ID NO: 184131 - RNA, 41 nt, Homo sapiens
cagggcuguccauucgcccccaccucuccagagggcccccc

SEQ ID NO: 184132 - RNA, 47 nt, Homo sapiens
accuucuccuaugguuugguuuauuuugagcaagguuuuguuuggau

SEQ ID NO: 184133 - RNA, 29 nt, Homo sapiens
ugauuaccguccaugugaggacuucugua

SEQ ID NO: 184134 - RNA, 48 nt, Homo sapiens
guaacugaagugaucacaaaaugccuucuuuggugugggaaacucaug

SEQ ID NO: 184135 - RNA, 66 nt, Homo sapiens
gcugucaaaguaagacuuucagacaaaaagugaaguccuuuagaaguaggaagacuuuuuaagggu

SEQ ID NO: 184136 - RNA, 38 nt, Homo sapiens
aguaugguauguuucauuaccaucggauuuggccagug

SEQ ID NO: 184137 - RNA, 86 nt, Homo sapiens
ccccauaccuggaaucaguuauuucuccaaggaauccugauuccuuuuagucaaagaaugauauuuagacagcggacacaucuaag

SEQ ID NO: 184138 - RNA, 41 nt, Homo sapiens
ccaagaccauuguagacaacaaaucuaccaaguagagcgca

SEQ ID NO: 184139 - RNA, 46 nt, Homo sapiens
uuuccuuguacaguaauaaagauguaucuggagucaguggcuacag

SEQ ID NO: 184140 - RNA, 45 nt, Homo sapiens
uuaaaugaggucaucaccuucaagauuuugaccugaacuuuucau

SEQ ID NO: 184141 - RNA, 29 nt, Homo sapiens
guuuuacuuuuuuaaaaaaugguuuaaaa

SEQ ID NO: 184142 - RNA, 61 nt, Homo sapiens
cauuuaaacaaagucucgaaaauaugggaaggauugcuauugagaaagaggugagaaggaa

SEQ ID NO: 184143 - RNA, 62 nt, Homo sapiens
gaauaaaggcuuacagguaggaaaacuaaaauggcuagugagagaugggauuagcaacagau

SEQ ID NO: 184144 - RNA, 48 nt, Homo sapiens
aauuuuuugaacagugaaguaacaucagguugguuuuuuaggaauaug

SEQ ID NO: 184145 - RNA, 66 nt, Homo sapiens
acaacaaaaacuugaauuagggcagugaaggaagaauaggagguagaauggagccuccauugaugg

SEQ ID NO: 184146 - RNA, 39 nt, Homo sapiens
gcaguuugaaauaagaguuuaguagaaagguugagagca

SEQ ID NO: 184147 - RNA, 71 nt, Homo sapiens
aaguguaugagagauccuuaaggggugcugcagagagguugaaucuuaaggaagguguguugguaacaaga

SEQ ID NO: 184148 - RNA, 49 nt, Homo sapiens
uuuauuccauggagagugucaaugaggggagcgggagggugcaggacga

SEQ ID NO: 184149 - RNA, 60 nt, Homo sapiens
aauuagggaggugugagaagguuuauauauaucauaaaauaagagauauuacagagggag

SEQ ID NO: 184150 - RNA, 46 nt, Homo sapiens
guuaacuuugcauauuguuuaaaauuucuguagugaauuuggguua

SEQ ID NO: 184151 - RNA, 64 nt, Homo sapiens
ccccuugcagugccugccauggccccuugcccucuucuuccucccuugauuuacguucaccuuu

SEQ ID NO: 184152 - RNA, 45 nt, Homo sapiens
guacaaucccuguccuacauuaggugcucuauaaaugguagcuuu

SEQ ID NO: 184153 - RNA, 48 nt, Homo sapiens
acuggaaguaggaaauuaaaaugugcaaaauuguaaauuaucauuaca

SEQ ID NO: 184154 - RNA, 45 nt, Homo sapiens
ugcgcuuuaauuuaauguucuccauaaagauucaggaccugucag

SEQ ID NO: 184155 - RNA, 71 nt, Homo sapiens
agugccuauuuuacaggagcccaugagcucuagcucaauuuauuucuccccuuucuucccagucaccaucc

SEQ ID NO: 184156 - RNA, 44 nt, Homo sapiens
aguaagaucuaaucagaggaaaaucugaaggaaucagaccagag

SEQ ID NO: 184157 - RNA, 38 nt, Homo sapiens
gaauacaaaguuguggauagaaaugcuaaugaaccagc

SEQ ID NO: 184158 - RNA, 36 nt, Homo sapiens
auuugguuugccauuuugccaguagcuuucaaagaa

SEQ ID NO: 184159 - RNA, 25 nt, Homo sapiens
uuugaauugugucucugggagcuau

SEQ ID NO: 184160 - RNA, 44 nt, Homo sapiens
uugggucaucugaacaagugggugucaaaaccagugauuuucac

SEQ ID NO: 184161 - RNA, 45 nt, Homo sapiens
auuccuugaauaguucucccucgguuucucuuccagaaguuacag

SEQ ID NO: 184162 - RNA, 45 nt, Homo sapiens
uagccuuguggcuuuaacggguaucuucaaauggcuacacguggu

SEQ ID NO: 184163 - RNA, 42 nt, Homo sapiens
aagaccauugagccucuuagcugaaaaugcugacaaguugag

SEQ ID NO: 184164 - RNA, 45 nt, Homo sapiens; identical to SEQ ID NO: 114102

SEQ ID NO: 184165 - RNA, 49 nt, Homo sapiens
cuaguguuccuaaucugcuuacugaccuuugcuauuuaagcugacuuuu

SEQ ID NO: 184166 - RNA, 55 nt, Homo sapiens
ugaaaaauuagcgauuuaauuucacaauauuuguaaauaagaaaaugggaccaau

SEQ ID NO: 184167 - RNA, 55 nt, Homo sapiens
cuagucguguggacauacagaacagagaacuauggaaccugaaugaaguguaugu

SEQ ID NO: 184168 - RNA, 49 nt, Homo sapiens
cuuucucuauuacauauguaccucuuuugguugagaauagaaacacuuc

SEQ ID NO: 184169 - RNA, 48 nt, Homo sapiens
aacaacuggcaguuuuuggcugaugugguuuggaaguguaauuuuaaa

SEQ ID NO: 184170 - RNA, 44 nt, Homo sapiens
ugagauaugaagggcuggugugaccagguugaaaaagacaggaa

SEQ ID NO: 184171 - RNA, 25 nt, Homo sapiens
acugggccucaaacgugagauguua

SEQ ID NO: 184172 - RNA, 49 nt, Homo sapiens
caguccugucauuuuaacggaaauuauccaaauuuuaaaaagaaccaaa

SEQ ID NO: 184173 - RNA, 30 nt, Homo sapiens
ucugugauuuugucacuuaauggaaaugua

SEQ ID NO: 184174 - RNA, 42 nt, Homo sapiens
uaguguuguaauuggagaucaucuucuugaagauggagccuu

SEQ ID NO: 184175 - RNA, 42 nt, Homo sapiens
aaaaugcuuuuacuguauugguuuagagacuguucccucuuu

SEQ ID NO: 184176 - RNA, 50 nt, Homo sapiens
gaauauaacucuguggacagagauagacuguuguguuaauuugggugggg

SEQ ID NO: 184177 - RNA, 23 nt, Homo sapiens
aaucauuuaagaguaaaggccua

SEQ ID NO: 184178 - RNA, 47 nt, Homo sapiens
uaccucuauaaugauuuuuuuucagcauuuuguugagccagcuucag

SEQ ID NO: 184179 - RNA, 46 nt, Homo sapiens
uuccuuuucccuuuaucuuuuucucccccuucaguucucugggaua

SEQ ID NO: 184180 - RNA, 47 nt, Homo sapiens
gccugcugucacccccaaagauugugaucuaauuguuugggggugug

SEQ ID NO: 184181 - RNA, 48 nt, Homo sapiens
cugaaaauugaacuaucaaaggcaagucuaaauaucacacguguauuu

SEQ ID NO: 184182 - RNA, 44 nt, Homo sapiens
aaguaaucaaucucugacccacgaauuuuucccuuucuuuugga

SEQ ID NO: 184183 - RNA, 44 nt, Homo sapiens
uugauuagcacuggaaauugaacuuuaguuuuugacauuggguu

SEQ ID NO: 184184 - RNA, 46 nt, Homo sapiens
ugccuuguagauuuccaaugagcaugugcagauguuaagucuguag

SEQ ID NO: 184185 - RNA, 46 nt, Homo sapiens
uuucaaaugcaaauucagcuuauucuugucacguguaccaucucua

SEQ ID NO: 184186 - RNA, 45 nt, Homo sapiens
aauaguauuaaagauacuguauuuuauaacauaccaagaugacug

SEQ ID NO: 184187 - RNA, 46 nt, Homo sapiens
aaccucuuuaaauuacuaaauaucaggauugcuugaaggggugaag

SEQ ID NO: 184188 - RNA, 45 nt, Homo sapiens
uuagaaacuauacucuggucccugggaugugcuuauuccuacugg

SEQ ID NO: 184189 - RNA, 53 nt, Homo sapiens
uaaccauuaucacaugaacucauugccaagguuuuagguaugaugauaucaga

SEQ ID NO: 184190 - RNA, 51 nt, Homo sapiens
uguaguaguguuuuuagucucagagucauguuaacccaaagauggauagga

SEQ ID NO: 184191 - RNA, 46 nt, Homo sapiens
guuugcuuaugaugcuugaagaaguuacugguaaaaucagauuuau

SEQ ID NO: 184192 - RNA, 39 nt, Homo sapiens
gaacagauaaagcaacaccacaagugucauugcuaugga

SEQ ID NO: 184193 - RNA, 45 nt, Homo sapiens
ugguaaccgugccacaccugaauuuuaaaaacggcuaucccccaa

SEQ ID NO: 184194 - RNA, 49 nt, Homo sapiens
aaaaaagacucuagugauaauaaagacauuuuugugccuggggaguuuu

SEQ ID NO: 184195 - RNA, 43 nt, Homo sapiens
gucauuugauucaggccccaauaaagcacuaaaauaguccaag

SEQ ID NO: 184196 - RNA, 46 nt, Homo sapiens
ugcaaguuguuuuuagauggcucaguuguauuauaguuauacuuac

SEQ ID NO: 184197 - RNA, 48 nt, Homo sapiens
caggaaaagaguaauacgaugcauaaaguauaagagaacuguucagua

SEQ ID NO: 184198 - RNA, 36 nt, Homo sapiens
acuguuuucccuauuguuuagucucuucugcuucca

SEQ ID NO: 184199 - RNA, 44 nt, Homo sapiens
gguacgucuuccuaaguuucuaugacagaaagauauugaagaag

SEQ ID NO: 184200 - RNA, 27 nt, Homo sapiens
agcaguuuugcucacggcacuuaucca

SEQ ID NO: 184201 - RNA, 52 nt, Homo sapiens
uuugugugguaacugagugccuuuaauuuaaacuacacggagcuaaucuuua

SEQ ID NO: 184202 - RNA, 47 nt, Homo sapiens
agaaauuacuauuaaauuugauuaacaaaugacagauuucagccuag

SEQ ID NO: 184203 - RNA, 41 nt, Homo sapiens
gugcaccacuuugucaaauguuuuucuuucucuucaaacag

SEQ ID NO: 184204 - RNA, 42 nt, Homo sapiens
auucuuuguuaaauacggcuauacauagucugaucuggguca

SEQ ID NO: 184205 - RNA, 43 nt, Homo sapiens
aaacauaauuuugagugaagaaaugcuugagcaucugggaggu

SEQ ID NO: 184206 - RNA, 42 nt, Homo sapiens
ccuuguccugucccuugcugagcacugacauuuucagagcag

SEQ ID NO: 184207 - RNA, 36 nt, Homo sapiens
cuccaugauuacuuuaaucugauuuaucugaagaaa

SEQ ID NO: 184208 - RNA, 46 nt, Homo sapiens
gggagccuuagccugaaucgaguuaguggcacuaaacuguccuaga

SEQ ID NO: 184209 - RNA, 26 nt, Homo sapiens
uaguuauucagacgcguauuuggcag

SEQ ID NO: 184210 - RNA, 40 nt, Homo sapiens
aagccaaacuuuagauuugcaaaauucuuuucuaauuuuu

SEQ ID NO: 184211 - RNA, 49 nt, Homo sapiens
ugccccauccauguuucuccucaaccugucuucucuuccauuccuuguu

SEQ ID NO: 184212 - RNA, 55 nt, Homo sapiens
caacacugcuuaugucauggaguagagaaucugacaugauagcguauauguaaag

SEQ ID NO: 184213 - RNA, 45 nt, Homo sapiens
ucuaaaggaagacaugugauuacuuuuacggguacauuaagggug

SEQ ID NO: 184214 - RNA, 58 nt, Homo sapiens
uagucacuagagaaaugcaaaucaaaaccacagugaaguaccacuucagacccaguag

SEQ ID NO: 184215 - RNA, 53 nt, Homo sapiens
ugauucauaaucaaaaaaauggaaacaauauccaauauccauuuauugaugaa

SEQ ID NO: 184216 - RNA, 45 nt, Homo sapiens
cauaaauuuguacuguuuaauagguuuggguuuaauuuugccuca

SEQ ID NO: 184217 - RNA, 20 nt, Homo sapiens
cauuucucugcuaaccuuuu

SEQ ID NO: 184218 - RNA, 46 nt, Homo sapiens
acuaucucugcaauguggaaacuuaaguuugcccucaaauauggaa

SEQ ID NO: 184219 - RNA, 41 nt, Homo sapiens
aaauauauguuauaaauaucaugugcauuugauuggccuga

SEQ ID NO: 184220 - RNA, 32 nt, Homo sapiens
ucuaauuuuuuucuaucucaacaucaucucau

SEQ ID NO: 184221 - RNA, 46 nt, Homo sapiens
gucauuuuuagcacaauaucucuauuuaaguuuucuuugaagccag

SEQ ID NO: 184222 - RNA, 46 nt, Homo sapiens
ugaauccauguugcacaugucuaacauuauaaagcacaugcagcau

SEQ ID NO: 184223 - RNA, 46 nt, Homo sapiens
gugaaucuguaacaauucacaaacugcauauucugccucuguguga

SEQ ID NO: 184224 - RNA, 41 nt, Homo sapiens
gaugcaagugaaagugcccaggacucuauugucaacaugga

SEQ ID NO: 184225 - RNA, 30 nt, Homo sapiens
agacaagccccuagucuucauuauucuuag

SEQ ID NO: 184226 - RNA, 135 nt, Homo sapiens
gguucccaauauaccaauuacuuccuaaugucaugcagacaccuauauucucagaaaugccaaagaaaggcugcucugcaaucucucagaauuauuuucccagcugaauuugucaguccaaauuuaaaagagcaa

SEQ ID NO: 184227 - RNA, 37 nt, Homo sapiens
agaaacguuuaagcuuuucuggcuucuucaguucuuc

SEQ ID NO: 184228 - RNA, 41 nt, Homo sapiens
acuuccuucuaccaaccuauccuuucuuccucagcucccau

SEQ ID NO: 184229 - RNA, 47 nt, Homo sapiens
aucauuuaccauagaggaauuaugucauuaaagguauuucauagcac

SEQ ID NO: 184230 - RNA, 40 nt, Homo sapiens
gcagaccucaguuaccucaacugaaaauaccauggcagca

SEQ ID NO: 184231 - RNA, 43 nt, Homo sapiens
uuccuuuuaagguuuucaccaauaaagcaaauccuguaguugc

SEQ ID NO: 184232 - RNA, 42 nt, Homo sapiens
uugguacaucauagcuuuuacuauagcaucuuugcauggcag

SEQ ID NO: 184233 - RNA, 30 nt, Homo sapiens
gcuaugaguaacaucugucaaagccaccua

SEQ ID NO: 184234 - RNA, 30 nt, Homo sapiens
gagcugauacgguacuaguaaugggcagca

SEQ ID NO: 184235 - RNA, 46 nt, Homo sapiens
uucucacuuaucucuaauuucagugaugauuaaucagcagcccaca

SEQ ID NO: 184236 - RNA, 24 nt, Homo sapiens
gcauagaaaacauuuuaaaaauac

SEQ ID NO: 184237 - RNA, 42 nt, Homo sapiens
cucagguuaaucuuugcauugucguucuacuccaaacuccaa

SEQ ID NO: 184238 - RNA, 69 nt, Homo sapiens
caugcugcccuugaguucucccugguaggacuugaaacaauuagcacuugauccacaagcaucaaaucc

SEQ ID NO: 184239 - RNA, 50 nt, Homo sapiens
cauaggaaacugaaauacagguucagaaucuugaguuucaucuucugaaa

SEQ ID NO: 184240 - RNA, 45 nt, Homo sapiens
uuuacaggguuuaaaaaaauucacaguguauuaugaaaaccucag

SEQ ID NO: 184241 - RNA, 44 nt, Homo sapiens
ccaacuaauuagaaggguguuacugaaggcaucggaugggagag

SEQ ID NO: 184242 - RNA, 48 nt, Homo sapiens
caguacuaauuuuuaaauaauuuacuggguugugaugacaaacccaug

SEQ ID NO: 184243 - RNA, 52 nt, Homo sapiens
acgcucauccuuggcugauaugagcccccuaauagagcagcaccaccuccuc

SEQ ID NO: 184244 - RNA, 45 nt, Homo sapiens
aaaugcaggcuugcagucugcgcauuguaaagcaggagcaccgca

SEQ ID NO: 184245 - RNA, 45 nt, Homo sapiens
auuaguuuuaaacccccagucugucacacucaaugaacaauucua

SEQ ID NO: 184246 - RNA, 89 nt, Homo sapiens
uugacuagagauaacuaacuccugucucaguuucaccauuucuuuuugccagcaaugagucguagaaggaaugugccugggaaguuuag

SEQ ID NO: 184247 - RNA, 17 nt, Homo sapiens
uuaacaugaagagcuuu

SEQ ID NO: 184248 - RNA, 45 nt, Homo sapiens
cuucaaaugcuuuuugcuuuucauuuauuauugcuugucacgcga

SEQ ID NO: 184249 - RNA, 44 nt, Homo sapiens
ggucauuguucuucuuuagaaaggucaugacuuuaauuauguug

SEQ ID NO: 184250 - RNA, 32 nt, Homo sapiens
uauguaggacgcuuugauauuuguugggccag

SEQ ID NO: 184251 - RNA, 21 nt, Homo sapiens
caaagaacaaguaaagccaca

SEQ ID NO: 184252 - RNA, 46 nt, Homo sapiens
cgccaugucagaugggucccugcugcaguucuaucaaucacccaag

SEQ ID NO: 184253 - RNA, 41 nt, Homo sapiens; identical to SEQ ID NO: 114212

SEQ ID NO: 184254 - RNA, 63 nt, Homo sapiens
cgaguuaaucuuggacagugacaaaugcugugaaacaauaaaaccggauaaaguggaagugag

SEQ ID NO: 184255 - RNA, 44 nt, Homo sapiens
ggaaacugggacccaaacggcuaaacgguuugcuuaggagacag

SEQ ID NO: 184256 - RNA, 46 nt, Homo sapiens
ucgccaugcugugcuugcucaucauucuggggcgcuauuuugccag

SEQ ID NO: 184257 - RNA, 47 nt, Homo sapiens
uggcccuauuuagaugauaaagagacagugauauuggaacuugcgag

SEQ ID NO: 184258 - RNA, 47 nt, Homo sapiens
gaggucuguuccuuuuauauaaguggacaaauuuugaguugccacag

SEQ ID NO: 184259 - RNA, 49 nt, Homo sapiens
guaagacuccagacuccagcuaacagucccuauggaaagauggcaucaa

SEQ ID NO: 184260 - RNA, 44 nt, Homo sapiens
uugauugcauuaggagguguuaucgcagcucgaauuucaguuua

SEQ ID NO: 184261 - RNA, 55 nt, Homo sapiens
acugcggagcugcagcaggacgacgcggccggcgcggcagacggccacggcucgg

SEQ ID NO: 184262 - RNA, 39 nt, Homo sapiens
ccagauuuuggaaaaccaaauauaaagggcuggacgugg

SEQ ID NO: 184263 - RNA, 41 nt, Homo sapiens
gagugaugacauuuacuguucuucccagugauuugcccuau

SEQ ID NO: 184264 - RNA, 44 nt, Homo sapiens
auaagggaagggaagcagucuaggcuuuaaauagcuucugagug

SEQ ID NO: 184265 - RNA, 39 nt, Homo sapiens
uacuggcaaauagcaucuuaccaggcgagaucucuccau

SEQ ID NO: 184266 - RNA, 38 nt, Homo sapiens
aauucaaaauguaauaugcaaaugaaucacccaagaau

SEQ ID NO: 184267 - RNA, 41 nt, Homo sapiens
ugcauuuuccauuuuaccgugcacuuguccucuaucuugaa

SEQ ID NO: 184268 - RNA, 82 nt, Homo sapiens
caacaacaaaagugucuauugcccaguccagcuguugucuccaccuuccuccucuuguuugcuuuuggaacaaaguuucuaa

SEQ ID NO: 184269 - RNA, 38 nt, Homo sapiens
agaaagcuugaguuacagggcuacugaguaaacgaacu

SEQ ID NO: 184270 - RNA, 45 nt, Homo sapiens
ugccaaaugcuguuaaaucaacugagagaaaucacaggcauucag

SEQ ID NO: 184271 - RNA, 76 nt, Homo sapiens
aguaauggugacauuacucaggcagucagccuucucacugaugagagaguuaaggagcccagucaagacacuguug

SEQ ID NO: 184272 - RNA, 56 nt, Homo sapiens
cuacagaaccaucugaaguagaggggagugcugccaacaaggaaguauuagcaagu

SEQ ID NO: 184273 - RNA, 53 nt, Homo sapiens
agguuacaguguagccgaaguuacucauuugacuaugcaguaggguaauaaaa

SEQ ID NO: 184274 - RNA, 95 nt, Homo sapiens
gaccuuacucaugauaacaaagaugaucuucaggcugccauugcuuugagucuacuggagucucccaaaauucaagcugauggaagagaucuuaa

SEQ ID NO: 184275 - RNA, 56 nt, Homo sapiens
ugcaugaagcaaccucugcagaaacuaaacgcucaaagagaaaacgcugugaaguc

SEQ ID NO: 184276 - RNA, 44 nt, Homo sapiens
ugguuggccaguugggcugaaaaauguuggcaauacauguuggu

SEQ ID NO: 184277 - RNA, 30 nt, Homo sapiens
gccagcccccgugcaacacacgcacacucu

SEQ ID NO: 184278 - RNA, 35 nt, Homo sapiens
guagaaagaauguagaauuauaccggggcuauuga

SEQ ID NO: 184279 - RNA, 219 nt, Homo sapiens
gaugaucuaauuagugacagcuuuguuuuuguuuuuaaauuauuuuuucagagacggggucucacucugucacccaggcuggaguacaguagugcaaucacagcuuauugcagccucaaacuccuggguuccagggaucuuccugccucaaccucccaaguagcugggacuacaggugcguaccaccaugcccggcuauuuuuuaauaggagguaggga

SEQ ID NO: 184280 - RNA, 57 nt, Homo sapiens
acuaauuagaucaucuucuuccucauaugauuuuuuuucuuucucuauuugaagguc

SEQ ID NO: 184281 - RNA, 59 nt, Homo sapiens
gggccaugguggagggugauguugagcuucuucccuccgaucacucggugaaguaugga

SEQ ID NO: 184282 - RNA, 69 nt, Homo sapiens
gagauuuuucuuagaaauugagaaauuguaaaaccaugaggcuauuucaaauuuccuuuguauauauaa

SEQ ID NO: 184283 - RNA, 46 nt, Homo sapiens
uacuuagguacauguacaggagcaaggagcuuauucgaaauaagag

SEQ ID NO: 184284 - RNA, 43 nt, Homo sapiens
guuuuggacaccuucaugcuuagaaauguaaaagaauauuaaa

SEQ ID NO: 184285 - RNA, 34 nt, Homo sapiens
ugcccuucagggaaauuaauggccuaauaaggga

SEQ ID NO: 184286 - RNA, 49 nt, Homo sapiens
aaaagaaacuguuaauggauaccauuagguaguagaacugagauggagg

SEQ ID NO: 184287 - RNA, 30 nt, Homo sapiens
uuugaaaauugaauuucuuguguauaguau

SEQ ID NO: 184288 - RNA, 61 nt, Homo sapiens
cgcucccggacaugcugaaauauguuauugaauuugcuaguacaaaaccugccucagaaag

SEQ ID NO: 184289 - RNA, 50 nt, Homo sapiens
caaagucacaggagcccucugauuuuauuccauccagucaugugcaacaa

SEQ ID NO: 184290 - RNA, 53 nt, Homo sapiens
aaagacuuguauugcaaguacuacucagacuauugaacagauguacugcgauc

SEQ ID NO: 184291 - RNA, 46 nt, Homo sapiens
aggugccuuaucgcuugcaugcaguucuuguucaugaaggacaagc

SEQ ID NO: 184292 - RNA, 48 nt, Homo sapiens
uaaugacaaacuacccuacuucaaugcagguaaaaguaucuuggcaga

SEQ ID NO: 184293 - RNA, 41 nt, Homo sapiens
uggaagcccuaucuguggaacucaagcauuacauucaggag

SEQ ID NO: 184294 - RNA, 46 nt, Homo sapiens
aggaaguagaggagugggaagaagagcagucuugcaaaaucccuca

SEQ ID NO: 184295 - RNA, 41 nt, Homo sapiens
auacccuucagcuggcuaggugaugccacagucuucacagu

SEQ ID NO: 184296 - RNA, 60 nt, Homo sapiens
gucugagcaugcugugauuguaaaggagcaaacugcccaggcuauugcaaacacagcccg

SEQ ID NO: 184297 - RNA, 56 nt, Homo sapiens
aguucccuuuuugguauuauggacaaaagauugccuucuaauuuaaaauagggaau

SEQ ID NO: 184298 - RNA, 44 nt, Homo sapiens
uuuuaggcauacaucuuucuuuauccuacugaauuagaacauag

SEQ ID NO: 184299 - RNA, 45 nt, Homo sapiens
auuaugaagguggcucaagcgaaacugaaggaaauugguccagau

SEQ ID NO: 184300 - RNA, 51 nt, Homo sapiens
ggguugggacucaauaauggaaagagucuaaaucccuauaauugcauuacu

SEQ ID NO: 184301 - RNA, 101 nt, Homo sapiens
uacagcauuagaaucacuuugggagcuuucauaaaaucccagugucccggucaucuaaacacuaauuaaaucagcuuaucagaagugggaaccaggcauca

SEQ ID NO: 184302 - RNA, 50 nt, Homo sapiens
cauguguaaagaaggauugaaaauaaaauugcacuuuuuagguacaaaau

SEQ ID NO: 184303 - RNA, 28 nt, Homo sapiens
gauaaaauaacuaguagcuguucaucug

SEQ ID NO: 184304 - RNA, 60 nt, Homo sapiens
uaaaaggcuucugauuggauauuguguuuuaaccaaauuuuaaagauuaauggaaucaug

SEQ ID NO: 184305 - RNA, 24 nt, Homo sapiens
agacauugugcuaggucuggggac

SEQ ID NO: 184306 - RNA, 42 nt, Homo sapiens
uuuuuuaauuuuugaaggagggaucaacuccaguuuccaaug

SEQ ID NO: 184307 - RNA, 57 nt, Homo sapiens
aacaaaagaagaaagaaacaaccuacugucuggagucauaacacaacuuuccuggau

SEQ ID NO: 184308 - RNA, 46 nt, Homo sapiens
aaucuauacauaccauuuccuuuugagcccagaaucuagauuugag

SEQ ID NO: 184309 - RNA, 46 nt, Homo sapiens
cccuucuuuugaaggacuccuuaggcuuuguugaaugaagcagaga

SEQ ID NO: 184310 - RNA, 47 nt, Homo sapiens
aauacuuucaggcacuaagacuaaucgaaugaacaaaguccacaguu

SEQ ID NO: 184311 - RNA, 37 nt, Homo sapiens
gaccccaaauuaagaaucuaggaagcucagaaacgaa

SEQ ID NO: 184312 - RNA, 24 nt, Homo sapiens
caacaccacagacacacacacgca

SEQ ID NO: 184313 - RNA, 41 nt, Homo sapiens
cccaaugacgccacacagacaaaggagaacgagagcaaagc

SEQ ID NO: 184314 - RNA, 45 nt, Homo sapiens
ucauaacuaggcaaaguaacaguguuuuugccucauuuuacagau

SEQ ID NO: 184315 - RNA, 50 nt, Homo sapiens
guguucucagacaggcggggcucagucugcucccaggacucacgggaggc

SEQ ID NO: 184316 - RNA, 25 nt, Homo sapiens
ugccagugccgcccuccagcugggu

SEQ ID NO: 184317 - RNA, 24 nt, Homo sapiens
gacuauuuauacagcagguuugga

SEQ ID NO: 184318 - RNA, 43 nt, Homo sapiens
aaaaaccaucaugcuagauuuacagagaaguuucugcauaucu

SEQ ID NO: 184319 - RNA, 24 nt, Homo sapiens
gaggugagaucaggugaggcuuga

SEQ ID NO: 184320 - RNA, 54 nt, Homo sapiens
ugggauaugcauaaccuaagcuggaugcuccaucuacccugaguucagugggac

SEQ ID NO: 184321 - RNA, 47 nt, Homo sapiens
caugauugacccuugcagcaaaggaaauaaaauuauagccuaauuaa

SEQ ID NO: 184322 - RNA, 24 nt, Homo sapiens
cugauuagugaaauaaaucuggga

SEQ ID NO: 184323 - RNA, 78 nt, Homo sapiens
gaaucuccugaagaauccauaugaguaugcgugcauguucauaguguucaagcaucaaagcugugugggaguuuuaga

SEQ ID NO: 184324 - RNA, 63 nt, Homo sapiens
ugcuagaaaaaugaugggcagaaaaagccuaauccaggcuccccuuggguugagaguccagau

SEQ ID NO: 184325 - RNA, 44 nt, Homo sapiens
ucuaaggugaaggauggauuccacuuaccuuuucaguguuugug

SEQ ID NO: 184326 - RNA, 44 nt, Homo sapiens
aucaagacacucaggaggaaagcucaaaaccucuguuugccuug

SEQ ID NO: 184327 - RNA, 30 nt, Homo sapiens
uagggacauggauauaucagagcagggaug

SEQ ID NO: 184328 - RNA, 38 nt, Homo sapiens
auaacagugaaggggaaggcaccaacacauuauuaaag

SEQ ID NO: 184329 - RNA, 46 nt, Homo sapiens
cagaggccacagguggggugcccauccucaaauacaaagcugagug

SEQ ID NO: 184330 - RNA, 46 nt, Homo sapiens
augguggugcguagccaugcccgugugucgucgcugacccugaaga

SEQ ID NO: 184331 - RNA, 46 nt, Homo sapiens
ggugccacagugcucucucaugguuuguaugacuuuaguggaaggu

SEQ ID NO: 184332 - RNA, 61 nt, Homo sapiens
uacuaaaaauaugacacauacaaacacccuguggcuugagaaugacuguuugaguccaucu

SEQ ID NO: 184333 - RNA, 49 nt, Homo sapiens
aguguaauuaaugcagacuucaggagggcuacugccucuuugaucugga

SEQ ID NO: 184334 - RNA, 45 nt, Homo sapiens
uucccuccaucaccuggaggacuucuacccggaacaucagcagcg

SEQ ID NO: 184335 - RNA, 46 nt, Homo sapiens
guaaacuggaaagugugaacuguccacaaaagagggcuugggggau

SEQ ID NO: 184336 - RNA, 25 nt, Homo sapiens
gagcccugggcagccucucgggccc

SEQ ID NO: 184337 - RNA, 46 nt, Homo sapiens
ucaugucugcucagcuaagcaauuuggugucuguugauagccaaac

SEQ ID NO: 184338 - RNA, 42 nt, Homo sapiens
gcucuuggugacccacuuuuauuucagagcccaggacuagga

SEQ ID NO: 184339 - RNA, 45 nt, Homo sapiens
gguugcugggugaugucaugcccuugugggagaucuguauuucuu

SEQ ID NO: 184340 - RNA, 48 nt, Homo sapiens
aaaucaggcuucauuaggauuaucccugaggcuaagaaagagcaagug

SEQ ID NO: 184341 - RNA, 45 nt, Homo sapiens
cagggaagcagcuaugugcguggucucugcuguuuuaauagcagc

SEQ ID NO: 184342 - RNA, 42 nt, Homo sapiens
auguugucaaguuuuacuuuucaaaaauacugcucguggcag

SEQ ID NO: 184343 - RNA, 46 nt, Homo sapiens
aauaaagcuguuuuaccaugaaaagucgguauuuugccuuggaucu

SEQ ID NO: 184344 - RNA, 38 nt, Homo sapiens
auauugguucacugaauuauacaguguugacaauaaua

SEQ ID NO: 184345 - RNA, 44 nt, Homo sapiens
uggaauauauauugcaaggucacccuagagagaagcaaugaaga

SEQ ID NO: 184346 - RNA, 30 nt, Homo sapiens
gggugauuggauguccuggguugcccagga

SEQ ID NO: 184347 - RNA, 55 nt, Homo sapiens
gaaauacagauuugucaugacgugggcaagaagcaaguagagauagugaaaagaa

SEQ ID NO: 184348 - RNA, 40 nt, Homo sapiens
uaauggaaugaugcagauagacuccgguuucugguggguu

SEQ ID NO: 184349 - RNA, 40 nt, Homo sapiens
ucuggcugaggacagggcagaggaagugggagaguagaua

SEQ ID NO: 184350 - RNA, 45 nt, Homo sapiens
agcgggggugggggagcuggagagagagagagagcguguuuagga

SEQ ID NO: 184351 - RNA, 45 nt, Homo sapiens
cauuuaucgcccuuacguuuugauuauaucaaaacugcagcagag

SEQ ID NO: 184352 - RNA, 25 nt, Homo sapiens
ggugacaaagcagaaauagauuaug

SEQ ID NO: 184353 - RNA, 25 nt, Homo sapiens
cuuguguuugacacgaucaauggau

SEQ ID NO: 184354 - RNA, 42 nt, Homo sapiens
cauuuauuuacuuuuuauuugacuaauugguauaguagucaa

SEQ ID NO: 184355 - RNA, 62 nt, Homo sapiens
gaaaaauuauguuaauaucguuuugucaucaccaaaaacuaauuaguuuuuuguauaaccag

SEQ ID NO: 184356 - RNA, 100 nt, Homo sapiens
guuggagaacaggugaagaggagguggggugggggggggggcgggguggugguggcggugcaggggaagggaacaggcaaagcuuuuuuuguuuacagga

SEQ ID NO: 184357 - RNA, 45 nt, Homo sapiens
gcauggaggcuauggaggugacauuuaucccagccauugucagau

SEQ ID NO: 184358 - RNA, 46 nt, Homo sapiens
aaagaaacuaaaucuugauauuucauggaguuuuuaucaaaacuca

SEQ ID NO: 184359 - RNA, 39 nt, Homo sapiens
aaaggaacaaauacaucaaugucugcccuuugguguccu

SEQ ID NO: 184360 - RNA, 40 nt, Homo sapiens
gauggcaggacgggggucccgugagguaaaggagucuaag

SEQ ID NO: 184361 - RNA, 39 nt, Homo sapiens
agcccauaugccaaaauguguuuguugaauucaccuuuu

SEQ ID NO: 184362 - RNA, 48 nt, Homo sapiens
aaguaagauauuuauauguaccucucccuucuggaaaaaaauauaaca

SEQ ID NO: 184363 - RNA, 33 nt, Homo sapiens
acccuuacuagccagaugaccuggagucauuca

SEQ ID NO: 184364 - RNA, 43 nt, Homo sapiens
ucacuauaaaggaaaagauaaggucauuugcugauagacaggg

SEQ ID NO: 184365 - RNA, 86 nt, Homo sapiens
aauauggacaguucagugagaaaaaaaaaaucuguaggcaagaaaugauucucuaauuuuaaucucguaaauguccacauaaaggu

SEQ ID NO: 184366 - RNA, 103 nt, Homo sapiens
aguguaggaugaacauaugaauuuauuaaaguggagauugagagauaaguaauuuuuguaaaaggaagucguauaaagaucccuugaacccauccaacuuuag

SEQ ID NO: 184367 - RNA, 66 nt, Homo sapiens
auuaauuacaacaaauauaccaugcuaauauaagaugcuaauaauggagaaacguugcgaguugau

SEQ ID NO: 184368 - RNA, 83 nt, Homo sapiens
gaaauugacacagaaauugacaugugaggaacuuaaggagauguaacaacaaauuauaauaugauacccuggauaggguccug

SEQ ID NO: 184369 - RNA, 46 nt, Homo sapiens
ucaacaaaauauaacguuuaauauagaucaagaugguuucauauag

SEQ ID NO: 184370 - RNA, 51 nt, Homo sapiens
uguccccauuuuuuaggucagcagacuguggcuuacacacuaaugccagau

SEQ ID NO: 184371 - RNA, 46 nt, Homo sapiens
aauauuuauuuaacuaaguauuuauugacuugaggaaauucucauc

SEQ ID NO: 184372 - RNA, 95 nt, Homo sapiens
acacaacgauagcuagauggauagcgagauggaugaacagacagaaagacagaugaacaggaagaaagaaaggaagauagaaagauggacagaaa

SEQ ID NO: 184373 - RNA, 27 nt, Homo sapiens
ccgaaugcagguguucuugaaagcccu

SEQ ID NO: 184374 - RNA, 31 nt, Homo sapiens
ggcuccacugaguuaaaauuagguuaaaguu

SEQ ID NO: 184375 - RNA, 48 nt, Homo sapiens
gauuuuagaacgcagugggguuaaaggagaaccaauagcaacaggguu

SEQ ID NO: 184376 - RNA, 45 nt, Homo sapiens
gggaugugcuucagcaaaauaagggagaaaauuaagaaaggaggu

SEQ ID NO: 184377 - RNA, 49 nt, Homo sapiens
ugccauuuacuagacuuugcuaaaccccuaaaauagcaaagguagauaa

SEQ ID NO: 184378 - RNA, 47 nt, Homo sapiens
uauaguauuacaagaaauuuuuguggcuuuaaaaaccugcuguagac

SEQ ID NO: 184379 - RNA, 42 nt, Homo sapiens
aauauuuccuauuuauacauuauaucaauuaaagcccucaaa

SEQ ID NO: 184380 - RNA, 56 nt, Homo sapiens
uagacgccaccuuuggcucuuucauugccguuuuucugcaucugugugguagucuu

SEQ ID NO: 184381 - RNA, 41 nt, Homo sapiens
gacaguuugaauccuugacucuucagcaguuuccaugaggu

SEQ ID NO: 184382 - RNA, 62 nt, Homo sapiens
uacuggugcaagcugguggcccuacacacuaccaggucacacacagugcucagcuagaagga

SEQ ID NO: 184383 - RNA, 28 nt, Homo sapiens
gggcugaaaaugggggagcaguuguuuc

SEQ ID NO: 184384 - RNA, 44 nt, Homo sapiens
auaauugccccacccucaccuagccccagguuauggucccaucu

SEQ ID NO: 184385 - RNA, 46 nt, Homo sapiens
ucuguuuggcuaguucuauugaaguaaucaaucaacucugccugac

SEQ ID NO: 184386 - RNA, 45 nt, Homo sapiens
gaucuuuggccguaucucauauauaaauguaauauagccucagug

SEQ ID NO: 184387 - RNA, 39 nt, Homo sapiens
caguaguuaugaaaguugaauugcuguauuuaggaauga

SEQ ID NO: 184388 - RNA, 66 nt, Homo sapiens
acaucuucccacugggucacugguuggguccuugggcaaacauuacugcccuggucuaugguugaa

SEQ ID NO: 184389 - RNA, 53 nt, Homo sapiens
uggauggacuggacugucuccaggacuuuggucuacaaggcuaguucugggau

SEQ ID NO: 184390 - RNA, 45 nt, Homo sapiens
gucuggcuuugauaucaggguaaugcugacuuaguaaaaugaguu

SEQ ID NO: 184391 - RNA, 44 nt, Homo sapiens
auucacucugucucaguuuuaaugaaguuuguuugcaguccaua

SEQ ID NO: 184392 - RNA, 52 nt, Homo sapiens
aaguuacuguuuuguauauuuucaaaaagaauuaaaaccacagagcugcccu

SEQ ID NO: 184393 - RNA, 37 nt, Homo sapiens
agaggaccaggaacggaacuuagccaagcacuuauac

SEQ ID NO: 184394 - RNA, 51 nt, Homo sapiens
uaggagagaucacguuagagacauaaaucuguaguuauuuaaguaguagau

SEQ ID NO: 184395 - RNA, 46 nt, Homo sapiens
agagggaagauugaugaacuuagugacugauuuggauaugcaagag

SEQ ID NO: 184396 - RNA, 46 nt, Homo sapiens
aaguggaaaagcugaauacuggagaauuagugcaguguuuugugga

SEQ ID NO: 184397 - RNA, 51 nt, Homo sapiens
auguguguucccuguuugggaggugaauggaggaaucccaguuaaagagac

SEQ ID NO: 184398 - RNA, 49 nt, Homo sapiens
auauauuaagaaagaaguaagagaggaaggaaaaaggggaggaaggagg

SEQ ID NO: 184399 - RNA, 51 nt, Homo sapiens
uaaagcaggaaauuuuggaaagauacacuuguaaugauuuuggauaaggau

SEQ ID NO: 184400 - RNA, 39 nt, Homo sapiens
auugaagagcaguuaaaggcuggaacuuggggcaagcca

SEQ ID NO: 184401 - RNA, 42 nt, Homo sapiens
gcuucaggaaucguguggaguuucacguuaugaaguccagga

SEQ ID NO: 184402 - RNA, 55 nt, Homo sapiens
ggaaugaaagcgaccucuuuccuggcccgguaccuugaggaugggaagaaggcag

SEQ ID NO: 184403 - RNA, 44 nt, Homo sapiens
agcgugacaauggagcccggauauuuggugggccuuuuggggga

SEQ ID NO: 184404 - RNA, 43 nt, Homo sapiens
accugcccuggacggccgacccccgguuggggagcgcacgggg

SEQ ID NO: 184405 - RNA, 42 nt, Homo sapiens
aggauuugcgcuuuggcucugauggacgggagggaaggaaga

SEQ ID NO: 184406 - RNA, 47 nt, Homo sapiens
gguugcgccgccgcccagagaaccucggcagugugcagggaggugca

SEQ ID NO: 184407 - RNA, 43 nt, Homo sapiens
gugggcacagucucugcacauuguacugccuuuaauaauuugc

SEQ ID NO: 184408 - RNA, 45 nt, Homo sapiens
cauggagagguaugugcagaaaauauuugugugguuuuugcagau

SEQ ID NO: 184409 - RNA, 52 nt, Homo sapiens
gauguuuugggguaaauauuuaaguauagcuuuuggggacagaucuaauaau

SEQ ID NO: 184410 - RNA, 41 nt, Homo sapiens
augguuuaaagcauuuuucuuuguccuagaguacacaacaa

SEQ ID NO: 184411 - RNA, 50 nt, Homo sapiens
uuaagguuuguuugugcuaauuuguaugguacaaucuucuaauuagggaa

SEQ ID NO: 184412 - RNA, 50 nt, Homo sapiens
accaggcgcugcaacuccgcuucaucggcuucgcccagcuccgccauugu

SEQ ID NO: 184413 - RNA, 45 nt, Homo sapiens
uaucccaacauaacuccaugaagugaugcaccuaaaaggaaagaa

SEQ ID NO: 184414 - RNA, 45 nt, Homo sapiens
uggugauggcaagaguggugucaaugaagcggucuacacagcugg

SEQ ID NO: 184415 - RNA, 31 nt, Homo sapiens
acaucuugccuuuuuuuuuuuuuuuuugcca

SEQ ID NO: 184416 - RNA, 48 nt, Homo sapiens
auuacguuuaguguagagugcauauacagcaaauuaaaggacccagaa

SEQ ID NO: 184417 - RNA, 46 nt, Homo sapiens
aggaaagugaggaaagagacacuaagaaaaccaaaaggaaaaagag

SEQ ID NO: 184418 - RNA, 46 nt, Homo sapiens
uaaagucaucuacccaugaaucccgcaaacacaagaagucaaagaa

SEQ ID NO: 184419 - RNA, 45 nt, Homo sapiens
uggaauaaaaaguucuaugauuaugaagcaaacaugccagacagg

SEQ ID NO: 184420 - RNA, 46 nt, Homo sapiens
cagauugcuuuuacaucuaaaaguucuucugcuuucucuuuuagcc

SEQ ID NO: 184421 - RNA, 46 nt, Homo sapiens
aggaggaaucagauauguggaaaauaagagaacuggaaaaacagau

SEQ ID NO: 184422 - RNA, 62 nt, Homo sapiens
guggcaugaucauaguuauauuuuagaaagaugguuugucagcuggguagggaaugaaucag

SEQ ID NO: 184423 - RNA, 36 nt, Homo sapiens
gagacuucuuccucuaggcaauaaagaagccaucaa

SEQ ID NO: 184424 - RNA, 53 nt, Homo sapiens
uacacaugguuauuccccccuacuugagauaaucuaaauauaaaccagcuacu

SEQ ID NO: 184425 - RNA, 45 nt, Homo sapiens
uaaguuauuuauaaugggcauuacugaauuuuuaaaaugccgauu

SEQ ID NO: 184426 - RNA, 46 nt, Homo sapiens
uuucucugcuauuauuaacccaccucaagcauguauuuuggcaauu

SEQ ID NO: 184427 - RNA, 45 nt, Homo sapiens
ucauuauuaccuuucuaucgauguaaauaugggagaaguuuuguu

SEQ ID NO: 184428 - RNA, 52 nt, Homo sapiens
agugaggauaaauacaauccuagccaacucaguuuucguaaugaaggaaagg

SEQ ID NO: 184429 - RNA, 43 nt, Homo sapiens
gauguaaacuuuuaaucuuucagaccagucuuugaagugguga

SEQ ID NO: 184430 - RNA, 42 nt, Homo sapiens
agaauugcugcugucuaaacuaggcaaaggaagucaagaaga

SEQ ID NO: 184431 - RNA, 41 nt, Homo sapiens
gugggugagaagcuaagugaaggagacuuacuggcagagau

SEQ ID NO: 184432 - RNA, 42 nt, Homo sapiens
ccauuauauuuaugcauucuuucucuuccuuaggccugagga

SEQ ID NO: 184433 - RNA, 45 nt, Homo sapiens
ccacuguuggauuugagagccuggaggaguguuauauggcaaaga

SEQ ID NO: 184434 - RNA, 43 nt, Homo sapiens
uggcacaggggcgaaaugggaaaucuggagaggagggauuggg

SEQ ID NO: 184435 - RNA, 42 nt, Homo sapiens
gggugggggguggcuggucccaggagaucaguuaagcccaga

SEQ ID NO: 184436 - RNA, 89 nt, Homo sapiens
ccucacacucaccuagccaccauggacaucgccauccaccaccccuggauccgccgccccuucuuuccuuuccacucccccagccgccu

SEQ ID NO: 184437 - RNA, 48 nt, Homo sapiens
ggagagcaccuguuggagucugaucuuuucccgacgucuacuucccug

SEQ ID NO: 184438 - RNA, 41 nt, Homo sapiens
agguguugggagaugugauugaggugcauggaaaacaugaa

SEQ ID NO: 184439 - RNA, 43 nt, Homo sapiens
cagcugauguagacccucucaccauuacuucaucccugucauc

SEQ ID NO: 184440 - RNA, 72 nt, Homo sapiens
caggucucuggcccugagcgcaccauucccaucacccgugaagagaagccugcugucaccgcagcccccaag

SEQ ID NO: 184441 - RNA, 28 nt, Homo sapiens
uaaguuaggaagaguuuuucuguuccau

SEQ ID NO: 184442 - RNA, 70 nt, Homo sapiens
gcugagcaguuuagucaaauuuguccuucagucaaauggaaaggauuauaugauucgugugaagacucau

SEQ ID NO: 184443 - RNA, 46 nt, Homo sapiens
cacccagcagcaaguagcaucaaugcagucccaguuuaggaaggag

SEQ ID NO: 184444 - RNA, 49 nt, Homo sapiens
ucucaaugauuuuggacugacuugugaccucugccucugugcucccugg

SEQ ID NO: 184445 - RNA, 48 nt, Homo sapiens
agggggauaauauugcuaaauguacuugaaacaaacaagccaggaaaa

SEQ ID NO: 184446 - RNA, 47 nt, Homo sapiens
aggaccucuggccacccggauuguuccuacugacaugaaugaccaga

SEQ ID NO: 184447 - RNA, 48 nt, Homo sapiens
ugccucuggcauucccugguuauuaguuucuugugggguguguguggg

SEQ ID NO: 184448 - RNA, 42 nt, Homo sapiens
gcgcaucagagcucgggaccggcccaggagcagcggguggag

SEQ ID NO: 184449 - RNA, 64 nt, Homo sapiens
caguauuaagaaguuaucaacaauugcccuagcacuuggaguagaaaggacccgaagugaauug

SEQ ID NO: 184450 - RNA, 47 nt, Homo sapiens
gugauuucugucucuaguucugacuuuuccauggaacuccugaggua

SEQ ID NO: 184451 - RNA, 87 nt, Homo sapiens
cuuccaaauugggugaauuugcaaaaguuuuggaauuagacagugugaaaagugaaauuguuccacuguucacuagucuagcuucag

SEQ ID NO: 184452 - RNA, 46 nt, Homo sapiens
ugacguucguuugaauaucaucuccaauuuggauuguguaaaugaa

SEQ ID NO: 184453 - RNA, 58 nt, Homo sapiens
auauauguauuuaguguaucucuuuguucaucuaugggugcuuaugccuggaaauuug

SEQ ID NO: 184454 - RNA, 37 nt, Homo sapiens
uuguuuuguacuuaaucacaggagcuuuuuugcuuuu

SEQ ID NO: 184455 - RNA, 57 nt, Homo sapiens
cuuccuaugguaauggcauuaugauaaaaaucuaaagcguguuaaaaaaaauaguaa

SEQ ID NO: 184456 - RNA, 47 nt, Homo sapiens
gggaggacagggaaggguuugggccaaagacaaagacuauggauaug

SEQ ID NO: 184457 - RNA, 42 nt, Homo sapiens
auccgagaagcugccaccaacaaccucaugaaacuaguucag

SEQ ID NO: 184458 - RNA, 41 nt, Homo sapiens
uuuacaguaaaaccucauuaauucugaaauuuaagauaaug

SEQ ID NO: 184459 - RNA, 46 nt, Homo sapiens
auuguugauuuuguucacaaccucuuuuaaaucuaacaaguccugu

SEQ ID NO: 184460 - RNA, 41 nt, Homo sapiens
gguggcauggugugcagggagcugccacaggguaggcggag

SEQ ID NO: 184461 - RNA, 49 nt, Homo sapiens
aucaccucccaguccaacagcgaggcccauacagaggacaccagugggg

SEQ ID NO: 184462 - RNA, 65 nt, Homo sapiens
uggaaauggugugaaaagccccaguucagcagucagugggugccagccacugccccagggccauu

SEQ ID NO: 184463 - RNA, 55 nt, Homo sapiens
uagugaaaauucaaugaaguaacaucaaaaaggcugccuuuuaagucacauggcu

SEQ ID NO: 184464 - RNA, 49 nt, Homo sapiens
agggagccuuccaugcauuuguuucacuuaaggaaaaugacccgagggu

SEQ ID NO: 184465 - RNA, 49 nt, Homo sapiens
caucccugauacuacacguuguucuguuugcauguuuguuacugcagca

SEQ ID NO: 184466 - RNA, 41 nt, Homo sapiens
uuaugaguucuccccagaccaaauggggaggaguaaggagu

SEQ ID NO: 184467 - RNA, 46 nt, Homo sapiens
gcugugaacccaucagaaaguggguuugugacucuggugagcgugg

SEQ ID NO: 184468 - RNA, 55 nt, Homo sapiens
cuguacuuccagaagaaacacaggaagaagaugccaaaaaaacauuuaaagaaag

SEQ ID NO: 184469 - RNA, 45 nt, Homo sapiens
ggaugagaaaaagaaaaggucuaauuuaugugugauaaagcaagu

SEQ ID NO: 184470 - RNA, 29 nt, Homo sapiens
uacauguuccaguggaaugaugaccggug

SEQ ID NO: 184471 - RNA, 44 nt, Homo sapiens
caaagcaauagcacagccugccaggaccuuuaugcuuggacuga

SEQ ID NO: 184472 - RNA, 72 nt, Homo sapiens
ugaggaagccaaagaagccugcaggagggauggaggccagcuagucagcaucgagucugaagaugaacagaa

SEQ ID NO: 184473 - RNA, 42 nt, Homo sapiens
uagggcagccagucugccggggagggacacagaggccuuguu

SEQ ID NO: 184474 - RNA, 42 nt, Homo sapiens
gagccccaccuugucauauaccaucaauaaaguacccugugc

SEQ ID NO: 184475 - RNA, 46 nt, Homo sapiens
uuguuucaaauucagcggcuuugauucagcaagccacaacaguuaa

SEQ ID NO: 184476 - RNA, 25 nt, Homo sapiens
uacagaaagaagaugccagaugaca

SEQ ID NO: 184477 - RNA, 41 nt, Homo sapiens
uaaaaaacugcaauccugaauauuagucuccuuucucaaau

SEQ ID NO: 184478 - RNA, 53 nt, Homo sapiens
uaagccuaauuuuaauuauuuuaaauuuuuuucugccuuuucggacuuagaaa

SEQ ID NO: 184479 - RNA, 46 nt, Homo sapiens
uaccuuaacauuccucuauguucuucaugccaguucuguauucuuu

SEQ ID NO: 184480 - RNA, 46 nt, Homo sapiens
uuuuuauuuuuuauuucaaaauaguugacuccauacauuucuagau

SEQ ID NO: 184481 - RNA, 29 nt, Homo sapiens
aagacaagaaacuacuuugaaaaacagga

SEQ ID NO: 184482 - RNA, 45 nt, Homo sapiens
uaaggccaaaauccgcuuauugauucucagacgaggugcauaaaa

SEQ ID NO: 184483 - RNA, 44 nt, Homo sapiens
accuuuccaacugcuucugauguuucuccucccuagccugagcc

SEQ ID NO: 184484 - RNA, 45 nt, Homo sapiens
auuucgcccuuauuuauaaaccuacauuuuaaaauuccugcagcu

SEQ ID NO: 184485 - RNA, 395 nt, Homo sapiens
aauacacaaaaauauuauucaugugauggaauacuacucugccauaaaaaguaacaaaauaaugucuuuugcagcaacuuggaugaagcuggaggccaugauucuaagugaaguaacucagaacauacaaaugccauauguucucacuuauaagugggagcuaagcuaugaggaugcaaagacagaguaauauaaucgacuuuggugacuugagaagcaaugguugggaauggggugagggacaaaagaccacauauuggguauaguguacauugcucgagugacaggugcacuaaaaucucagaauacacaaugauagaacccauucauguaaacaaaaaccaccuauauuccaaaaacuacugaaauaaaauaauaauaauuggaaauaguau

SEQ ID NO: 184486 - RNA, 45 nt, Homo sapiens
uggaguuacuguaaaagaugugaaccagcaggaguucaucagagc

SEQ ID NO: 184487 - RNA, 70 nt, Homo sapiens
uuuuucuucuuggcuuccucuagaagugcaaucuuggcagugaauucagcaaguucugcugccuaaagua

SEQ ID NO: 184488 - RNA, 50 nt, Homo sapiens
aucauguucguuuucuguuggaggaaugacugguggugguggagguggag

SEQ ID NO: 184489 - RNA, 42 nt, Homo sapiens
uuucgguuacacguucuuccucgcuucuaugguucauuaccc

SEQ ID NO: 184490 - RNA, 53 nt, Homo sapiens
uaagucccacagaagugcugacacgaagauaaaaugcagagcucaggcuugga

SEQ ID NO: 184491 - RNA, 33 nt, Homo sapiens
aagcaaaacugguaggaguuuguaaaugaguau

SEQ ID NO: 184492 - RNA, 39 nt, Homo sapiens
aaaagaaagugaaauaugacauugaauagggucauuaau

SEQ ID NO: 184493 - RNA, 61 nt, Homo sapiens
gcauagcauaaacucaacuuguaugauguuuaauuuuuuuuuuuuaaaucugggagaagag

SEQ ID NO: 184494 - RNA, 47 nt, Homo sapiens
uggugaucuuagauauugaaaacuaaucagggaaaguagauugagag

SEQ ID NO: 184495 - RNA, 45 nt, Homo sapiens
guuuuacucuggcuuucaccucucauucuuccuuugaauaugugg

SEQ ID NO: 184496 - RNA, 47 nt, Homo sapiens
caagcacacucccagauccagauaaauacagaagcucugaagauuca

SEQ ID NO: 184497 - RNA, 47 nt, Homo sapiens
guuuguauacaucgugccacccaaauguaaucguucagaggaaguga

SEQ ID NO: 184498 - RNA, 46 nt, Homo sapiens
uuuaugccaaaaagaaaguuauaucaacuuccucuuuguggcaauu

SEQ ID NO: 184499 - RNA, 366 nt, Homo sapiens
guuaauuaauuuuaaaacucuaggccgggcaugguggcucaugcguguaaucccagcacuuugggaggccgagauggguggaucaccugcggugagggguucaagaccagccuggccaacauggcaaaacccugucucuacuaaaaauacagaaauuagccaggcauggugguacccgucuauaaucccagcauacucgggagggugaggcagaagaaucacuuuaaccugggagguggaggcugcagugagccgagauuacgccacugcaguccagccugggugacagagcgagacucugucucaaacaaaacaaacaaacaaaaaaaaccaccaaaaaaaacaaaaaacaaaaaacaaaacaaa

SEQ ID NO: 184500 - RNA, 23 nt, Homo sapiens
agaugguagcccuuuuguaagag

SEQ ID NO: 184501 - RNA, 50 nt, Homo sapiens
agacugaaagaaagggaagccagaagagaagccaacaagagacaagcaaa

SEQ ID NO: 184502 - RNA, 66 nt, Homo sapiens
aaagacuucaggaagaggacaaauuugacaaagaagaauauaggaaaaaaauuaaggcaaagcauc

SEQ ID NO: 184503 - RNA, 91 nt, Homo sapiens
guucagcaguggccacaaaugcagaaaucugccaucaaggaugcugaggaagaugaugacacaggugguaucaacuuacauaaagcaaagg

SEQ ID NO: 184504 - RNA, 45 nt, Homo sapiens
agacgaaaagucacaaaaucgugugccauucaaaggugguggaag

SEQ ID NO: 184505 - RNA, 79 nt, Homo sapiens
cuucuaaauccagcaucaagaaaaaaaugaccaaaguugcagaagcaaaaaaaguaaugaagagaaauuuuaaagugaa

SEQ ID NO: 184506 - RNA, 44 nt, Homo sapiens
gaaaaagugguuguugagggcaaugacagccccagcauugaagg

SEQ ID NO: 184507 - RNA, 43 nt, Homo sapiens
aaaaccuuugguggauuccugaauggaaaaucuuuagaacuuc

SEQ ID NO: 184508 - RNA, 52 nt, Homo sapiens
ggcugacagugaauacuccuuuccuucuuuccuuucucggacaauaauauug

SEQ ID NO: 184509 - RNA, 44 nt, Homo sapiens
uucugauaacacaagcaagaacacaaauccuuccugcuaauaaa

SEQ ID NO: 184510 - RNA, 58 nt, Homo sapiens
auuguaggcuguguaguaauuaugguacaaacugcugugguuuuguaagaccuguucu

SEQ ID NO: 184511 - RNA, 109 nt, Homo sapiens
agaucaaggaaguuccuacacaguucuuggacagagaugaggaggaagaagaugcugauuucuugaaggugaagcggcauaauguguuuggauuggaccuuaaagacga

SEQ ID NO: 184512 - RNA, 46 nt, Homo sapiens
acagacaggauaaugauacugguaaugaagaacaggaagaagaaga

SEQ ID NO: 184513 - RNA, 36 nt, Homo sapiens
aauauacauuguguaauugcuaaaugaagcuaacua

SEQ ID NO: 184514 - RNA, 42 nt, Homo sapiens
auagauguccagaaaaaauuggaaucuauuuuagcucaagau

SEQ ID NO: 184515 - RNA, 51 nt, Homo sapiens
ucuuaaugacugaggagaugaagaggaguuagaacaacaucacauuauugu

SEQ ID NO: 184516 - RNA, 57 nt, Homo sapiens
aaguguuuuuuuuuuuuguuuuuuuugauugauucauguuuauccugugggccaucu

SEQ ID NO: 184517 - RNA, 30 nt, Homo sapiens
cacagacuguccuguuuggcaggcuugcuu

SEQ ID NO: 184518 - RNA, 42 nt, Homo sapiens
cuaagugauuuggaaucauagauaucucuuuuuccuuucuuc

SEQ ID NO: 184519 - RNA, 45 nt, Homo sapiens
ccuugcacuccauggucgacagcagcaaaugagaagaauggaagu

SEQ ID NO: 184520 - RNA, 41 nt, Homo sapiens
uaaagcccuaaugagauguggaauacuaaucagcccagcaa

SEQ ID NO: 184521 - RNA, 46 nt, Homo sapiens
uauuaacccauuuuauuuuugauggauuucaggguaaauugcagau

SEQ ID NO: 184522 - RNA, 49 nt, Homo sapiens
ucaggguacuugaauguagcauuucccaaaauguggucugggaggggaa

SEQ ID NO: 184523 - RNA, 46 nt, Homo sapiens
uaucaccuacgagagaacuggccuaucagaccuuugagguucuccg

SEQ ID NO: 184524 - RNA, 23 nt, Homo sapiens
ggaaagcgcucccugcaaucccu

SEQ ID NO: 184525 - RNA, 42 nt, Homo sapiens
acaacagcgugaaaccagcaggacaaguuuuaagaaguugca

SEQ ID NO: 184526 - RNA, 32 nt, Homo sapiens
ugucucuucgcugauacaacaaggugcuaguu

SEQ ID NO: 184527 - RNA, 35 nt, Homo sapiens
agaucguacauugcagaagaaaagagaacuuagag

SEQ ID NO: 184528 - RNA, 42 nt, Homo sapiens
gaacaauggcaccucucucauccccaaaccuuuuggggacuu

SEQ ID NO: 184529 - RNA, 52 nt, Homo sapiens
acccacaaagagaggguuaagugugaggugggacagaugugggguugaaagu

SEQ ID NO: 184530 - RNA, 46 nt, Homo sapiens
ugguaauaguagcaguaaagccuguguggcuguaguaggucccuag

SEQ ID NO: 184531 - RNA, 38 nt, Homo sapiens
caacuugcuuuuaacuauuaggccuguuuggcagaggc

SEQ ID NO: 184532 - RNA, 54 nt, Homo sapiens
aggucauaccuccccaaaguguuuaccuaaucaguagguucacaaacucuuggu

SEQ ID NO: 184533 - RNA, 52 nt, Homo sapiens
uaauaaauuauagacugcuugaacaguuguguccagauuaagggagauaaua

SEQ ID NO: 184534 - RNA, 74 nt, Homo sapiens
cuucaguauaugaauuacccuuucauucagccuuuagaaauuauauuuuagccuuuauuuuuaaccugccaaca

SEQ ID NO: 184535 - RNA, 46 nt, Homo sapiens
gacuggaccaugaauccuuugaaagcuuuguauuuacagcagaggc

SEQ ID NO: 184536 - RNA, 46 nt, Homo sapiens
aaauccuuccuacuccugagacaguuccuuuuagacucaccagaga

SEQ ID NO: 184537 - RNA, 50 nt, Homo sapiens
uuuauacuaaaguuguagaaaccagaauauuggauuugagggacauuuuu

SEQ ID NO: 184538 - RNA, 69 nt, Homo sapiens
uuuucagaaauauaauuucaggagcacuuuggggagugguauuggcagcaggaagaaaaauuaagggau

SEQ ID NO: 184539 - RNA, 77 nt, Homo sapiens
uuaauagaugaggugucuuuugagccuggucuucaagaaagaaagaaagcauaauucagacagaagauagagcagau

SEQ ID NO: 184540 - RNA, 43 nt, Homo sapiens
ggguuuuuuuguuuucagcauaaacaguuguccuagaagaaac

SEQ ID NO: 184541 - RNA, 81 nt, Homo sapiens
aaaucuauguaucuauucuuuuuaguaaauauuuggucaucauggaauguuguuugccuaccaagauauuacaaauauaag

SEQ ID NO: 184542 - RNA, 37 nt, Homo sapiens
uucaucuuuauugccccuauaucugucauauuuuuau

SEQ ID NO: 184543 - RNA, 68 nt, Homo sapiens
aaugauuucagugccuuucagugccaaaagaaaaugauggugagugacacccaaaauuaaagguuauu

SEQ ID NO: 184544 - RNA, 46 nt, Homo sapiens
aggucuuccagauguguaauacauuacugcagagaaacacggaaac

SEQ ID NO: 184545 - RNA, 41 nt, Homo sapiens
uuuaccaaaaauaauagauuguguagguuccgauggcaagg

SEQ ID NO: 184546 - RNA, 46 nt, Homo sapiens
ccuuagcaaaugcaaacagagaugaauuucugacuaaaccagaggu

SEQ ID NO: 184547 - RNA, 46 nt, Homo sapiens
caguuaccauaggagagggucuagaauggggcauuagauuggagga

SEQ ID NO: 184548 - RNA, 45 nt, Homo sapiens
uuaaacaguacaauucaguuagcuguggagucucugaguggcagc

SEQ ID NO: 184549 - RNA, 44 nt, Homo sapiens
gccuuucaaauauuucagacuguaagacugcuauaaaauuagag

SEQ ID NO: 184550 - RNA, 62 nt, Homo sapiens
ggucauugaccuaaaagauaguguagauuucuugaucauaguguuguuggauaacaacagaa

SEQ ID NO: 184551 - RNA, 46 nt, Homo sapiens
cugaacauuuuaaaaccucuccuguuuaaaaauucccuuucucaca

SEQ ID NO: 184552 - RNA, 55 nt, Homo sapiens
ucauuucagacuuaccauugggguagaaugguguugacauuagcaggaguuggag

SEQ ID NO: 184553 - RNA, 49 nt, Homo sapiens
uaugguggugguaggggugguugguaaagaaugagagggagaggugagu

SEQ ID NO: 184554 - RNA, 42 nt, Homo sapiens
cuacuuuccuucuaugacauauaauggguauuucucaugcca

SEQ ID NO: 184555 - RNA, 52 nt, Homo sapiens
uugcaaauaaauugacugccgauauauuuuauaaauacauuauaacugacag

SEQ ID NO: 184556 - RNA, 41 nt, Homo sapiens
cuaacagacugcuuuccaaagauucuuguaaauauucuucc

SEQ ID NO: 184557 - RNA, 128 nt, Homo sapiens
guuuaugaaaugauaauuagcacauuuuacauugugcuaauuacaauuauauuuacuugagugaacauccagugaagcacuggaaggauucuaucaugaggaucuuuuauauuugaguacuggaauaa

SEQ ID NO: 184558 - RNA, 49 nt, Homo sapiens
uuuuaaaagcaaaguggcaguaaagggcucuaaauuggacaacuuagca

SEQ ID NO: 184559 - RNA, 29 nt, Homo sapiens
aaaccugaguuuaguugauugacucaaga

SEQ ID NO: 184560 - RNA, 44 nt, Homo sapiens
cuguagggacagagauuuauagauuauagucaaacucgugauca

SEQ ID NO: 184561 - RNA, 46 nt, Homo sapiens
cuagugauuacagugucccuugcaaaaggaagaaaauagaacuagg

SEQ ID NO: 184562 - RNA, 47 nt, Homo sapiens
acagauuuuaggucagaauauggaagaaauuuauaagaaacacaguu

SEQ ID NO: 184563 - RNA, 46 nt, Homo sapiens
aacagaaugucugagaauagcaaaaccaaauguaucagccucaaca

SEQ ID NO: 184564 - RNA, 54 nt, Homo sapiens
acuuaaugaucugcuuaucugcugccgucaacuagaacaugauagagcuacaga

SEQ ID NO: 184565 - RNA, 49 nt, Homo sapiens
cguggcuaacggagaaaagaagccguggccgcgggaggaggcgagagga

SEQ ID NO: 184566 - RNA, 39 nt, Homo sapiens
aggaccuuugaggccaaagguuuucccuugguagggaag

SEQ ID NO: 184567 - RNA, 60 nt, Homo sapiens
cauccuccacgcaauacgucguccaguguagaggugugaaaugccaguugcauauuuuaa

SEQ ID NO: 184568 - RNA, 40 nt, Homo sapiens
gcucuuacuuuugucguuuaucauuuuacaucuuaaauag

SEQ ID NO: 184569 - RNA, 52 nt, Homo sapiens
uuuuuuuucuagcaaaucuuugggugccuaguauguuccaaacacugugcca

SEQ ID NO: 184570 - RNA, 46 nt, Homo sapiens
auacugcacucugacuuuugcaucucacuacuccacuuaaguagcc

SEQ ID NO: 184571 - RNA, 46 nt, Homo sapiens
acguguuugaggucaaacaggaccaaaacugacacaccccuaacag

SEQ ID NO: 184572 - RNA, 23 nt, Homo sapiens
cagagguauaauguuuuaugaaa

SEQ ID NO: 184573 - RNA, 57 nt, Homo sapiens
agcacaaccugguguuucuguucaaggcugccaaacacuagagcauuccaccuaagg

SEQ ID NO: 184574 - RNA, 36 nt, Homo sapiens
aauaaugucaucucuauggaagaaauuggaccauac

SEQ ID NO: 184575 - RNA, 42 nt, Homo sapiens
ucagcccgaacgagaacuggaauugcagaaaucaaacggcag

SEQ ID NO: 184576 - RNA, 51 nt, Homo sapiens
auggcauaucacuguuucaugggaaauauguuuauucuguaaugguauaua

SEQ ID NO: 184577 - RNA, 76 nt, Homo sapiens
uucauuucaaaaccauugccaacauaagauguuaugauuugccaucuaauuagauaaaaugauuuacaauaguaag

SEQ ID NO: 184578 - RNA, 70 nt, Homo sapiens
ccagagacuucaauugaugaauuccuaggacuuccgguaugggugguuggggugugcaugggugcgugug

SEQ ID NO: 184579 - RNA, 50 nt, Homo sapiens
ucuucauucauugaaugcagucuguuccugaaaaacacauuggaugauga

SEQ ID NO: 184580 - RNA, 46 nt, Homo sapiens
uuccagucaaccuauggaauccaaucccaguauagucuuagcagau

SEQ ID NO: 184581 - RNA, 45 nt, Homo sapiens
guaccgagugaaucucaguuacagccugaucagccugauauacca

SEQ ID NO: 184582 - RNA, 40 nt, Homo sapiens
agcucaggcauccaagucugagaauucacaggagccuuca

SEQ ID NO: 184583 - RNA, 46 nt, Homo sapiens
ccauguguuuccaaggauggaggauauauacaguugaugccagcca

SEQ ID NO: 184584 - RNA, 44 nt, Homo sapiens
gacagagagaccguaguagguugcaugaaaaugaggggaucaac

SEQ ID NO: 184585 - RNA, 59 nt, Homo sapiens
aaauguacuuucaguagguacagcugugaaggaucuaaaacaagaacaaacuaaauccg

SEQ ID NO: 184586 - RNA, 44 nt, Homo sapiens
ucauugcauuaugaugaguaaacauucuggacacauaagaacag

SEQ ID NO: 184587 - RNA, 40 nt, Homo sapiens
gauagcaaaauaucuaauuagaaaucaacaguuugaugag

SEQ ID NO: 184588 - RNA, 26 nt, Homo sapiens
acuccacgaggccacacaggguacag

SEQ ID NO: 184589 - RNA, 30 nt, Homo sapiens; identical to SEQ ID NO: 157164

SEQ ID NO: 184590 - RNA, 45 nt, Homo sapiens
acgauggcuacauugaccuucaguuuaagaaaaccccucuaagau

SEQ ID NO: 184591 - RNA, 65 nt, Homo sapiens
gcuugucauuuuugggacuguccaaagaagagaugugauuuuuuuuuuuuuaauauaguagaagc

SEQ ID NO: 184592 - RNA, 58 nt, Homo sapiens
cugucauaaugaauacaucuugacacuuuccuuggacugggagcacuggccccauacg

SEQ ID NO: 184593 - RNA, 41 nt, Homo sapiens
accuuuuccccggacucccagcuccuugucacugcuucaga

SEQ ID NO: 184594 - RNA, 42 nt, Homo sapiens
caugucgggaaagugaacauuuuugguguggaaagugggaaa

SEQ ID NO: 184595 - RNA, 46 nt, Homo sapiens
uugggaagguaucgcuggagaauuguugccaggcagggguaaagcc

SEQ ID NO: 184596 - RNA, 72 nt, Homo sapiens
ucauccagguggcaaguuagcaggcuugaguuaggugagguuugaaauggaagccacaacgcugucuguggu

SEQ ID NO: 184597 - RNA, 46 nt, Homo sapiens
ccuaauaaaagcucuugcucucuaaguaggugacauggagguaguu

SEQ ID NO: 184598 - RNA, 59 nt, Homo sapiens
auggggagggcugggagcugugcagcaguggcaguggcagggaugggagagcagguggc

SEQ ID NO: 184599 - RNA, 81 nt, Homo sapiens
ggagcuucccagcugcugagguggaagaaggaaaugcuuugaggcucaaaacucuguuaaugccggcucaucuggggaggu

SEQ ID NO: 184600 - RNA, 49 nt, Homo sapiens
cuuggugaucagaacagaaaaagaaaacauaauuuauuggucucuuguu

SEQ ID NO: 184601 - RNA, 54 nt, Homo sapiens
auacugagaggaggauugguucauccaagucuuuaccacaauuuagugaguaau

SEQ ID NO: 184602 - RNA, 106 nt, Homo sapiens
uuuguccuugauccuugguuaaggaaaugaccaaccagguaagaccuguguugaagggaaaaacaucaauuggucucuuugccaaguucaaguccaguagguuuuc

SEQ ID NO: 184603 - RNA, 73 nt, Homo sapiens
ccagggacugauccauagaagggugucagaacaacuucauaauaaagaguugccuuauuuucuuggucaaggg

SEQ ID NO: 184604 - RNA, 73 nt, Homo sapiens
gcuguuaguugagucccuagguucagaggaagaaagaagaccauaccaccugguagggagugcgaaggagguu

SEQ ID NO: 184605 - RNA, 44 nt, Homo sapiens
uuuuugcagucuuuggugcuacauuuuucucaucuuugugcuuu

SEQ ID NO: 184606 - RNA, 84 nt, Homo sapiens
agcccucaaauuaauacuuacaaugcuuuuguggucuuuggaagacaugacauuuuuucacgugaaaaauuuuaguugccugau

SEQ ID NO: 184607 - RNA, 58 nt, Homo sapiens
agcagugugacuuuguuaugaauauaaauuauagauauuuucauaucaugauauugug

SEQ ID NO: 184608 - RNA, 51 nt, Homo sapiens
aaccuucggcagcuuuuuaggcuggcagauuuaaagaaaguaaccugaacc

SEQ ID NO: 184609 - RNA, 162 nt, Homo sapiens
acacuaccaaccugucuguaaucccagcacuuuggaaggccaagacaagaggaucguuugaggccaggaguuugauaccagccugggcaacauaaugagaacuugucuuuacaaaaccaaaacaaaacacuaccaauuugagaucuucauaggcaaggauua

SEQ ID NO: 184610 - RNA, 42 nt, Homo sapiens
guggcuuccauggcuccauuugcccuggcuguuccucggugu

SEQ ID NO: 184611 - RNA, 43 nt, Homo sapiens
gaucuaacgggaguuuugaaguguggagcaggggggaaaaaaa

SEQ ID NO: 184612 - RNA, 34 nt, Homo sapiens
ugugugugugagagauaugugggguguaacugug

SEQ ID NO: 184613 - RNA, 31 nt, Homo sapiens
uacaccccacauaucucucacacacacacac

SEQ ID NO: 184614 - RNA, 5701 nt, Homo sapiens
ggcguuccagacgauugcacggaaugcacuuaagcaggugggucucccacagcugaccagcccacucuggugaugccugaccacugacccagucccugccuggccuccugcccuuaaucuucuucccuaacccacucuuuucuguauagccagaauacccuauguguucaucugggaagguuaugacauguucugcuuaagcuuccagaaaucccacuuuggggggaauaauauaaaagaugcagaggcugugaagucugaggcugcccuucuuuuacuaggcuuguucuuauuuucuuugcugugauuaggagaucaggucacugggagaccccgaacagauugcugcuucuauuuaaggaggaaauaaacuugaauaugaaucccagcucugcugcguaccaaucguuauaucuaguuugggcuuaaaaaaaaauuauggccgggcacuguggcucaugccuguaauccuagcacuuugggaggccaaggcgggcugaucacuugaggucaggaguucgagaccagccuggccaacauggugaaacccccucuccacuaaaaaauacaaaaaaauuagccagaccuggugguggucgccaguaaucccagcuacucgggaggcugaggcaggagaauugcuugaacccaggcggcagagguugcagugagccaagaucgugccacuguacuccauccugggugacagagugggacucugucuaaaaaaaauuaaaaauuaaaauaaaaaaaauuauaucugaacuucuacccccucaccugaaaaaugggaauaccugcuuuugcagggugauuaugaagauuaaaugagacagacucuuccagcucucacauacugacugguaacuuuuuuccuuaggaacaguuaaguaaacaacacaaagaaggaagaagauguaggaaaacuauucaaggaauauaauaccuagaauuucuuauuuacuguuucugugauuagauacaaccacucaugcgaguugaaagucuguuuugauguacagcucuguuaggggcaguggugauuaaggcaggucacgaggccucaucagacagugucuggggguggucagagguguggcagguuugggaggaugcauagaacacuugaagcacaugguggcugugaagggcaaggcagauucugcugacuccaggaagccggcugaaugaagguaauggcuuucagcaggacaaagaguuguuuguaaugguugcuccaaggaccagggaaauucuggcauggguggggucugcacuaaguguuccagaaugaaagggacagaucuacucaaugaggaaauuguuccacccagaaugccaggagagcccucaagugguaaggagcagaccaagaugcagacuuggccacgcuuacccccaaauaauaauguuuguguuuuucuuaauguucauauaagggaauggaaauccaaauauguguaggaaaguguuucccaccuguucccuguugccuggcaucacugucugaguuuuucucuuccaucacuacugucccuguugucuuuaugcuuuuauuuuuagagcuagcccuuaagaaguuagauuguuaaaucggaggguguaucuuauuguaagucagggugccagguugcuuuccccaaggggaauaacauuucagcaaugugggcuugcuuucuucuaccuccuugccagcaagcaauaggugucaccugucacugcugacauugccgaucuuuggguguguaaauugccaccaucgugacuacuggucccucugaguuccccucccuggggcuuagccauuuggauuuucucugcugcacacagccggcacacagcacaugguugggccucucucaguucucaugagcuguuggugaauugaaguuaacucuacuugcaucuuaagugacuuuuccaacucuguggucuuuuuaaguccuuugaacauagggaaaaaguaauuuuuuauuugguuaugucauuuuaaguuucuauguuuccugugucuaccucagauuuuucuguaauucagcuggaauuuguuuuggcuuauggcagaaaagagagacuugccuuuccucucaagagagcucagccaguuguuugaaaucauucagcuauguuacacaagccguuucccucccugaauagaccguggccugugcuaaaugcucguaugugcugggaucuguuucuggucucuccagucuguucuggugauguccaugccauguucccuuaucuggacuguguugauuugacugccugaugaggcaaguuuccucuugccacagucuuuuuuuuuuuuuuuuuuuuuuuuuuuuuugagacggagucuugcucuguuccccaggcuggaaugcaauggcgugaucucggcucacugcaaccuccgccucccagguucaagcgguucuccugccucagccuccugaguagcugggauuacaggcauccgccaccaugcccagcuaauuuugguaauuuuuuaguaaagauaggguuucaccauguuggccaggcuggucuggaacucacauugugaaccgcccgccucagccucccaaagugcugggguuacaggcaugagccaccgcacccggccugccacauuucuuuuuuaauaauuuuguuuccaccauuuuccucucuuaccuuccacaccccaaauaaaacucuguugagauuuugauuggaauuuuuuucuucaagcccacuguuuuuuccucauugauugcaguuuuguuguggcuguugcauuagucugcucaggcugcguuaacaaaaccccacagccugggaggguccaacaacagacauuuuguuuucucacaguucuggaggcuggaaguccaugagcaaggugcuggcacauguuucuggugagggugcuuuucugggcuaucuucucacugugucccucccaugcccuuucugcugugugcacagagagaggacacaugagcaaggugucucuggugucaccucuucuuauaaggacacgaauucucagaucagguccccauccugcaaccucauuuaaccuucauuccuuccuuacuccaaauacagccaccugaaggguuagugcuucaacacaggaauuuuggaggaacacaaacauucugcccagccgagugcgguggcucaugccuguaaucccagcacuucgggaggcugaggcggguggaucaccuuaggucaggaguucaagaccagccuggccaacauugugaaaccccaucucuacuaaaaauacaaaaaauuagcuggcgugguggugggcaccuguaaucccagcuacuuaggaugcugaggcaggagaauugcuugaaccugggagguggagguugcagugagccgagauugcaccauugcacuccagccugggcaacaagagcgaaacuccaucucaaaaaaaaaaacaaaacauuccacccaugauacuauuuuaggucuuguuucuguuccuucaguaagauugauugauucuuuuuuuuuuuagagacagggucuugcucugucagucaggcugauacgcaguggugcaaucaucacucgcuauaaccuccaacuucugggcuccagcagucuucccaccauagccuccuaaguagguaggacuacaggcacacccaugcuauaauugauuuauaauaugauccuuugccuuucacaguaaacauauuccuagguacuggugggaauauaaaaugucacuauuuguaauagccaaaaaguaagaacaacucaaauguccaucaacugguaagugaauaaacagggcagcuuauccaugcauucuaauauuauucagcuauaagaaggaaugaaguagugacacaugcugccacaugggugcuaagugaaggaagccaguugcaaaaagaccauauguuguacgauuccauuucagugaaauguccagcccggaugcaguggcucaugccuaaaaucacagcacuuugggaggcugaggccggaggaucacuugaaaccaggaguuugagaccaucuugggcaacauagcaaggccucaucucuacuaaaaauuaaaaauuagcuaggugugguggcaugagcuuauaguuccagcuacuugggaggcugagacuggaggauugugugagcccaggaguuagaggcugcagugagcugugaucaugccauugcacuccagccugggcgacagagcaagacucugccucaaaaaaaaaaaaagaaagaaaucacaguccacuagaagaaauggggaaaauuaaaauaaauaaauaauguuuaaaaauuaaguguccagaauaauaggcaacucuauugagacagaaaguagaugagugguugcuggguccaggaugguauagaaugggggugggaaggaacuacuaaugggcauaggguuuuuuggggggugaugagaguauuuuaaacuuaauguugauggcugcccaacuuucugaauauacuaaaaaccauugaauuguacacuucauggcaugugaguuaaaacccagcaaagcuauuaggagugcaauggcaccaucuuggcucacugcaaccuugaccucccggguucaagcaauucuccugccucagccuccugaguagcugggauuauaggugcuugucaccaugccuggcuaauuucuguauuuuuaguagagacgggguuucaccauguucgccaggcuggucuugaacuccugacuucagguggucgaccugcuucagccucccaaagugcugggauuacaggcgugagccaccaugcucagccaaagcuguuauuuuuuuaaguauguauuccuagauguuuuauacuuuuauaguuauugugaauggaaugauuuuuuuccuagauaacuuuuaaugaauagaaacaguuccugcuuuaucuccaaauucuagaacagucacuggcacacaagugcucaguguuuaagugacauuguuuuccugcacccaaaaguagaaugcugcuccucauuggaagcauguuacuuuagcaaagugccacuaaaaugaccauaguccaugugcucugaucacuugucacagauggugauaaaauucauucacagcuuccuuucuaggccugcagcauuugggagacaaaacucugcuaaaccuuuggaagaaaaaagagaccagaggccauuggucccgaaaaguggauggaagauagggagguagaaggaauguuacaggcugagagggcagcucacacucagcuccagccacuucaccucgugcacacacuggcugaggguugccagauguuugagaaaagcuagaaauccagaccauuguuaaccauuggcaacuauagggaacauacagaaagcaucugaacuggaugugguagagcucccagaucaugaucugauugagaauguccaugaacuucuguccugauugcucagugcagacugcugcuucuucuggcaagacuccucucuucacauugaccuggaguugucacaaaaucuguuuuucucuugcuacuccccugagcauggcaccuucugccagagcgcucccuuaacugugugggcaggcucugcuucacagcuccccgcccacucugcccaagcagaagugagccccuccugggcagaaagugcccgcaaugagggcugaaauguuucuauucccugaguaaccaaccuuucucuguuuccuuguccaggaaacggag

SEQ ID NO: 184615 - RNA, 1055 nt, Homo sapiens
uuguuguguugggaaacaagauugaccucgaaaacagacaaguaaguaccaacgaugauagauauugucacagacaccugcuccccaggggccuugugaauuuggaggguucucugcuaagcucacauggcucuaggaggugcuggugggagucuucauuaccauaugccagcccuucaggccaacugccuuuaaggaccgggacccaggugaccuggguuaaguccccauccugcccccagcuggcugugacuuugggccauugucuuggcugucucagcuucacuucccuuucugcacuuugaaggagggaauucgguuuugucauucucaguagugcccucccaguaccuccaggccaugccuggaucuccaugugugcagaauauugcuuugggcuuugaguaaaauugcuguacuguaguuucaaauaccauuucuguuggaaacauagacucuuugauuaauuacaacuagguuuauuucugaccacagaucuuuucuuaagugacuuaguccuuaucucuuggcugaaaaugggcuagggguuggggaaggaaugagaaugugugaguggcauaggugacaucacacuagcaguaauggugaagggacuauaaaccuuaagaccaagcugcugggcauuuccuguccugggaucucugaggucccaguaaacacucuucauuucuucccggacuggcuucuuacuccauucacaaauggcuuuuaaguauaacugagggucagaagguaugagcuguagaccgagacaggcuuugagcucucuagcugaauccuagcuauccugagcauagcuagcaggacaaguuuggacgggucugcaggucuccuccaacacccucuuuccccaugucuguguccucaccuguacuaccuguagacgaggggccaugacacuuccuggggaggauggagucagugcuggcugcuucugucaugagccuaugugcacccugcuucuucuuucagguggccacaaagcgggcacaggccuggugcuacagcaaaaacaacauucccuacuuugagac

SEQ ID NO: 184616 - RNA, 48 nt, Homo sapiens
gugcagacugcugcguucugguauuugaugugacugcccccaacacau

SEQ ID NO: 184617 - RNA, 45 nt, Homo sapiens
uugggggcagucacaucaaauaccagaacgcagcagucugcaccu

SEQ ID NO: 184618 - RNA, 24 nt, Homo sapiens
uaaacaugcuuguugauuauggag

SEQ ID NO: 184619 - RNA, 24 nt, Homo sapiens
ugcgcgaggcuugggugggaggag

SEQ ID NO: 184620 - RNA, 67 nt, Homo sapiens
uguguucuggaaaggagcauaguaccgucguugcggcaggugguguugaguguguauucguguggcc

SEQ ID NO: 184621 - RNA, 70 nt, Homo sapiens
ccucccuuguguguaagccucgaaaauggauaggugaaaggagauacgcgccagggcugcuccccggaaa

SEQ ID NO: 184622 - RNA, 59 nt, Homo sapiens
uuugcaaaaaccuugauguuauaauugaccuuaaaaugguuaccagacuaucugggcag

SEQ ID NO: 184623 - RNA, 75 nt, Homo sapiens
aauuuaugcuaagacuugagaagcccacgauacaggcuggagaaggggaggauuuuccaagaguggaaaacagaa

SEQ ID NO: 184624 - RNA, 48 nt, Homo sapiens
gagacgggccugaauggcuucgagggugauuacucugguagaaguugg

SEQ ID NO: 184625 - RNA, 50 nt, Homo sapiens
aaaugucaagcaugacuggagagccagagugauaaagcaggggucccuuu

SEQ ID NO: 184626 - RNA, 42 nt, Homo sapiens
uugguguuaccgccuuuauuugugcuaaagugccagcguuuu

SEQ ID NO: 184627 - RNA, 59 nt, Homo sapiens
gccauguaggucucuccauagggcaccucaucacauggcaacugguuuccaucagaggg

SEQ ID NO: 184628 - RNA, 49 nt, Homo sapiens
aguauuucaacaaaaauuaaauaccuaagaaucaacuuagaugugcacg

SEQ ID NO: 184629 - RNA, 49 nt, Homo sapiens
aaagaauagacuuguucaaccagauguucaauaaaauguuguauacuaa

SEQ ID NO: 184630 - RNA, 47 nt, Homo sapiens
ugcaaaugagaauuuaguauaagguaaaggugguauucuaacuuaau

SEQ ID NO: 184631 - RNA, 45 nt, Homo sapiens
aagguuuguauggagagccaugaagguaagagguaaaaauuaaaa

SEQ ID NO: 184632 - RNA, 45 nt, Homo sapiens
uucuaagaccuguccuucugaaugucucuuacuauuuucccugug

SEQ ID NO: 184633 - RNA, 58 nt, Homo sapiens
aauaucacauggacuuaaugcauagagagcugccugguuuuucaugauugugcccacg

SEQ ID NO: 184634 - RNA, 49 nt, Homo sapiens
uucgaaaaugcucuuucaaucguugaugcaaccaaacucuuugggaguu

SEQ ID NO: 184635 - RNA, 47 nt, Homo sapiens
ccauuuuccauuaguuuuuagaagacaaugugucuaaagagaugcag

SEQ ID NO: 184636 - RNA, 48 nt, Homo sapiens
gaagaagugacuucagaagaagaggaagaagaagaagagauggcugaa

SEQ ID NO: 184637 - RNA, 61 nt, Homo sapiens
cagaauacuggagacuggguaauuuauaaagaacagacauuuauuuucucacuguucugaa

SEQ ID NO: 184638 - RNA, 46 nt, Homo sapiens
caugaacuuuuucuuuuuccccucauaagauaauaaacaaggggcc

SEQ ID NO: 184639 - RNA, 52 nt, Homo sapiens
gggaacaugacugagguugaagguauaggaggaaauacaggcuaaaggcauu

SEQ ID NO: 184640 - RNA, 50 nt, Homo sapiens
uuguauuguuuuucauuuuaaaguuuuucguuacaggagaaauuaggcua

SEQ ID NO: 184641 - RNA, 82 nt, Homo sapiens
ugcagugucugggucagugcaagcuucagauagacuuaugaaagagcucagggacauauacagaucacagaguuauaaaaca

SEQ ID NO: 184642 - RNA, 39 nt, Homo sapiens
ccaaggagcuggaaccuauggugaccucuauuuuuccug

SEQ ID NO: 184643 - RNA, 47 nt, Homo sapiens
uuuauauacaguucaaaaauagguaaaacuaauguugauuagggcau

SEQ ID NO: 184644 - RNA, 59 nt, Homo sapiens
aggaauaauucucgagaauuuuguaugacuccuuuuuucuuuuuaagguauguauuggg

SEQ ID NO: 184645 - RNA, 49 nt, Homo sapiens
guuauuuaaaauacuaagucaucuuacguuuccauuuuauuaacgggau

SEQ ID NO: 184646 - RNA, 26 nt, Homo sapiens
gucaccuaaggguagggccauugggc

SEQ ID NO: 184647 - RNA, 63 nt, Homo sapiens
cguuuccaaugcccuggaccuuuagagagcucaucaucuuuccuuauggucgcaagucuugaa

SEQ ID NO: 184648 - RNA, 68 nt, Homo sapiens
ugugagcacggagaauugugcagaaucguguucuccaugaccaggaacaugcagggcacagugcuagg

SEQ ID NO: 184649 - RNA, 78 nt, Homo sapiens
ggguaagguuugcccagggguauguguguaaguaacacagcuccaaacugggagcugggcaggagcuuggucagccag

SEQ ID NO: 184650 - RNA, 39 nt, Homo sapiens
gaagaggaaagaggcuugcccaggacucuggagagggaa

SEQ ID NO: 184651 - RNA, 63 nt, Homo sapiens
uuuucugccaccuuugagacuggagcuccaggccuugagugauuuagggucugcauugcuuug

SEQ ID NO: 184652 - RNA, 40 nt, Homo sapiens
cagguggggcguggagagacagagcggcggccacguagag

SEQ ID NO: 184653 - RNA, 51 nt, Homo sapiens
ggaacgggaggcggaaccugcgguggcggccacaacgcccauggacgggcu

SEQ ID NO: 184654 - RNA, 43 nt, Homo sapiens
gucccucgguguccuccgcgggccggcgcgaugcggcugggcc

SEQ ID NO: 184655 - RNA, 37 nt, Homo sapiens
ccggcgccggccgcggcggcgcacagcagcagcagcc

SEQ ID NO: 184656 - RNA, 43 nt, Homo sapiens
cgccgcagcgacuacgaccgcgaggcgcugcugggcguccagg

SEQ ID NO: 184657 - RNA, 30 nt, Homo sapiens
gauguggaugaauauguuaaacucggccac

SEQ ID NO: 184658 - RNA, 25 nt, Homo sapiens
ucgccugcagucuuuuuugcugcuc

SEQ ID NO: 184659 - RNA, 45 nt, Homo sapiens
cuaguuguauuaauagaaaugggguaggaagugggaaaggcuguu

SEQ ID NO: 184660 - RNA, 44 nt, Homo sapiens
uuguugaauaugauaaaaacagugaugauacugugacuugggau

SEQ ID NO: 184661 - RNA, 53 nt, Homo sapiens
uaccuggaagugauacugcuagaucauacgguaauucuauuuuuaauuuuuug

SEQ ID NO: 184662 - RNA, 53 nt, Homo sapiens
acagucuuucuguuuuuggcuucuucgauuuaaugugagcuauucuuauuuug

SEQ ID NO: 184663 - RNA, 46 nt, Homo sapiens
gucccgguuugagucuugaagaauuuauugcuuuugagcauccuga

SEQ ID NO: 184664 - RNA, 47 nt, Homo sapiens
uucuucaggaugcucaaaagcaauaaauucuucaagacucaaaccgg

SEQ ID NO: 184665 - RNA, 47 nt, Homo sapiens
auaggaagauauugaggaaaguacugaaacagcuggccauugaacag

SEQ ID NO: 184666 - RNA, 98 nt, Homo sapiens
auucaagaagcuuuagaagaacaugacaaaaauggugauggauuuguuaguuuggaagaauuucuuggugauuacaggugggauccaaguaagucacc

SEQ ID NO: 184667 - RNA, 83 nt, Homo sapiens
ugcaaaugaagauccagaauggauacuuguugagaaagacagauucgugaaugauuaugacaaagauaacgauggcaggcuug

SEQ ID NO: 184668 - RNA, 45 nt, Homo sapiens
cagagagcuuuuugucaccauucaaauccauuucaucaauuagau

SEQ ID NO: 184669 - RNA, 73 nt, Homo sapiens
gaauggugacaaaaagcucucugaagaagagauucuggaaaacccggacuuguuucucaccagugaagccaca

SEQ ID NO: 184670 - RNA, 27 nt, Homo sapiens
agcuuuaaucucugagccugucucagu

SEQ ID NO: 184671 - RNA, 59 nt, Homo sapiens
acagucagaauuaucuuaauguagauuauaauuuuggucuuuuaggaaaaaaaaacaaa

SEQ ID NO: 184672 - RNA, 45 nt, Homo sapiens
gaugccugaacaauauuauuuaaguaguaugugaccgagcuauaa

SEQ ID NO: 184673 - RNA, 61 nt, Homo sapiens
uuugccuagucauuugggauuguaaaguggaagggcuaaagacuaauugcuauaugacagc

SEQ ID NO: 184674 - RNA, 47 nt, Homo sapiens
uccaguuggugaaaugccucugcaaaagguuaccugcaugguaagga

SEQ ID NO: 184675 - RNA, 68 nt, Homo sapiens
ugcuugcuuucucucuggugcugcugcugcccaccaucugagacuccugagugccuucuauuuuggcc

SEQ ID NO: 184676 - RNA, 58 nt, Homo sapiens
gcucugugcuguuugaaaacccuuuaguuugaagacagucagugguuuugcuaguggu

SEQ ID NO: 184677 - RNA, 41 nt, Homo sapiens
uggcucgucaugaaugauaauuggaaaagguggcauaccag

SEQ ID NO: 184678 - RNA, 42 nt, Homo sapiens
cugauuugugacaguuuuuccuuggaggaacauuugguccag

SEQ ID NO: 184679 - RNA, 46 nt, Homo sapiens
ucuuccuucucaguuuguacagcaaucuugccaucuuucucuucua

SEQ ID NO: 184680 - RNA, 122 nt, Homo sapiens
uuuaaaaccgagacacuuauacauauguaacaaaccugcacauugugcacauguacccuaaaacuuaaaguauaauaauaaaaaacaaaaaacaaaaaaaccgagacaugaaccaggcaaac

SEQ ID NO: 184681 - RNA, 46 nt, Homo sapiens
ggacccaggucaucuggcuccagaccccaugcuguuaaagccgugc

SEQ ID NO: 184682 - RNA, 182 nt, Homo sapiens
gccucugugugugugcaggaggggcugcucugugggucuaugcauucgugugaaugcaagggcgagagugucgcguguaaguguuccaauguaacagcuauuuaucugguguguauugaugguuugugcuuguaugggugccugugaaaagguuuuguguggacccgaauugcugccuggcu

SEQ ID NO: 184683 - RNA, 89 nt, Homo sapiens
ucuggagugguucgggcccaauguggggcuuuguuucagggaaguauugaugcccuaagugugaauccugacgucagcaccuagcuggu

SEQ ID NO: 184684 - RNA, 65 nt, Homo sapiens
aaaugacaacugggacaaaugcugugacaaggucuguggggaccuggucuagucuggacuaggga

SEQ ID NO: 184685 - RNA, 45 nt, Homo sapiens
cacacaccaccugacaucagagguuugcauccaaaaggccucaac

SEQ ID NO: 184686 - RNA, 45 nt, Homo sapiens
gguggacuuccugaacugggaggucaccgaccacaaccugcacga

SEQ ID NO: 184687 - RNA, 42 nt, Homo sapiens
ccguggccuuuguggagcaagggcacguacgcgugggcccug

SEQ ID NO: 184688 - RNA, 42 nt, Homo sapiens
gaagaugacuggacagggauggagagugaggaagaaaauaag

SEQ ID NO: 184689 - RNA, 46 nt, Homo sapiens
ggaagguuuguugagagccaucuuuggucgaguaacauuccugcag

SEQ ID NO: 184690 - RNA, 28 nt, Homo sapiens
ugcaggguucuaccagugccuacaccaa

SEQ ID NO: 184691 - RNA, 82 nt, Homo sapiens
cucagacuacaccauucuagauugcauuuacaaugagguaaaccagaccuacuacguucuggaugugaugugcuggcgggga

SEQ ID NO: 184692 - RNA, 51 nt, Homo sapiens
ggaggcgggagccaacuuguuaggccuguggcugagacgcugcagggcggg

SEQ ID NO: 184693 - RNA, 42 nt, Homo sapiens
uaggggcguggagaaggagagcggcucccccuccccuaccag

SEQ ID NO: 184694 - RNA, 44 nt, Homo sapiens
gcgcgcggaggggggcgggcucucgcgccgccgcucagaggcgg

SEQ ID NO: 184695 - RNA, 41 nt, Homo sapiens
gggcgugaagucugaguuccuccgccuucuugggauccggu

SEQ ID NO: 184696 - RNA, 30 nt, Homo sapiens
acacucaggcugccuaaccccuucccaggg

SEQ ID NO: 184697 - RNA, 45 nt, Homo sapiens
agucggcuuagccaggagguugugcuggacguuggcugccccuau

SEQ ID NO: 184698 - RNA, 50 nt, Homo sapiens
ggugggaguggccuuggacuccucccuggcuggggagacugcuugugugg

SEQ ID NO: 184699 - RNA, 46 nt, Homo sapiens
ccagccugcugcaauccguggaagagcccauggugcaccugcggcu

SEQ ID NO: 184700 - RNA, 30 nt, Homo sapiens
cugagguguaccugcccugucugggccagg

SEQ ID NO: 184701 - RNA, 24 nt, Homo sapiens
gugcacagggucuagucugggugg

SEQ ID NO: 184702 - RNA, 42 nt, Homo sapiens
cagcccauuaaagcaucuggcucguuuuuggaaguggggccu

SEQ ID NO: 184703 - RNA, 60 nt, Homo sapiens
ucuguccccauggaaacuccucggccuccccuggugcugcaccuucuuggauucccuccu

SEQ ID NO: 184704 - RNA, 49 nt, Homo sapiens
cacagaaggagggcgcaaggccacccagcucuccaccaaugccugucau

SEQ ID NO: 184705 - RNA, 45 nt, Homo sapiens
agaccuggcugcccagcugcaggaaagagaagcuccagccccggc

SEQ ID NO: 184706 - RNA, 45 nt, Homo sapiens
gaacaaugugcgggcugugccacagccuggugccuuccagagggc

SEQ ID NO: 184707 - RNA, 45 nt, Homo sapiens
gagaagcagggcagcuacagcccagcacucccacugcagccucug

SEQ ID NO: 184708 - RNA, 51 nt, Homo sapiens
cccugucaggacaccgggcccacccacuacccaccaccccaccacccacca

SEQ ID NO: 184709 - RNA, 64 nt, Homo sapiens
ggagcuaccagagagagaagggaaagggagccaaaguucugggguaggggagaggaagggaaag

SEQ ID NO: 184710 - RNA, 26 nt, Homo sapiens
cacucuccugaaagugguagggaguu

SEQ ID NO: 184711 - RNA, 42 nt, Homo sapiens
gucaccgagagauaccuaaaugccucacugugcuggagccag

SEQ ID NO: 184712 - RNA, 43 nt, Homo sapiens
gcaagggaagauugcacagggaaugugacaucagggaacagau

SEQ ID NO: 184713 - RNA, 50 nt, Homo sapiens
cuacuaccgcacgggacagcuccacgugcagcccacagcugagugccaag

SEQ ID NO: 184714 - RNA, 46 nt, Homo sapiens
ccacaaaugacgauguggcuugagcccccugucccaauggccccag

SEQ ID NO: 184715 - RNA, 46 nt, Homo sapiens
acauggauggacggccucauuggcauagaaauagauggcuccacug

SEQ ID NO: 184716 - RNA, 42 nt, Homo sapiens
guaaaugggccgaaaccagcagacguaggagcagggugugaa

SEQ ID NO: 184717 - RNA, 37 nt, Homo sapiens
agaugcagacacauucacagauucacacccacacaaa

SEQ ID NO: 184718 - RNA, 64 nt, Homo sapiens
acacaguuuucuuguccccugggagagaaguuugaagaaaccacagcugauggcagaaaaacuc

SEQ ID NO: 184719 - RNA, 58 nt, Homo sapiens
auugguucagcaucaggagugggaugggaaggaaagcacaauaacaagaaaauugaaa

SEQ ID NO: 184720 - RNA, 68 nt, Homo sapiens
gaauaaaaauuccaucaucacuuuggacaggaguuaacuaagagaaugaccaagcucaguucaaugag

SEQ ID NO: 184721 - RNA, 47 nt, Homo sapiens
gagaaacgcgagaggcaggaaggaauuggggcaugaaguagugagga

SEQ ID NO: 184722 - RNA, 33 nt, Homo sapiens
agucuccaugggccccacacagcggugggggcu

SEQ ID NO: 184723 - RNA, 64 nt, Homo sapiens
ggcucauucacuaucauucuccuccucuguuagggaggagaaugguggcuggaguccccagcaa

SEQ ID NO: 184724 - RNA, 46 nt, Homo sapiens
ucuugugcccaggcugugcuagauaguguugaauggaggcagaaaa

SEQ ID NO: 184725 - RNA, 43 nt, Homo sapiens
uaaacuuuugagaaguagcaauggacucgugagaguggguaua

SEQ ID NO: 184726 - RNA, 28 nt, Homo sapiens
gcuaggagcaucacagcagagagauagg

SEQ ID NO: 184727 - RNA, 46 nt, Homo sapiens
guccaggccuuucuugugucugcagaggugaagugcacauguggaa

SEQ ID NO: 184728 - RNA, 37 nt, Homo sapiens
ccuggaaacgacaagggaaaaugagcucagccugggu

SEQ ID NO: 184729 - RNA, 34 nt, Homo sapiens
ggaacacuaaaaggggccccacuuagaugaccug

SEQ ID NO: 184730 - RNA, 46 nt, Homo sapiens
gccugaguuucaguuccugauuggagaugaggcagcaacacaccug

SEQ ID NO: 184731 - RNA, 42 nt, Homo sapiens
ccaguuguggauggggacucacccccgaggggaugccaagau

SEQ ID NO: 184732 - RNA, 49 nt, Homo sapiens
ccaugcguacuugggccuuuucuuuucuggcacccaucucuccaccuaa

SEQ ID NO: 184733 - RNA, 41 nt, Homo sapiens
ucagaucaauuuccugcagguugguuuuccuuguuagagca

SEQ ID NO: 184734 - RNA, 42 nt, Homo sapiens
uuuucuggccuggaccagcgacggaugguggugccaccgggu

SEQ ID NO: 184735 - RNA, 45 nt, Homo sapiens
ggccagguggggcggggacgggccgccugaccucugcccccuaga

SEQ ID NO: 184736 - RNA, 43 nt, Homo sapiens
ccagugggugcaaaaaugacgaagaggaguccccgcgccccag

SEQ ID NO: 184737 - RNA, 41 nt, Homo sapiens
gacucuggaccagugugggcugcccgccggcgccuggccca

SEQ ID NO: 184738 - RNA, 95 nt, Homo sapiens
uggcaucagggccugggaggucaaagguaagaggaacugcauggggcuuggcaaguucucaggaaggcuucaaccugggaucuugaagccaguug

SEQ ID NO: 184739 - RNA, 49 nt, Homo sapiens
ggcgaggagcacagaagaggcugccuucaccaacggacagcaguuuuca

SEQ ID NO: 184740 - RNA, 38 nt, Homo sapiens
aauguggcuaaugccugccuuagggaaccguugugagg

SEQ ID NO: 184741 - RNA, 51 nt, Homo sapiens
aggggacugagguuauugaaucuguguugguuucgguaggaguuugcuaaa

SEQ ID NO: 184742 - RNA, 46 nt, Homo sapiens
ggaacuuguuauaaagcuguucuacugguucaagcaacaguugaag

SEQ ID NO: 184743 - RNA, 46 nt, Homo sapiens
accagccacuuacuccaaagucuauucuucgguugccagagacaga

SEQ ID NO: 184744 - RNA, 50 nt, Homo sapiens
uucuaacuguaaaagacaaaaaugucuuucauacccugaugggaagugag

SEQ ID NO: 184745 - RNA, 42 nt, Homo sapiens
acuuagcgauauauacaaauaugaaauaguaauuguacagag

SEQ ID NO: 184746 - RNA, 25 nt, Homo sapiens
gagaaagagcaaagcccaagagcag

SEQ ID NO: 184747 - RNA, 47 nt, Homo sapiens
aaggauuuuaagcuggcaaaaggagaagcagguguacagauccguaa

SEQ ID NO: 184748 - RNA, 43 nt, Homo sapiens
ccaauguccucugguguccagucagggacgcccaucaccaaug

SEQ ID NO: 184749 - RNA, 51 nt, Homo sapiens
agggguauuuaagcugauugucagaagaauuaguuagaaguuagcuagcca

SEQ ID NO: 184750 - RNA, 46 nt, Homo sapiens
gagaucuggggcaaauugccacucucuuugaguuucauuuccaugg

SEQ ID NO: 184751 - RNA, 24 nt, Homo sapiens
ccuauacuauuacugggaggagua

SEQ ID NO: 184752 - RNA, 46 nt, Homo sapiens
caagggauggcccaggaguuggggaacaagaagacaaaacacccua

SEQ ID NO: 184753 - RNA, 61 nt, Homo sapiens
ggauccugggccugcccugcaagaaugaucuuuacuugucugcccaacuacucucccucau

SEQ ID NO: 184754 - RNA, 55 nt, Homo sapiens
cuugacaccuccucuuccccuccugccugcccacugagagccaagaacacaccaa

SEQ ID NO: 184755 - RNA, 61 nt, Homo sapiens
cuggaaggagcaaccuucccaggcuuuucaucugcuccucauuauccucucccucugccug

SEQ ID NO: 184756 - RNA, 57 nt, Homo sapiens
ggcccgaggagggggucaaagcccagcccagggcuggcccccacccaaucacgcuca

SEQ ID NO: 184757 - RNA, 49 nt, Homo sapiens
ggcccuggaguucagggguucaggacccagccauggaggagucugaggg

SEQ ID NO: 184758 - RNA, 634 nt, Homo sapiens
gauuguaucaguccauucuccugcugcuaauaaagauguaccugagauguacauuacucaguacauuacauguacguuacagauguacauuacauguacugagauguaauuuauaaaggaguaauuuauaaaggaaagagguuuaauuuacucacaguucagcauggcuggggaggccucaggaaacuuacaaucauggcagaaggggaagcaaacauguccuucacauggcaucaggagaaagaagaaucagugcccaguaaaggaggaagccucuuauaaaaaccaucagaucuuaugagaacuaacucacuaucaugagaacaggaugggggaaacugugccccacgauucaauuaucuccaccugguccuucccaugacacauggggauuaugggaccuacaauucacgaugagauagccauaacauaucaaugaugaugaugaaauugacccagcauccuuuguuggaguccucauuguacaagagguacugugaugugcccuggguaugcauuauuucauuggugacagccucacgacaacccuuuggaggcagcaucuuguuauucccucauuuuuucccagaggugccaucugaagcuuggaaagguuaaguagcuugccccaauu

SEQ ID NO: 184759 - RNA, 139 nt, Homo sapiens
aggcuuccuggagaaauggcuuuuaagggaugggaagauggcaggaaggccacaguggagauggaggagagggcagagggcaggugggugcuaagaguagcaggcaguccagacagagugaggcuggugaugcggggag

SEQ ID NO: 184760 - RNA, 45 nt, Homo sapiens
acccccaucacccacccccaggaugggucagacauuuucccuugu

SEQ ID NO: 184761 - RNA, 46 nt, Homo sapiens
agugcuggguguccugcuccuccacaucccauggagguagcagugg

SEQ ID NO: 184762 - RNA, 45 nt, Homo sapiens
ccuuuguggggacagccacuguccucuagcucugcacaguugggu

SEQ ID NO: 184763 - RNA, 78 nt, Homo sapiens
cagggugcagggagaagacaggcuucaggugccccagacaccccagaucaccccgcgaugaucacaccacagagccca

SEQ ID NO: 184764 - RNA, 53 nt, Homo sapiens
ugauuuccuguccuauaaaaggaaguaacacuccccuccucacccagggugau

SEQ ID NO: 184765 - RNA, 48 nt, Homo sapiens
ucuuuauuaguacacuccucucugguuccaaccuggggggauggagga

SEQ ID NO: 184766 - RNA, 41 nt, Homo sapiens
gucagagacacagggaugggacagggcaagagaagggagag

SEQ ID NO: 184767 - RNA, 45 nt, Homo sapiens
ugggugcugcuguuccucgugacccuucgagucuguucaggggcc

SEQ ID NO: 184768 - RNA, 49 nt, Homo sapiens
aaacagcugcccaccccccccaucccagcagcucagcuaagcccugaug

SEQ ID NO: 184769 - RNA, 45 nt, Homo sapiens
cuuugugcugugacugcaucaccuuuauggaguguagacauuggc

SEQ ID NO: 184770 - RNA, 42 nt, Homo sapiens
gccugcugauauucugcaggacugggcaccaugggccaaaau

SEQ ID NO: 184771 - RNA, 42 nt, Homo sapiens
uccaggcauggccaccugccuuccccuggucagccuggaaga

SEQ ID NO: 184772 - RNA, 62 nt, Homo sapiens
agggggaaagaauaauuugcauuacugagagaggccaugcuuugaugacuaguuggauaaua

SEQ ID NO: 184773 - RNA, 36 nt, Homo sapiens
ucagccccuuccuccuuccuccuggguuuggggauu

SEQ ID NO: 184774 - RNA, 375 nt, Homo sapiens
uccccauucuuuuaaguuuuuuguuuuucuuugguuucuuuguuuguuuuugagacagagccucagucuguugcccaggcuggagugcaguggugcgaucucggcucacuguaaccuccaccuccuggguucaagcgauucuccugccucagccucccaaguagcugggauuacaggcacacaccaccacacccagcugauuuuuguauucuuaguagagacaggguuuccccauguuggccaggcuggucucaaacuccugaccucaagugauccgccugcauuggccucccaaagugcugaaauuacaggcgugagcuaccgcgcccgguccccauucuuucaaguuuucaucaaucauaaacauacccaaaa

SEQ ID NO: 184775 - RNA, 163 nt, Homo sapiens
aauuaauuuucauccucaguuuuaaacggcaagccuaguaacuucccauauauucaacauauuauuuuuccaccauuugaaacuugccuauuaauaguuauuauguuacugauagaacugaguuuugcuggucuggggaauaagggaauuucaagugaguucc

SEQ ID NO: 184776 - RNA, 70 nt, Homo sapiens
guugcuagacaaacauguccccaguuuggaaaucuuaggaaaccgcauuaucaaacaguuuuaaggagga

SEQ ID NO: 184777 - RNA, 43 nt, Homo sapiens
uaucucuaaucacauaagcaucccuuguuccauaaacuugcac

SEQ ID NO: 184778 - RNA, 46 nt, Homo sapiens
ucaccaucauuuccacuccagcagccucgcuucuccagcucgcagu

SEQ ID NO: 184779 - RNA, 47 nt, Homo sapiens
agauggugccaucagccagugguucaugcuuuuaguacuagauggga

SEQ ID NO: 184780 - RNA, 45 nt, Homo sapiens
augguuucccucuuacaagaggugcccuggaugggguucccaggu

SEQ ID NO: 184781 - RNA, 51 nt, Homo sapiens
aaggcgaggaaugagaccaaaaaugaugaugcccuuugacucccagccacc

SEQ ID NO: 184782 - RNA, 64 nt, Homo sapiens
aacucucaagauaucacaccaguugacaacuccauggacagcaauauccaucaaaggcgaaauu

SEQ ID NO: 184783 - RNA, 91 nt, Homo sapiens
ucucuggauccaucaugagagacuggagcugaaacccauugauaagucuccagacccaaaccccaucaugacugauacuccaauuccucgc

SEQ ID NO: 184784 - RNA, 63 nt, Homo sapiens
cugcaaaucagugaauggcucucauaaguacaaagggaauuccaaagaugugaaaccuccaga

SEQ ID NO: 184785 - RNA, 47 nt, Homo sapiens
gauuaucgcugucuuuuguacccgucguaccaccucucaccagaaaa

SEQ ID NO: 184786 - RNA, 48 nt, Homo sapiens
cuguacuuagauguagucuguaaaaucaaagaagcaaaguuggagggu

SEQ ID NO: 184787 - RNA, 32 nt, Homo sapiens
uuaggagacagugucuuuuugagcaacuagga

SEQ ID NO: 184788 - RNA, 43 nt, Homo sapiens
uuucuggguauaaaccuuagauugacaccuuugcuuuauugga

SEQ ID NO: 184789 - RNA, 29 nt, Homo sapiens
aguccauguucugaaaagcuggggaauuu

SEQ ID NO: 184790 - RNA, 47 nt, Homo sapiens
gugaagauuuaucccagaaugauuccucaccuacucauugaccaaau

SEQ ID NO: 184791 - RNA, 42 nt, Homo sapiens
guuauugagccuguugugggaaacagacugacucaccagaua

SEQ ID NO: 184792 - RNA, 55 nt, Homo sapiens
caauaaacagagauucugcucuuguacccugaagccacaaaaaaaaaaaaaaaaa

SEQ ID NO: 184793 - RNA, 45 nt, Homo sapiens
cauaauugugaauuggcagccucccuccgaagccaauggcaaaau

SEQ ID NO: 184794 - RNA, 46 nt, Homo sapiens
ggauuacgugggcagacaacucgcugcccaagcaccagaagauuac

SEQ ID NO: 184795 - RNA, 46 nt, Homo sapiens
acucguguuccugaagugccuagcucucuucacguacgcccgcucg

SEQ ID NO: 184796 - RNA, 47 nt, Homo sapiens
aaauggguguguauagguagcaccuuuaucagugauaggugcuggac

SEQ ID NO: 184797 - RNA, 40 nt, Homo sapiens
aagugaggaacuaaaguuacguggcuguuuaaccaacagu

SEQ ID NO: 184798 - RNA, 46 nt, Homo sapiens
ggauguugauguuucaagucacucuuacaccauuaauggguugaaa

SEQ ID NO: 184799 - RNA, 46 nt, Homo sapiens
cauaggaaaugaaaaguugacagauucuauuucuuuguaccaagau

SEQ ID NO: 184800 - RNA, 46 nt, Homo sapiens
auaaauuguacuacauggaaaaggggacugauaaagaacagguaug

SEQ ID NO: 184801 - RNA, 47 nt, Homo sapiens
cuggcccagcaccuaaccuucgugcauaugcagcuucgccuaccucc

SEQ ID NO: 184802 - RNA, 40 nt, Homo sapiens
cauauagaggcaucauucaugagagauacuaggauacaga

SEQ ID NO: 184803 - RNA, 47 nt, Homo sapiens
uuucagugacagagauugaagauaagaaucaaacccaggcaagaaca

SEQ ID NO: 184804 - RNA, 45 nt, Homo sapiens
gaaauaauuuaagaacuuuaccugacggguagaauaagugaagaa

SEQ ID NO: 184805 - RNA, 42 nt, Homo sapiens
auaugauauuaguauacaagauuuacauaucagaaggcagau

SEQ ID NO: 184806 - RNA, 46 nt, Homo sapiens
uuaagaaaguuguacacugugauuuuauuaaacaguacuuugggaa

SEQ ID NO: 184807 - RNA, 41 nt, Homo sapiens
ggagacaaccuuaccuacucuguguucuacaccaaggaagg

SEQ ID NO: 184808 - RNA, 49 nt, Homo sapiens
caguuuuaucagaaauggaguuuguguuccuauuucuuguccuguuugu

SEQ ID NO: 184809 - RNA, 77 nt, Homo sapiens
uucuguagcauaagaugccccauuuaugaacaggcagaagggagcagacagcccagcagucucagugagacugagau

SEQ ID NO: 184810 - RNA, 45 nt, Homo sapiens
uauuguucuugcuacuuauucuguuagcuccucuuagauuuuugc

SEQ ID NO: 184811 - RNA, 66 nt, Homo sapiens
uuuuuuuuauuugaauuuaaagaauaaaaccgccaguuucauauuguccagauugagugguuucuu

SEQ ID NO: 184812 - RNA, 51 nt, Homo sapiens
ucauuuucaaacuuuugguguucuuuuguuuuaggguuaucaacuguagac

SEQ ID NO: 184813 - RNA, 47 nt, Homo sapiens
uuauuacauguuggauagauguuucuacaaaagaagauggcacaaga

SEQ ID NO: 184814 - RNA, 45 nt, Homo sapiens
ugugaagugacuggaaaaccaacuccaacugugaagugggucaaa

SEQ ID NO: 184815 - RNA, 366 nt, Homo sapiens
aaguuuuuuguuuuguuuuguauuuuugagauggagucucccucuggugcccaggcugaagugcaguggcacagucucggcucacugcaaccucugccucccaguugauucuccugccucagccucccaaguagcuggaauuacaggcaugcaccacaggguccagcuaauuuuuguauuuuuaguagagacgggggguggggggggggggucucaccauguuggcuagguuggucucgaacuccugaccuccagugauccaccugacuuggccucccaaagugcuaggauuacaggugugagccaccgcgcuggccgagaaauacuuuuaauuaguaucagauggaugaguaccuguuagcuaaa

SEQ ID NO: 184816 - RNA, 29 nt, Homo sapiens
acaaugauauaaaacauugaauucuuaag

SEQ ID NO: 184817 - RNA, 42 nt, Homo sapiens
gguaaauaucacaaacacccuugaagaagccagacacaaaag

SEQ ID NO: 184818 - RNA, 26 nt, Homo sapiens
ugugcccagcuaccacacccagggag

SEQ ID NO: 184819 - RNA, 46 nt, Homo sapiens
guguugccauguguugcuucaggacuuccuacuccaaccauuaaau

SEQ ID NO: 184820 - RNA, 40 nt, Homo sapiens
uuugaauguuaaauuauuuuaauuuucuaauuuucuaagg

SEQ ID NO: 184821 - RNA, 49 nt, Homo sapiens
caaagaagagaaauucaauuuauagaaaagggauugcauuuucccaaau

SEQ ID NO: 184822 - RNA, 79 nt, Homo sapiens
gauacagacccuggcuaaaaugugugucuguaucccuuuaaagugggaaggagaguggcaaguaugaggaauugaaaau

SEQ ID NO: 184823 - RNA, 39 nt, Homo sapiens
uggaaauaaagaugaauuggacgugcuuucuguccucag

SEQ ID NO: 184824 - RNA, 54 nt, Homo sapiens
aacuuugucauggacauagcuagugaaagaugauuuuaaaauagagcucaaauu

SEQ ID NO: 184825 - RNA, 49 nt, Homo sapiens
uugguaaguguuuagguuucuggguaaaauugcaucaauaauuggagaa

SEQ ID NO: 184826 - RNA, 52 nt, Homo sapiens
gaaaaaguaagaaguaaaggacuggugauagaaaauggucagcaagggagga

SEQ ID NO: 184827 - RNA, 50 nt, Homo sapiens
gaauguacugacuccccuucuucgcucuccuccccuccccgcccccuugc

SEQ ID NO: 184828 - RNA, 46 nt, Homo sapiens
ugcugaaaccuggccuacccagcaccacagagaaguccaggccgua

SEQ ID NO: 184829 - RNA, 29 nt, Homo sapiens
gaagaucaucaaaaagauaugauuugcag

SEQ ID NO: 184830 - RNA, 29 nt, Homo sapiens
uugccacuaaguuuauuguuuuaaaagca

SEQ ID NO: 184831 - RNA, 27 nt, Homo sapiens
aagaaaauaguuaugaauguuuuuuca

SEQ ID NO: 184832 - RNA, 69 nt, Homo sapiens
aguucugaagcuaaagaggugauagauggaaaggucaugaaauggccuaauaagcccugguaaggaaug

SEQ ID NO: 184833 - RNA, 36 nt, Homo sapiens
uggggcuugcuguagagugggauuagaggcaggaaa

SEQ ID NO: 184834 - RNA, 30 nt, Homo sapiens
caaccacaggagggugguugaggaggagga

SEQ ID NO: 184835 - RNA, 43 nt, Homo sapiens
gguuuacaaggugaaugauauguaguacacagguggucuggug

SEQ ID NO: 184836 - RNA, 53 nt, Homo sapiens
uguagaagaaggagauuucugguauaggugaauagauggggcuguuaucaaag

SEQ ID NO: 184837 - RNA, 51 nt, Homo sapiens
gguccaggagaggguacaggcagguguguguugcagauauuuuugucagcg

SEQ ID NO: 184838 - RNA, 43 nt, Homo sapiens
cuccaguaggguacaguagccggggucaggggcacagcaggca

SEQ ID NO: 184839 - RNA, 46 nt, Homo sapiens
ugccucagauucccuccucuuugcagaauguaggcagguauuggug

SEQ ID NO: 184840 - RNA, 24 nt, Homo sapiens
gcagcuacugaggagaagaggggc

SEQ ID NO: 184841 - RNA, 48 nt, Homo sapiens
ucuguagucacaccuggauguaaccagcuuccuacuuuggagucagug

SEQ ID NO: 184842 - RNA, 145 nt, Homo sapiens
gcugagggcacaguaaguguggacccucaaaaagggcuccuuuuucaucucugggguuggaucccaauauugagaauccuagaaaaaucuuguuuugccuuaggauccugguggcuugagauagccccaguagaaauggaagagg

SEQ ID NO: 184843 - RNA, 45 nt, Homo sapiens
agggagagagcgacccugagaacagucacagauuggcuuuuuaag

SEQ ID NO: 184844 - RNA, 51 nt, Homo sapiens
uuccccgcuuuccucaccggggcuugcuguuggauacaucucgccauuacc

SEQ ID NO: 184845 - RNA, 45 nt, Homo sapiens
ugguagaugauccuuccuucccauaugagagcuucacuuuuccag

SEQ ID NO: 184846 - RNA, 45 nt, Homo sapiens
uccgggguauccgugugcuugcagaguuugacacuccuggccaca

SEQ ID NO: 184847 - RNA, 46 nt, Homo sapiens
cucuggcaccuuuggaccagugaaucccagucucaauaauaccuau

SEQ ID NO: 184848 - RNA, 43 nt, Homo sapiens
acaucgucucuucuuauggcaagggcuaugugguguggcagga

SEQ ID NO: 184849 - RNA, 51 nt, Homo sapiens
aucauacagguguggcgagaggauauuccagugaacuauaugaaggagcug

SEQ ID NO: 184850 - RNA, 46 nt, Homo sapiens
aaaugaaacaacuuagcuggggugagggccacauugggaagguggu

SEQ ID NO: 184851 - RNA, 45 nt, Homo sapiens
cucagguaccccugagcagaaggcucuggugauugguggagaggc

SEQ ID NO: 184852 - RNA, 34 nt, Homo sapiens
uguugccgaaaggcuguggagcaacaaguugaca

SEQ ID NO: 184853 - RNA, 46 nt, Homo sapiens
ggccggugcuggcgcucgcauucaauaaagaguaauguggcauuuu

SEQ ID NO: 184854 - RNA, 51 nt, Homo sapiens
aggugggcgaugccaacauuaauacucaggaccccaagauacagaaggaaa

SEQ ID NO: 184855 - RNA, 45 nt, Homo sapiens
uaaccuugaggcugaggcaguggcuccuugcacagcagcugcacg

SEQ ID NO: 184856 - RNA, 96 nt, Homo sapiens
cguggcuccggaucucuucgucuuugcagcguagcccgagucggucagcgccggaggugagcggugcaggaggcuacgccaucaguccccaccaag

SEQ ID NO: 184857 - RNA, 158 nt, Homo sapiens
uuucccgccccagcccuacccccucauucuggucccauccucuuccuccugccccaauccucaaugcgccuccauccucgccugccuucucucggucccucgugauugauuccacccuugcuuccccuuucuccgcgccgccuguuccgugcucguuu

SEQ ID NO: 184858 - RNA, 49 nt, Homo sapiens
ggaaaaagauuaggaacuggcagucauccauagaggugaaauacagagg

SEQ ID NO: 184859 - RNA, 56 nt, Homo sapiens
caugguaauuucaggaugauuuuuguaucugaaacuuaacagacuuagaguugguu

SEQ ID NO: 184860 - RNA, 46 nt, Homo sapiens
cagaaucacugcugcagcuacucaccccugcauacaucacaaagaa

SEQ ID NO: 184861 - RNA, 46 nt, Homo sapiens
aaauaaaaucuggcagcaggucuaauuauauaauuucuaaguagug

SEQ ID NO: 184862 - RNA, 39 nt, Homo sapiens
acuaggguuaauccaaaaaccugucuaucagacccagau

SEQ ID NO: 184863 - RNA, 52 nt, Homo sapiens
ugccaauuuagaaucuuuuucuauuauuuaucauuuaaguuaguaaugagau

SEQ ID NO: 184864 - RNA, 40 nt, Homo sapiens
cagccuuaaagcucaaaggccauccccacuucugucccca

SEQ ID NO: 184865 - RNA, 48 nt, Homo sapiens
gagagaaggaaguugagacaguuggcucuguaacauuaagauggaggu

SEQ ID NO: 184866 - RNA, 45 nt, Homo sapiens
ccgucgaagaggagggggcugcgguggccaccgcggcggagcccg

SEQ ID NO: 184867 - RNA, 40 nt, Homo sapiens
agccucccaaacaccagaucacggccccggauccccagua

SEQ ID NO: 184868 - RNA, 38 nt, Homo sapiens
cuggguuuuaaugugaauuauguugcuggcguauuuug

SEQ ID NO: 184869 - RNA, 45 nt, Homo sapiens
ucaguuugccucauucuuggaagccucaucaaaauucuccacaag

SEQ ID NO: 184870 - RNA, 46 nt, Homo sapiens
uguuaaaguggaucacuguuccuugguuuguaaacauaugcaccuc

SEQ ID NO: 184871 - RNA, 41 nt, Homo sapiens
uacgagcaguuccuuucccaccaaugcacacuugugccugc

SEQ ID NO: 184872 - RNA, 47 nt, Homo sapiens
auacuauccaugcugaugggacaggauccaauaugaauauaaaugau

SEQ ID NO: 184873 - RNA, 39 nt, Homo sapiens
auuauuuuaauuuuuuuaagggccuagacuuagcagaau

SEQ ID NO: 184874 - RNA, 29 nt, Homo sapiens
uaugagauguguuuguaguuuucauguuu

SEQ ID NO: 184875 - RNA, 46 nt, Homo sapiens
ccaacacccaguccaccagaggagcuuagagauucugcagagaugc

SEQ ID NO: 184876 - RNA, 69 nt, Homo sapiens
cuugguuaaaacaaaaguguguaauguguuuugaaaaacaguauuuaaaguauuuucucauuuuaagag

SEQ ID NO: 184877 - RNA, 46 nt, Homo sapiens
cccggaaaaaucccagaacaccucuuucugaucuccagggcaugaa

SEQ ID NO: 184878 - RNA, 46 nt, Homo sapiens
gucuugcuguguaggcagcauuuccuccaucugagacaagcaucug

SEQ ID NO: 184879 - RNA, 53 nt, Homo sapiens
aaccugaaucuugaacgcacccaagccuccgccuccgcgcgacucggcggcag

SEQ ID NO: 184880 - RNA, 42 nt, Homo sapiens
aucagaaaaaaguaggccgggcuaagagagaaaguaggagaa

SEQ ID NO: 184881 - RNA, 37 nt, Homo sapiens
gagcagugguccuuacauuuuuucuguaaacggccag

SEQ ID NO: 184882 - RNA, 29 nt, Homo sapiens
auuaaucaguuguuaccugcugugggagg

SEQ ID NO: 184883 - RNA, 46 nt, Homo sapiens
aaaccuacuacccagucagagguuucgccacucuuugcaggcacag

SEQ ID NO: 184884 - RNA, 47 nt, Homo sapiens
gggauauuauuauccccauuuacagaaaaaggaacugaggcuuacag

SEQ ID NO: 184885 - RNA, 56 nt, Homo sapiens
ggauuccucauguuuaaucugcuggcucucuuuaguuacauuauagaaucuaugug

SEQ ID NO: 184886 - RNA, 34 nt, Homo sapiens
aaauuaaaaacagaaaucccacuuaaaagugaaa

SEQ ID NO: 184887 - RNA, 46 nt, Homo sapiens
gauaauguuacuuucuuccaagaauguuuucauuuuuuucugccug

SEQ ID NO: 184888 - RNA, 41 nt, Homo sapiens
agaaagaagcuuagcccuuagcucccugaagacagcuggca

SEQ ID NO: 184889 - RNA, 69 nt, Homo sapiens
acuacuugaagcuauuuuuguuaauauucugguuacugaaguuuauuguaaauauguauguauaguagg

SEQ ID NO: 184890 - RNA, 49 nt, Homo sapiens
gccauuuaaauuauuuugccacucugggcuucugaaaacacaaagggag

SEQ ID NO: 184891 - RNA, 78 nt, Homo sapiens
uauucaauuuuuaaaauucuggggucauccuucucacuuguuuuuacguuacauuuacauuuucauuuuugcauuaaa

SEQ ID NO: 184892 - RNA, 40 nt, Homo sapiens
agaccacauagaauugcauucaaucuuuccaguaacucaa

SEQ ID NO: 184893 - RNA, 46 nt, Homo sapiens
gauuuuuauuuauuucuaggugucauagauuaaaaagcacaucaag

SEQ ID NO: 184894 - RNA, 64 nt, Homo sapiens
cugccccgccguaaccccgagcgcgggagggcgaggccaucgguuugcgggcaagcuggccccg

SEQ ID NO: 184895 - RNA, 59 nt, Homo sapiens
aaugugggggaggcgggcagaagaaggggugaagaaaaggggacauccugaguuccgag

SEQ ID NO: 184896 - RNA, 47 nt, Homo sapiens
uucuaggguuuuaaauuauguaaaauguuuacuuauucugagcuuag

SEQ ID NO: 184897 - RNA, 65 nt, Homo sapiens
ucugccugugaaguaugauagucugcauuuguaaugagcauucaagugauucugaugcaggugag

SEQ ID NO: 184898 - RNA, 48 nt, Homo sapiens
uugaaucuauagcagcauugucaguacagaccagugguucucaaacuu

SEQ ID NO: 184899 - RNA, 39 nt, Homo sapiens
uggaaaacauauauauguuagcaucaaagggggcagaag

SEQ ID NO: 184900 - RNA, 43 nt, Homo sapiens
guauucuuuaauugggcuguaugacuuaaaagaaacugcaggg

SEQ ID NO: 184901 - RNA, 47 nt, Homo sapiens
auucagcuuuaagggcaacagccccuuauaaguuucuaucugagcag

SEQ ID NO: 184902 - RNA, 46 nt, Homo sapiens
aguaaggaaccaggaugagaaagguggcuggccaauuauggugacc

SEQ ID NO: 184903 - RNA, 50 nt, Homo sapiens
aguccauuacuuaagaagacaaugaaauaauuuuaguuagcaccucaggu

SEQ ID NO: 184904 - RNA, 45 nt, Homo sapiens
uaucuacacaauggggaccucaaggcuauuucuauccaauccaga

SEQ ID NO: 184905 - RNA, 46 nt, Homo sapiens
caacccugcucccccgacguccaccgugauccacauccgcaacgag

SEQ ID NO: 184906 - RNA, 41 nt, Homo sapiens
gaugguguguuuaugucuuuugaaggcuacaauguggaagu

SEQ ID NO: 184907 - RNA, 101 nt, Homo sapiens
uugacugucucauaaaugaugaacacacaauuaaagggagacgagaggggaacgaagucuuucuuccauucacuuggguugagaaauauuuugauguuuau

SEQ ID NO: 184908 - RNA, 83 nt, Homo sapiens
ggccaaacaacagucugaggaagcauucccucaggaacagcagaaagcacccccuguuguugggggcuucaauagcaaugugg

SEQ ID NO: 184909 - RNA, 75 nt, Homo sapiens
gaguaguggcuucagaguggauggguuugaaaaaagagcagcagcaucugagaguaacaacuauaugaaccacgu

SEQ ID NO: 184910 - RNA, 47 nt, Homo sapiens
guacagagauccaauauauacaauugacauuuuggaagagaccagaa

SEQ ID NO: 184911 - RNA, 46 nt, Homo sapiens
uuauggagugcugaugaugauuuucauucagcacaagcucuggauu

SEQ ID NO: 184912 - RNA, 38 nt, Homo sapiens
uauauggugacuuggagccauaauaugauacuaugaug

SEQ ID NO: 184913 - RNA, 39 nt, Homo sapiens
ucuguucagggcaccaaaauuagaaacaaauuauuuuug

SEQ ID NO: 184914 - RNA, 55 nt, Homo sapiens
aguaaccuccauugccacugcugccacagcugugauggguggcugggcuugagag

SEQ ID NO: 184915 - RNA, 42 nt, Homo sapiens
uuguuuuguauuuucuagaguuuuauauaaauggaauuacau

SEQ ID NO: 184916 - RNA, 42 nt, Homo sapiens
ggguauuucaaguaucugaaaauuauaagggugugcagggug

SEQ ID NO: 184917 - RNA, 82 nt, Homo sapiens
cugcagguucuuuaggaggccgguguccgcagguugagcguggauacagcuccugagcaacuggaaucuguugagggugggg

SEQ ID NO: 184918 - RNA, 42 nt, Homo sapiens
gagcgagcgagcgagagaaagggaggggggaggcgcgggagg

SEQ ID NO: 184919 - RNA, 24 nt, Homo sapiens
ccccuccucagggguaagcuuucg

SEQ ID NO: 184920 - RNA, 52 nt, Homo sapiens
aaacuucaaaccucagagagcagcacgcaguaccugcagcugucagugagga

SEQ ID NO: 184921 - RNA, 47 nt, Homo sapiens
gacuuugcaccccagaaagcagaggugagguauuaugcaacugauuc

SEQ ID NO: 184922 - RNA, 72 nt, Homo sapiens
ucaccugaaagaaggcccgaccgugugagcggggcugaggaauggggcugaagcagggggaggguguuagag

SEQ ID NO: 184923 - RNA, 45 nt, Homo sapiens
aaguuuguuuaacuuugguaaguuugcgauugaggugaggccuac

SEQ ID NO: 184924 - RNA, 46 nt, Homo sapiens
ugagguucggacacuuuucugccaauacuuccaggcccccugagac

SEQ ID NO: 184925 - RNA, 121 nt, Homo sapiens
ccaccauccucauccuccuccucaucauccaggcccuccacguagcccucagcauccgagucaggggccuccuugucgucccggucauagccgucgagauaugugaguugcgggaggagcu

SEQ ID NO: 184926 - RNA, 44 nt, Homo sapiens
ccuccucauccucguccuccucgucuuccacuaccugagcaucu

SEQ ID NO: 184927 - RNA, 51 nt, Homo sapiens
agaaaaaaauaaguuucagggggcaggauuggaggggggggggagagggga

SEQ ID NO: 184928 - RNA, 43 nt, Homo sapiens
guggguuguccagguaggagauaggaguggcccagccuggggc

SEQ ID NO: 184929 - RNA, 41 nt, Homo sapiens
uucugccuggagagucugcguuuaaugaggcuugggcugag

SEQ ID NO: 184930 - RNA, 70 nt, Homo sapiens
uuuuaaaaauuaauauaucuccacuaucaauaguguaguauuuauuucagaucccuuauuugggggaggg

SEQ ID NO: 184931 - RNA, 43 nt, Homo sapiens
gaaauaaaacccuucucagaaacaagcagaccaaagcuuacag

SEQ ID NO: 184932 - RNA, 35 nt, Homo sapiens
ucuuuaucaaucgaggggauggguuugccgcccau

SEQ ID NO: 184933 - RNA, 47 nt, Homo sapiens
gguguuucacaauacacauuuggauugauuuuacaagauagaauuag

SEQ ID NO: 184934 - RNA, 50 nt, Homo sapiens
uucucauuuuauaaauaagcagugucuuaaauagugcugguccuggguag

SEQ ID NO: 184935 - RNA, 43 nt, Homo sapiens
caguaccaugcacuaugaguagcuaaggcauucauuuggcacu

SEQ ID NO: 184936 - RNA, 46 nt, Homo sapiens
aucuucuucgcugcacuguguuuugguagagaugcacacuaaauac

SEQ ID NO: 184937 - RNA, 85 nt, Homo sapiens
auucaaauguaucauuugugagaaaacuugagcaaaucgaagaagauccuuguggguguuccuguuaccuuuuugucugaggugc

SEQ ID NO: 184938 - RNA, 45 nt, Homo sapiens
auauugucagcaccuaaaauccguucccgaacuauaaggccuucc

SEQ ID NO: 184939 - RNA, 45 nt, Homo sapiens
acauucaguucuauucccauaagcauggauugguggaagaaccuc

SEQ ID NO: 184940 - RNA, 46 nt, Homo sapiens
uuuaugaugucauaguucucacggucauuugcaaaggaggcaccca

SEQ ID NO: 184941 - RNA, 52 nt, Homo sapiens
agagagggugagggaggggagggcccgugaauuaacgaguccgcgcgcgucg

SEQ ID NO: 184942 - RNA, 44 nt, Homo sapiens
gccgcguucgccagcgcuuuaaaccugggcccucacagcccauu

SEQ ID NO: 184943 - RNA, 39 nt, Homo sapiens
aguuuuugguacgaccuggaugaagggagaagucugagc

SEQ ID NO: 184944 - RNA, 45 nt, Homo sapiens
acugcaccauccuuagcaaaaaggaauguguuggcucauauggcc

SEQ ID NO: 184945 - RNA, 62 nt, Homo sapiens
cuguaacagaaggcgaggccccggguagggaauaaggcagugggggaggccugggacuggga

SEQ ID NO: 184946 - RNA, 46 nt, Homo sapiens
agaaagggagccgguguguggagaggggagaggguaguauuuuggg

SEQ ID NO: 184947 - RNA, 40 nt, Homo sapiens
gggcuaugugcacuccagaccccugcccaggcucaggccc

SEQ ID NO: 184948 - RNA, 49 nt, Homo sapiens
gccccuccccuugucuuccagauacccuguguaacgaacucgaccagga

SEQ ID NO: 184949 - RNA, 80 nt, Homo sapiens
cccugauuuauauugaaagggcggcggugcgggggggggaggucggggccggggcgggggcggggucugucacuugaagu

SEQ ID NO: 184950 - RNA, 54 nt, Homo sapiens
ucgcgggguggugggggccgcccugcacuugcgcgccuuaccagguuccucaca

SEQ ID NO: 184951 - RNA, 36 nt, Homo sapiens
cugagacugccagacacagagacagaaaaggggugu

SEQ ID NO: 184952 - RNA, 42 nt, Homo sapiens
gcagccguacucgggcuccagcgcucucaaacccaaccaggu

SEQ ID NO: 184953 - RNA, 54 nt, Homo sapiens
gacagauaauacauaaauagcuugauacuugaagaagguacaaaacagaugaga

SEQ ID NO: 184954 - RNA, 50 nt, Homo sapiens
augacuuaguuaucauuugugaucacuuagaaaguuccuugcuaggguaa

SEQ ID NO: 184955 - RNA, 81 nt, Homo sapiens
guucggugauauuaggccguggaauaguuuuggauugaauuggaucuaccuuuuugggaaaguuugguucuacuucaugua

SEQ ID NO: 184956 - RNA, 37 nt, Homo sapiens
ucggagucuacaacauaauaauuuagugaaggacaaa

SEQ ID NO: 184957 - RNA, 45 nt, Homo sapiens
agauuuuaucccuggaccauugauaauaaauacuauucagcagac

SEQ ID NO: 184958 - RNA, 61 nt, Homo sapiens
ggacauuucaaauccauuugaaugucuuuuggacauuugaagccaaaagauagaccccaaa

SEQ ID NO: 184959 - RNA, 46 nt, Homo sapiens
gcgaauuguccaagcccugaaugccaaugugugguccaauguagug

SEQ ID NO: 184960 - RNA, 47 nt, Homo sapiens
uagcauuuggagcuagcuuagagagaggccugaaugccagucaggag

SEQ ID NO: 184961 - RNA, 47 nt, Homo sapiens
ggguggugaaaauguucuggaauuaaauggugaugaugguugcacaa

SEQ ID NO: 184962 - RNA, 44 nt, Homo sapiens
cgccuggugcauuugaaggauaucaggacgcuugcuggcugagc

SEQ ID NO: 184963 - RNA, 42 nt, Homo sapiens
gcuagugaaaucauuucuuucuuaaaagaauuuuuuauucaa

SEQ ID NO: 184964 - RNA, 47 nt, Homo sapiens
aauugaaguaucuuaguuuuaguaaguuuggucaugcuuauuacuca

SEQ ID NO: 184965 - RNA, 54 nt, Homo sapiens
uuuuucuuggaucuuuuuucccucuuuggcuuuaauuucuccuugucauuauga

SEQ ID NO: 184966 - RNA, 52 nt, Homo sapiens
auaaaauucauggugcuuuuuuaguacuuccuguguaaaagaccuuggcaaa

SEQ ID NO: 184967 - RNA, 42 nt, Homo sapiens
agguugauagcauuguggguaaguuccuccuuuggcugccaa

SEQ ID NO: 184968 - RNA, 97 nt, Homo sapiens
cuauaaaagguccagugcuauuauuauaauuauauaucacacuuguguauuucugaagggucuuagugugagcuuuucauugaauauuaacuucuaa

SEQ ID NO: 184969 - RNA, 42 nt, Homo sapiens
ucugagauaccucucuacucagcccagucauauuuugccaaa

SEQ ID NO: 184970 - RNA, 85 nt, Homo sapiens
cugccugacuuguuuauaggguccccuuaauuuuaguuuuuaguaggagguuaaggagaaaucuuuuuuuuccucaguauauugu

SEQ ID NO: 184971 - RNA, 35 nt, Homo sapiens
uaggaaugaggguaggauaaaucucagaggucugu

SEQ ID NO: 184972 - RNA, 82 nt, Homo sapiens
ccauucaaggagcuuguagcucugagcuaugaugcuuuuauugggaggaaaggaggcagcugcagaauugaugugagcuaug

SEQ ID NO: 184973 - RNA, 46 nt, Homo sapiens
uugaaguauagugucugagcucaugcuagaaagaaucaaaaagcca

SEQ ID NO: 184974 - RNA, 114 nt, Homo sapiens
ucucugcccuuccaagccuguaaccucggaggacuaucuuuuguucuuuauccuuugucuuguuugagugggucagccccagaggaacugauaagcaaauggcaaguuuuuaaa

SEQ ID NO: 184975 - RNA, 27 nt, Homo sapiens
ucaguguuucuuugaggugauugcauu

SEQ ID NO: 184976 - RNA, 27 nt, Homo sapiens
uagaaaauauacuaggccaucugguua

SEQ ID NO: 184977 - RNA, 40 nt, Homo sapiens
uacagccauuuagugaagucuucaugugauaagcacugag

SEQ ID NO: 184978 - RNA, 62 nt, Homo sapiens
ggucaugaggucccuacugaauaugaacacugaaauugccuaggaucauggguggacuuaag

SEQ ID NO: 184979 - RNA, 46 nt, Homo sapiens
gccaacaaguaccuucaggaucugaacugucacaucuuacccaaag

SEQ ID NO: 184980 - RNA, 46 nt, Homo sapiens
gccuucccaacugguaaagcaagugguccaacauuuucgccaguag

SEQ ID NO: 184981 - RNA, 344 nt, Homo sapiens
cagcauucuuuucagaaucuuuuuuuugagacagaguuucgcucuuguugcucagccuagagugcgguggcgcaaucuuggcucacugcaaccuccgccucccggguucaagggauucuccugucucagccucccaaguagcugggauuacaggcaugugccaccacgccgggcuaauuuuuuguauuuaguagagacgggguuucaccauguuggccaagguguucucgaacuccugaccucaggugauccaccugccucuuccucccuaagugcugggauuacaggcgugagccacugggcucggcccuuuuucagaaacuuuaaguccauaugaggugagg

SEQ ID NO: 184982 - RNA, 38 nt, Homo sapiens
agggaaucucucucucugaggaaucagaugacaccugg

SEQ ID NO: 184983 - RNA, 46 nt, Homo sapiens
uuagcccuccaaucaaugaucaguucuagaagaggggaugagaugc

SEQ ID NO: 184984 - RNA, 37 nt, Homo sapiens
gggacugccuuucgcugcuuguugggguuacagguga

SEQ ID NO: 184985 - RNA, 43 nt, Homo sapiens
acucccggaggcugacgggaaagccaaagagcaggugaggcac

SEQ ID NO: 184986 - RNA, 67 nt, Homo sapiens
auagguggcuagggccuauuucucagacuguuccugagaaagaagagcccuaguuguuugaacagua

SEQ ID NO: 184987 - RNA, 46 nt, Homo sapiens
ccacaguaggccacauuaguaucaaaucagagcagaguaguagcag

SEQ ID NO: 184988 - RNA, 46 nt, Homo sapiens
acuaccuuuuccuuucccaucuaaguuauauaucaugugcauggcg

SEQ ID NO: 184989 - RNA, 46 nt, Homo sapiens
uuuaaacaauggugaagggcagauuuuuacuauugauggcccccug

SEQ ID NO: 184990 - RNA, 57 nt, Homo sapiens
ugccaauacuaugcuuaacugagacuggcaaagugaagagucaaaaauagcaaggag

SEQ ID NO: 184991 - RNA, 39 nt, Homo sapiens
ugcccccuggugaccugaacaucccugacuacacagagg

SEQ ID NO: 184992 - RNA, 42 nt, Homo sapiens
uucaagucccccaguucuguccagacaucuggucuuaccuau

SEQ ID NO: 184993 - RNA, 43 nt, Homo sapiens
gaugaggagacaggcuuaagagagguuguggaacuugcccaag

SEQ ID NO: 184994 - RNA, 31 nt, Homo sapiens
gagcaauaagaauccuagaggaaggaggaag

SEQ ID NO: 184995 - RNA, 42 nt, Homo sapiens
aagauuuuaagaaaugcaaggaaacuaccugaaaaaacacag

SEQ ID NO: 184996 - RNA, 45 nt, Homo sapiens
uccuugauucuccccuauuguucugguguuuggcuggaauuaaau

SEQ ID NO: 184997 - RNA, 47 nt, Homo sapiens
uucuguauucuuagugauuguuacaaaccccuuuauugcugucugag

SEQ ID NO: 184998 - RNA, 60 nt, Homo sapiens
ccuaaaacaucugauuaauauaggcuagcugauuucuuaaaaauucguugcauugaagga

SEQ ID NO: 184999 - RNA, 45 nt, Homo sapiens
gauccaaagggaacacaguauguaggucaaacuggcaguaacagu

SEQ ID NO: 185000 - RNA, 44 nt, Homo sapiens
ucaugccauucuuaaguaaaucaacuauuuucaacacugaagaa

SEQ ID NO: 185001 - RNA, 56 nt, Homo sapiens
ugaugagagguucauucuuguguauucaguuaaugacaccaaaaggcucagcccac

SEQ ID NO: 185002 - RNA, 46 nt, Homo sapiens
cgauucaguuucacauugccauauccagugaaaaucaaaguuagau

SEQ ID NO: 185003 - RNA, 34 nt, Homo sapiens
gaggacccauccacauggaaaaauucuugaaagg

SEQ ID NO: 185004 - RNA, 46 nt, Homo sapiens
ucaggucuuuuucauuuuuuauaauauccuuaugaaaucacaaagu

SEQ ID NO: 185005 - RNA, 42 nt, Homo sapiens
gauucuccuggaucuuugucaaccugacugugcgauucugua

SEQ ID NO: 185006 - RNA, 48 nt, Homo sapiens
cccaccagggguuacuuucaugugacuuugccacaguugcaggugaga

SEQ ID NO: 185007 - RNA, 62 nt, Homo sapiens
aguuagagcagguuaggguccuucuugcaggagucugcagucuuagauagguacagacagac

SEQ ID NO: 185008 - RNA, 3695 nt, Homo sapiens
accaggcacauguacaggcauaccuuguuuuauugugcuuugcuuuauugugcuuugcagauaaugcgguuuugacaaauugaagguuguggcaacaaagucuguuggcgucauuuuuccaacagcauguguucauuuagugucucuguguuguauuuuguuaauucuuggaauaguucagauuuuuucauuauuauuauaucuguucuggugaucugugaucagugaucuuugauguuaacuuuuuuuuuuuuuuugaggcagggucucacucuguugcccagguuggagugcagcagugugaucauagcucaccguagccuugaacuccuggguuugagcaguccuccuggcucagccuaccaaguaggacuacagguaccugccuagcuaauuuucaauuuuuuaauuuuuuuagagguggggucucauuauguuggccaggcuggucuugaacuccuggacuuaagcaauccucuugccuuggccucccagaucccugagguuacaggcuugaaccacugugccuagccuugauguuacuauugugauuguuuauuauuuauuuauuuauuuuugagacagggucucacucugucacccaggcuggagugcaguggugugaucuuggcccaccgcaaccuccgccucccagccucaagugauccuuccaccucugcuucccaaguagcugggacugcaggcaugugccacugugcccagcuaguuuuuguauuuuuuguagagacgagguuggucucgaacuccuaagcucaaguggccugcccaccucggccucccaaagugcugggauuacagguuugagccacugugcccagccaccauugugauuguuuuauggcaaaaugaaaugcaccuauauaagauggugaacuuaaucgauaaauguauguguucugacugcucucacuggccauuccuccaucucucucccucuccuugggccucuccucugagacacaacaauauugaaauuaagccaguuaauaacccuacaauggggucgggugugauggcucaugccuguaaucccagcacuuugggaggcuguggugggugugucacuugaggucaggagaccagccuggccaacauggugaaaccccgucucuacuaaaaauauacaaaaauuagcuaggugugguggcgggugccuguaauccuaacuacucaggaggcugaggcaggagaaucacuucaaccugggaggcugaaguugggugagcugagaucacgccaccgcacuccaguggcagagugagacucugucucaaaaacaaaacaaacaaacaagcccuacaguggcuucuaaguguuaaagugaagaguugcacaugucucacuuuaaaucaaaagcuagaaaucauuaagcuuagugaggaaggcaugucaaaacugagacaggcugaaagcuaggccucuugcaccaagcagccaaguugugaaugcaaagaaacaauuuuugaaggaaauuaaaagugcuauuccagugaacacccaaaugauaagaaagcaaaauauccauauugcugauaugaagaaaguuugaguggucuggauagaauauaaaucagccacgacauucucuuaagccaaagccuaauccagaacaaggccccaacucuuucaauucuaugaaggcugagaggugaggaagcugcagaagagaaauuugaagcuagcagaaguugauucaugaggcuuaaggaaaggcuccauaacauaaaagugcaaggugaagcuacaagugcugauuguagaagcugcagcaaguuauccagaagaucuaacuaagauccuugaugaagguggcugcacugaacaacagauuuucaauguaacagccuucuacuggaagaagaugccguggaggacuuuuauaguuagagagaagucaaugccuggccucaaagcuucaaaggacagucugacucuuuuguuaggggcuaaugcagcugguggcuugaaguugaagccagugccccuuuaccauucugaaaauccuagggcccuuaagaauuauguuaaaucggccgggcaugguggcucaugucuguaaucccggcacuuugggaggccgaggcagguggaucaccugaggucaggaguucaagaucaggcugaccaacauggcgaaaccccgucucuacuaaaaaauaaaaaaaauuagcugggcaugguggcgggcgccuuuaaucccagcuacuugggaggcugaggcaggagaaucgcuuggaucugggaggcagagguugcagugagcugagaucgcaccacugcacuccagccugggcaauagagagagacucugucucaaaaaaaaaaaaaaaaagaauuaugcuaaaucuacucugccuaugcucuguaaguggaacaacgacuccuggaugauagcacauuuguuuacagaaugguuuacugaauauuuuaagcccacuguugaggccaacuucucagaaaaaaaaaaaaaaaaaaaaaaaaauauauauauauauauauauauauauauauauauauauauauguauauuccuuucaaaauauuacugcucauugacagugcaccuagucccacccaagagugcugauggaaaugucaaggagauuaauguuguuuucaugcccgcuaacauaacauuccuuuugcagcccauggaucaaggaauaauuuugacuuucaggucuuauuuagaaaauacuuuccguaagguuaaaacugucguagguagugauucugugauggaucugggcaaagucaauugaaaacuuucuggaaaggauucaccauucuagauaccauuaagaucauuugugauucauaggaagaggucaaaauauaaaaaugaacaggaguuucgaagaaguggaauucaacccucauggaugauuuugagggguucaagacuucaguggagguaguaacugcaggugugguagaaauagcaagagaacuagacuuagaaguggagccugaaggugugacugaaugcagcaaucucaugauaaaacuugaagggaugaggaguugcuucuuauggaugagcaaagaaagugauuuauugagauggaaucuauuucugaugaagaugcucugaacauuguugaaaugacaaugaaggguuuauacuguuucauaaacuuaguuaauaaagcaguggcagggguugagaguauacucugauuuuaaaagaaauuauucucuggguaaaacaguaucaaacagcauugcaugcugcaaagaaaucuuuagugaaggaaagacucaaucaaugagacaaacuucauuguuguccuccuuuaagaaauugccacagccacuccagccuucagcagucaccaccuggaucaguccacagccaucaacauugaggcaggacccgccaccagcaaaaagauuacaacucccugaaagcucacaugaucauuagcauuuuuuagcaaugaaauauuuuaaaguuaagguauguacacuguuuuuuagaauaauacugcauacuuaauagacuauaguauaauauaaacauaacauuuauauauacugggaaaccagaaacuuugugugacucacuuuauugugauauuagcuuuauugugguggucuggaacagaaccuacaauagcuccaagguaugccuguaaauuaaaaugauaggauacuguuucucacauuagagu

SEQ ID NO: 185009 - RNA, 70 nt, Homo sapiens
uuaccuaauagaaaaaggggcagauaauauaaacauuucagaguaaaaggaaacaagaaugaccaauaag

SEQ ID NO: 185010 - RNA, 85 nt, Homo sapiens
ggguuucacuucagauaagauccuguaagaaaauaugggaguuucgugguuggguaucugaauaaaucuuaccuguagggcaggg

SEQ ID NO: 185011 - RNA, 42 nt, Homo sapiens
cuugcagcagauaaugacugagcugagccuggagugagaccu

SEQ ID NO: 185012 - RNA, 42 nt, Homo sapiens
caacaagcuuuacaucguggggggcgugcgcggcgccagcaa

SEQ ID NO: 185013 - RNA, 46 nt, Homo sapiens
gaauuagucacacagcuaauggccaaggguuuuccuuugaguugua

SEQ ID NO: 185014 - RNA, 44 nt, Homo sapiens
agauggcaagcaugugguguuuggcaaaguucuagagggcaugg

SEQ ID NO: 185015 - RNA, 47 nt, Homo sapiens
caggagguggugcggaagguggagagcaccaagacagacagccggga

SEQ ID NO: 185016 - RNA, 54 nt, Homo sapiens
ggcaucugguggagcggacccacuccccucacauuccacaggcccauggacuca

SEQ ID NO: 185017 - RNA, 46 nt, Homo sapiens
acagccccuggcccccgccaucggccccccuuacccccaguugcua

SEQ ID NO: 185018 - RNA, 44 nt, Homo sapiens
uuagaauagaaguggaagaagucaguaggugcccaaaugcuauu

SEQ ID NO: 185019 - RNA, 39 nt, Homo sapiens
agugccguguguucccgggacauugggaagcaggagaaa

SEQ ID NO: 185020 - RNA, 50 nt, Homo sapiens
uagcaaacagaaagacuuguccgugggagagcuauccggugacaucccuu

SEQ ID NO: 185021 - RNA, 54 nt, Homo sapiens
ccuggguccaaaacaaaguucucuuggggcaaggcggguuggccgaaggugaaa

SEQ ID NO: 185022 - RNA, 62 nt, Homo sapiens
ugaacaaguuaggguggcggucccaggugggggccggcaggacugggagccagggaaggcga

SEQ ID NO: 185023 - RNA, 40 nt, Homo sapiens
gcuguuuguucaucucuguauguaaaaacugacagugaga

SEQ ID NO: 185024 - RNA, 92 nt, Homo sapiens
cucagccagaugucagccaggcuugacaaaauagaagagggucaaaagaagacuuuugauggucagagaacaaggcaagaagaggagaagau

SEQ ID NO: 185025 - RNA, 40 nt, Homo sapiens
uagucuggggagcugaugaccauuaaucaaugacauaaau

SEQ ID NO: 185026 - RNA, 42 nt, Homo sapiens
aacgaccuaugaggggcuccagcacuugaacaaagaacagca

SEQ ID NO: 185027 - RNA, 57 nt, Homo sapiens
aaaaagaauaaguguuacuuucuauugacucuaacuaauagguguuacuuccuauua

SEQ ID NO: 185028 - RNA, 46 nt, Homo sapiens
uaagccucguggagcagcuggaagacaggauccucugccaugagaa

SEQ ID NO: 185029 - RNA, 35 nt, Homo sapiens
uacagagaaguauaagauuggauaagccuauuaaa

SEQ ID NO: 185030 - RNA, 18 nt, Homo sapiens
uagaggucugucuguaaa

SEQ ID NO: 185031 - RNA, 40 nt, Homo sapiens
uugugcugccgucgcugaguguggcuuaaauaaaaagcau

SEQ ID NO: 185032 - RNA, 45 nt, Homo sapiens
ggcuuuugaugcucgccuuaagaaguguaguggcaagggucgacc

SEQ ID NO: 185033 - RNA, 46 nt, Homo sapiens
ggagauguuuucuccaaauauugaagacuuuguuuacaucacagac

SEQ ID NO: 185034 - RNA, 362 nt, Homo sapiens
aagcacaacaguauuuuagguagguuucuuuauuuuuuauuuuuuugagacaggguuuuauucuguuguugcccacgcuggagugcagugacacaaucugggcucacuguagccucaauuuccuggguucaaucaauccuucuaccucagcuucccaaguagcugggacuauaggcauaugcuaccacgcccagcuaaguuuuugauuuuuuuauagagaugggguuuugccauguugcucaggcuggucucgaacuccuuagcucaagugaucugcccaccucggccucccaaaguguugggauuauaggcaugagccacugugcccauccgugguagauuuuuaauaaugagaguugaag

SEQ ID NO: 185035 - RNA, 49 nt, Homo sapiens
ccuacuguugcuaugguuauauacucccacuucauacauuaccaagagu

SEQ ID NO: 185036 - RNA, 54 nt, Homo sapiens
aauuuaagucacuggcagguaucugugcauucauagaacuuauaaaggucccag

SEQ ID NO: 185037 - RNA, 58 nt, Homo sapiens
aacagcucugaugaacacuaaauauuaauuucaauuagcuagauuguacauacuugca

SEQ ID NO: 185038 - RNA, 49 nt, Homo sapiens
caguauaaauuuucuugguguauccuuuuccuuucaacacagugcagau

SEQ ID NO: 185039 - RNA, 42 nt, Homo sapiens
gcacauauuaugggcuugugacccuaaacuugcaggcaaggu

SEQ ID NO: 185040 - RNA, 47 nt, Homo sapiens; identical to SEQ ID NO: 115419

SEQ ID NO: 185041 - RNA, 36 nt, Homo sapiens
auauggucaguauggugucaucacaaaaaaauaaag

SEQ ID NO: 185042 - RNA, 72 nt, Homo sapiens
cucuaugaaaguugaauguccaauaggaaguuaagccuguggucuggauuuccaaagauauuuggguuaaag

SEQ ID NO: 185043 - RNA, 43 nt, Homo sapiens
cugccucugggcagauagagguuuggagaggaaagaauaggag

SEQ ID NO: 185044 - RNA, 65 nt, Homo sapiens
gcacuagcuuuagaauuggauagauucgaguugaccucccagcucugacuaauuagcuuggugac

SEQ ID NO: 185045 - RNA, 44 nt, Homo sapiens
uuuuagaugucauuucgguuuugguaacauuucuugguauuaau

SEQ ID NO: 185046 - RNA, 44 nt, Homo sapiens
aaauuuugaugguaugucuucugggucugacagauuaaaaauaa

SEQ ID NO: 185047 - RNA, 49 nt, Homo sapiens
gaaagacagccuacagaauggggggaagaaaaauauugcaaauccuuua

SEQ ID NO: 185048 - RNA, 46 nt, Homo sapiens
gauuucuacuguuauacagcccuugaggcagaaugcagcagaaguu

SEQ ID NO: 185049 - RNA, 44 nt, Homo sapiens
cuuaacauuuaguaagaaaggcuuauggguuuuuguggugacua

SEQ ID NO: 185050 - RNA, 112 nt, Homo sapiens
ugucaguggauauuugcugcauugagcaacauugugcuugcguuuuauacaccuauguaaguguaucuuaaggaauaauuacugaaaguguuucagaggguauaugcauuga

SEQ ID NO: 185051 - RNA, 31 nt, Homo sapiens
cuccuucagaaaaugugaagggcuauucaag

SEQ ID NO: 185052 - RNA, 50 nt, Homo sapiens
ugcuuuaaacugguuuuaaaaaaaauaaugauuuaauaacauucacacga

SEQ ID NO: 185053 - RNA, 43 nt, Homo sapiens
aacaaaaagagaggauauuaaugcagaggaagaaacgagaagu

SEQ ID NO: 185054 - RNA, 31 nt, Homo sapiens
cuuaugcucuauaucuacuguauuucuaaaa

SEQ ID NO: 185055 - RNA, 79 nt, Homo sapiens
ccaaaaaaaaaauguauguauauguauauguggugaucguggguagggggaagaauucagagggaagaagcuuguggac

SEQ ID NO: 185056 - RNA, 29 nt, Homo sapiens
guguuuuggucuaaucuucaagaggaauu

SEQ ID NO: 185057 - RNA, 56 nt, Homo sapiens
gauucuugguaacagcuggcccagguuucuacagguacucaauuuauaucauuaca

SEQ ID NO: 185058 - RNA, 43 nt, Homo sapiens
cuugacuccggugaugucuaaguuccgccgcuucagcucggac

SEQ ID NO: 185059 - RNA, 46 nt, Homo sapiens
uucagcuucucccuccggaucgaugugcugcuguuaacccgugagg

SEQ ID NO: 185060 - RNA, 47 nt, Homo sapiens
cacauugagauugaauguauuuguuuuagcauaugagagaaaggaga

SEQ ID NO: 185061 - RNA, 34 nt, Homo sapiens
augcucuuccaagcaacccuaaaaacucugcuug

SEQ ID NO: 185062 - RNA, 332 nt, Homo sapiens
agcuacuacagaugcuccuugacucaucauaaguugaaaauaucguaagucgaaaauguauguaauguuggcaacagagaugaugguucaguguaugauuuuucaacuuugugauggugagaaagugauacacgugcaguagaaacuguaaccccauuuaaguuuuaaggagcucuccuccacuuaaugugggguuaugucacaacccaucauaagauugaaaaauacgaaucauaguaaguugguuaacauacauacaguccacuuguacuacugcaaguaaacaaugugagauguauacagugagaacauugcuguuuagucaccaggau

SEQ ID NO: 185063 - RNA, 44 nt, Homo sapiens
uaagugagaagaaaaguaaaaaauacugaguuuguuggaguaaa

SEQ ID NO: 185064 - RNA, 46 nt, Homo sapiens
gugcuuuagguagcuggauuauagaaguuuagugaauuuggagugg

SEQ ID NO: 185065 - RNA, 50 nt, Homo sapiens
agcuuggaacuagggaaucaggaagaucuauaacaaggagagauucccag

SEQ ID NO: 185066 - RNA, 37 nt, Homo sapiens
uugaaugugcauacagaucacucugggguagucuggg

SEQ ID NO: 185067 - RNA, 51 nt, Homo sapiens
uuacaauguggauucauuacaccaaaaacaccagcgugccaaaagagcagu

SEQ ID NO: 185068 - RNA, 45 nt, Homo sapiens
aggcaagcacaagacugggccuaaucuccauggucucuucaggca

SEQ ID NO: 185069 - RNA, 46 nt, Homo sapiens
auuuuauuuuuugaauaagaaauaugcucguauguuuuaaaauuua

SEQ ID NO: 185070 - RNA, 93 nt, Homo sapiens
uucagugaugaauuuaaaguagaaacaucaaauaaaguacuugauuaugauaccucucauauuuacacuggacauauuuaugguaaguuggac

SEQ ID NO: 185071 - RNA, 48 nt, Homo sapiens
uucauccagacucgugguggcacauuuuauguugagccagcagagaga

SEQ ID NO: 185072 - RNA, 20 nt, Homo sapiens
uuagggagauuuaggaagac

SEQ ID NO: 185073 - RNA, 43 nt, Homo sapiens
aguaacuauggaaaugagaaacugagguaggaaaaaaucauug

SEQ ID NO: 185074 - RNA, 50 nt, Homo sapiens
cccauaaauacgguccucaggggggcugugcagaucauucaguauuugaa

SEQ ID NO: 185075 - RNA, 46 nt, Homo sapiens
caacuucagcugaaaaaaauacuugucagcuuuauauucagacuga

SEQ ID NO: 185076 - RNA, 33 nt, Homo sapiens
uucccuuaggauuuugaaaaugugaaacuagag

SEQ ID NO: 185077 - RNA, 50 nt, Homo sapiens
gguagccuugagagauugaauguggaaagaaugaaaccaaaggagaagaa

SEQ ID NO: 185078 - RNA, 45 nt, Homo sapiens
ggguuggagcaccuucagguaguuuaucauauuaaauaugucuua

SEQ ID NO: 185079 - RNA, 49 nt, Homo sapiens
accacauuaauauuuuugucucuaaagcuugcucacaaaaugccuccug

SEQ ID NO: 185080 - RNA, 32 nt, Homo sapiens
caguuacagacuauuguacuuaaggauguaau

SEQ ID NO: 185081 - RNA, 46 nt, Homo sapiens
agaugguaagaagaaguccuuaaacacuggaauuauuacuguucag

SEQ ID NO: 185082 - RNA, 45 nt, Homo sapiens
agaguugcuaaaugcugcaucuagauucagaagaaaggcaagagg

SEQ ID NO: 185083 - RNA, 48 nt, Homo sapiens
cuagaccuccacugauuuuccuccuuuucuaagacagugaccccuaaa

SEQ ID NO: 185084 - RNA, 75 nt, Homo sapiens
gagaaucuaagaauuugggucaaaaagaaaauggcaauuacaucauguaugcaagagcaacaucuggggacaaac

SEQ ID NO: 185085 - RNA, 61 nt, Homo sapiens
uuaacaacaauaaauucucacucuguaguauuagaaauauaagccaaguucuugagaagaa

SEQ ID NO: 185086 - RNA, 46 nt, Homo sapiens
cagaaucuggccaaccuauuuguggaaauggaaugguagaacaagg

SEQ ID NO: 185087 - RNA, 52 nt, Homo sapiens
uauagugaccaguguaaagaugaaugcugcuucgaugcaaaucaaccagagg

SEQ ID NO: 185088 - RNA, 63 nt, Homo sapiens
guuacuuauugugaaaauguaacuaucuuccauauuuuaaaaaucuuaacuuuaaauauuuag

SEQ ID NO: 185089 - RNA, 62 nt, Homo sapiens
gcacagugugcauucaagucaaagucugagaagugucgggaugauucagacugugcaaggga

SEQ ID NO: 185090 - RNA, 55 nt, Homo sapiens
agaaauauggcuuagaggaguguacgugugccaguucugauggcaaagaugauaa

SEQ ID NO: 185091 - RNA, 27 nt, Homo sapiens
auguuagggaagugcccuuccaguuag

SEQ ID NO: 185092 - RNA, 46 nt, Homo sapiens
uuaggugagcccaagcaagguaggcauccacgccaaaguuggggag

SEQ ID NO: 185093 - RNA, 29 nt, Homo sapiens
gagaauugcaccccuguggaggagugacu

SEQ ID NO: 185094 - RNA, 52 nt, Homo sapiens
gaacaggauaaaucuggaacuucuuguugggccagaaaguaagaaagugcuc

SEQ ID NO: 185095 - RNA, 46 nt, Homo sapiens
augcaguguucauacuccaaguaguaauccaaaguugccuccuccu

SEQ ID NO: 185096 - RNA, 23 nt, Homo sapiens
uauguaacucagaauuguuuagc

SEQ ID NO: 185097 - RNA, 29 nt, Homo sapiens
guucaccugcauuuaccugucuggggcaa

SEQ ID NO: 185098 - RNA, 30 nt, Homo sapiens
ccgagagaguuaucaaaugggacacaugag

SEQ ID NO: 185099 - RNA, 46 nt, Homo sapiens
ucacaaguaacaguugaagaaaaaauggcaagagaucauauccuca

SEQ ID NO: 185100 - RNA, 46 nt, Homo sapiens
cuguacuucugugugcaauuguaaacagaaauugcaauauggaugu

SEQ ID NO: 185101 - RNA, 45 nt, Homo sapiens
uucugacauuuuuuuuccuaaaauuuuuaacagcauugaagguga

SEQ ID NO: 185102 - RNA, 50 nt, Homo sapiens
agcaaaaacauuuaauguauuaacaggcuuauugcuaugcaggaaauaga

SEQ ID NO: 185103 - RNA, 46 nt, Homo sapiens; identical to SEQ ID NO: 115526

SEQ ID NO: 185104 - RNA, 87 nt, Homo sapiens
cugugcaaagguuggaaguggguuugcauuucuaaaauggugacuuuuauucugcaagaguucuuaguaacuucuugagugugguag

SEQ ID NO: 185105 - RNA, 46 nt, Homo sapiens
uggaaauuuuuacuaaaaauugcaaaaaauaaaguauugugcaaag

SEQ ID NO: 185106 - RNA, 44 nt, Homo sapiens
auuucacugaaagacauguaauaaaugcuauuugauagguaaga

SEQ ID NO: 185107 - RNA, 42 nt, Homo sapiens
accaugugguuaaacacaauauucaaauauuaaacuuuucaa

SEQ ID NO: 185108 - RNA, 46 nt, Homo sapiens
ugccaaggauucuucuauggagagcagcugcgugggcauaugguga

SEQ ID NO: 185109 - RNA, 45 nt, Homo sapiens
auccucuguaaccugucaauaaacagguugucaaagcugcuggaa

SEQ ID NO: 185110 - RNA, 48 nt, Homo sapiens
uucuucacauucugcaauggcagcuuucaguuuggcaaaagagucaaa

SEQ ID NO: 185111 - RNA, 43 nt, Homo sapiens
gauucccuuuucuuuaacuauacaauaaauggaaagaaaaaau

SEQ ID NO: 185112 - RNA, 45 nt, Homo sapiens
ggcgcuucaacauuucccgcagcuccaccaaacuccgcugcgcca

SEQ ID NO: 185113 - RNA, 54 nt, Homo sapiens
gcaguaaucugauaaacacaguugggagcagucguuuagguauggcuuuggaag

SEQ ID NO: 185114 - RNA, 24 nt, Homo sapiens
ggggaucagaaucugccacuuacg

SEQ ID NO: 185115 - RNA, 48 nt, Homo sapiens
uuuuuuggggggguuaaaauaguauaaaagccucuacgucuaaccacu

SEQ ID NO: 185116 - RNA, 66 nt, Homo sapiens
ggauggagaggcaaggauggugugggaaauauuuugaaggaagucuauaggguuggggaauugacu

SEQ ID NO: 185117 - RNA, 50 nt, Homo sapiens
ucugcccaacugucaaccuugacaaauuguggacuuuggucagugaacag

SEQ ID NO: 185118 - RNA, 46 nt, Homo sapiens
uacaaaguucugggaaagggaaagcuccccaagcaggcugucaccg

SEQ ID NO: 185119 - RNA, 47 nt, Homo sapiens
gggggggccuguguccugguggcuugaagccgcauggagggaguuuc

SEQ ID NO: 185120 - RNA, 45 nt, Homo sapiens
acuguuuauggaaugugaagaagaggagcuggaaccauggcagaa

SEQ ID NO: 185121 - RNA, 46 nt, Homo sapiens
agauacugaugacauuuguuaaaauguccacucaaaaauguaugac

SEQ ID NO: 185122 - RNA, 44 nt, Homo sapiens
guagaaugcauucauucuucacaucuggaaccauucauuuggac

SEQ ID NO: 185123 - RNA, 50 nt, Homo sapiens
uuuucagguaacuuaaacaucucacaagaaugugaaugugauuauacaga

SEQ ID NO: 185124 - RNA, 39 nt, Homo sapiens
ggacaaagggaauaaugaguuugaacugaggaagaaaag

SEQ ID NO: 185125 - RNA, 45 nt, Homo sapiens
accucugcaaucaggagcuucaccuacaccuuccauuagugcaag

SEQ ID NO: 185126 - RNA, 53 nt, Homo sapiens
uugucacugaacauugacacccuacuuuuuaugugugcaagauucugugucag

SEQ ID NO: 185127 - RNA, 92 nt, Homo sapiens
agguguacauccugccuuguuugugauuggccaagaaacuggauaggacuaagcuucaguguuaaggcccucuuucugcagaaggguaggca

SEQ ID NO: 185128 - RNA, 66 nt, Homo sapiens
agcuuagcaaauuucugucuucuaccaaaguaauugaaugucuaaaauaaugacuauuucagcagg

SEQ ID NO: 185129 - RNA, 47 nt, Homo sapiens
agccaugagaguagcuuuuaggaugguugacguuucuauccuauuag

SEQ ID NO: 185130 - RNA, 19 nt, Homo sapiens
acaauagauaaaauauuua

SEQ ID NO: 185131 - RNA, 44 nt, Homo sapiens
aauuuaugaauuaaaaauccccaaaucaguaaaaccucaaucau

SEQ ID NO: 185132 - RNA, 50 nt, Homo sapiens
cuuucuugaugucaauuuauguugauauuacuuaaugauuguuugccucu

SEQ ID NO: 185133 - RNA, 65 nt, Homo sapiens
cuugauaugacaggcucacuuuguuaauuuuucaaaaagaaaaagucuacugaaacucuagucua

SEQ ID NO: 185134 - RNA, 46 nt, Homo sapiens
auuuugugauucacuagauaguuucuguuaacacuucagggccaga

SEQ ID NO: 185135 - RNA, 88 nt, Homo sapiens
agauguguauguauguuauauauuuacauauacuuuuucaggcauguguuuuuuuuuuaaauugggcuauuaaaaauuagaaaaauau

SEQ ID NO: 185136 - RNA, 387 nt, Homo sapiens
guuugaaugcuuaucugauuuuauguauggaaagacauucuaaacauaagaagcuauuuaaaucauaaaggagacugggcaugguggcucauaccuguaaucccagcccuuugggagccaaggcaagaggauugcuugagcccaggagaccagccugggcaacauggcaaaaccuugucucuaugaaauauaaaaaaaauagcugggcuugguggugugcaccuauauuccuagcuacuugggaggcugaggugggaggaucacuugagcccaggaggucaaagcugcagugagauauuugcaccacuguguuccugucugggugacagagcaagacccugucucaaaaaaaaaaaaaaaaaaaucauaaaaaaauauagauuuuuu

SEQ ID NO: 185137 - RNA, 46 nt, Homo sapiens
cgauuagcaucagauaauguaagcauugaucaguuuuugagaaaaa

SEQ ID NO: 185138 - RNA, 44 nt, Homo sapiens
uagcgagcaaggcaguauucauuuggaaccucugacuccauccg

SEQ ID NO: 185139 - RNA, 46 nt, Homo sapiens
gaugacauuccuggaggaaauaacccuagcacaacagaggcaacag

SEQ ID NO: 185140 - RNA, 34 nt, Homo sapiens
ugucaguguguaagcuguguagaaauucuuugau

SEQ ID NO: 185141 - RNA, 47 nt, Homo sapiens
aaaucugcccccgaauaauucuauuuuuccaaucacugcuugauuca

SEQ ID NO: 185142 - RNA, 48 nt, Homo sapiens
aaaauugaaguguuaaaaucagaaaacaagaagcuagaaaaacaaaaa

SEQ ID NO: 185143 - RNA, 46 nt, Homo sapiens
agugaccaccuguacauugaggggaagaacuuugccgucagaagaa

SEQ ID NO: 185144 - RNA, 52 nt, Homo sapiens
ccaguccugguggggaucguucugcccggcaccguuacccucagaucuuacc

SEQ ID NO: 185145 - RNA, 47 nt, Homo sapiens
ggagagcgaauggugagugcacugguguucgcugguuuggguaagau

SEQ ID NO: 185146 - RNA, 46 nt, Homo sapiens
cucacacccagcaacaguaacaccccucuuaaacauucugccucag

SEQ ID NO: 185147 - RNA, 41 nt, Homo sapiens
uuccacuucuuccauuguaauuggauuauucauucaacaga

SEQ ID NO: 185148 - RNA, 45 nt, Homo sapiens
gccauuuauuuucuggucuaucacaaaaguaaaagaaggauugaa

SEQ ID NO: 185149 - RNA, 48 nt, Homo sapiens
uagucgcugagucagugucugagcauauuagcacugaaguaugcuaaa

SEQ ID NO: 185150 - RNA, 60 nt, Homo sapiens
gaaauuaauggacuggauccaaaguaggcuccccaguuaagugcacuuacuugagauuug

SEQ ID NO: 185151 - RNA, 47 nt, Homo sapiens
augaaaucuaaauuuuuguauuuuaggaaaauucacgaauugugaga

SEQ ID NO: 185152 - RNA, 43 nt, Homo sapiens
ccuuuucauaggaguggaucuaaagggaagagacagaaaccag

SEQ ID NO: 185153 - RNA, 45 nt, Homo sapiens
gugacguuauaugacccaaugaauggaguucuuacaagugugcaa

SEQ ID NO: 185154 - RNA, 53 nt, Homo sapiens
agacacaaaaguuuagcauuuaccaaaccagucuguacaaaccuuacagccag

SEQ ID NO: 185155 - RNA, 45 nt, Homo sapiens
uacagauauuaaaauauauauuacuuaaaauauauuacuggaaag

SEQ ID NO: 185156 - RNA, 46 nt, Homo sapiens
uauucuauaaauugagcugaaaacuacccuuggccaaguuacuuac

SEQ ID NO: 185157 - RNA, 46 nt, Homo sapiens
uauuauaauccugccuuucuuuugggguauuagcuuguaacccuaa

SEQ ID NO: 185158 - RNA, 87 nt, Homo sapiens
guauaucuacuguguuagaugcucuucuaugagugggaaauacagcuuuucuugagaaacucgguuuaccagcaaaacaaagagcca

SEQ ID NO: 185159 - RNA, 100 nt, Homo sapiens
ccugugucauuauaaaugucauuccgucuuuauucugcugaggcacucacaacuaaauuuaaaauguaccauuuuccuagcaaauucucuuggaaaaugg

SEQ ID NO: 185160 - RNA, 27 nt, Homo sapiens
ucuaaaugucuucauagcaaugucuau

SEQ ID NO: 185161 - RNA, 116 nt, Homo sapiens
uguuucauuccggaauaugaaauucuauguaggacuugcauggauucuuuccagaugagggcugccaugucccuccaguucuucuacacuuaagguuaggauuaacacuccuguuu

SEQ ID NO: 185162 - RNA, 46 nt, Homo sapiens
uucagaccucagccagcaaugcaaauuguucagccucccuagaauu

SEQ ID NO: 185163 - RNA, 45 nt, Homo sapiens
auccagacuucuaucuggugucuucugguacuuacuuugagccca

SEQ ID NO: 185164 - RNA, 75 nt, Homo sapiens
guuaaaaucuaguuaggggacauggaacugaugcuuauagugaagcuuaccaaagagaagacauuuaucugacca

SEQ ID NO: 185165 - RNA, 46 nt, Homo sapiens
gacuuucagcccuuaacauguuuggaaaugagaacaaauggcacaa

SEQ ID NO: 185166 - RNA, 46 nt, Homo sapiens
uugugaaauuuuuucaagaaguacaaguacagauccuuuuguccag

SEQ ID NO: 185167 - RNA, 84 nt, Homo sapiens
gcaacagagauugcacaaaugaacugucuaauucuugcaagguaaguuuccuuuggucuugguaaauguuaauuuauaugagaa

SEQ ID NO: 185168 - RNA, 30 nt, Homo sapiens
cauaguuuuggggggaaaaaaccuuaaucu

SEQ ID NO: 185169 - RNA, 62 nt, Homo sapiens
ucaaauucugaucuauaauuuagaauuuuaaauuccauuuaggaaacuuuucuaaaaccaga

SEQ ID NO: 185170 - RNA, 85 nt, Homo sapiens
gaaauaccuuaaaauaguuuauuuugugguaauaauuauaguuuguuguggaugcuuuugagaagaguauuuuaaauguguuuuu

SEQ ID NO: 185171 - RNA, 39 nt, Homo sapiens
cauuucaauauuuucuuauuuuauuguucuuccuaaaau

SEQ ID NO: 185172 - RNA, 63 nt, Homo sapiens
acagugagaugggaagggaagauaaauuauaauuuuggggaccaccaacuuuggugaggcggu

SEQ ID NO: 185173 - RNA, 70 nt, Homo sapiens
cugguucaguauccucuguuccuuguguaaaauugggagaccauggucagaugaagacagauacuuagag

SEQ ID NO: 185174 - RNA, 43 nt, Homo sapiens
cuaagauugaagcgaacuguugggauagaacaagagcagcaga

SEQ ID NO: 185175 - RNA, 41 nt, Homo sapiens
uauuggauguucacugucacuaggacuugaagccucaacua

SEQ ID NO: 185176 - RNA, 59 nt, Homo sapiens
uuuuggaacauuguguaaacauucuuagauuauacuuaaacuauuaagugggguaguuu

SEQ ID NO: 185177 - RNA, 46 nt, Homo sapiens
cucauggauguguguuuuaauugugggguaaugucaauggaagauc

SEQ ID NO: 185178 - RNA, 113 nt, Homo sapiens
gaaugaggagugccuaagcucacagaagaaaacuaagauaguuuacgacaauggaaacauaaaacacuaagaaucaggacuaagaauauagcaaggagaaaaacagauucagg

SEQ ID NO: 185179 - RNA, 45 nt, Homo sapiens
aagaaaaugaaaguuuaaaguagacugcugacagagagauaaaaa

SEQ ID NO: 185180 - RNA, 74 nt, Homo sapiens
ugaaaaguacaugcuuuugguguuauagauauauuuugaaaacccacuauuuuauucuagacagaaaauccaag

SEQ ID NO: 185181 - RNA, 54 nt, Homo sapiens
cugagacuaaaaaugacuuauuuaccuaaaaccaguggcucagaagaugauaau

SEQ ID NO: 185182 - RNA, 50 nt, Homo sapiens
cacuuuuaaacauuuagauauuauucagucuguaacuuauccugauauaa

SEQ ID NO: 185183 - RNA, 47 nt, Homo sapiens
ccaaaugggugcccauuuucuaaguaaucugcguauuuugccacaga

SEQ ID NO: 185184 - RNA, 44 nt, Homo sapiens
uuuuuaaucauaauacaguuuuguuggaaucuuggcaaauuuau

SEQ ID NO: 185185 - RNA, 47 nt, Homo sapiens
uucuuuggcuguuuuaugacuugauaaaaugccuugccuugguccag

SEQ ID NO: 185186 - RNA, 52 nt, Homo sapiens
uauccuuggaaggaccuauuauguaaaccaugaaucuagaagaacacagugg

SEQ ID NO: 185187 - RNA, 42 nt, Homo sapiens
uuucuuuagcuacgguacaguaagaacuggucuucugacuag

SEQ ID NO: 185188 - RNA, 47 nt, Homo sapiens
ggcaacauucaacugcaagcacaacgugcauuuaccaccaggcggca

SEQ ID NO: 185189 - RNA, 81 nt, Homo sapiens
auuuuagaacugggaaauuauaagagaagaugaagccaccauguauagcaaccaggccuucccaucaccuccaccgucaag

SEQ ID NO: 185190 - RNA, 52 nt, Homo sapiens
auuuugaugucauuaaauaacaaaacuaagauauuucagauagugauaauag

SEQ ID NO: 185191 - RNA, 21 nt, Homo sapiens
cugugaaacauucaagagaag

SEQ ID NO: 185192 - RNA, 53 nt, Homo sapiens
gccaggguuucaucacucaggcgugcacuggcauucacaugcccggcagccag

SEQ ID NO: 185193 - RNA, 45 nt, Homo sapiens
uucaucuggauuaccaccagguugggaagaaaaacaagaugaaag

SEQ ID NO: 185194 - RNA, 54 nt, Homo sapiens
uaauauuauuuguauucaggagaaugcuuaugcgucuuuuuaauauuguuuugg

SEQ ID NO: 185195 - RNA, 40 nt, Homo sapiens
cuccaaagcacuuuugaauccauaucucauuuaauaucaa

SEQ ID NO: 185196 - RNA, 48 nt, Homo sapiens
cugaucguuauuccuuuugauauuauagccugacagugauagauuuua

SEQ ID NO: 185197 - RNA, 42 nt, Homo sapiens
ucagauauaaaaagaacacaaugggaagauccucgguuggag

SEQ ID NO: 185198 - RNA, 25 nt, Homo sapiens
cuuccgaagaaaguugaagaagcag

SEQ ID NO: 185199 - RNA, 35 nt, Homo sapiens
uucaguauauuuuauaauauagaaaaauggcauuu

SEQ ID NO: 185200 - RNA, 67 nt, Homo sapiens
ccgagcaacuguucuugaagacucuuaccggagaauuaugggugucaagagagcagacuuccugaag

SEQ ID NO: 185201 - RNA, 63 nt, Homo sapiens
gcucgacuguggauugaguuugauggugaaaagggauuggauuauggaggaguugccagagaa

SEQ ID NO: 185202 - RNA, 34 nt, Homo sapiens
cauauuaaaguuuuucaaaugaaguauuuaaaug

SEQ ID NO: 185203 - RNA, 53 nt, Homo sapiens
acagauaaauccaaacucuggauuguguaacgaagaucaccucucuuacuuca

SEQ ID NO: 185204 - RNA, 48 nt, Homo sapiens
ugaauauuacaauucccuaagauggauucuugaaaaugacccaacaga

SEQ ID NO: 185205 - RNA, 45 nt, Homo sapiens
acaugagcugaaaaaugguggaucagaaauaguugucaccaauaa

SEQ ID NO: 185206 - RNA, 48 nt, Homo sapiens
auacaauggcgauuuguaaaccgaauccagaagcaaauggcugcuuuu

SEQ ID NO: 185207 - RNA, 43 nt, Homo sapiens
aaauacaucuuuuuucuagggauucuuugaacuaauaccacag

SEQ ID NO: 185208 - RNA, 46 nt, Homo sapiens
augugaaugacuggagggaacauacaaaguauaaaaauggcuacag

SEQ ID NO: 185209 - RNA, 59 nt, Homo sapiens
gaauuaugggauaaacuucagauggcaauugaaaacacccagggcuuugauggaguuga

SEQ ID NO: 185210 - RNA, 71 nt, Homo sapiens
cagaucuugaagaaaaucauauaaaaagcauuugaagaaauaguacgacaacuuauuuuuaaucacuuuua

SEQ ID NO: 185211 - RNA, 99 nt, Homo sapiens
uagaguuaggugccugccuaaagccaggcaccaccacaccuggcuuuagaguucacacaauaggauauaaguccuguaugacuuaaauagugaauuuug

SEQ ID NO: 185212 - RNA, 48 nt, Homo sapiens
uagaccugccuuaugcaccuuacugccuagauuuuugggaaaaaacuu

SEQ ID NO: 185213 - RNA, 56 nt, Homo sapiens
cucuugccugcauauccuauugaccauugguauagucaucacuuuuucauauuuua

SEQ ID NO: 185214 - RNA, 44 nt, Homo sapiens
ugccuugaagaacuaaaugaaguguauagcacuugccuuuacua

SEQ ID NO: 185215 - RNA, 82 nt, Homo sapiens
uaugaagacaauguuuuuaauuacaaauccagaauucuguaggcaaaaugcuacaguucauaucuuccuuuaaccaaacuga

SEQ ID NO: 185216 - RNA, 42 nt, Homo sapiens
uaaaacaaucaaaaguaggcguaagcagaauaaggcaaaagg

SEQ ID NO: 185217 - RNA, 78 nt, Homo sapiens
aagugugccaagacuguauuuauauuucauacuuauauuguuucauccuuauauuggaaugauuauauagaaaaugcu

SEQ ID NO: 185218 - RNA, 54 nt, Homo sapiens
auauauguuacgaaucuucuuaaauauauauauauacacacccugugagaacug

SEQ ID NO: 185219 - RNA, 31 nt, Homo sapiens
gaagcaauucacagauuaauguacccugcgu

SEQ ID NO: 185220 - RNA, 57 nt, Homo sapiens
ugugcaaauugaccacacucccaaagaaucauuuaaaaguaaagugacuucuaagag

SEQ ID NO: 185221 - RNA, 45 nt, Homo sapiens
uucuagaaauuacaagcauauaacuuuagccuacaaucucuuauu

SEQ ID NO: 185222 - RNA, 42 nt, Homo sapiens
gacuuuuuaaaaucuucugacacaguaaauauauauaucaag

SEQ ID NO: 185223 - RNA, 27 nt, Homo sapiens
gcuccgaggcuugccucgcagccgcag

SEQ ID NO: 185224 - RNA, 60 nt, Homo sapiens
ccucaaagggugaaaaacagacacccccuggcagagaccucgaacggugcccacccccuc

SEQ ID NO: 185225 - RNA, 48 nt, Homo sapiens
aaaggcaacaaauauucaguuuauuuuccguagguuuaagaggagaag

SEQ ID NO: 185226 - RNA, 46 nt, Homo sapiens
gguggacaacaaaacaggaauagaggagaggaaauaugugugggga

SEQ ID NO: 185227 - RNA, 56 nt, Homo sapiens
gaauauagaggauuuggauuaagauuggagaaggagcauaauuuaugcagucacaa

SEQ ID NO: 185228 - RNA, 53 nt, Homo sapiens
aacacuaacauuugggagacaaggggggaaaaagacgcugaaaagcagaaugu

SEQ ID NO: 185229 - RNA, 57 nt, Homo sapiens
aaucacuucaucacuagagcaaauuuuuuauugucuuugcuugcugucuuaaaugag

SEQ ID NO: 185230 - RNA, 42 nt, Homo sapiens
aaauaucauaccucaugacugaugacaguccaaccacaagau

SEQ ID NO: 185231 - RNA, 42 nt, Homo sapiens
uuuagagcaagaggagcuucaagcauugcagauagagcaagg

SEQ ID NO: 185232 - RNA, 46 nt, Homo sapiens
agugcuuauggaagaaacugcuuauccagcuuuggaggaaaccagc

SEQ ID NO: 185233 - RNA, 46 nt, Homo sapiens
ucugauauuguuacccuugagccaccuaaguuagaagaaauuggaa

SEQ ID NO: 185234 - RNA, 54 nt, Homo sapiens
aauguggguuaggcuguuuuguuagaauauauaaugaagguaauguuaauguag

SEQ ID NO: 185235 - RNA, 46 nt, Homo sapiens
uacuagaagguuauuaauuuuacccucuaguaaauaugucagcaug

SEQ ID NO: 185236 - RNA, 51 nt, Homo sapiens
cuggauauuuggugaggaggaccuugacaauuggaauaacagugggaaugg

SEQ ID NO: 185237 - RNA, 46 nt, Homo sapiens
acauuuuuuuuugaaagagaagaaauaaaaugucaaaugcuuuaaa

SEQ ID NO: 185238 - RNA, 54 nt, Homo sapiens
aaccuugcuacagaaaaucaguauuuaagaguauccuuggagaaggaagaaaaa

SEQ ID NO: 185239 - RNA, 51 nt, Homo sapiens
ccucuuccaaaugcugcuuaaguuucugauuuucuuuaacuaauucaguac

SEQ ID NO: 185240 - RNA, 47 nt, Homo sapiens
ggagacucuguugacagaagcaaagaugcuaaagagagaacuggaga

SEQ ID NO: 185241 - RNA, 57 nt, Homo sapiens
ucccguaagauugcuauuuccuuuuuuucaguauauacauugggagaaucugacuug

SEQ ID NO: 185242 - RNA, 49 nt, Homo sapiens
ugguagucaguuacauggcaagucagauucucccaauguauauacugaa

SEQ ID NO: 185243 - RNA, 65 nt, Homo sapiens
aucuuucccacaaaucagaacgcugcuguucgaagguuagcuuccguuccagcucagugagucuu

SEQ ID NO: 185244 - RNA, 60 nt, Homo sapiens
gggaaagauuguauguugaggcaaaagaucaaaauggaaaacaaggaacagauggaaaaa

SEQ ID NO: 185245 - RNA, 46 nt, Homo sapiens
guagaauucuucauggcaucaaauguuuccuuaacugaacccaaaa

SEQ ID NO: 185246 - RNA, 46 nt, Homo sapiens
auucuaccaaggaguuuguaaggcaucauaaagagaaaauuaagca

SEQ ID NO: 185247 - RNA, 49 nt, Homo sapiens
acuuuaaagauaccaccaagaauaucuuugaugaaaaggguaauaaaag

SEQ ID NO: 185248 - RNA, 48 nt, Homo sapiens
augcaaaaugauggaaggaaagaaaagccaguucacuuuaaagaauuc

SEQ ID NO: 185249 - RNA, 45 nt, Homo sapiens
ggauucaccacuguguuaaaaaggcucauggacucuuguugagca

SEQ ID NO: 185250 - RNA, 43 nt, Homo sapiens
auuuagacagauaauucaaagguacauguuaaaagaacuggau

SEQ ID NO: 185251 - RNA, 46 nt, Homo sapiens
uuccuucauguuucuaagauaaucuuuaacaucauuaacaaaguca

SEQ ID NO: 185252 - RNA, 54 nt, Homo sapiens
gauguuaaagauuaucuuagaaacaugaaggaauaugaaguagauaaugaugga

SEQ ID NO: 185253 - RNA, 49 nt, Homo sapiens
gugugaccaaagaagugucuauauauauauucauccaacuucucaaaua

SEQ ID NO: 185254 - RNA, 54 nt, Homo sapiens
aauaauuucacuuaaggugaucuuuucauauaaacuauaaugaaaagaaacaaa

SEQ ID NO: 185255 - RNA, 70 nt, Homo sapiens
cuuuuauguauuuauucacuuuuggaagcuaggaaugagcaacacaaauuuuacucugaagucagaagag

SEQ ID NO: 185256 - RNA, 74 nt, Homo sapiens
aaaaaugaagcuaacauuugaagauuagguaaguuucauguuacagaauauaaagaugaaaauggauaaaaaau

SEQ ID NO: 185257 - RNA, 47 nt, Homo sapiens
aaaggcuucuugagugagguggccuuugaacugaacuuaguuuuuaa

SEQ ID NO: 185258 - RNA, 47 nt, Homo sapiens
agggaagggaauuucacuuaaaaggaaggucauuuggagaugugaag

SEQ ID NO: 185259 - RNA, 41 nt, Homo sapiens
aggagaggaaaggaaaaaacauuuggaaaauaguaacauug

SEQ ID NO: 185260 - RNA, 53 nt, Homo sapiens
uaaaagauauuaaauaucugaauuacaauccuaguauauccauauaaaaauaa

SEQ ID NO: 185261 - RNA, 46 nt, Homo sapiens
ugauaaaaagcaacguaugguaaauauugaaaacuccaggcaucga

SEQ ID NO: 185262 - RNA, 42 nt, Homo sapiens
uugugaaucaguauugaggaucaaaagguaauugccccaauu

SEQ ID NO: 185263 - RNA, 40 nt, Homo sapiens
auuaccuuuugauccucaauacugauucacaauugaguua

SEQ ID NO: 185264 - RNA, 38 nt, Homo sapiens
uuagcuucguugaauuuuuuuugacacuggaaauguuc

SEQ ID NO: 185265 - RNA, 65 nt, Homo sapiens
cugacuuguuuucuugugaaauuuuuugcacaucugaauaucguggaagaaacaauaaaacuaca

SEQ ID NO: 185266 - RNA, 42 nt, Homo sapiens
agcuuuuccuugagcuguauuuguugcagcaauguuuaggag

SEQ ID NO: 185267 - RNA, 48 nt, Homo sapiens
aacaguaugccaaagaucagaaggaauuaaaagaaaagaugcaguugg

SEQ ID NO: 185268 - RNA, 27 nt, Homo sapiens
cggguccggucccuccgggagggccga

SEQ ID NO: 185269 - RNA, 46 nt, Homo sapiens
ugucugauggagauuaugauuaccucaucaaguuuuuagcuuuggg

SEQ ID NO: 185270 - RNA, 49 nt, Homo sapiens
augguaaauuuaacuccaaauuuaucacaacagugggcauugauuucag

SEQ ID NO: 185271 - RNA, 79 nt, Homo sapiens
aucccuagguacacuggauccugagucugugcucauagcaugacacugggcauggaccuauaacaccuuauaaggcauu

SEQ ID NO: 185272 - RNA, 43 nt, Homo sapiens
cuggaggaaagaaagggcauggcuuuucaugaaaugguacaca

SEQ ID NO: 185273 - RNA, 31 nt, Homo sapiens
aaaacccagauauagugcuguguggaaacaa

SEQ ID NO: 185274 - RNA, 44 nt, Homo sapiens
guauauuuguauucuaucgauucucuaauuugaauuaucaagag

SEQ ID NO: 185275 - RNA, 46 nt, Homo sapiens
ccaaugggacaaacauaagccaagcaauugagaugcuucuggaccu

SEQ ID NO: 185276 - RNA, 94 nt, Homo sapiens
guggugcgaucaaauggucaugccucuacggaucaguuaagugaagaaaaggagaaaggggcauguggcuguugagaagucaaguaagcgacau

SEQ ID NO: 185277 - RNA, 64 nt, Homo sapiens
agcauccgguucuaaaauuaauuuguugcagcuuuguaaauauuucuuuaagauucagccugag

SEQ ID NO: 185278 - RNA, 46 nt, Homo sapiens
caugaauauaggacaaaucauggcuauaucuauagaccuuggauaa

SEQ ID NO: 185279 - RNA, 54 nt, Homo sapiens
accucauaaaauauuuugaucuguuuuccuaaacugaccauggaagaccugagu

SEQ ID NO: 185280 - RNA, 46 nt, Homo sapiens
gauaucccagaagaaacugaagaaacaaaaacuuauggcacgggag

SEQ ID NO: 185281 - RNA, 45 nt, Homo sapiens; identical to SEQ ID NO: 141509

SEQ ID NO: 185282 - RNA, 67 nt, Homo sapiens
aaaggagcaggagggcgacgucgcccgggacugccagcgccugguggccuugcugagcucgcggcuc

SEQ ID NO: 185283 - RNA, 49 nt, Homo sapiens
gcugcaggcucagggcggcugggugagcacgcggcggacaccgggacac

SEQ ID NO: 185284 - RNA, 38 nt, Homo sapiens
uauuuauucucccaccuucucugggugaucagacauug

SEQ ID NO: 185285 - RNA, 518 nt, Homo sapiens
aagggagaccacuaaauugacagaaucuuuguagcauuucaaaagggugucaggccucugagcccaagcuaagccaucguauccccagugaccugcacauauacauccagaugaccugaagcaacugaagauccacaaaaaaaaugaaaauagccuuaacugaugacauuccaucauugugauuuauuucugccccaaccuaacugaucaguguacuuuguaaucucccccacccuuaagaagguucuuuauaaucucccccauccuuaagaagauuccuuguaacucuccccacccuugagaauguacuuugugagauccacccccugcccccaaaccauugcucuuaacuccacugccuaucccaaaaccuguaagaacuaaugauaauccaccacccuuugcugacuccuuuuucagacucagcccgccugcacccaggugaaauaaacagccuuguuuuucacacaaagccuguuugguggucucuucacacggacacgugagacaaaggggag

SEQ ID NO: 185286 - RNA, 72 nt, Homo sapiens
ugauuggguuugggacaaauuuguguuauaauaguuuaaggugggugggcagaggagggggagaguuuugaa

SEQ ID NO: 185287 - RNA, 60 nt, Homo sapiens
uuucugcaacuuuugucuugguuauguaacauauuucaacagaucuaaaaaugucauuca

SEQ ID NO: 185288 - RNA, 45 nt, Homo sapiens
ucaagaaaauaaggguccaggguuauuuccuaucacacaccaagg

SEQ ID NO: 185289 - RNA, 61 nt, Homo sapiens
agaaaauuauaguuuaaaugacucuaugcaucuuguuuuuccucaagaggcacauaaucac

SEQ ID NO: 185290 - RNA, 42 nt, Homo sapiens
gacuggggaccuggggucugaaaacucccuuuaaucucagag

SEQ ID NO: 185291 - RNA, 33 nt, Homo sapiens
aaggccccuggacagcagcagccaggagauggc

SEQ ID NO: 185292 - RNA, 45 nt, Homo sapiens
gagauagcauaugcaaagaacagcuuccaccuguggggcugaggg

SEQ ID NO: 185293 - RNA, 52 nt, Homo sapiens
agaaagcuucagaggcugaugaaucugucuuucucauguugagagaggacgu

SEQ ID NO: 185294 - RNA, 45 nt, Homo sapiens
agcauugcuuucuuuaauuuuauuuccuucuuuaucccggcguau

SEQ ID NO: 185295 - RNA, 46 nt, Homo sapiens
auauuuuugaaaacuuguuucugcuuugcuaaugaagugguagaga

SEQ ID NO: 185296 - RNA, 41 nt, Homo sapiens
aagugaaguuaaaucuccucagcuagcugcuucaccuuuaa

SEQ ID NO: 185297 - RNA, 65 nt, Homo sapiens
gggaaagacacucacauucuuuagggagccucuaucuccagauugccugaucucccuugggugaa

SEQ ID NO: 185298 - RNA, 330 nt, Homo sapiens
aggcacucaaauacuccauaauaaaaugaucauggaaacuggcagucuuacuccaauugcccaggauggagugcaguggcaccaucucagcucauugcagccucaaauuucccaggcccaggugucccuccuacuucagccuccugcauagcugggacuacaggcaagcaccaccaugcccagcuaauuuuuuauauuuuugguagagacaagguuucaccguguugcccaggcuggucuugaauuccuaggcucaagcagucugccugcuucagccucccaaaauccugagauuacaggugugagccauugugccuggccuggcccucu

SEQ ID NO: 185299 - RNA, 59 nt, Homo sapiens
ugaaggaaaaaucauauuagccagucggaauauucaguuacauuaacaugacuugcuaa

SEQ ID NO: 185300 - RNA, 42 nt, Homo sapiens
cuuuuuugcuucucagugcauugauaagaaaaugauccaaaa

SEQ ID NO: 185301 - RNA, 48 nt, Homo sapiens
ugagaacugaucucuaucuugauacgagguuuuauuucagcuugagag

SEQ ID NO: 185302 - RNA, 41 nt, Homo sapiens
uguugccuuucaagacuagaauacaucuuugucucccagug

SEQ ID NO: 185303 - RNA, 37 nt, Homo sapiens
acuuaagcauuugccuuaaauguuucuuaagcccuag

SEQ ID NO: 185304 - RNA, 43 nt, Homo sapiens
caugcagcuucaucaagcucuuaucaccagaagcagccagucu

SEQ ID NO: 185305 - RNA, 15 nt, Homo sapiens
cccuguagucauuuc

SEQ ID NO: 185306 - RNA, 46 nt, Homo sapiens
ccagaucacgguccugcacgucuaccaccaugccucgaugcugaac

SEQ ID NO: 185307 - RNA, 42 nt, Homo sapiens
auaagauuucuaacauuucugggcucucugaccccugcgcua

SEQ ID NO: 185308 - RNA, 43 nt, Homo sapiens
agagaaacacacaugccuuaaaauuuaaaaagcagggcccaaa

SEQ ID NO: 185309 - RNA, 42 nt, Homo sapiens
acagaucuuauuuuuuuauuuugagugccacuauuaauguaa

SEQ ID NO: 185310 - RNA, 91 nt, Homo sapiens
cagcaaacaaaaagucaauuuugcuuuccaccagugcgagagaggauguauacuuuucaagagagaugauugccuauuuaccguuugacag

SEQ ID NO: 185311 - RNA, 46 nt, Homo sapiens
uguuuugacacagauuuccuuguaaaaugugccuaguuuaccaaaa

SEQ ID NO: 185312 - RNA, 36 nt, Homo sapiens
agcuacagcauaagagaaucgagaaauuugauagag

SEQ ID NO: 185313 - RNA, 47 nt, Homo sapiens
ucuguuugaaaaggagucauggcaucuguuuacauuuaccuuaucaa

SEQ ID NO: 185314 - RNA, 58 nt, Homo sapiens
acaagggaaagauaguguuuaaguggucaggauuauaggagagaagcuggagcaagga

SEQ ID NO: 185315 - RNA, 76 nt, Homo sapiens
auuaucugugggaugaaugcauaaagccuuuggugccaugccagacuacuuuuuaaauuauaacuauuuugcagag

SEQ ID NO: 185316 - RNA, 48 nt, Homo sapiens
ucaucgagacuuaaagccugagaaccuccucugcaugggaccagaacu

SEQ ID NO: 185317 - RNA, 45 nt, Homo sapiens
cugccaugaaaguaguagagcuugggucuggcugccaugauuccu

SEQ ID NO: 185318 - RNA, 47 nt, Homo sapiens
ccauagaaguuguacuucucagcaagauaguugaggauggcucuagu

SEQ ID NO: 185319 - RNA, 46 nt, Homo sapiens
cagaacucugccuugcugccaugagaacaagcucaggaugagagga

SEQ ID NO: 185320 - RNA, 36 nt, Homo sapiens
cauuugacccucagguggagagcuuuugaguacagg

SEQ ID NO: 185321 - RNA, 46 nt, Homo sapiens
gauggaagcaagggucuccuguuuuuccucaggggauuugaagggg

SEQ ID NO: 185322 - RNA, 47 nt, Homo sapiens
caucacgcaaccugcugccauuagagcagcacuaucuuccuggcaag

SEQ ID NO: 185323 - RNA, 36 nt, Homo sapiens
gcaaaccaggccuaaucacgccggccgaggcucagg

SEQ ID NO: 185324 - RNA, 66 nt, Homo sapiens
ggaguuggggaggagagaaagaucugcgauagugcuguaacccaggugaggcugacuugggcagug

SEQ ID NO: 185325 - RNA, 46 nt, Homo sapiens
cgacgucacggucagguggugcagagcuggacggcaacgacgucgg

SEQ ID NO: 185326 - RNA, 43 nt, Homo sapiens
cacuuuccucauaaaaauugucagcucucucugacacuuagac

SEQ ID NO: 185327 - RNA, 24 nt, Homo sapiens
uucauggccuguccuggccaagug

SEQ ID NO: 185328 - RNA, 46 nt, Homo sapiens
auuuaagggcaaaauggaauuuuucaacuuuauguguucgcagaau

SEQ ID NO: 185329 - RNA, 50 nt, Homo sapiens
aucuccuugcugaauguauucccauauuuuacuuccaguuuaugccacua

SEQ ID NO: 185330 - RNA, 46 nt, Homo sapiens
gugauuauaccucagguauuucugaguguccuauugucuaauagga

SEQ ID NO: 185331 - RNA, 23 nt, Homo sapiens
aggguugugaaugugaaaggggg

SEQ ID NO: 185332 - RNA, 50 nt, Homo sapiens
aacaaaucaguuugaaugcauucuauaguuucaaagaucugugcgugaga

SEQ ID NO: 185333 - RNA, 23 nt, Homo sapiens
aucaucaaaugaaugggcuaagg

SEQ ID NO: 185334 - RNA, 42 nt, Homo sapiens
caugaaaugaaauaaaaguaaaaguuuaucugcaucuguggu

SEQ ID NO: 185335 - RNA, 42 nt, Homo sapiens
ccauggucuuuaugaaaguagauuaauuaguguagugugugg

SEQ ID NO: 185336 - RNA, 46 nt, Homo sapiens
ugguggaaauagaaaacagaucccauaagaauuugggcuggguuac

SEQ ID NO: 185337 - RNA, 47 nt, Homo sapiens
gggucuguccugcacuguuugggaggcacaguggguuagaaugggug

SEQ ID NO: 185338 - RNA, 42 nt, Homo sapiens
uucauucaaacagacaaggccuuauacaagccaaagcaagaa

SEQ ID NO: 185339 - RNA, 44 nt, Homo sapiens
gcaaguuugguuuuaaguuucuuucauuucucacucuagggaag

SEQ ID NO: 185340 - RNA, 57 nt, Homo sapiens
cauagucucuuacaggagauggacacaaagcaaaugauuaucauauacuguguuagg

SEQ ID NO: 185341 - RNA, 46 nt, Homo sapiens
aaaggagacguaacgcuuacauuuuuaccuuuauccuuuuggggaa

SEQ ID NO: 185342 - RNA, 35 nt, Homo sapiens
uuuaaugaugaagagaugaaaaauguaauggauuc

SEQ ID NO: 185343 - RNA, 45 nt, Homo sapiens
agauuaguuguguuuuaaaugcuugggcaugggagugggaggugg

SEQ ID NO: 185344 - RNA, 94 nt, Homo sapiens
aggagugaggggaugggcagccuuguggugguagcugugggaguggagaggauggaagagagaagcauaggacuuugguguucauuggauuugg

SEQ ID NO: 185345 - RNA, 62 nt, Homo sapiens
ggugaagguaacucgugcugauggcaaccaacugacucuugaagaaagaagaaauaauguag

SEQ ID NO: 185346 - RNA, 88 nt, Homo sapiens
ucauaacagugacacagagaaacuauacugaguacuggagcggaucuaacaguggaaaucagaaaauggaagcuguucagaaaauaaa

SEQ ID NO: 185347 - RNA, 45 nt, Homo sapiens
uugguaguaaaaguagcauggcaguucauagucuguuuaagucuc

SEQ ID NO: 185348 - RNA, 42 nt, Homo sapiens
cuaggugggaucgccuuuugaguuggugguuaguggcaacaa

SEQ ID NO: 185349 - RNA, 49 nt, Homo sapiens
ucuuggacuccaaaagccuguguaauuguguauuauauugaagaugaug

SEQ ID NO: 185350 - RNA, 46 nt, Homo sapiens
uuuuagauaaagcuauauuggaguaaagugaaagcugaaccaucug

SEQ ID NO: 185351 - RNA, 42 nt, Homo sapiens
augaguuggaacuuuauaacacaggauauuauuuaggcaugu

SEQ ID NO: 185352 - RNA, 46 nt, Homo sapiens
acaaauuugauauucuaaugacuucaaaugaaauaaaugccacagg

SEQ ID NO: 185353 - RNA, 70 nt, Homo sapiens
ucugggagaaauuccuaucacagucacagcucuuucacccacugcuucugaugcugucacccagaugauu

SEQ ID NO: 185354 - RNA, 45 nt, Homo sapiens
caucuuauuagacuugacugacaauaggcuacagaguacccugaa

SEQ ID NO: 185355 - RNA, 61 nt, Homo sapiens
uuuacauuuuggauuaucugacuaaaaagaaacaacugacagauaauuugaaagaaaaagc

SEQ ID NO: 185356 - RNA, 43 nt, Homo sapiens
uuaaaggacaucagaaauccaacggugaauuuugggauccagg

SEQ ID NO: 185357 - RNA, 67 nt, Homo sapiens
gaugugcaagagucuauccauuuuuuggagucugaauucaguagaggaauuucagacaauuauacuc

SEQ ID NO: 185358 - RNA, 67 nt, Homo sapiens
uagcccuuauaacuuaugcauugucaucaguggggaguccuaaagcgaaggaagcuuugaauaugcu

SEQ ID NO: 185359 - RNA, 31 nt, Homo sapiens
gccuggucagauaaguaacgugcauuaucuu

SEQ ID NO: 185360 - RNA, 44 nt, Homo sapiens
ucugagggaaucccaauuaugagguggcuaagcaggcaaagaaa

SEQ ID NO: 185361 - RNA, 44 nt, Homo sapiens
aaggacaaauauccaagugaccgugacggggccuagcucaccaa

SEQ ID NO: 185362 - RNA, 47 nt, Homo sapiens
agacagcagaggugugggcaaggggcaguuauuuaaaaaucagugua

SEQ ID NO: 185363 - RNA, 44 nt, Homo sapiens
guuaauauuuccgcaaaugguuuuggauuugcuauuugucaggu

SEQ ID NO: 185364 - RNA, 43 nt, Homo sapiens
guuguauauaaugugaaggcuucugggucuucuagaagacgaa

SEQ ID NO: 185365 - RNA, 47 nt, Homo sapiens
ggcuuuauggugccuucagaagcaauuucucugagcgagacagugaa

SEQ ID NO: 185366 - RNA, 42 nt, Homo sapiens
cuauuuagauucuguaaguaguaaaacauaagguaacuguug

SEQ ID NO: 185367 - RNA, 55 nt, Homo sapiens
acaacucugaagugaagcuguccuccugugaccuuugcagugauguccagggcug

SEQ ID NO: 185368 - RNA, 43 nt, Homo sapiens
cugcauagauuucuucaccugaucuuuguguggaagaucagaa

SEQ ID NO: 185369 - RNA, 49 nt, Homo sapiens
cuggguuuguggagaaucagagcaucuugacaugacugcugaccuaaag

SEQ ID NO: 185370 - RNA, 59 nt, Homo sapiens
aacuuuuaagauccccgaauccugagcaccucaaucuuuaauugcccuguauuccgaag

SEQ ID NO: 185371 - RNA, 47 nt, Homo sapiens
aaacuugcaaaguacauaaguauuuuuuaaaaaucaaucgaacagaa

SEQ ID NO: 185372 - RNA, 68 nt, Homo sapiens
uucauuugguggaaauucuuauuacuuacaugaaugaguuugaauuuaguggcaaggaagaaaaaaaa

SEQ ID NO: 185373 - RNA, 11477 nt, Homo sapiens
aaucuagguaaguuuuuuaguauuuacuaaaauuuuguauauuaaucugaguacuuacagcuguauuacauuuaacuucacagucucaaaugugcaugaacauuagaauuauguuguaaauguuuuaaaaccacuacaguuuccuuuagacugcauccugguggugaucccuccaaaggcaguggaagcucagaaguuguauauucacacuuaggucagucucacagucauuguaauuucaguguauacuaauuguugaucugaugguagguaaucauucccucauuaucaccaucccacaugcugagacagugguccguucuguuaggaagagaguguucucuuuuucuuucuauaaugaagcaugcggggagauuuuaccucuuccauggaaucuuccucccuaguacauccauauacugggaaggguguaggugugauaacuucugugauuaccuugaguuuaagaaagaauagaaacacaauuuuuuuuaugcaaaauuuuuuuuuacugcauucuacuuacuacucgauguuagaaauuaaauguugacuauaacauggucccuccaguccagaaucuaaaggaaauugccauuuuacuccuuuuuaaaauaaaggggguauaaugauaauauucagguagauauacauguauucuuucgugagauauauaaucuguguucagaaagacaucaugacuagaacauaaagguuuucaagauaaggauuauuauacuacauaaaaggacauaacguacauggucuugagcccuuggccuuccgggugggucuaguuuugugacugauuucugacaccuacucucuuuuuaauuuuaauuuaccagaaauuuugccauuugggacuaagcccuggagguaguaguaagucuuuugcaaacuucucuuaagaauuccuuaggaccagaugaaagcagcuguacaaugcaaucauaauaaaauaaauaucccaaacuguaagucuucuuuaaaaguaguuaccuugggaaauuuuucccaaggaaaaauggaaagauauuaccuacuggguauuugcuuacuguggguuagguacuguguuggucccuuauaaauaccuuguggaaucucaaagcagcccuauauugaaauggcacuauguuauaguugaagagacuuagagucuuggguuaaauaacuagcagaacaguccuguagcuuacauguggcaaagacaggcuugaagcccagagccaauuucuugauuacccucaguuaauuuguaaguuagcauuaacaugacccuguguuuauauaauuaaauuuuuugacccccauuacugaguuaugguaagguuuuauguauuuccagagcaugugacuuucauagaaacagcuuuuuuuuuaacauuuguuuuauugguuuaugaauauuuuauuaaguuauauaauacaauaauuguaacuaccugaagcacauaaaguuggcuccugauaaguauacuguuugauaagaguagauguacuauagugugacuuaugaucugucaugggcaucagaaguaauggagcauguugguuaacaggaagucaauuaggagagcuaauuccauuauggagucucaaaacaauuuugaaaauuguaauaauggagaaacacaguccuuaaaaauaguuauuuggaagguuaguacuuuauaaaguauuaacuuacacaucuuuugcauguauaaguuaaagaauguaaaaaaaaaagucucagaaucagcuuucuuuuaaauguuacuguguucugggcaucuaaucuguguuuuucauuuuuuaugccauguacucauuuuugacuccauauuccuccuaccuaaucucauggcuuuuccuacucuuuggauucccaaucuguaucucugguccaaacaucucucuugugcuccaagccaguauguccaacuuggguguaccacagauacuucaaaauccuugugucucaagaccagccugggcaacaugcccugagaccccaucucaaaaaaaagccaaaacaaaacagaaaaugauuccaugccucccaauaucuuuucuauuaaucaucuacucagguuacccugaagaaaaauacugggagccuuucguuaccccuuuuauuaggucacucaggcuaccauaacaauaccacagauuggguggcuuaaauaacaaguuuauuuucucacaguucugaugacuggaauuccaggugcucaccagguuggugucuagugagggcucuuccuuugauuugcagggguuacccucuugcuguguauucacauagccuuucuuugguugugcauagagggagaaggagugaaugagagcaugagugagcucuuuggugugucucuucuuauaaggacacuaauccuauuggaugaggaccccacccuuacgaccucauuuaccuuaauuacuuccuuagaaguccuacuuucaaauacagccacacuggggauuagggcuucaacaugugaauuuggaggcagggggacacaaacagucaauaggaccucucuuuuuccucgcuguuugucucuagucagucuaaaaguuguaucuccuaaagcuacuuaaucgcucuugaauauccuucuauuccaggguuucucgauugugguuuugacauuugggcuggaucauucuucagugggaguggugagggaagugggggucugaccuguauaguguaggaugguuaacagccuuccuggccucuaagacuccaguaguaccucccaguuuugacaaccaaaaugucuuuagauauugaaaaauguugcccuccggggguggaggguguuggcagagucauccccaguugagaaccauugcuccaauuucaugguuucuugccuggauuagcauuaggauuacuguaguaauuuccuuaaggacgccccugccuucaaguugucuucggcccuuuucauuucuccacauaaucaucagugaccuuccuaacaugcaaaucuguuccuguaagacucccugcaugaaauucuagcuuucuggaaaaccuaaacucuucaggauuauguuuuuuaccuucaggauuauuuuuuaccaccccuucucugaccucaagugccaguccuuugacuuagcccuuucuuucucuucuguuuucccuugguuaguccuuauguguucuuaaacacuuagcucaggugauccuuucggguuggguuaaguauucuguauuucuuauguucuaagagacucugcuguaacauauacuucaguuugguauuagcacccauaugcuuuuguuuccacugcuagucucuaagcuccauaagggcaaagaucuaaugcuuccuagucaccugguacaaagccuggcaaacaauggguauuaaugacuguuacauguauguaugaauguauuguuucaaaauuugaaaaagggaacauacuaagaugucucgaagagaugaugaagugccaucuauauugguaaauucauaacauucuuaugguuuuggcuuuaauuauauagaccuggaggcuuaauuuacccuguaaacugagagaucaaccucuuggggaugauuuuacccuaacccugcuuagguagacuagaacaucaauauauucauauauaaugggaaauguaauggccagccauucuggaacaaaugacauuggagguaaaauuauauaugaaaauguugcccaaacugcaugaaaucagauuugguggggaucauuaauuuacaaaugcuuuaauuaaggaggauuugauggacucuuuaacacuacccaguuuaaggaaagcuaguaagccuuuuaagggaacuauuaugcauauguccuuuggguaaggcuaugauuuuggcaaagaacaaaagaaugccugugaauucccuuuuucaguuuuucauccugaccagcacuccuuaaacacauuuauuuauaauuucuucuaaaaagaaaguguguguguauguauccacugauaaauuugggagucagguaguggagggcaggcauuuagcuacaucuggaagaauuaauaaaaugaaucuaacuacaucugaagaauuaaaauguaacuacaucugguaaaaguaccaaaggagaucuuuguaaaguguacugaaagauaggucuuaucagauuuuagagcauuaugaagcuacagaauuuuuuuuucuuuuuuuuuuuuagauggagucucacucugucacccaggcuggagugcagugguaccaucucggcucacugcaaccucugucuccuggguucaagcgauucuuaugccucagccucucaaguagcugggguuacaggcgugcgccaccacaccuggcuguuuuuuguauuuuaaguggagaugggguuucaccauguuggccaggcuggucuugaacugccgaccucaggugauccaccugccucagccucccaaagugcugggauuacaagcgugagccacugugccuggccuagaauuuuuuaaaacgagauucccuuuaaaagauagaugacugaacacauacagcccuuuccucauuauaguaguaguaaaaauauaaaaagauauaaaacacauggacaaagaauggcaggcauguuacugggggacaaaauaaugugccaguuuuuagaaguugggguagauagguaaguuuugcgaagaaaaacacaugugagagccaccuuacccgaauaacucuggaaaacgaggugcuguauggaaaaaccuaacuugaaaaucuguauauauugaacaguugacuccucuauaaucaagaugccuaccuuauaugcccauuuccacuccaugcucaggugagagaccauaaguuuaauucucuagaaaaaguaaauaggaaaggagcaggauuuaggaaagcguguccucauauagaaugggggcgaaauguagggcagaaaagaaggggauuaauuaaaaacuuuggaaaaugcucaagcagugaacgucagcccaagccaucuccaaccccuacccugccuauaaaacguaccaagguuuggccgggcaugguggcucacaccuguaaucccagcacuuugggaggugaggcaggcggaucacgaggucaagaaauugagaccauccuggccaacauggugaaaccccgucucuacuaaaaauacaaaaauuagcugagugugguggcgcacaccuguagucacagcuacucgggaggcugaggcaggagaauugcuugaacuugggaggcagagguugcagugaucugagauugugccacuucacuccagccuggcgacagagcgagacucccucuggaaaaaaaaaaagaaaaaaaaacuuaccaagguuugaauuccagauguuuugcacagaugcaagucacauuucuuggagugggcaugucaauaucacuauaugagcuuauuuuaaaauuaauaacuguuucuuguaucuuuuucugucucuuaaaucuuuaugccuaacuuuuuagauuuuucagccuuuuuguggcaaucuuuauguuuuaggugugucucuuacaaacagccuacaguacauuuuuacuauccagucaaacaaucuuucucucuuaaccagaacuuuuagagccuuacagguguaaaugguuuaaauccgccugucacagauuuggcaagugguuuggcaacccccuuuaagcuaguuccuguucuuucgacauaucccugucacuguuugguaccuccuuugugaaacaaccagauauuccaagcccaucuuguacuuugucugaccagccauuauuuccaaggauuccuaguuccuuuuaauggggaaugguuuguagaaauggaaaaucuaguuccuaccaccgaagugguauuuugucuaggccuuuuuggcaaacaggguaggaaauauauguauauguccgucuguaaaaaucauguauaugcguguauguaaaaaucaucaaaggagggccuuaagaaaaacuaaacacacacacauacauacacacaaacauacagacaaaaucguaaguucauacugauaacuuuaguuccaaugcaacacucaguauaaaauacuaagguggcagguagcuuucaacacuuagaauauaucacacccaguggccucuaguuuccgucuuugcuguugagaauucagcuuuuuaaaauguugcuccucugaagguauucuguuuuuuuaagauuuuuaccuuguaguuuuaucaggucuaauauuacaucuagguguggaguucucuuuuuaauacugugcacaguuuguuaggcuucuuaagucuaugaauugaccuuaucaguugugaaaaauucucagcuuugcggggggauccccucucaccaaucauagguuuagcauuaaaauauguaacaauagccauuauuucuucacauacuuccucugccucauucuuuuucucuguuucuucuggaaaugcaaucaaauauauuuuagaacuucucaugguagcuuucauauaucucaaccacuucucuugcuaucuuucucgccaugcugcacucuggauaguuucuucugaccgauagucuuuuauuugaaaauacugagcauauuauuucugauaauucugacaucucaagucuuugcaggucauuuucugcuuucucuugcuuuucuugguucuuguucaugauuccuuguuucucugugcuguugacuuugaguguuuauuggggauuguucaugagaaaucgcacuuuggauuucuuaaggccuggguugaaguguuuuuccccaaaggaauuugcauuugccacuuuuaaagcaucagaucuugcaagaacucaguauccugagaacagcauggggggagccaccccuaugauccagucaccucccaccaggucccucccuccaugugggauuauaauuugagaugagauuuggguggaggcacaaaggcaaaccauaucagcaguaaacuauauuuuuagauuaaaaaaauucuuuaaagggggaacaaagagaaaacuacccagcaaugaaauaggcuguacaacauaaauaugcaaguuauuuuaauaauaaaaaaacuggaugacguagcucaugccuguaauccugacaacuccugaggucaagccaggcagaucacuugaggccaggauuucuagaccagccugggcaacacagcaagacccuucaucucuaaaaaaaaaguuuaaaaauuagccagguguaguggccugugccuguagucccagcuacuugggaccugaggugggaggaucacuggagcccagaaauucaaggcugcagugaacuaugccuaugccauuguacuucaaccugggugacagagcaaaacuccaacacucaguaaaaaaaugaaaaaaagaauaaauguaaacaaccuauauacagaaaaaaauguucauucucacuguuaaguaaauaaacauaaaugugcuaccauuuuucaccuaucauauucacuaaguuuuuaaauuugcuuacuuaaagcuuagguaaguacagugagaugggauaugcucuuguucuguuaguggggauguaaaaugauaugacuuucuucuagaaaaacaguaacauguuauaaaauagugugugggaaaaccuuaaauauucauacauuuagucagggguuggcaaacuacagcccaauuuggccuguagccuauuuuuguauggcccuaccacuacaaguauuucuuacauucuuaaaggguaauggggaaaaacacaaauaagaauauaugcuagacacuguaagugggacacaaagccucaacuauuugccaucuguccuguuacauaauuaauccacuauuaccuauguuuauuagauuaauuauacuucuagaagucugucagaggcaaauaaucagauaugggcggacuaaagacugaugaaauggacagacauacucagcaagaacuuagagugaacuuauauuucuaacaguaauggaguggacagucauaagacauucauacaguaaaacuauuuucuagaaauaaugaaauagagaaauguuccuaaugaaguauaagauguaaaacuguauauggaauauacuguacaucaaggaaagacugcaaggagauaaauauucaagugcuuacucugaauguuagacuuauaggugauuuuuuaauuuuuuaaugcuuuuucauguuaucucagcuuccuaguuuugaucuuauaaucaaagaaaaaaacauaucuuugcuccuucuguuauggccacuaaaagaauaugaagaaagcugcgugugguguugcaugccuguagucccagcuauuugggagacugaggcaagaggauugcuugagcccaggaauucuaauccagcuuggguaauauaacaagacacugucucuaaaaaaaaaguuaaauaauuaaaaauuaaaaaagaaaaaaagaacgaagagacaugagaguugagaaaauaaagaacccuuugaggaaugugucucuguuauucaucuucauauauauccagugccagacauuagcuaggugcuugguaaacauuuguuuaaagaaugggcaacuaggucgugaauaugaaaaacugcucagccucaaagagaugcaaauucaaauuauauauaauuuuccccauaucaaauuagcaaauauuuuguuuaauaaaaauucuuguuguguuuuuuuuuuaaguuggauuuuuuuggagauauaauugacauauaauaaaauucacccuuuuuacaaauguacaguuugaugcauuuugaaaacuggauaauuguguaaccauggccacuaucaagacagggaaucuucccauuuccaucaccccaaaauguccccuuguacuccauucucuccucuuacuccuaauaccaugcugucacuacuuuggauucuguuacuauaguuuucccuuuucuagaaugucauauaaauagaaucauacaguaugcugcuuuuugucucuggcuuucuuagcauaacacuuuugagauucaucauuuuguugcauguacuguugugguggucuuuuuuuauuguugacuaguuuuccauuugauauauuacauuuuguuuauccauucacugguugguggacguuuggguuauucccaaauuauuaugauuaagaauaaaguugcauuaaauaugaguauaaaucuuuguguggcugcaaauuuccauuuauccugcguaaauacguaccuaacagaauugcugggucacauauggugaguguaucuauaacuuagaaacuggcaagguguuuuccaaagugacuguacuauugcauucccacaauuuaauauaagaugcugaaauaaguacuuauugcaauugugagugaaaacuuauaacucuuugggaaagcauuuuuggcauucugaaucaggucaguaaaaauguuuauucucuggccuucaagaaacaucuuuguaagggauaaucuaaaauaugcacaaggauauuugucaaaguaccauuguauuagaagacuaaaaauauacacuccagcuguugucuuugguaaaauuuauaaauucagcacuaaguuaggcauugugguggguucaaaagcaacuuaagauguguuccuugacuuacauaacuuguaaucuagugagaaaacugugcuaauugccugaaaaauuuucacugagcaaugcaacacagcauuaaaugaguguuaaaauaugccacauuaagaagaaugagcaguagggaugaagacuuggauggauuucagcaagguuuugaagcacggcuaaagcuugaguuggaggguuggagcuuucuagguggaacacaccaugacuagagguaaaaauggucuaaguauguaaaaaucauuggaauauauguauguauguagagauaauaaaacuauguuauuggaggcucuuaauggaacaggaacagcauaaucuuuaaaagcuggaaagacucugcugugaggcucugcauucuuauaaaagcuuuggguagucuaggaaacagcagugcucaggaaaugguagaaaacaaucauuuuuacugguacuaauauaacaaauuucagcuugauagaguaguuugauaaggaaccauuguuaucuuuuguaaguagcacuaacauauacauuauauucauggucauuuuuucuagucguuuauguaggauacagaaaggagagagaaagaaaaacuuuuuuacccugugauccacagaauguuaagccucuugguagcagaaccuuugucuuguuauuaaauacuucugucuuccaugauuagcacauuguauggggaguaggaguagagagcugguugcaggauuuauaauuaacccaaugaaagguaaagagaagauugucuagauuagccugagguauauauaacuguguuaagugauaaugguuccuggaugagguugauggauugggcaaaaugauagauugaaagauuugaaaaucaugcuuuaaaucauaugugcauuucuugaauguauagaaugagcaaauaguaaagggaggaugucauauaaacaguguaauaccugccauuuacuuagugccuuguuuaugacagguguaauacauauuaucucacauuaaagucauacuacagggcacacacgguggcucacgccuguaaucgcaacacuuugggaggccaaggcugguggaucacuugaggucaggaguucaagaccagccuggccaacauggugaaacgcugucucuacuaaaaauauaaaaauuagccuggcguggcgacagguuccuguaaucucagcuauucaggaggcugaggcaggaaaaucacuugaaccugggagguggagguugcaguaagcccagaucaugccacugcaccccacccuuccugggcaacagagugagauugucucaaaaaaaaaaaaagucauauuguagaugaaguggaguuauugaauugcccacagacacacaauuauuagauguuagagcugggauaugaacagugcacuuaaaaaaauaaaagccagcucuaauguuacuucuuccuuucaggaaaccuuccauauaacuccuguccaccuuuuacuaccuagguuaacuugaggcuccuccuuuguuuucauaugauauacaguugguaacugcaguuuugcauuugcuuauggaauuauaauugcagaauacauuuggaauuugaggacuuagcauucucugauucaucuacuccuucaguaacuugcaaguuaaaggugaaggcccauggugugaaucacagugcaaggcagguaugccagagggacucacuccucaugaguguaggcccaacucuugagauacuaggccaaauuuucagaggucugggcauuuucagcaaaugcccagacuuuuuauguuugucucauccaguaccuaacuuacucaacuuggaauucaguguaacacagcuaugaguguauguuuauauucaaguaauucauaguaucuuuaaaccauagguccucugcuguaccacuuugaaaaucuggcaaa

SEQ ID NO: 185374 - RNA, 46 nt, Homo sapiens
uauaaacuuuauccuuggauccaucaguuuagcaauaaccggagau

SEQ ID NO: 185375 - RNA, 48 nt, Homo sapiens
acauggauaaguuaaaauccacgcugaaacaguuugugagagacugga

SEQ ID NO: 185376 - RNA, 45 nt, Homo sapiens
ccaacagaaacuacuuccucaguuucuucuucacuuggacaagau

SEQ ID NO: 185377 - RNA, 46 nt, Homo sapiens; identical to SEQ ID NO: 116024

SEQ ID NO: 185378 - RNA, 50 nt, Homo sapiens
agaaugcucguauacaucucuuuaacaaccacaaaccuuaagccauguag

SEQ ID NO: 185379 - RNA, 48 nt, Homo sapiens
uuugcuauacuuauuuucaauucaauuacaccacgauucaaauaauuc

SEQ ID NO: 185380 - RNA, 72 nt, Homo sapiens
gggcagugaaccagagaucacgcgccgcgccgcgaggcuugggggagguguugaaauucucauuuacagguc

SEQ ID NO: 185381 - RNA, 54 nt, Homo sapiens
gcugugugugugugugugugccuuccaaaucaugccauaauuguaauguugaau

SEQ ID NO: 185382 - RNA, 42 nt, Homo sapiens
uguaacuuaucuauuuauaguuaugagauuaagacuggagug

SEQ ID NO: 185383 - RNA, 46 nt, Homo sapiens
ugacccuucccaaguauuugugcaaugauuguguuuacugcuggau

SEQ ID NO: 185384 - RNA, 48 nt, Homo sapiens
uguuacuuuuuuguccguguccucucauuuggguuuuguaacugcaau

SEQ ID NO: 185385 - RNA, 43 nt, Homo sapiens
gaggagucuaugccauuuuaagaaaaacaauuaaccugguuaa

SEQ ID NO: 185386 - RNA, 46 nt, Homo sapiens
auguagaaaaacauuauuuuaaaaaaguuccaacacacagccauga

SEQ ID NO: 185387 - RNA, 46 nt, Homo sapiens
acgugcuuauuaggaaaugagucuguauggaaaucucaccacagau

SEQ ID NO: 185388 - RNA, 87 nt, Homo sapiens
cagauuccaaaugauuaccaguccagucgcaaccagccaggcccgccggguccaccgggaccuccugguagcgcaggagccagagga

SEQ ID NO: 185389 - RNA, 46 nt, Homo sapiens
augaugcgagcaguugcaagacaagucugugaacaauugauaagug

SEQ ID NO: 185390 - RNA, 46 nt, Homo sapiens
aagggaugaaaggugaugcuggagagccaggacuuccaggccgaac

SEQ ID NO: 185391 - RNA, 69 nt, Homo sapiens
cagaguuuugacauugucugcaguccaguguggaccaguagagacagaugcugugauauucccucuagg

SEQ ID NO: 185392 - RNA, 46 nt, Homo sapiens
aacaacugaugguuaugaaauucuuggaaaacuccuuaaaggggaa

SEQ ID NO: 185393 - RNA, 47 nt, Homo sapiens
guguuaagauuuacauugacugcuaugaaauuauagaaaaagacauc

SEQ ID NO: 185394 - RNA, 47 nt, Homo sapiens
aaggauacaagaggcgaggugcaaacuguuacauuugacacagaaga

SEQ ID NO: 185395 - RNA, 49 nt, Homo sapiens
aaacucccagugacccuuuugcaauuuggcaaaucacagacagagacua

SEQ ID NO: 185396 - RNA, 45 nt, Homo sapiens
agcauacaggauucagaagaaugcguuugugaaucagccuacagc

SEQ ID NO: 185397 - RNA, 79 nt, Homo sapiens
ugccaacauugccagcaaaccaagugaacggcacguguucauuguggacgacuuugaaucuuuugagaagaucgaagac

SEQ ID NO: 185398 - RNA, 39 nt, Homo sapiens
uaucaaggagaaagucuugacuugggagagcggcaugag

SEQ ID NO: 185399 - RNA, 64 nt, Homo sapiens
cguacaaugacaaggcccuagcccuuggggcccuccagaauauuagguacagaggaggaaacac

SEQ ID NO: 185400 - RNA, 43 nt, Homo sapiens
aacaaaguuguaaaauucaucuucaauacugugggaggcuuug

SEQ ID NO: 185401 - RNA, 46 nt, Homo sapiens
guggaucagaaaccagucacugcuucacuggccuuucaccagacac

SEQ ID NO: 185402 - RNA, 48 nt, Homo sapiens
ucaccgggcagccaccuccuacaggcuaaaacuaagcccugcagaugg

SEQ ID NO: 185403 - RNA, 49 nt, Homo sapiens
uuaugcucaauaugauucuggacucaguguccccuugacagaucaaggc

SEQ ID NO: 185404 - RNA, 52 nt, Homo sapiens
ugaaucuuaagccauaaauacagaaaugagaugaugagcaaucauuuucugu

SEQ ID NO: 185405 - RNA, 64 nt, Homo sapiens
gaagaaacaauguaauacugcagccccugcaaccugacacuccauauaaaauuacuguuauugc

SEQ ID NO: 185406 - RNA, 45 nt, Homo sapiens
aguucagcaguacaggaucaucuauucucccacuguuggugaucc

SEQ ID NO: 185407 - RNA, 41 nt, Homo sapiens
cgcguuguguauucuccuguggauggcacaagacccucaga

SEQ ID NO: 185408 - RNA, 44 nt, Homo sapiens
guaguucccguuuauacugaaggugaugggggacgcacaucaga

SEQ ID NO: 185409 - RNA, 46 nt, Homo sapiens
ccgggaauaccaauuaugccauucuuaggaaucugcagccagauac

SEQ ID NO: 185410 - RNA, 46 nt, Homo sapiens
uaucaccguauccucucuguauccugauggugaaggaggucggaug

SEQ ID NO: 185411 - RNA, 42 nt, Homo sapiens
caccaucuaugaaguuuccauuacugccaucuauccugauga

SEQ ID NO: 185412 - RNA, 45 nt, Homo sapiens
agaugugucucucuacagaauaacuugggcaccuuuuggaagcuc

SEQ ID NO: 185413 - RNA, 46 nt, Homo sapiens
gacgagggggagucuccuccagugacugcucaagaaacuacccgug

SEQ ID NO: 185414 - RNA, 42 nt, Homo sapiens
cugcacgaccucacuagugaaccugucacuguucgggaaguc

SEQ ID NO: 185415 - RNA, 42 nt, Homo sapiens
cugaauauuuaugauguuggcccuaccaccaugcaugugcag

SEQ ID NO: 185416 - RNA, 96 nt, Homo sapiens
cgaauggaaacuagcacagugcugaaagaucugaaaccugaaacugaauauguugucaauguguauucugugguagaagaugaauauagugagccu

SEQ ID NO: 185417 - RNA, 47 nt, Homo sapiens
uuuuagagugagcuggacaccaccuucugacaguguggaucgauaua

SEQ ID NO: 185418 - RNA, 75 nt, Homo sapiens
gcagauuuugagucacucuccaggauaguggaugaucucaccauuaauuuguguaacagugucaaagguccaggu

SEQ ID NO: 185419 - RNA, 68 nt, Homo sapiens
aaaaugcugaugaagucgaauuaaagaugauugcaacugauccugaugauacccaugcauacaaugug

SEQ ID NO: 185420 - RNA, 52 nt, Homo sapiens
aucacaagacgauguugaagcaccuucaaagaaacucaaggaugagggagug

SEQ ID NO: 185421 - RNA, 45 nt, Homo sapiens
aauuucauucgccaacagaacuucaggacccaagcuggcaugaga

SEQ ID NO: 185422 - RNA, 48 nt, Homo sapiens
auaguggggaucccagaacagaguggcaguuaaaugcacacagagaca

SEQ ID NO: 185423 - RNA, 32 nt, Homo sapiens
auuguggaagucuuugacauuggccccaaaag

SEQ ID NO: 185424 - RNA, 55 nt, Homo sapiens
gcugguaccaccuauaaaguaaauguuuuuggaauguuugauggaggagaaagcu

SEQ ID NO: 185425 - RNA, 46 nt, Homo sapiens
cugggggaguuagugguuggacccuaugacaacacaguuguuuugg

SEQ ID NO: 185426 - RNA, 50 nt, Homo sapiens
caguucuuccuauuuacaagaugggagaaggaaagcuuaggcaaggauca

SEQ ID NO: 185427 - RNA, 80 nt, Homo sapiens
aguaucucaagauuccaaaacccugaaaguagaugaagaaacagaaaacacaaugagaguuacauggaaaccagcaccag

SEQ ID NO: 185428 - RNA, 48 nt, Homo sapiens
accaaauacagaauuucaguauuugccacuuacagcaguggagaagga

SEQ ID NO: 185429 - RNA, 56 nt, Homo sapiens
ugguucuccucaagauuuaguuacuaaagacaucacugacacaucaauuggggcuu

SEQ ID NO: 185430 - RNA, 71 nt, Homo sapiens
uacggugcugcagggauugaaggaagggacacaauacgccuuaucugugacagccuuguaugcgucugggg

SEQ ID NO: 185431 - RNA, 103 nt, Homo sapiens
cuuggaguggggcaccaggaaaagugaaacaguaucucgucacauauaccccaguggcagggggugaaacucaagaggucacugugaggggagauacaaccaa

SEQ ID NO: 185432 - RNA, 47 nt, Homo sapiens
aauauuucucaggaccugguacuccauuaacuggaaaugcagccacu

SEQ ID NO: 185433 - RNA, 51 nt, Homo sapiens
uugcugguggagagagcagagaaguuaccaccccacccaaucagaggagga

SEQ ID NO: 185434 - RNA, 74 nt, Homo sapiens
ccucgaaaccuaaaggugacagaugagacuacagauaguuucaaaauuacuuggacucaagcuccagggagagu

SEQ ID NO: 185435 - RNA, 52 nt, Homo sapiens
gcggaguaugaggauggcuucagcauucccuuagcuggagaggagaccaccg

SEQ ID NO: 185436 - RNA, 46 nt, Homo sapiens
uggagaaaauguuuuuucauaucacaucaccuacaaggaagcggcu

SEQ ID NO: 185437 - RNA, 46 nt, Homo sapiens
cucacacagucuaucugccuuagaauugagcaagaauuggcagcua

SEQ ID NO: 185438 - RNA, 45 nt, Homo sapiens
uuucagagauccugcgauaaaacugaggaauucagauguugaaau

SEQ ID NO: 185439 - RNA, 49 nt, Homo sapiens
acagaggaggaucuacaaauacuggcaaagcaaugacuuaugucagaga

SEQ ID NO: 185440 - RNA, 93 nt, Homo sapiens
aaguuuugaaauuucaccaaauaggguccagauuagucuugugcaauacagccgggauccucauacugaguucacuuugaaaaaauucaccaa

SEQ ID NO: 185441 - RNA, 56 nt, Homo sapiens
auaaaagccgauauuguguuuuugguugauggcuccuauagcauugggauugcaaa

SEQ ID NO: 185442 - RNA, 79 nt, Homo sapiens
cucucagcagacacagaauaccagaucaguguuuccgccaugaagggaaugacauccagugaacccauuucaauaaugg

SEQ ID NO: 185443 - RNA, 100 nt, Homo sapiens
agugacuggcuacaaagucauccucacaccaaugacugcaggaagccgacagcacgcucugaguguggggccucagacaaccacgcucaguguucgcgac

SEQ ID NO: 185444 - RNA, 42 nt, Homo sapiens
ucagguguugaugaacaacuuggugaauugguuaguggagaa

SEQ ID NO: 185445 - RNA, 41 nt, Homo sapiens
ggaaaaucccaggaugaaguggaaauuccagcaagagagcu

SEQ ID NO: 185446 - RNA, 54 nt, Homo sapiens
acagcucugauaccaggacugaauuuaacuuaaaucaguacuaccaaagggaug

SEQ ID NO: 185447 - RNA, 48 nt, Homo sapiens
gugccuggacugauuugguuuuccucguggauggcucuuggagugugg

SEQ ID NO: 185448 - RNA, 47 nt, Homo sapiens
aacagguaguucgacaaagccaguggagaagaaaccuggaaaaaccg

SEQ ID NO: 185449 - RNA, 49 nt, Homo sapiens
acaauaacuucauaugaugaaguagaagaaaguguaccaguuauaggac

SEQ ID NO: 185450 - RNA, 52 nt, Homo sapiens
ggccuacuaaagaauuuacccuuucagcuaguaccacugaaacuuuauuguc

SEQ ID NO: 185451 - RNA, 59 nt, Homo sapiens
uucagacuugaauuuuaaaauuauagaugaaaauacuguucauaugucaugggcaaaac

SEQ ID NO: 185452 - RNA, 45 nt, Homo sapiens
ucaaugaaguguugcuaagcauucaaaugaauguuuuggcuaaaa

SEQ ID NO: 185453 - RNA, 25 nt, Homo sapiens
uggacuuguaauaguguaggugggc

SEQ ID NO: 185454 - RNA, 42 nt, Homo sapiens
uggggaucaauauuuauugacuuguaguaacugccaccaaua

SEQ ID NO: 185455 - RNA, 46 nt, Homo sapiens
gcaaucgcuugguucaguuucauucagcucucuauggaccaguaau

SEQ ID NO: 185456 - RNA, 50 nt, Homo sapiens
ggacgauaagcacugcuucccgcaggcauuuuaaaaauaaaguuccggag

SEQ ID NO: 185457 - RNA, 43 nt, Homo sapiens
uuuugagcuuugcgagcuugagaaggcaguuuaaaaaccaagc

SEQ ID NO: 185458 - RNA, 62 nt, Homo sapiens
uugaugagguuaguagcuccgaucugaguaaaaccaagacccagguggggagugucugacac

SEQ ID NO: 185459 - RNA, 62 nt, Homo sapiens
cugaccuuacuuucccuuccgucuauuccucucgccccaggccguuacuggguagauguaag

SEQ ID NO: 185460 - RNA, 52 nt, Homo sapiens
cggaaucugcuggugaggagcuucucaucuugcauucaugaugggggcgagg

SEQ ID NO: 185461 - RNA, 44 nt, Homo sapiens
guuccgguuccggcguggccauuuucguuggugguguucaguug

SEQ ID NO: 185462 - RNA, 44 nt, Homo sapiens
uuuuauaaaauacuugagaaaagaucucuaccaaagauacccuc

SEQ ID NO: 185463 - RNA, 42 nt, Homo sapiens
ugggcaaaccuuguuuuuaaaacaguuugauaauccugucag

SEQ ID NO: 185464 - RNA, 46 nt, Homo sapiens
acuuucacauuucacuugguccacuccacauuuccuuaacacacgg

SEQ ID NO: 185465 - RNA, 40 nt, Homo sapiens
ugugugguuugauauggcuggaacucuuccccuuccauuu

SEQ ID NO: 185466 - RNA, 27 nt, Homo sapiens
cucccucccucuuuuccccccgcccug

SEQ ID NO: 185467 - RNA, 72 nt, Homo sapiens
auggaauccgaggauuuaaguggcagagaauugacaauugauuccauaaugaacaaagugagagacauuaaa

SEQ ID NO: 185468 - RNA, 41 nt, Homo sapiens
acaguauucaagagccagaugaugcacgugacuacuuucaa

SEQ ID NO: 185469 - RNA, 35 nt, Homo sapiens
uuuuuuggguaggaccaagacaaucucuuccuaag

SEQ ID NO: 185470 - RNA, 26 nt, Homo sapiens
uuuuccgguucacuugggcauuuaca

SEQ ID NO: 185471 - RNA, 76 nt, Homo sapiens
guugguuauuuaaucuuucaaaauauuuuuagucaugcccauuuggaagagucccaguuaaccuucuaaauagccc

SEQ ID NO: 185472 - RNA, 46 nt, Homo sapiens
gucugcuaagaaucucuuccuguuuuguuugagagucuccauaacg

SEQ ID NO: 185473 - RNA, 44 nt, Homo sapiens
uacauuucuauuauauuuagacuugacuaaauauugacauuaaa

SEQ ID NO: 185474 - RNA, 46 nt, Homo sapiens
ggaaaugauuccugugaauuaagaaauuuaaagguauuuuaauucu

SEQ ID NO: 185475 - RNA, 58 nt, Homo sapiens
cugaccuccugacauggcagagcaacuuuguguggacuuaaaggaaauaauuuuaguu

SEQ ID NO: 185476 - RNA, 30 nt, Homo sapiens
auagcuuaagaaagcagacuagccaccuaa

SEQ ID NO: 185477 - RNA, 73 nt, Homo sapiens
uuuuaucuccuuugucuaucaauugcuaauauuucguuuaggacuuuuguauccauuauaaugaaaggagugg

SEQ ID NO: 185478 - RNA, 54 nt, Homo sapiens
ggcaaacaaagcacaaauguauacuggacagauuuaagcucaaaggccaaacuc

SEQ ID NO: 185479 - RNA, 51 nt, Homo sapiens
aaacccaugaguaauuaacuauaaaaaucaacugauaaaaaaauuagcuga

SEQ ID NO: 185480 - RNA, 64 nt, Homo sapiens
aacuggaaagaggugauaguguuuuaaggauugaaacaauauaauaaauuacaaaggaaaaaca

SEQ ID NO: 185481 - RNA, 231 nt, Homo sapiens
augagaaagaagaauacagauauagccggaugguaguggcaugccuguaaucccagcuacucgggaggcugaggagaagaaucgcuugauccugggaggcagagggugcagugagccgagaucaugccacugcaguccagucugggaggcagagugagaugcugucucaaaaaaaaaaaaaaagaaaagaaugcagcuauaauuauguguguguauauguacauauguaag

SEQ ID NO: 185482 - RNA, 43 nt, Homo sapiens
aaagauaauucaccagugaucaagaucagggcuauaggggugg

SEQ ID NO: 185483 - RNA, 40 nt, Homo sapiens
agcuagaugguauuuuuguuuguauauuggugggcuuauu

SEQ ID NO: 185484 - RNA, 46 nt, Homo sapiens
uaugucuuccuccagagagaaugggaaaucuaagucaaagguacug

SEQ ID NO: 185485 - RNA, 37 nt, Homo sapiens
uugauuuauuuuauaguuaaccaaauggccaagggaa

SEQ ID NO: 185486 - RNA, 59 nt, Homo sapiens
uuuugaagcuguacacagcaaucaacacaauucucaaagcacaagucucaagcuuuuua

SEQ ID NO: 185487 - RNA, 46 nt, Homo sapiens
acugcaaccucuuggugaggggcuuuaggcccgccucugaugaaau

SEQ ID NO: 185488 - RNA, 94 nt, Homo sapiens
auggagucuuauaucccugucaaacaacaguggcaaaaauguggaacugaaauuuguggauucccuccggaggcaguuugaauucaguguagau

SEQ ID NO: 185489 - RNA, 47 nt, Homo sapiens
gaagcuuaugugcagaaaaugguuaaagugugcaaugacucugaccg

SEQ ID NO: 185490 - RNA, 65 nt, Homo sapiens
guuaaaauugucugaggaggcaggcuccuggaaugucauaauuuaguuuauauuugauuguaacu

SEQ ID NO: 185491 - RNA, 46 nt, Homo sapiens
acugccuguuggacuucuuacccgagggggugaacaaagagaagau

SEQ ID NO: 185492 - RNA, 45 nt, Homo sapiens
gcugcaagugauggagcuacagucuguguuaccacaaggggagau

SEQ ID NO: 185493 - RNA, 43 nt, Homo sapiens
accaaaggaugcccauacugaacuucaauagaaacccgguaga

SEQ ID NO: 185494 - RNA, 51 nt, Homo sapiens
auuugccugccucccauauaguacaucccacauucugccucuaggcaagau

SEQ ID NO: 185495 - RNA, 48 nt, Homo sapiens
auacaaccugccgugccuuugcugcugccgcaguagauuuucagcuca

SEQ ID NO: 185496 - RNA, 41 nt, Homo sapiens
ugaauuccacgagauucaccagcgguuuugcuccaguccaa

SEQ ID NO: 185497 - RNA, 37 nt, Homo sapiens
gccaccucuucgccucuuguuggcgccccucgcugga

SEQ ID NO: 185498 - RNA, 50 nt, Homo sapiens
accagggcggcggcaggaagaggagcgggagcaggagcgcggagcggagc

SEQ ID NO: 185499 - RNA, 40 nt, Homo sapiens
gcaccucguccaggcggcugccgcugagguugagcgcggc

SEQ ID NO: 185500 - RNA, 42 nt, Homo sapiens
guccccuuguggaacugauccugaaccacaucgugcccccug

SEQ ID NO: 185501 - RNA, 46 nt, Homo sapiens
uccuuuaccugccgcgggaugugcuggcccaacugcccagccucag

SEQ ID NO: 185502 - RNA, 46 nt, Homo sapiens
accugacacaucuagaaagccuccaccuggaggacaaugcccucaa

SEQ ID NO: 185503 - RNA, 47 nt, Homo sapiens
ggauuguuguccaggaaaacccuaaugugggguagaccuugcaacuc

SEQ ID NO: 185504 - RNA, 44 nt, Homo sapiens
uggcagacauggugaccuggcucaaggaaacagagguagugcag

SEQ ID NO: 185505 - RNA, 46 nt, Homo sapiens
gugcugaccuggacugugacccgauucuucccccaucccugcaaac

SEQ ID NO: 185506 - RNA, 45 nt, Homo sapiens
uaagagguuugcagggaugggggaagaaucgggucacaguccagg

SEQ ID NO: 185507 - RNA, 42 nt, Homo sapiens
uccacuuuuuuauccccuugcgguucaaauacaaaaccagga

SEQ ID NO: 185508 - RNA, 43 nt, Homo sapiens
uggaaggguaucauuacagauaugaaaucaaugcggaccccag

SEQ ID NO: 185509 - RNA, 65 nt, Homo sapiens
ccucaguucuaacucggaugucugagaaauauuagaggacagaccaaggacaacucugcaugaga

SEQ ID NO: 185510 - RNA, 96 nt, Homo sapiens
gcaugaacaugggcuucuugcugucugucucucucucaguacaguucaagguguagcaaguguacccacacagauagcauucaacaaaagcugccu

SEQ ID NO: 185511 - RNA, 48 nt, Homo sapiens
guaccuaaguuguggagaaaauaauugcauccuauaaacugccugcag

SEQ ID NO: 185512 - RNA, 29 nt, Homo sapiens
uaagaacauaaugaaguugguaaaagcua

SEQ ID NO: 185513 - RNA, 22 nt, Homo sapiens
aaaauauccucaagaaaaucua

SEQ ID NO: 185514 - RNA, 29 nt, Homo sapiens
agauugcugacuucuuguuauguccuuau

SEQ ID NO: 185515 - RNA, 33 nt, Homo sapiens
uuuugaucagagaaauguuaauacauaugaagc

SEQ ID NO: 185516 - RNA, 52 nt, Homo sapiens
uuuaaaugugcacaagacuugggcuuuuuucuucuagacuauguacaucauu

SEQ ID NO: 185517 - RNA, 46 nt, Homo sapiens
augcuaaggaguaaucuauuuuuacaagaaugcucaauggugguga

SEQ ID NO: 185518 - RNA, 46 nt, Homo sapiens
cuucuuuggcuauaguuguuguuucaaguugaaacagcaucacuag

SEQ ID NO: 185519 - RNA, 2027 nt, Homo sapiens
auacaaaacauuuuccuaacaaagaagauuccaacaaccaacaauuaccucacauaacuguuauuauuuuuacagaugaacaaauugacaucacaaugaggaaacuagaaaauuacgaaaagagaaacaaucuugaaaaagauaaauaaacaucucuacuuuuuaggaugaaacagacaaaauuaauuugauuugcuuaaugcuacugcaaugcauucuaaacucagaguuguuaaaaguaacuguauauuaggccgguguaaucccagcacuuugggaggccgaggcaggcggaucaugaggucaggagaucgagaccauccuggcuaacacagugaaacccuguuucuacuaaaaauacaaaaaauuagcugggcgugguggcgggcgccuguagucccagcuacucgggaggcugaggcaggagaauggcgugaacccgggaggcagagcuugcagugagccaagaucgcgccacugcacuccagccugggcaacagagcaagacugucucaaaaaaaaaaaaaaaaaaaaaaguaacuguaaauuaguggauuuauguuuucagaacugcaauaagaaaauggcugggcaugguggcucaugccuguaaucccagcacuuugggaggccaaggccaggggaccacuugaggccaguuugauuucagccugggcuacacagugagccuccaucucuacaaaaaaauuuuaaaaaucagcugggugugauggcacgugccuguagucccagcuacucaggaggcugaagugggaagaucaccugagcccaggaggucaaggcugcagugagcuaugaucacacuacuacacuccagccugggugacagaguaagacccagucucaaaaaaaaaaaaaaaaaaggacacaaaaauaacuucuuuuaaguuaucugagggaaugaagaaggaagauaaaagacgaaaacccauuuagagaagggaacauggacgcauaucuucucuauuugaccagaagaaaaaucugugguaugcaagggaaauucagacaaaacuagaauuuuuuuuuaaaugucauucucaauguacauaaugcuaugcuuugucucuuuuucuguaucuguacuguacugcucagucuagccauuugucacauuccaccuaauguaguacaacuuucucuaauaccaacuucuucccacuuacuggacuaacuguugccaaaauugucuucucugcccaacaguauguaaaaauacaaagcugugaauuuuguaauacuuaggucugaguguuuccuucugcuuuuauggcuuucuuuaauguauaggaaauuaccuuuucagcaucuuccuacaaucaaucuauccuuucauucaucuaaaauaccagggcuguucauuccaucucaccacucugaauucaacacaguggcuuuauaucugagccaauuuucucacaguccaaacacguguuuucugccacuuaaaauaugguugcaaugccauuaucuuuauaaaccuauaaaaucuaaggaauugcgaauuuugccuaucuuauaaaaauacaucauuauuugucucaaauucuacauaaacuacuauccagaaauuaaccaagcugucugauaaaauaauaaauuuccaaucacuauauucaagcaauaguuguaugauggucaugaaugcucuaacaugggcacaacuuuuggacacaggaguaagcuggauucuaaggucccucacaaauauaauucuguucuuaccucugaggcacaaauacaaauacauaaccauccuuugcuuuaauuaguagguccauauaaauauuauguauuuauuugcuuuuugccuacaccucaucacguacaacuaaauggugaaaaaaaaaguuuuucaugaggauaaagaggcaucaauuuuaauaaauuagcaaaugaauguuaggcaaaaaaaaaaaccacaggaacauuuaaaaaucaaacauaacauuuuuagggcaauuaguacacauaccuuuggggaguggguuguuuugggcuuggag

SEQ ID NO: 185520 - RNA, 42 nt, Homo sapiens
aaaaaaaauauuguccuuauaacgguccaucucagaagccag

SEQ ID NO: 185521 - RNA, 59 nt, Homo sapiens
aaucacggcaacaaaauuuacuccaccucugaauuacuggucuuaaucucagaagccga

SEQ ID NO: 185522 - RNA, 47 nt, Homo sapiens
ccgaucagcgguuccucacgccaaaacucggagccuguggccgucac

SEQ ID NO: 185523 - RNA, 44 nt, Homo sapiens
auagccucccggagucagaacgaggccgucccgcccucucgcac

SEQ ID NO: 185524 - RNA, 40 nt, Homo sapiens
uuuuuuuccugcagagaucauugaaauucaguugaucaca

SEQ ID NO: 185525 - RNA, 46 nt, Homo sapiens
uucccaagcagagugaguguuccuucccuugucugaguggccuugg

SEQ ID NO: 185526 - RNA, 47 nt, Homo sapiens
auguguauuuuucccuugucaaaaauuaguugaaauuguucauuaau

SEQ ID NO: 185527 - RNA, 93 nt, Homo sapiens
uaugccugacaguggacucucuuucugcucacugacccugagaaacagcuuuguccuuuauggcuccuccuugacuguuucccgcccuccaac

SEQ ID NO: 185528 - RNA, 500 nt, Homo sapiens
auuccacaacuaagcuauaggucacccagaaacccccaggacagcugucaggaggccaagacucaguauaaggaggcuacagggcagacuacuggguuugacauguaauguggcucuuaugcugacacugguaccccauguuucuugccagaggcuggaguaccauucccucauggagguucuucaccuagugaccuucauugccaucuucaugggaauccccacacacccuuacugcaguuggguuuuuauagccuccaggacccugccucccacccugagcuccagcauucuguccugauaaugucauagccaguucuggucuucguguuacuugagaggguuguagccagagaacuaguuguggguccccaucuuguaccuuuccuugaguaggucaaagccugcucucacacgagucuggggaagcccggcagccuggccuugccucuccaaugggaggggaaaugaggagggaguaggcugucugaacugcuugg

SEQ ID NO: 185529 - RNA, 31 nt, Homo sapiens
gggggcuagccauguuggcagucugauccuc

SEQ ID NO: 185530 - RNA, 43 nt, Homo sapiens
ugcuggauuuuggcaggcaggggugaccagguguaugcuggga

SEQ ID NO: 185531 - RNA, 46 nt, Homo sapiens
uccuuccugagauauccuuauaggggugaaccuguauuauggguag

SEQ ID NO: 185532 - RNA, 49 nt, Homo sapiens
cuuucagagucaacagaaggaggauaggcauuauucauauccccaagua

SEQ ID NO: 185533 - RNA, 33 nt, Homo sapiens
aggaaaauagcuuuguucuuauaaagauaagac

SEQ ID NO: 185534 - RNA, 728 nt, Homo sapiens
uugaggcaggaaauuaaagaaagaaagaaaaaaaaaaagggaauaagcuuuccugugcuaggcugacuugucccagaggcagcaacaagcacagcugaaacccaggaaaagucuugauaauacuaucuaagaagccaggacacagaagaaugugcucuggagacucucccaccacucccuccacauagggagaagaaaaacaaauuucucuuuguuuuacaguaugaguuuauagauuccuguucccuguaacuagugacuucuaguauucuguuuuaucuaagcaguggagugauggucauaaagcaacugagcaggccugagauacggccaccugggcaccauagugaaggccauggaauaagccuugcuaggcacuacggcaaacuagauaauggccaucugaguugcauagcaauggucauguguaauccugaguuaugaaccuguuacaauuugauuaaccgucuugucuugccucuguauccuugcuuuugcuuugcgccaguguaagcuugacucaaguuagcccauccccuuuuagaaguguguauaagcgucaagugcugucuuuguucuuggcucaguuuuuggauguugagucugcugggucugagugcacucagaaaagauccuccugguuuaccccgaggucucucuuguccuccuaauucacacgacaguauaaguuacaucuguauguacuauaaaucuaacaaauaguauua

SEQ ID NO: 185535 - RNA, 29 nt, Homo sapiens
guguacugagguagcugcugggcccugga

SEQ ID NO: 185536 - RNA, 45 nt, Homo sapiens
uggcauggaagccuugggucuguggaacuagaucuguauaaaaga

SEQ ID NO: 185537 - RNA, 38 nt, Homo sapiens
uuucagcagauauuuucacccaucuacuuugugucaga

SEQ ID NO: 185538 - RNA, 46 nt, Homo sapiens
aguccaaaagaauuuccaucuuucugagcaugcaagaugaaauuga

SEQ ID NO: 185539 - RNA, 48 nt, Homo sapiens
uuuuaaugaguuuucacaccuaccagaguggguguaccaggaagggau

SEQ ID NO: 185540 - RNA, 45 nt, Homo sapiens
cugccugauggaugauucaacugaauaugguuucuuucaccagga

SEQ ID NO: 185541 - RNA, 40 nt, Homo sapiens
aacauccagcauaguguucccaaagugugaggagccccag

SEQ ID NO: 185542 - RNA, 43 nt, Homo sapiens
uuugcuggauuuuggcaggcaggggugaccagguguaugcugg

SEQ ID NO: 185543 - RNA, 490 nt, Homo sapiens
uuauuccacaacuaagcuauaggucacccagaaacccccaggacagcugucaggaggccaagacucaguauaaggaggcuacagggcagacuacuggguuugacauguaauguggcucuuaugcugacacugguaccccauguuucuugccagaggcuggaguaccauucccucauggagguucuucaccuagugaccuucauugccaucuucaugggaauccccacacacccuuacugcaguuggguuuuuauagccuccaggacccugccucccacccugagcuccagcauucuguccugauaaugucauagccaguucuggucuucguguuacuugagaggguuguagccagagaacuaguuguggguccccaucuuguaccuuuccuugaguaggucaaagccugcucucacacgagucuggggaagcccggcagccuggccuugccucuccaaugggaggggaaaugaggagggaguaggcuguc

SEQ ID NO: 185544 - RNA, 103 nt, Homo sapiens
ugaacugcuugguaugccugacaguggacucucuuucugcucacugacccugagaaacagcuuuguccuuuauggcuccuccuugacuguuucccgcccucca

SEQ ID NO: 185545 - RNA, 47 nt, Homo sapiens
guauguguauuuuucccuugucaaaaauuaguugaaauuguucauua

SEQ ID NO: 185546 - RNA, 62 nt, Homo sapiens
gagcuguguauuuccuaggagguagaaaacugugggaaacuguggcuaauaaaaacuaagug

SEQ ID NO: 185547 - RNA, 67 nt, Homo sapiens
ccugggugacuuugcagaucugcucacccucggugagcaacagugucagccaugcaagcaggacaga

SEQ ID NO: 185548 - RNA, 58 nt, Homo sapiens
cagccugcugggcugggucgcguagcccaggguggaggcagaacgaugcugcuguggu

SEQ ID NO: 185549 - RNA, 45 nt, Homo sapiens
cgugaccauccaugaggcucugaaaacggugauugacucccagac

SEQ ID NO: 185550 - RNA, 39 nt, Homo sapiens
caccaaauacuugugaaaugacugucagggcccagggaa

SEQ ID NO: 185551 - RNA, 49 nt, Homo sapiens
acuuucuagcaaugccacggcaaaguugguguuucagcacaugcuagag

SEQ ID NO: 185552 - RNA, 45 nt, Homo sapiens
acugagacuaagaauugaaguaaugcaguuuuaagaaguacuuuu

SEQ ID NO: 185553 - RNA, 48 nt, Homo sapiens
gaccaucccugaugcguagaugugagaggauguuuucuggcacagugu

SEQ ID NO: 185554 - RNA, 72 nt, Homo sapiens
caaagcaggcccacgccugggcuggccuugguugaggggauggaggaauguuuucgggggugcuuugcaggg

SEQ ID NO: 185555 - RNA, 49 nt, Homo sapiens
guuagagggcucuagggggagaggugguggccuggagguaggugguccc

SEQ ID NO: 185556 - RNA, 40 nt, Homo sapiens
cuguugcguugguguguaggaaaugaacagcaacaggaag

SEQ ID NO: 185557 - RNA, 46 nt, Homo sapiens
uuucuggugucucguuaccauaguggaaguuuucaugccucgagac

SEQ ID NO: 185558 - RNA, 40 nt, Homo sapiens
cuuaggaauucuguaagccaugcaugagcuggaguucuga

SEQ ID NO: 185559 - RNA, 42 nt, Homo sapiens
ugcgaacucugcccaacaacaaacauuacuccugccccaccu

SEQ ID NO: 185560 - RNA, 46 nt, Homo sapiens
cacuuauguauacaaagcaaagaacaacacagugacuccuggaggc

SEQ ID NO: 185561 - RNA, 77 nt, Homo sapiens
aagcaccugcugcugaaauuugggggcaaauaacuggaguaggccugcugggaacaggacuuguuaaaagaacuaug

SEQ ID NO: 185562 - RNA, 96 nt, Homo sapiens
agcuucugcaccaaaaggaugaucagauucugggccuuaccagccagcuggagagguucagcuuggagaaggagagucuucagcaggaaguaagga

SEQ ID NO: 185563 - RNA, 81 nt, Homo sapiens
caagugaaggcacaucaggcaguggcagcgucagcaucaggaagccggccuccgaaaugcaacugcagguccagagccagc

SEQ ID NO: 185564 - RNA, 108 nt, Homo sapiens
cuggcucaggauuccccuuugauuuuggacguaaccccuacaaaggaaagcgcccuuugaaagacauaauugggucguacaaaaaucgucacagcaguggugacccuu

SEQ ID NO: 185565 - RNA, 45 nt, Homo sapiens
gacccaaccccuaaggaccuagaggaguccauaguacaggaagaa

SEQ ID NO: 185566 - RNA, 74 nt, Homo sapiens
cuaaacaggcauaauugcugguuucuggugacucuuuguuaaagcaguuagccaaaggccauacauccauauac

SEQ ID NO: 185567 - RNA, 77 nt, Homo sapiens
gcaguggguccagcggugucccagugcccugugaagugaugaaccagucaugucaaaaaaaugaacagaaguauagc

SEQ ID NO: 185568 - RNA, 33 nt, Homo sapiens
ugcauucacccuuuaggaaccagagcugaggag

SEQ ID NO: 185569 - RNA, 47 nt, Homo sapiens
cugugccuuugccguguaacacagugauuaagaaccaggcugccuga

SEQ ID NO: 185570 - RNA, 24 nt, Homo sapiens
ugugggagggaggaugugagggag

SEQ ID NO: 185571 - RNA, 57 nt, Homo sapiens
cugugagaguuuuugagucacuuucacgacugucuuagcgcucugacuauuccaggu

SEQ ID NO: 185572 - RNA, 45 nt, Homo sapiens
ccuagagauccccgaauacuuuuucgguauuuaaauccccaauag

SEQ ID NO: 185573 - RNA, 48 nt, Homo sapiens
guaauauuuagagaggccucuuuggccuuuguauauuuuauuccacuu

SEQ ID NO: 185574 - RNA, 32 nt, Homo sapiens
uaauuuucaaagcuauugagauugcaguuaaa

SEQ ID NO: 185575 - RNA, 120 nt, Homo sapiens
gaugaggaaugucaugaauccuuucagaaaugggaaugucucuguguuugucucuguaauguagaggcaucuugagaggcuggacuuuugaugaauugucauaagaacugaccccauaua

SEQ ID NO: 185576 - RNA, 92 nt, Homo sapiens
cuccugugauuuaucguugcccuucauuguuuaaccuccucauagggcuguuaucuagaaucagaaauaccaauuuuuuuauuauuuggcau

SEQ ID NO: 185577 - RNA, 42 nt, Homo sapiens
ccaaaacacaauaaauaauguugucgcuuguaagaauuuuca

SEQ ID NO: 185578 - RNA, 43 nt, Homo sapiens
uuuugaugaauguaauuugcugaucuccucacuggugauguca

SEQ ID NO: 185579 - RNA, 81 nt, Homo sapiens
gauggguuguggaacaaaucucagggccagaggaggccaauuuuuagagcaaguacuauuaaugcuucuagauuagccuag

SEQ ID NO: 185580 - RNA, 51 nt, Homo sapiens
gaauggagagguggugauggaauuaauaguauuggagggggccagaaagug

SEQ ID NO: 185581 - RNA, 42 nt, Homo sapiens
guggacaacugguauagugagggaccuauuuuuuucucauga

SEQ ID NO: 185582 - RNA, 47 nt, Homo sapiens
agguugaguuuguugauuuagaugauacuuuaggacccagcuugaca

SEQ ID NO: 185583 - RNA, 45 nt, Homo sapiens
auaacuuuucuaaaguauuuaaacacagaaauagcagugcuacuc

SEQ ID NO: 185584 - RNA, 62 nt, Homo sapiens
cuuuuauuuggacuucauuugcuaauguaaacuaauaauucaauacaauucauauaauuuaa

SEQ ID NO: 185585 - RNA, 46 nt, Homo sapiens
aacccagaugaaguuguuuuaaaauuugaaaauggcaaagccagag

SEQ ID NO: 185586 - RNA, 46 nt, Homo sapiens
ggcugcacucuuugugaauucgauacagucgacuugucugcaguag

SEQ ID NO: 185587 - RNA, 48 nt, Homo sapiens
caaaugcaaaauacuuuuacuguaauauguucaagcuccugaauuaaa

SEQ ID NO: 185588 - RNA, 47 nt, Homo sapiens
aaagcuaagcaugaaaucaaaacuauaaaaauaguaggaccagaaga

SEQ ID NO: 185589 - RNA, 59 nt, Homo sapiens
ucaggaugaaaagugugauuauuacuuuaguguggaugcagauguuguuuugacaaauc

SEQ ID NO: 185590 - RNA, 47 nt, Homo sapiens
gagggaacuuaguuauguucuacagcuaauaaacuuucaauucaagu

SEQ ID NO: 185591 - RNA, 50 nt, Homo sapiens
ucuggggagcauugaguccugauggauacuaugcacgaucugaagauuau

SEQ ID NO: 185592 - RNA, 55 nt, Homo sapiens
gcuguggggaauacuaagagauaauauauguuuaccauacucacauuaugguuga

SEQ ID NO: 185593 - RNA, 37 nt, Homo sapiens
cuaauguguacuuaauuaaaggaaagacacuccgauc

SEQ ID NO: 185594 - RNA, 46 nt, Homo sapiens
ucgugauaaacuggauccugauauggcucuuugccgaaaugcuaga

SEQ ID NO: 185595 - RNA, 49 nt, Homo sapiens
ucgggcuaauucauaggcaaccgaguuggauuucaguaauaaagaugua

SEQ ID NO: 185596 - RNA, 42 nt, Homo sapiens; identical to SEQ ID NO: 116310

SEQ ID NO: 185597 - RNA, 62 nt, Homo sapiens
acugcuaauuacaauacuucccauuauaacaaugaccucuggcagauuuuugaaaauccugu

SEQ ID NO: 185598 - RNA, 50 nt, Homo sapiens
aaaauuuuguauuucauagaaugacauaagcauauucagaaccaggcaaa

SEQ ID NO: 185599 - RNA, 45 nt, Homo sapiens
aaccgugauuauucaaagauuuucacugaaaauauaguugaacag

SEQ ID NO: 185600 - RNA, 76 nt, Homo sapiens
ucuuuugguuccccauauuuucugaaaaagccugugaugaauugguagaagaaauggaacauuacggcaaaugguc

SEQ ID NO: 185601 - RNA, 36 nt, Homo sapiens
aguucuagacuuagauaaauuggcuagccaaggcuc

SEQ ID NO: 185602 - RNA, 43 nt, Homo sapiens
gguuaugaaaaugucccaacugaugauauccacaugaagcaag

SEQ ID NO: 185603 - RNA, 66 nt, Homo sapiens
ccugaacgacagcguucucuucguccucaucaugaugcuucuacauuuaccauaaacauugcacuu

SEQ ID NO: 185604 - RNA, 46 nt, Homo sapiens
agaucccuaaguuauuuacuuuucauugaauugaaauuuauuuugg

SEQ ID NO: 185605 - RNA, 52 nt, Homo sapiens
uauuucuuaaugucugcucugagccuuaaaacacagauugaagaagaaaaga

SEQ ID NO: 185606 - RNA, 67 nt, Homo sapiens
aaaaaaagcaugggaagauuuuuauuuaucaaaauauagaggaaauguagacaaaauggauauaaau

SEQ ID NO: 185607 - RNA, 51 nt, Homo sapiens
uuccuuuuuuagaaaguucuagaaaauaggaaaacgaaaaauuucauugag

SEQ ID NO: 185608 - RNA, 47 nt, Homo sapiens
uaauguaaagguuaaacuugaaaagaaauucuuaaucacggugccaa

SEQ ID NO: 185609 - RNA, 25 nt, Homo sapiens
uuugaaaauacuuggaagggagaga

SEQ ID NO: 185610 - RNA, 46 nt, Homo sapiens
auacuuuaaaguuaaaugaacaaaauaaauacuaauauuggauggc

SEQ ID NO: 185611 - RNA, 51 nt, Homo sapiens
uugcuuuucuuuaucauguuuccuaaaaguaaauuugcaaagaaaguaaca

SEQ ID NO: 185612 - RNA, 40 nt, Homo sapiens
ugaagcagagaccaauguuuuggugcugaggcugguucag

SEQ ID NO: 185613 - RNA, 51 nt, Homo sapiens
cagaaacaaaaagccccauugggcaugauaagccgaggaggcauucuucua

SEQ ID NO: 185614 - RNA, 47 nt, Homo sapiens
aauauucgugguaucugugaacauguuaagaguaauuuggauguggg

SEQ ID NO: 185615 - RNA, 47 nt, Homo sapiens
aggccgccaaugccuggcggaccgcccucaccuuccagcagaucaaa

SEQ ID NO: 185616 - RNA, 42 nt, Homo sapiens
gagggugggcguuacuuaggaggaggaggcugggagggagau

SEQ ID NO: 185617 - RNA, 42 nt, Homo sapiens
agauggcggacaaaacgccaggcggaucucagaaggccaguu

SEQ ID NO: 185618 - RNA, 67 nt, Homo sapiens
cucccgaaaagccgagaagaggagccguuugacccaacuugagggugauccgauagacacucuuuag

SEQ ID NO: 185619 - RNA, 29 nt, Homo sapiens
uaagugcuucccucgcuccccacccccgc

SEQ ID NO: 185620 - RNA, 43 nt, Homo sapiens
gaaccagcucugaagaaguagaauuuuguugaauggcgggggu

SEQ ID NO: 185621 - RNA, 46 nt, Homo sapiens
aaaaguucacugcuacaaagggaucccaacccacuggaggcuuuga

SEQ ID NO: 185622 - RNA, 45 nt, Homo sapiens
ggcuauaccacuuaguauaguucgcuacuauuuuguggccuacau

SEQ ID NO: 185623 - RNA, 68 nt, Homo sapiens
gcauagaguaggcucuugauaacuuguggaagaaagggagggagggaggagcagagagagggagggaa

SEQ ID NO: 185624 - RNA, 42 nt, Homo sapiens
ucccagaccuguuuucacaugugguggcauucuuacuggaga

SEQ ID NO: 185625 - RNA, 40 nt, Homo sapiens
agaucuagucguguccugcauuagugauuacaaagggcac

SEQ ID NO: 185626 - RNA, 61 nt, Homo sapiens
cucaguugaguuuuauagauucauaauuaaagcuguuuucagucaaaggccuguuguaaug

SEQ ID NO: 185627 - RNA, 52 nt, Homo sapiens
ggaaauggaagaucaaagauagugcuuugacuacucuaugcucauuaggaaa

SEQ ID NO: 185628 - RNA, 79 nt, Homo sapiens
uaauaacauagauuaugcugagucaagauaagcuggauuuagagacagccauauauuuuuuaacugauuuagagucaac

SEQ ID NO: 185629 - RNA, 42 nt, Homo sapiens
auagcauugacuguuaccuucuucacuuuuucguuguuggga

SEQ ID NO: 185630 - RNA, 43 nt, Homo sapiens
guugauggccuuaacaggucuuagguuuuuuacuuuuacugua

SEQ ID NO: 185631 - RNA, 64 nt, Homo sapiens
caacauaggcaggacacauuuagaagagcccaugaagcauggugcugggugcaggagacacaua

SEQ ID NO: 185632 - RNA, 40 nt, Homo sapiens
uauacauugguugcacuaggcucauuauuucaguugccug

SEQ ID NO: 185633 - RNA, 64 nt, Homo sapiens
gagagucaguauggcaagucuuuaagaaacaaauauaaacaucccgaaauaaauggaacaccca

SEQ ID NO: 185634 - RNA, 55 nt, Homo sapiens
aaaugguaguguugcuuuauuuauuuauuuuuuaaccucccuuccaggucuguaa

SEQ ID NO: 185635 - RNA, 48 nt, Homo sapiens
guauugauguaguuaguccacauuuaaauuuuuauagaauuauauagu

SEQ ID NO: 185636 - RNA, 40 nt, Homo sapiens
gaacucuaccucauuuaaauaucguuucugcauauccuua

SEQ ID NO: 185637 - RNA, 34 nt, Homo sapiens
cuauuuuuaguucucagggguaaugacugggauc

SEQ ID NO: 185638 - RNA, 33 nt, Homo sapiens
auuuggaaaucuuaaacgugggugacuaagaga

SEQ ID NO: 185639 - RNA, 50 nt, Homo sapiens
cuaccucuuuuuuuuuuuuucuuaaugaggcacauuuuuuuugagugaca

SEQ ID NO: 185640 - RNA, 46 nt, Homo sapiens
uuguuuuuaucuaaagaugaaugauuuuuauccaucuauaaaaggu

SEQ ID NO: 185641 - RNA, 48 nt, Homo sapiens
uuccugccucaaaacaguuuucaguuugacuuugguuuuauuaaauuu

SEQ ID NO: 185642 - RNA, 50 nt, Homo sapiens
uauccucugcuuauuacuagaucucauuuuuaacucuauguuauguaagu

SEQ ID NO: 185643 - RNA, 31 nt, Homo sapiens
auuaaugagaugguguguguguguguguguu

SEQ ID NO: 185644 - RNA, 46 nt, Homo sapiens
guauacauggagacaaguagaugauuaugggagauauuuuagagag

SEQ ID NO: 185645 - RNA, 54 nt, Homo sapiens
ggcucagaaaagccugacuagaguuugguuaaggagagaaucuuggucagcagc

SEQ ID NO: 185646 - RNA, 47 nt, Homo sapiens
cagagauuauuuguaugcucaaaauaguuauauauucauuaaugaau

SEQ ID NO: 185647 - RNA, 53 nt, Homo sapiens
uguaggcaguaagaugugguuuuguuugucauuguccaggcugagaguagugg

SEQ ID NO: 185648 - RNA, 42 nt, Homo sapiens
ucaacuauuuccagugagggcacacagcauucuuauucaggu

SEQ ID NO: 185649 - RNA, 87 nt, Homo sapiens
ccuguggcuuuagagauggugaauauucucaagcaacugaaagaagguuugugugacuggagcugagaugguaaggguaaggaaugu

SEQ ID NO: 185650 - RNA, 44 nt, Homo sapiens
uaaggaagcaagccuuccucugccuggcuacaaggugcgcgaga

SEQ ID NO: 185651 - RNA, 162 nt, Homo sapiens
auauugaauaaacaauucacugauggaacaauuuuuuuuuuuuuaacaaaaccuuguguugagggcugacuuucaauagauuguagugagggagcugcucugcuagguacaaaaccccaacccagaagcagguccuugauggaacaauuuugagagcaagau

SEQ ID NO: 185652 - RNA, 58 nt, Homo sapiens
uagcuugagaagucagaauuucaagugaccugugacagggccacuguggaagauggga

SEQ ID NO: 185653 - RNA, 41 nt, Homo sapiens
aagaauaaauuaauguacaugaacggaauaauacauaagaa

SEQ ID NO: 185654 - RNA, 40 nt, Homo sapiens
guuaucaauuuuucuaaugccaagauacuagugagaaaca

SEQ ID NO: 185655 - RNA, 37 nt, Homo sapiens
uauucauuagcacuuuccucauuuucuacuaccuccu

SEQ ID NO: 185656 - RNA, 59 nt, Homo sapiens
ggauggagacauuaguaagguagaaggugucugaggggcuucuucaugauaaaaagcaa

SEQ ID NO: 185657 - RNA, 58 nt, Homo sapiens
acugggaagcucaccuuguguaggagccuaagaacucuggagugaccagguauaagga

SEQ ID NO: 185658 - RNA, 43 nt, Homo sapiens
cuuagcuugucagaggcagacacaaauggguuggcccaaaguc

SEQ ID NO: 185659 - RNA, 56 nt, Homo sapiens
gaaggaugaccuuuaacccuucacaauaccuggcacauugcuuugcaguaucagac

SEQ ID NO: 185660 - RNA, 43 nt, Homo sapiens
cuuuaaaaguacauaauucagugguuuuuaguauauucacaag

SEQ ID NO: 185661 - RNA, 49 nt, Homo sapiens
cuggaguggguguccucguagguucccccaucccacccagagcggcaga

SEQ ID NO: 185662 - RNA, 70 nt, Homo sapiens
cauauuggugaugccuuuuguuacuuucuguuauuucaaaagcagcaccaauccccuguugccaaaacaa

SEQ ID NO: 185663 - RNA, 67 nt, Homo sapiens
aaaacucuugggccagcuggggaguggggcguaggaccuuuuauuuggaggccucacugugugacag

SEQ ID NO: 185664 - RNA, 35 nt, Homo sapiens
cugauugaaucaguugugauggguaguauuguaaa

SEQ ID NO: 185665 - RNA, 42 nt, Homo sapiens
gguucauuguugugauaccuuucaaaaauguuugauuaaaaa

SEQ ID NO: 185666 - RNA, 50 nt, Homo sapiens
uaguccugggcgggaaggauagggagaagaaguaaguuacgggaagucag

SEQ ID NO: 185667 - RNA, 52 nt, Homo sapiens
agaaaacaaaccacaaagcaaaccacuguauuuuuuaacacuacccagaaac

SEQ ID NO: 185668 - RNA, 39 nt, Homo sapiens
uucacauaaaaaugagcuacagaaagguauugagaucaa

SEQ ID NO: 185669 - RNA, 140 nt, Homo sapiens
aauuaaagcauggcaagugcuaggaagaagugcagguuuuuauaaagaguaugacccauccugagaguaacagaaaggccucuuugaggaagugguauuuaagauagaacuugaagaaugaauaauagcuaaccagggag

SEQ ID NO: 185670 - RNA, 46 nt, Homo sapiens
gaugcucaccugguagagguuaucgacugccaacaagugccuuggu

SEQ ID NO: 185671 - RNA, 57 nt, Homo sapiens
uaugcugguaguugguuaucuuaaauaugaaugaacaaauauguauuccuugguaga

SEQ ID NO: 185672 - RNA, 43 nt, Homo sapiens
uuccauaaagugaugggaaugaaagaccgauuaggguggguuu

SEQ ID NO: 185673 - RNA, 126 nt, Homo sapiens
ucacagcuggauacuccaccaucaccucaaccucaaggugucccaucuuagacaaggcagcaugagagaagaagaacauuuuuuuuuaaguuaaaaaaaaaaaaaaggucccagaaucggccucac

SEQ ID NO: 185674 - RNA, 13 nt, Homo sapiens
agggaaaauagca

SEQ ID NO: 185675 - RNA, 46 nt, Homo sapiens
agaaauucuaaaaauugauggcucuaacacuguggaccauaagaau

SEQ ID NO: 185676 - RNA, 33 nt, Homo sapiens
aacugccucuuauuuuaggcuguagauaaaaua

SEQ ID NO: 185677 - RNA, 47 nt, Homo sapiens
uuauuuuuuacaugcugaauuagccucgaucuuuuugauuaagagca

SEQ ID NO: 185678 - RNA, 113 nt, Homo sapiens
guuuuagggauaaaaugguacccggccaacaucaagugacuuuauagcugcaagaaaugugguauguggagaaguucuguaugugaggaaggaaaaaaagaaaauaaaagugu

SEQ ID NO: 185679 - RNA, 42 nt, Homo sapiens
ccagauagggaccggugaacaccugauuccaaacauguagga

SEQ ID NO: 185680 - RNA, 48 nt, Homo sapiens
aggugugugguacaugacauuggguuacaucauaacgugcuuccagau

SEQ ID NO: 185681 - RNA, 45 nt, Homo sapiens
uuugggacgaguuauguucaaaaucacagcacgugcauaguauga

SEQ ID NO: 185682 - RNA, 61 nt, Homo sapiens
cuuugcuccuaacaacacugggaaagaaguaacaguugagugcaagauugauggaucagcc

SEQ ID NO: 185683 - RNA, 40 nt, Homo sapiens
guuacuuccuacccuuuccacauauucaucaucuggauca

SEQ ID NO: 185684 - RNA, 28 nt, Homo sapiens
cauauauuaagguaaaauagguucaaca

SEQ ID NO: 185685 - RNA, 45 nt, Homo sapiens
gauuaaagccugaaggagugccaaggauagauuguguuucaaagg

SEQ ID NO: 185686 - RNA, 42 nt, Homo sapiens
auucucaaggaaacccuuguauucuugugaaaaugaacagag

SEQ ID NO: 185687 - RNA, 45 nt, Homo sapiens
ccaguuuauguugcaugucaguuuccuauuucauuacuucaagca

SEQ ID NO: 185688 - RNA, 33 nt, Homo sapiens
gguuuuuacaugcagaguggucugggaaagccu

SEQ ID NO: 185689 - RNA, 46 nt, Homo sapiens
auucaguaggucugauccaacuucguaugcaggguacauugaagac

SEQ ID NO: 185690 - RNA, 48 nt, Homo sapiens
uguuggugguuauacuccaaauucaguaugugaaaaccacauuuuaau

SEQ ID NO: 185691 - RNA, 45 nt, Homo sapiens
aacuucaguguguauaauuccaaagacuguaaacuaacugcuaua

SEQ ID NO: 185692 - RNA, 27 nt, Homo sapiens
cccugauguaauucgauuucuuugaaa

SEQ ID NO: 185693 - RNA, 94 nt, Homo sapiens
uacccugugugcaggcuauaaacgcaggccaaugguacauguggugacagcagcagaagagaagggcagguacugagccauuaucuagcaggag

SEQ ID NO: 185694 - RNA, 220 nt, Homo sapiens
uguaagaugguguucuuuguccuguggagugugccauuaacccauuuaugcuggagguugcaauuuuuaaaauuuuugcaaugagaccuuggcaaggacauugagcaguaggauauaacucccacaugcuuagcguuccaguaauggaacacaggcauaaauggaagcuuuacaaacuuuacaaaaaugugcaucacugggaaaguaacaggacuugccu

SEQ ID NO: 185695 - RNA, 55 nt, Homo sapiens
aauuguucugcuuuggagaucaggcuucaucccaucuggggcaucugacaguagg

SEQ ID NO: 185696 - RNA, 40 nt, Homo sapiens
ccaggaaggauucuuuuuuuaauucucuugaagggacugu

SEQ ID NO: 185697 - RNA, 42 nt, Homo sapiens
cuggcgggaggcggcagcggcgcgggccgagcggcgcgggga

SEQ ID NO: 185698 - RNA, 49 nt, Homo sapiens
agguuuccuugguuuaaaauagggauaagaauaacacuuaucucauaag

SEQ ID NO: 185699 - RNA, 26 nt, Homo sapiens
ucacaaugagauaaaagaaccugaag

SEQ ID NO: 185700 - RNA, 44 nt, Homo sapiens
cugaccucuuacagcuggguuuaacuccugcaguuacacagggc

SEQ ID NO: 185701 - RNA, 24 nt, Homo sapiens
uccaggaaggaaagaaaaggauga

SEQ ID NO: 185702 - RNA, 87 nt, Homo sapiens
uaaauggcgauuagauuucgauuaucccagauaaucuguuuacucuucagucaugacugugaaauaccaucucucagagcuaaaguc

SEQ ID NO: 185703 - RNA, 46 nt, Homo sapiens
aaguuauucaauacaauuguaaaaucaaguaugagcugccccacug

SEQ ID NO: 185704 - RNA, 44 nt, Homo sapiens
aauuuaauuuauuaaauuaagucaguauguaaauuguccuuaaa

SEQ ID NO: 185705 - RNA, 48 nt, Homo sapiens
aggauuucaggcaaauucuuucuaauguugauguuaagagaguaauca

SEQ ID NO: 185706 - RNA, 57 nt, Homo sapiens
aaucuaauuugauaugguuggaggaaaauucacuguaaggcaguccacuuuagggcu

SEQ ID NO: 185707 - RNA, 46 nt, Homo sapiens
ucuguaccauaaauuuggaccaggaagaaguuuaucguacccaagu

SEQ ID NO: 185708 - RNA, 47 nt, Homo sapiens
gaaggugguuuggaauugaggcauugcauguuuagagguagccaggg

SEQ ID NO: 185709 - RNA, 47 nt, Homo sapiens
aucagaugguuuuucugggacuuguuaaauuugaaaugccuacugga

SEQ ID NO: 185710 - RNA, 49 nt, Homo sapiens
gaggucugcuggauuugcuaagagacuggguaugggaguuuggggaaau

SEQ ID NO: 185711 - RNA, 58 nt, Homo sapiens
aaugaaaaaaacuaaacacugaccgggguugggggaauggaaggagaagagaucagag

SEQ ID NO: 185712 - RNA, 36 nt, Homo sapiens
ugaaugauaaggcacucgccauugaagauaucuagg

SEQ ID NO: 185713 - RNA, 51 nt, Homo sapiens
acaagaaguagagaaguaggauaagagggcaaguugcagguuuaggcugug

SEQ ID NO: 185714 - RNA, 41 nt, Homo sapiens
gagauuaaaaaggguguauucaugcuaagaguucauuuuua

SEQ ID NO: 185715 - RNA, 54 nt, Homo sapiens
ugaguucugucauuugaacauuuuaguuuuaaaaacgacccuuuggugucaggu

SEQ ID NO: 185716 - RNA, 46 nt, Homo sapiens
cugguauccaucuaaacauucccacccaggguuauucaugcuagag

SEQ ID NO: 185717 - RNA, 50 nt, Homo sapiens
aaacagcucaaaggagacgcggcccaagggcucgccgucgacggcaaugu

SEQ ID NO: 185718 - RNA, 68 nt, Homo sapiens
augcuuuaggaugaaguucucaucuucaaauuucuccccauagauggacuugccaccagugccauuau

SEQ ID NO: 185719 - RNA, 45 nt, Homo sapiens
cccaaagcgcuccauggccuccacaauauucaugccuucuuucac

SEQ ID NO: 185720 - RNA, 44 nt, Homo sapiens
guuaagauaaaacacaagucaaacuuauucgaguuguccacagu

SEQ ID NO: 185721 - RNA, 47 nt, Homo sapiens
uuacgucuuccagacuuaagcucaucaaauugcgcggguggggggca

SEQ ID NO: 185722 - RNA, 31 nt, Homo sapiens
ccccaaccccccaaggaggagaguggggcgc

SEQ ID NO: 185723 - RNA, 43 nt, Homo sapiens
ggccgggccccaaacgccccagggcugcgcgcaaaucaaccau

SEQ ID NO: 185724 - RNA, 42 nt, Homo sapiens
cacggccaggggcgcguccucacggcugaugcccggcagcag

SEQ ID NO: 185725 - RNA, 78 nt, Homo sapiens
auugacuuuagguccauuacgcagucauuugcuaacccaaucccucucugugccagguaccaggcagagucuagaugc

SEQ ID NO: 185726 - RNA, 64 nt, Homo sapiens
aggaaggaagccacagugaggaagaggaggggaugaagauucaaaguacagcuggccacaagga

SEQ ID NO: 185727 - RNA, 56 nt, Homo sapiens
gagcacuggacagugcuauugugaacuguguaauggaagggggagugacaugggag

SEQ ID NO: 185728 - RNA, 54 nt, Homo sapiens
augaagaacuugacaugccuagguggcagaugcagcuuaugguucaaguggguu

SEQ ID NO: 185729 - RNA, 74 nt, Homo sapiens
ccauccaauaaagcaaaaaauuuucuuuucaaugcauacgguucauucaccaacauagacuauauacuggguca

SEQ ID NO: 185730 - RNA, 23 nt, Homo sapiens
caaaucuuguauaucuuuacuga

SEQ ID NO: 185731 - RNA, 48 nt, Homo sapiens
auuuuguuucuacaaggaguagcauaaaaaucaguguguagguuaaug

SEQ ID NO: 185732 - RNA, 47 nt, Homo sapiens
ugaacuguacuuaucagcuccaaagggggucccuagauuacuaacag

SEQ ID NO: 185733 - RNA, 53 nt, Homo sapiens
uuuaagugcuaaaaaucaauccauuucuugcccuucaauaauuguccaugccu

SEQ ID NO: 185734 - RNA, 26 nt, Homo sapiens
auuagauuaucugugagauagcauua

SEQ ID NO: 185735 - RNA, 46 nt, Homo sapiens
uuggacauuguuuauuugugcaacaacuagaaaggagcaaugaagu

SEQ ID NO: 185736 - RNA, 61 nt, Homo sapiens
guaaaacuuguguugaccuuuagugcauuauauucagcuuuuaacaguauuauguauguac

SEQ ID NO: 185737 - RNA, 46 nt, Homo sapiens
gugccauuucuacugccuaauacagugccauuugccuugugaagac

SEQ ID NO: 185738 - RNA, 49 nt, Homo sapiens
acaguguucauaacauuuuucuggguuuuaaauauguuguuucggauau

SEQ ID NO: 185739 - RNA, 47 nt, Homo sapiens
uuuaaauuuaauuauuuggcaguagucacuguuuuugacaaccaaug

SEQ ID NO: 185740 - RNA, 42 nt, Homo sapiens
ugacaacucaucuagugagacagauuccaaacacagccauua

SEQ ID NO: 185741 - RNA, 46 nt, Homo sapiens
gugggaaugaugcuagcugcugccaccucaaaaacuugugccacaa

SEQ ID NO: 185742 - RNA, 39 nt, Homo sapiens; identical to SEQ ID NO: 116560

SEQ ID NO: 185743 - RNA, 46 nt, Homo sapiens
guagggucuugccaucucaacucuccuacuggcuuuagaauagaga

SEQ ID NO: 185744 - RNA, 69 nt, Homo sapiens
ucucuauucuaaagccaguaggagaguugagauggcaagacccuacgcagcacugcuuuuggccuacuc

SEQ ID NO: 185745 - RNA, 40 nt, Homo sapiens
ugcaaaccucagagguucuaaaguguagggccuuuggugu

SEQ ID NO: 185746 - RNA, 43 nt, Homo sapiens
uauucauuuugcuuuuaaaagaaucuguuaguuaaggacagaa

SEQ ID NO: 185747 - RNA, 46 nt, Homo sapiens
auucauuuugaauguagugauuugggaugcuaaucaaaccccaggu

SEQ ID NO: 185748 - RNA, 41 nt, Homo sapiens
cuuaaacacauacaaaaacucaaaaguucaaaaagucacaa

SEQ ID NO: 185749 - RNA, 62 nt, Homo sapiens
agcuaggaagguggcaaguaaaacauaugcacuauccuagaaacauacuguuccagguagau

SEQ ID NO: 185750 - RNA, 77 nt, Homo sapiens
uuccuaacaacauuuauaaaaauuuauuguacuauuguaaaguuuuuuauauauggguuuuuuuccagccucaaauu

SEQ ID NO: 185751 - RNA, 45 nt, Homo sapiens
aauuaugaaaaugucacaaaauuaaaaugcaaaauaaaaaguaau

SEQ ID NO: 185752 - RNA, 46 nt, Homo sapiens
uuaaggcagaauugaucuucuuuuagguaaguauuuagauucugaa

SEQ ID NO: 185753 - RNA, 42 nt, Homo sapiens
auaagaauuuguaagccucuaaaguugagcuauaaauuuuca

SEQ ID NO: 185754 - RNA, 46 nt, Homo sapiens
ucucauacuuguucagagguuauugcacuguacacuuacuguguag

SEQ ID NO: 185755 - RNA, 52 nt, Homo sapiens
cuguuaaacacuuuugguuuagaaauaaagugaaucaauuugaccuauauac

SEQ ID NO: 185756 - RNA, 66 nt, Homo sapiens
acacuggcuauguguacaugcuuacuauagaaauguuuccaggaacucucuguuucugucaucacu

SEQ ID NO: 185757 - RNA, 49 nt, Homo sapiens
ucaucaguugacauuuuuguagucaggaguuuacaugcuaggguacaag

SEQ ID NO: 185758 - RNA, 32 nt, Homo sapiens
ggaauuguuuugucuguuuaaggauaauguga

SEQ ID NO: 185759 - RNA, 50 nt, Homo sapiens
aaugcauuguuuauuccucuucccaacuuggcaucaaguguaucuuaugu

SEQ ID NO: 185760 - RNA, 46 nt, Homo sapiens
uuuuuuaggauggucaccuaaaauuagaauuucuggauaaaagggc

SEQ ID NO: 185761 - RNA, 68 nt, Homo sapiens
uuaaggaacaguguauuuauagauaagaguuuuaaauguuaaaauucuauaaauggaccugagauuuu

SEQ ID NO: 185762 - RNA, 73 nt, Homo sapiens
uugcuguuagaaauuaacaguaguaauaugaauacaaaggcuauguuucauaaugugagggagaagguauagu

SEQ ID NO: 185763 - RNA, 108 nt, Homo sapiens
aucuacuuacuuuuucuaguuauaaacagcuaauuauacaguuaaauacucaguauagcaacgguuaacugaguggcaggagaaauaacaggccaaccauucugguac

SEQ ID NO: 185764 - RNA, 49 nt, Homo sapiens
auuaccacagauugccccuccuuaaaauucuucuuuugaccucugugau

SEQ ID NO: 185765 - RNA, 57 nt, Homo sapiens
aaaagguuucaucagccuuuucuuuuuucaaacuuguuuacauaaguacaugaauag

SEQ ID NO: 185766 - RNA, 46 nt, Homo sapiens
ugggugaaaaauggacacuuuuauuucaauugcuucaucuauaaaa

SEQ ID NO: 185767 - RNA, 52 nt, Homo sapiens
uuacuuauuuggaggauuauaaagaguuuucuuaucaaaaaugccuucggug

SEQ ID NO: 185768 - RNA, 46 nt, Homo sapiens
aguuuagccuccuguuuagauuugcuccuucuaaaucauuuggaga

SEQ ID NO: 185769 - RNA, 41 nt, Homo sapiens
gccccgaaucccgagcggcgcccagcccggaagacccggcg

SEQ ID NO: 185770 - RNA, 49 nt, Homo sapiens
uacacacacacacacacacacacacacgcacaugcauacacacacaggc

SEQ ID NO: 185771 - RNA, 45 nt, Homo sapiens
gggauucugcggaagugcugcuucccccaugucuguugggugcag

SEQ ID NO: 185772 - RNA, 60 nt, Homo sapiens
gcagaccccaccgggguccucgucaucucccagcccagcccgcagagcgaguaccggcag

SEQ ID NO: 185773 - RNA, 49 nt, Homo sapiens
cggaaagacuacagaucuuaacgaucagccuucgcuccuaauguauuug

SEQ ID NO: 185774 - RNA, 44 nt, Homo sapiens
cugucauuguguauggaguacaguaagggaacuagaauucaggg

SEQ ID NO: 185775 - RNA, 47 nt, Homo sapiens
ccuguuucagaacauucucugaaacuauuaagacaguugauaggaag

SEQ ID NO: 185776 - RNA, 55 nt, Homo sapiens
uuucauuuuuaaauguuugauuuagugugaaagguaacagauugcuacuucaguc

SEQ ID NO: 185777 - RNA, 44 nt, Homo sapiens
gauauuuucaguaauauauucauacaucuuguuucagugauagc

SEQ ID NO: 185778 - RNA, 98 nt, Homo sapiens
cugaaugccgugaaguuaaacagagccaaagggaaggaggccaugcauaccuguuuaaaacagagugcuuaccgggaagcccucucugaccugcaguc

SEQ ID NO: 185779 - RNA, 58 nt, Homo sapiens
cagguaagauguacacauuuuagacuucuuggaauaaagaauuaacuaauuauagaau

SEQ ID NO: 185780 - RNA, 37 nt, Homo sapiens
uagugaauauuauuuaguuuaaugaggagacuguauu

SEQ ID NO: 185781 - RNA, 45 nt, Homo sapiens
guugaauccaaugggaacuguucaaacaaauccauauacugaaaa

SEQ ID NO: 185782 - RNA, 44 nt, Homo sapiens
uuuaaaggacaauugagaacuggagacauaauauuacacagcug

SEQ ID NO: 185783 - RNA, 72 nt, Homo sapiens
guuuuggauaaaguaaaaacgaagaaaucaacgaaaacuauuaaucccucuaaauaucagaccaucaggaaa

SEQ ID NO: 185784 - RNA, 68 nt, Homo sapiens
cacuggaauuugauauuaauauuugugacuuaccaagaauggcucgauuauguuuugcuguuuaugca

SEQ ID NO: 185785 - RNA, 40 nt, Homo sapiens
uuauauggugggaacuuauuugucuuuauuucucaauguc

SEQ ID NO: 185786 - RNA, 47 nt, Homo sapiens
auucaucuaaucuuccucuuccauuaccaccaaagaaaacacgaauu

SEQ ID NO: 185787 - RNA, 55 nt, Homo sapiens
aacugugugaugaacagagcccugccccauuuuauacuuguggaaugcugcaaga

SEQ ID NO: 185788 - RNA, 45 nt, Homo sapiens
uuauagcugcuuucuauuucaucauauaguauaaacgugaaauau

SEQ ID NO: 185789 - RNA, 50 nt, Homo sapiens
guaaaugaauuggcaauccaaaaacguuugacuauucaugggaaggaaga

SEQ ID NO: 185790 - RNA, 44 nt, Homo sapiens
gugauauucuguacacguaucuguuuugauacaguggaauggug

SEQ ID NO: 185791 - RNA, 53 nt, Homo sapiens
ggggaaagcucaucguagcuguucauuuugaaaacugccagguaggauuauau

SEQ ID NO: 185792 - RNA, 45 nt, Homo sapiens
auugucuuggauggacuggcuaaaacaaacauauccaccagagca

SEQ ID NO: 185793 - RNA, 35 nt, Homo sapiens
ccaguuuuaugcauaguauaguacauuuuaaguau

SEQ ID NO: 185794 - RNA, 44 nt, Homo sapiens
gcauagcaugaccuuucaaaacuguuuucuuugcugcaagcauu

SEQ ID NO: 185795 - RNA, 51 nt, Homo sapiens
agcauuuuagagcuucauguuguguuugagaauggaggcccagagaaggag

SEQ ID NO: 185796 - RNA, 48 nt, Homo sapiens
cuaaagccaaaaugacuuaagaagcaaaaaucuaauuuacaccccuga

SEQ ID NO: 185797 - RNA, 43 nt, Homo sapiens
ggcagggaugggggcgccggaguggagcgguugcggcggccug

SEQ ID NO: 185798 - RNA, 56 nt, Homo sapiens
acuuuaaaguuccagaccuuuguccugucacagccuguaguggggaaaaggcugcu

SEQ ID NO: 185799 - RNA, 60 nt, Homo sapiens
uagauuuggauacccagcuaaaugucuuaacaagguagggagaggaaagauaagaaggag

SEQ ID NO: 185800 - RNA, 43 nt, Homo sapiens
guuaauuuuaguugugucuaccacguaguuaaacucugugauc

SEQ ID NO: 185801 - RNA, 58 nt, Homo sapiens
ugcgccgcugccugcagugcuggggugggugucggcggcgcugagggcgggggcggcg

SEQ ID NO: 185802 - RNA, 40 nt, Homo sapiens
ugauuggucaguagacgggggcacaugccaaacaccacag

SEQ ID NO: 185803 - RNA, 49 nt, Homo sapiens
cauccuccucuacaauuguagguuuuccuuccuucuuuguuuuuuucgc

SEQ ID NO: 185804 - RNA, 54 nt, Homo sapiens
aucacaaaggaugagacagaauuugaaauuguugguggaagaaacaucauguca

SEQ ID NO: 185805 - RNA, 132 nt, Homo sapiens
agggcugaggcagaggauuccuucuggauguaacccaugguacuagaguagccaugagucacauccguuuuuuauuucauuucaauuucauuauuucauuucaauuucauuucauuucauuuuucaucuuau

SEQ ID NO: 185806 - RNA, 43 nt, Homo sapiens
aaucauguuuuuaaaaaauaucuuauaggugaagugccagcau

SEQ ID NO: 185807 - RNA, 46 nt, Homo sapiens
aacuauugcuucuuugcaaauggaagucuguagauuaaaaaaggag

SEQ ID NO: 185808 - RNA, 31 nt, Homo sapiens
ugauaacuuaugaaaggaacaagagcacaug

SEQ ID NO: 185809 - RNA, 19 nt, Homo sapiens
cagugauuguguuuucuga

SEQ ID NO: 185810 - RNA, 29 nt, Homo sapiens
ggguccaaauuaagaaacuacaugagauu

SEQ ID NO: 185811 - RNA, 60 nt, Homo sapiens
ggauagugcugauguuuguacaugugugaaaauauuaaaacuacugaauuguauacuuag

SEQ ID NO: 185812 - RNA, 34 nt, Homo sapiens
gcuguuauauaacauauucaaaaccaaaauucaa

SEQ ID NO: 185813 - RNA, 82 nt, Homo sapiens
aaugaugguuacauauauauuuuuuuaaccuguguaauuauguuuuauuaauuuuauaaaacauauaauauauaaaacuuau

SEQ ID NO: 185814 - RNA, 46 nt, Homo sapiens
gcuuaauuugaagaagcaggaugaaaaugaagguaucaaaguugaa

SEQ ID NO: 185815 - RNA, 42 nt, Homo sapiens
aauucucuguuaaaauauccuuuuauuucucuuuugcagaua

SEQ ID NO: 185816 - RNA, 39 nt, Homo sapiens
aaggaaaaaauauaugcauauuguagauauaauaucaga

SEQ ID NO: 185817 - RNA, 43 nt, Homo sapiens
guccaaaggggguacagucggagauuuguuuugggagagucgg

SEQ ID NO: 185818 - RNA, 26 nt, Homo sapiens
gaaaugcaaggacagcacuuugcccu

SEQ ID NO: 185819 - RNA, 59 nt, Homo sapiens
aaccccuacucaggucugaccagcggugcgcuauauucagagccagccagggauaggag

SEQ ID NO: 185820 - RNA, 76 nt, Homo sapiens
uaucuugucaagcauuuaucaugauacugcugaccagaagugacugcuguguagcuguaauuugucauguaauuga

SEQ ID NO: 185821 - RNA, 85 nt, Homo sapiens
aacuaaaagagacugucuacugcauugggcagcguaaauucagcaccauggaagaacuuguagaacauuacaaaaaggcaccaau

SEQ ID NO: 185822 - RNA, 62 nt, Homo sapiens; identical to SEQ ID NO: 116731

SEQ ID NO: 185823 - RNA, 35 nt, Homo sapiens
ucuggguauuuuaaaaaaaagagagagagaaaugg

SEQ ID NO: 185824 - RNA, 53 nt, Homo sapiens
agucaccaggcaucaagcagaaauggcauuaaaugaaagaggacaugaagggg

SEQ ID NO: 185825 - RNA, 80 nt, Homo sapiens
accucaacaugcccgcuuaugugaaauuuaacuacauggcugagagagaggaugaauuaucauugauaaaggggacaaag

SEQ ID NO: 185826 - RNA, 75 nt, Homo sapiens
auucggggaagucaaagaagaagaaaacauaauggagagagugggcugugaucuugguugcugcauauagaguuu

SEQ ID NO: 185827 - RNA, 26 nt, Homo sapiens
guugauuuagggguauagacuggauu

SEQ ID NO: 185828 - RNA, 46 nt, Homo sapiens
ccaaaugcuggcauccaguauaucaaggauuugcaaaccaggucac

SEQ ID NO: 185829 - RNA, 77 nt, Homo sapiens
auucucaacacuuacucagugauacaggugaaggaaaaacaacaugcuuaaacuaaagaauacugaaaucacuaaua

SEQ ID NO: 185830 - RNA, 51 nt, Homo sapiens
gcacaacaagccuaaggaaacaaagaguaaccugacaagagauuccagaga

SEQ ID NO: 185831 - RNA, 41 nt, Homo sapiens
uaauuuagaggaaaaaaaaguuuuggaaagagaagccucag

SEQ ID NO: 185832 - RNA, 43 nt, Homo sapiens
aguccagcuuuuacauuagauaaacuuuucccuuuucucauaa

SEQ ID NO: 185833 - RNA, 53 nt, Homo sapiens
uuugcguaauuguucuuugucuagguguagaagaaaaguacaauuucuccuug

SEQ ID NO: 185834 - RNA, 41 nt, Homo sapiens
gauagguuuuguaaccuuucuucuguauuaacauacaaguu

SEQ ID NO: 185835 - RNA, 36 nt, Homo sapiens
gucucaccuucccgcugccgagccgggcagcuccag

SEQ ID NO: 185836 - RNA, 45 nt, Homo sapiens
uaucaucuuacugguugaaugguaaaccauuacuauuagagaggg

SEQ ID NO: 185837 - RNA, 42 nt, Homo sapiens
cccagagucuguccccagacauugcaccuggcgcuguuaggc

SEQ ID NO: 185838 - RNA, 46 nt, Homo sapiens
uuaagaucacgcagaacaacgccaugaagaucuccuuugccaagaa

SEQ ID NO: 185839 - RNA, 45 nt, Homo sapiens
cuucguggagcgggaccgcaagcgggagaagaggaagcccaagag

SEQ ID NO: 185840 - RNA, 43 nt, Homo sapiens
uaggagagaauuggaguuuaauuaguauacugugugugugugu

SEQ ID NO: 185841 - RNA, 45 nt, Homo sapiens
cuggcagggguuucuacaagguaccagaugacuugcuucccuggg

SEQ ID NO: 185842 - RNA, 45 nt, Homo sapiens
uuacuuuauuggaggaagcagcacaccagaaaaagugacugaaga

SEQ ID NO: 185843 - RNA, 48 nt, Homo sapiens
uggcuagaaugcuguggaacaaauacaaagugaaaaaaguucucugua

SEQ ID NO: 185844 - RNA, 37 nt, Homo sapiens
gugugacacacaguuuuggaaaaaggucugugguagu

SEQ ID NO: 185845 - RNA, 74 nt, Homo sapiens
aacuuucagaaacuuauguuuuuauaacacuuaaagcauguauuuuaaaaauauauuuuuagacggcuucauuc

SEQ ID NO: 185846 - RNA, 60 nt, Homo sapiens
gauuagugugauaaauauuuguuaaauaauuuacaaaauaauggaaucacaaaaacuuac

SEQ ID NO: 185847 - RNA, 73 nt, Homo sapiens
ugaaggcacuucucauaaucacagcacugguagguuuucuuucuguuaaacugaguaaacuuauauguuuuga

SEQ ID NO: 185848 - RNA, 46 nt, Homo sapiens
aucaaguccucauugacaguaugggucugaagaauacaccaucauu

SEQ ID NO: 185849 - RNA, 41 nt, Homo sapiens
ugcuccagaaccuuucuucaagagugacacaucauugauau

SEQ ID NO: 185850 - RNA, 73 nt, Homo sapiens
cagcaugguauccugugguagaccuugaggugaccuuggggucagccaguucuggguugcaaguccaccuuca

SEQ ID NO: 185851 - RNA, 46 nt, Homo sapiens
uuaacaggccuuuauagagacacucagacguccauuacugacagcu

SEQ ID NO: 185852 - RNA, 40 nt, Homo sapiens
uucuauugaaccagauacaaaacuaggaaacugccagacc

SEQ ID NO: 185853 - RNA, 52 nt, Homo sapiens
gguauuuuaagcaauaauuauuaaaaacagaagugcuacaucaccugucuuu

SEQ ID NO: 185854 - RNA, 36 nt, Homo sapiens
aaggucccuuacacauuuuuuaagacagagcagagg

SEQ ID NO: 185855 - RNA, 45 nt, Homo sapiens
cuuacuuccggcuuucuacaugcuuggcaguugacugcagggaug

SEQ ID NO: 185856 - RNA, 45 nt, Homo sapiens
auucuugcauucccaaucauuuaacaauuauagaaaaaacaauac

SEQ ID NO: 185857 - RNA, 42 nt, Homo sapiens
cgacgccucagccccgcggggucgccgaggcgugcgcggcga

SEQ ID NO: 185858 - RNA, 78 nt, Homo sapiens
ggaaaacccuuauucuaagcagaggaaacaccaaagaagacgaccuugaggcaagaaugugaauuugguguuuucuaa

SEQ ID NO: 185859 - RNA, 42 nt, Homo sapiens
caaaacacgagaagaacugaaagauacucuugaaucugaaau

SEQ ID NO: 185860 - RNA, 42 nt, Homo sapiens
aguacuggagaacagacgacgcggaugcucauuuccuaacaa

SEQ ID NO: 185861 - RNA, 38 nt, Homo sapiens
gguaaggauauguuaaggcgaguggaggagcguacuag

SEQ ID NO: 185862 - RNA, 59 nt, Homo sapiens
ccgcggcggcaccaggaacccgcggcagcggagcugcagggccccggcgggggaaaggg

SEQ ID NO: 185863 - RNA, 940 nt, Homo sapiens
uuagcgcgacuccauucaaacuacuacaaacacaaggugagugggccacagucuuuuauauacccagcuuucugacgggacaacuaauaagaaugagugaaaaucugauuagguaauguuuuguaaagacuuggcuuugcugcguucaaaugaaaccaguaauuucaaccaagccaacagaggugccugguagaggcuuuuaggccaccuaaauaaaagcuauuuaaaauugugaauauagggaagaaacaaaaccaauuaugaauagaagccauguauuugauaugccagugugugcuccugggaaugucugacagccauuggauuuauaccuauuuucccauccacucugacggaacugacaccuccccacauucuggugauaaagaugggaugauugggaaagugcccuccuuuuacggagcugggcccaacaugauuacugucaaauuccauuuagagugguuuuucccauacuugaaaaauaugcucauuaacuccacaaacauuuguggccauaugccuauguggaaaauugauuuuuucuaaauccucccugcuaacaugugauccaugagcagcagcaugggcaucaccugggaacugguuagaaaugcagaaucaggggccccacccauaccugcguuuuccagggaggacucacggguacauuauaguuggagcugccuccuggagacuguacugguucuugcgaggccaagucuugaccucgagguggcgcugcucuucuccuugcuaggccuccuggccucugguugcccagggccuaggugaaaugcaguuagagagcagggcuugugugcugaucucuccccucccuucacuuccuuucugccccggugaccaguacccucgccccagagacaccagcuucaguggccugucguuggaagaguacaagcugauccuguccacaggu

SEQ ID NO: 185864 - RNA, 30 nt, Homo sapiens
cagguugcagagccugaggccugugaucag

SEQ ID NO: 185865 - RNA, 38 nt, Homo sapiens
agaaaauccuugggaccaaaggaggguuaagagaagug

SEQ ID NO: 185866 - RNA, 26 nt, Homo sapiens
gcgaggcuccacaguccaggcagaag

SEQ ID NO: 185867 - RNA, 47 nt, Homo sapiens
auuauuauuauuauuauuauuauuauuauuauuugagaucuuggguu

SEQ ID NO: 185868 - RNA, 1025 nt, Homo sapiens
guauuuccuugggaaggcaugguauuguaucuuuuauuuauuuauuuuuuugauagggacuuucgcucuuguugcccaggcuggagugcaguggcuccaucucggcucacugcaaccuccgccucccgaguucaagcgauucuccugccucagccuccugaguagcugggauuacaggcaugcgccaccacaccuggcuaauuuuguauuuuuaguagaugcgggauuucuccauguuggucaggcuggucucgaauucccgaccucaggugauccgccgccucggccucccaaagugcugggauugcaggcaugagccacugcgcccggccuuucuuuuuguuuguuuguuuguuuuguuuuguuuuguuuuugagacugccucacucuuuccuaggcuggagugcaguggcguaaucuuggcucacugcugcaaccucgcugcuggauucaagcgauucucgugccucagccucccgaguagcugggauuacaggcacccaucagugugccugcuaauuuuuguauuuuuaguagaaaugggguuucacaauguuggccauguuggucucaacaucuuaccucaagugaucugcccaccucggucuccucggccucccagagugcugggauuacauaugugagccuccgcacccggcccuguuuuuuuguuuuguuuuguuuuguuuuuuuguuuguuuguuguuaagacaaaggucuuccccuguugcucaggcuggagugcaauagcaugcuuauaguucacuaaagccuucaucuucugggcucaagugaucuucccaccucaaucuccaaaguaguugggccuacaagcacucgccaacuuacuuggcuauuuuuauuuuuaguggagacaaguucucaccagguugcccaggcuggucucaaacuccugaacucaagcgauccucucaccuaggccucccaaagugcugggauuacagguguuagcuacugugaccggccgaaggcauaguaucuuuauuagaugacccuaguguuag

SEQ ID NO: 185869 - RNA, 33 nt, Homo sapiens
uauuauuuuccuuguugaugcuugaucaccaga

SEQ ID NO: 185870 - RNA, 45 nt, Homo sapiens
uaagaaauaugguguggaccucaucagauacacucaugcagcaaa

SEQ ID NO: 185871 - RNA, 42 nt, Homo sapiens
uacuauucguuacuuguccuugcaugacaacaaauacaucag

SEQ ID NO: 185872 - RNA, 34 nt, Homo sapiens
uuuaagagaagaugaagaaugccaagcaguagug

SEQ ID NO: 185873 - RNA, 55 nt, Homo sapiens
aagggauuuauuuuuauuugaauucugugucuguaauauugugcaguuagaguug

SEQ ID NO: 185874 - RNA, 42 nt, Homo sapiens
caaugauggcaagcucauccucauuuccaccaacggcagcuu

SEQ ID NO: 185875 - RNA, 46 nt, Homo sapiens
cacuggaggcuucauuuacuccagacucucaguuuauuaugauugg

SEQ ID NO: 185876 - RNA, 60 nt, Homo sapiens
ucaucuuaguggcugccuguugguaggguaaugguauucggccccuuuuuuagaugagaa

SEQ ID NO: 185877 - RNA, 50 nt, Homo sapiens
uggaugguaaacacacaggcccgauuaccuguuugcaauucaaccccaag

SEQ ID NO: 185878 - RNA, 80 nt, Homo sapiens
caacuggugguuucccuauuucaucuccuauuauuugaucucuggcugggcuggucuugccuuucauuuuuauucuuccu

SEQ ID NO: 185879 - RNA, 56 nt, Homo sapiens
agcacuccuuuuuuucccuuccuuuaaaaaaaagggggcggggggucugcuuuggu

SEQ ID NO: 185880 - RNA, 49 nt, Homo sapiens
gagggcggccagcaggaagaaacucagagggaacugagauaauaguggg

SEQ ID NO: 185881 - RNA, 50 nt, Homo sapiens
aaaagaaaauaauuacuuugaugagcgucuucaaaaggacucuuggugca

SEQ ID NO: 185882 - RNA, 44 nt, Homo sapiens
agcagcauguacauucaaauugaagaugcuugagagccccacua

SEQ ID NO: 185883 - RNA, 45 nt, Homo sapiens
gaggagccggugaagucaucaguuccgcacaucccuucuacccuc

SEQ ID NO: 185884 - RNA, 41 nt, Homo sapiens
uuguggcauuauccacaaccaucauguuucuuaggugccaa

SEQ ID NO: 185885 - RNA, 46 nt, Homo sapiens
ggugguaucaucugaagacuauguacacaauuuguggugggcaggg

SEQ ID NO: 185886 - RNA, 46 nt, Homo sapiens
aggccuguguuauaugucauauuuagcguuuuuauauaugaccuuu

SEQ ID NO: 185887 - RNA, 43 nt, Homo sapiens
gcauauaugugugugcguaugcauauaucucucaucuguaguu

SEQ ID NO: 185888 - RNA, 92 nt, Homo sapiens
cauggccuucuuagagcagagagaggaguaugucauuuuacuaaguuccuaaacaaacauuuaugcaggcaacacuccuugcagauccagaa

SEQ ID NO: 185889 - RNA, 51 nt, Homo sapiens
gguaaaucaaggcaucacaauuucuguucagcgggcaggaauaggcuguga

SEQ ID NO: 185890 - RNA, 48 nt, Homo sapiens
aaaguaauugcuuaaaaaaaaaaagugcuagcaauucacagccuauuc

SEQ ID NO: 185891 - RNA, 47 nt, Homo sapiens
aaauuauuucccguuguaauuauaauuacugcuuauuaaggaaaaua

SEQ ID NO: 185892 - RNA, 48 nt, Homo sapiens
gaaggguugaguaaacaguagaggaugcaaggcagccugagguaagug

SEQ ID NO: 185893 - RNA, 51 nt, Homo sapiens
cuuaccucaggcugccuugcauccucuacuguuuacucaacccuucaccag

SEQ ID NO: 185894 - RNA, 52 nt, Homo sapiens
caggcaaauggguuaccaaagcaauugccuucugccagacugggugcugggg

SEQ ID NO: 185895 - RNA, 53 nt, Homo sapiens
ccaggacuggcguuuggucgugcagaguaagccgagacucguggaggcugcac

SEQ ID NO: 185896 - RNA, 75 nt, Homo sapiens
acccucuggucaggguguaaccugccuccugagggcaguuuggcuaucucccuugcuuggcaguggcacuuaggg

SEQ ID NO: 185897 - RNA, 42 nt, Homo sapiens
aggaccuccucuucccccuuccaaauaauaaagucuauggac

SEQ ID NO: 185898 - RNA, 67 nt, Homo sapiens
gaaagaggugggagaaggagggagaagggagggggcagcaggaaggagaggaguagggggcugggcu

SEQ ID NO: 185899 - RNA, 42 nt, Homo sapiens
uaggugucacuugggggugcauccacuucugagggacaggaa

SEQ ID NO: 185900 - RNA, 43 nt, Homo sapiens
caggcugccucaccucugccauuccuucucccggaaugccagg

SEQ ID NO: 185901 - RNA, 41 nt, Homo sapiens
caaggauucugagggcuacaucuaugccaggggugcccagg

SEQ ID NO: 185902 - RNA, 40 nt, Homo sapiens
aggccucaaaggggucgugacuccaauguuccugggggca

SEQ ID NO: 185903 - RNA, 45 nt, Homo sapiens
ucaccauagucaggcuugggcuggacagugcggauacgcagguac

SEQ ID NO: 185904 - RNA, 54 nt, Homo sapiens
gcgcugagaggcgagcgugagcccagcgacaggagagugaggugggggcccugg

SEQ ID NO: 185905 - RNA, 42 nt, Homo sapiens
auguuccugggugagguggcccugggcagagagcaccauauc

SEQ ID NO: 185906 - RNA, 55 nt, Homo sapiens
gagcacagugaggugggagggagcaggccgggacaaggagggagugacgguuggg

SEQ ID NO: 185907 - RNA, 56 nt, Homo sapiens
gauucaucccagaacagauggggcugaaguucuaggaugccugaggucaccaagag

SEQ ID NO: 185908 - RNA, 56 nt, Homo sapiens
gaagggcagguggccaagaaggcccagaaggauggacugccugggcaggcugacag

SEQ ID NO: 185909 - RNA, 46 nt, Homo sapiens
aacaucuucagcaaggagauguucaagaacaccauggcccucaugg

SEQ ID NO: 185910 - RNA, 46 nt, Homo sapiens
uagaagaugcaaagaaggacuuugagaagaaauuucgggaaaagac

SEQ ID NO: 185911 - RNA, 34 nt, Homo sapiens
cggcaaccaugccagggcugaacuagcugacaca

SEQ ID NO: 185912 - RNA, 45 nt, Homo sapiens
acagcucuggguucuaagcuccgggaggauaaucuggccccaaga

SEQ ID NO: 185913 - RNA, 46 nt, Homo sapiens
ggggcaaauccaaggguggcggcaagaugaaugaggagaucuccag

SEQ ID NO: 185914 - RNA, 63 nt, Homo sapiens
cuagaauccaagacucugucccuuggcucugagaucguggcuguuuccuuuaguuucuggucc

SEQ ID NO: 185915 - RNA, 51 nt, Homo sapiens
ugccaggcacugccuuugcuguuggaagugcagagauaggcaggcggguga

SEQ ID NO: 185916 - RNA, 42 nt, Homo sapiens
acagccuagcuccaaggaagccugaggaggaggaggaggagg

SEQ ID NO: 185917 - RNA, 46 nt, Homo sapiens
aaaagaagcugcgcuuggccaagcucuaccuagagcagcuccguca

SEQ ID NO: 185918 - RNA, 42 nt, Homo sapiens
ggcugaggcccgugcauuugaggaggaccagguggcggggcg

SEQ ID NO: 185919 - RNA, 43 nt, Homo sapiens
gggguagcgaguggguagcgaguggugcuguaaaauacauaaa

SEQ ID NO: 185920 - RNA, 29 nt, Homo sapiens
gaauguggcagagaacuccuacguggaga

SEQ ID NO: 185921 - RNA, 44 nt, Homo sapiens
acacucuuauccuccuuauuuaaguccuucccaggcuaugcccc

SEQ ID NO: 185922 - RNA, 46 nt, Homo sapiens
agaaaauagucccuggcuccucuggcccugggagccuaaagggcag

SEQ ID NO: 185923 - RNA, 46 nt, Homo sapiens
cgcccuccaaguccagcuccucaaaagaggagccgcuggcaccuga

SEQ ID NO: 185924 - RNA, 64 nt, Homo sapiens
ccgugccagugggcacaugaaauggaucuggucuuccugguagaucuccagccgaggauaggca

SEQ ID NO: 185925 - RNA, 25 nt, Homo sapiens
acguuauuauucugcccggaaacuu

SEQ ID NO: 185926 - RNA, 50 nt, Homo sapiens
uuugugcuuucauuccugggggaagggagggaggugggguaaagccagag

SEQ ID NO: 185927 - RNA, 46 nt, Homo sapiens
ugauguagguguccaaggcaggauggacacggcggguagccagcca

SEQ ID NO: 185928 - RNA, 46 nt, Homo sapiens
cugggugccgggaaggagaacaccuugaagccaaauuucugguaga

SEQ ID NO: 185929 - RNA, 42 nt, Homo sapiens
guguguguguguuuacacacaugcuugcagggucaggaccug

SEQ ID NO: 185930 - RNA, 41 nt, Homo sapiens
uagcagcccagccacuagggccuguccacaggccagagcug

SEQ ID NO: 185931 - RNA, 90 nt, Homo sapiens
ggcugacaugucagccacacagagcuuccugagggcagagccaggucugauucaucuccagaguguagguguagaguagaaccuggcaca

SEQ ID NO: 185932 - RNA, 42 nt, Homo sapiens
cggcacguggagagguaacgugaauuuccccuauauucaaga

SEQ ID NO: 185933 - RNA, 46 nt, Homo sapiens
uuaguacgugacagcacgcaccccagcuaccuguucacgcugucag

SEQ ID NO: 185934 - RNA, 24 nt, Homo sapiens
cagcgugaacagguagcuggggug

SEQ ID NO: 185935 - RNA, 25 nt, Homo sapiens
ucagagcuggaagggguacugucgg

SEQ ID NO: 185936 - RNA, 53 nt, Homo sapiens
uagacuuuggccaagaagaaaaggcuguuggguauuucccuucucuucuggug

SEQ ID NO: 185937 - RNA, 46 nt, Homo sapiens
aguguauccgggagcugaguagccgucgauugcagaggugagcacc

SEQ ID NO: 185938 - RNA, 57 nt, Homo sapiens
gagccaaaacaguuaaguuuaguguugucaagaggacaggaagagggaggagggagg

SEQ ID NO: 185939 - RNA, 56 nt, Homo sapiens
cuuuccugguuccucucacucccaggguggcaaccaacuauaucugaggaccagag

SEQ ID NO: 185940 - RNA, 49 nt, Homo sapiens
cacuccagcuaaaaaugugaagaaaacguaaguggccaagacaagaaug

SEQ ID NO: 185941 - RNA, 55 nt, Homo sapiens
gacgcugggcaagucgcuucccuucucugacccuacuuguaucugaagauguggc

SEQ ID NO: 185942 - RNA, 55 nt, Homo sapiens
gagaccuggccgguaccauucuccauagugcagauggggaaacaggguuggagag

SEQ ID NO: 185943 - RNA, 49 nt, Homo sapiens
gccguggauacggacagugaacagguagaccagguugaaggaagccaug

SEQ ID NO: 185944 - RNA, 46 nt, Homo sapiens
ucuucuggcauaucuuuaccuucaccaggaggcugugcaccaaguu

SEQ ID NO: 185945 - RNA, 46 nt, Homo sapiens
ucuucaucaucauccaugcugggccagauggacuggucuuccacuc

SEQ ID NO: 185946 - RNA, 55 nt, Homo sapiens
ggggggcuugggaggggaggugccacacucaagguggucuggaguuacagcgucg

SEQ ID NO: 185947 - RNA, 36 nt, Homo sapiens
auuuuuggcaaauccuugccuuggcucagggcucuc

SEQ ID NO: 185948 - RNA, 42 nt, Homo sapiens
ugcaaugucucagcuuucugccuagaggugggugaagccuca

SEQ ID NO: 185949 - RNA, 571 nt, Homo sapiens
cauuugaccuggguccugggucuucauuacucugauucaagucucuuuuuuuuuuuuuuuuuuuuuuuggagauagucucucucugucacccaggcuggagugcaguggccugaucucggcucacugcaaucuccgccuuccggguucaagcaauucuccugccucaggcuccugaguaacugggauuacaggcaccugccaccacacccagcuaauuuuugguuuuuugggggguuuuuuuguuuuuggguuuuuuuuuuuuuuugggacagagccucgcucugucgccuagguuagagguuagagugcaguggcgcaaucuuggcucacugcaaccuccgucuccuggguucaugcgauucuccugccucagccucccgaguagcugggacuacaggcgcgugccaccaugcccggcuaauuuuuuguauuuuuaguagagacgggguuucaccauguuggccaagauggucucgaucuccugaccucaggugaugugcccgccucggccucuaagugcugggauuacaggcaugagccaccgugcccagccucaagucugaaauauau

SEQ ID NO: 185950 - RNA, 47 nt, Homo sapiens
caugcucccaccccuaagaacugcccaggcccacuacuuacagccaa

SEQ ID NO: 185951 - RNA, 45 nt, Homo sapiens
cccugcuuucccagccacuacgcucaaagguucagccccacuacu

SEQ ID NO: 185952 - RNA, 46 nt, Homo sapiens
agaacucgugagccagauccccauccucaucauagaacauagagcu

SEQ ID NO: 185953 - RNA, 46 nt, Homo sapiens
aacacaggaggaaucgagguagcaaacggcugaaaugcucugacua

SEQ ID NO: 185954 - RNA, 42 nt, Homo sapiens
cuuggcuaggccuggcuugaagagaucaggagagggaggcag

SEQ ID NO: 185955 - RNA, 48 nt, Homo sapiens
cagcaguagggaaggagagaccugcccauagccacuuuauucccccac

SEQ ID NO: 185956 - RNA, 45 nt, Homo sapiens
gaguuugaguagugucuccuccugcgugcggagcgugugugccag

SEQ ID NO: 185957 - RNA, 50 nt, Homo sapiens
ccugcagacccagcccaggaccaggggcagccacgggccucccgccccau

SEQ ID NO: 185958 - RNA, 42 nt, Homo sapiens
gcagccugaaagcuguggcuucagugucgcggggcggcugcg

SEQ ID NO: 185959 - RNA, 42 nt, Homo sapiens
uccucacuggacgcagccguggcugccagcuucagcccacgc

SEQ ID NO: 185960 - RNA, 43 nt, Homo sapiens
uugugaggauggaauggggguaacucaccaucaggaugggcau

SEQ ID NO: 185961 - RNA, 26 nt, Homo sapiens
cagguggggacccggauucugucagg

SEQ ID NO: 185962 - RNA, 42 nt, Homo sapiens
aaggaacuuauccaagaucacauagcccaggccacagggcac

SEQ ID NO: 185963 - RNA, 42 nt, Homo sapiens
ucaucauggaggaugucacccugaccuuaccagagugcaugc

SEQ ID NO: 185964 - RNA, 46 nt, Homo sapiens
aggcauggggaggugaagggcugugugguuauccuguuucuggguu

SEQ ID NO: 185965 - RNA, 44 nt, Homo sapiens
caaugaaagaagagauucaguucugcucucagcaccucgcucau

SEQ ID NO: 185966 - RNA, 45 nt, Homo sapiens
ggcugugacuccugggaaucacagccugguggcuggcuucugccu

SEQ ID NO: 185967 - RNA, 45 nt, Homo sapiens
cagaagcgggacggccgcaaggugcggaaagcugccaagaacgag

SEQ ID NO: 185968 - RNA, 41 nt, Homo sapiens
aaaauggccucaucaaggagcccugugggacccccgaguau

SEQ ID NO: 185969 - RNA, 58 nt, Homo sapiens
cugcuucugauaagaacaucaaggauggugucugugcccagauugaaaagaacuuugc

SEQ ID NO: 185970 - RNA, 51 nt, Homo sapiens
gcaguccagcacggcugcagcccagucggccucagccacagacacugccac

SEQ ID NO: 185971 - RNA, 41 nt, Homo sapiens
uuggcacauggcuagggauacugcucacuagcuguggaggu

SEQ ID NO: 185972 - RNA, 70 nt, Homo sapiens
cuugaucaccuauacaaacagaugugauuucaaaaccguuagccugggcaagggugagcuuucaccacau

SEQ ID NO: 185973 - RNA, 51 nt, Homo sapiens
cauggcagguagggaaugggcaguaaaauauuuuccuaaguaguucaagca

SEQ ID NO: 185974 - RNA, 36 nt, Homo sapiens
gcagcauccuuggagcuaugcucaucucugccacag

SEQ ID NO: 185975 - RNA, 55 nt, Homo sapiens
aaaaguccccagcaaggacccagacagaaagcacacaacuccugucaguggcccc

SEQ ID NO: 185976 - RNA, 44 nt, Homo sapiens
accagcuauauacuacauuauagaaucuggucuguagcucccag

SEQ ID NO: 185977 - RNA, 73 nt, Homo sapiens
ucucaugggccccaagggccccugaacuccaggcuagagacagccagggagaccuuuccuuaggguaggguaa

SEQ ID NO: 185978 - RNA, 53 nt, Homo sapiens
gacuaaucccaugccacgcaggcaaugggcugcucaaggccuuagcucuguuc

SEQ ID NO: 185979 - RNA, 25 nt, Homo sapiens
acagagcccaaggccuuaccaccca

SEQ ID NO: 185980 - RNA, 50 nt, Homo sapiens
gacucuuucugggccuggagaccacggucacuuguugacugucucugugg

SEQ ID NO: 185981 - RNA, 48 nt, Homo sapiens
cucagcccaagcuucuaccugccuuugacuugcuucuaggcauagccu

SEQ ID NO: 185982 - RNA, 45 nt, Homo sapiens
aguguaccaccuguccaccauccacggcccaaguccaccccagac

SEQ ID NO: 185983 - RNA, 44 nt, Homo sapiens
ugggacucuggcuucucggaggugucaggcagcacauggcgaga

SEQ ID NO: 185984 - RNA, 42 nt, Homo sapiens
cugcagccaaccucccaaacuggcccagaugugcagcccagc

SEQ ID NO: 185985 - RNA, 53 nt, Homo sapiens
ggagggcuccauccugguaaggcgccaggucuucucucucuugacacuuucac

SEQ ID NO: 185986 - RNA, 43 nt, Homo sapiens
uggacuagguccgagguccccuuccuugcauucaggugaccaa

SEQ ID NO: 185987 - RNA, 45 nt, Homo sapiens
gcacugauguggcuugcucucuccuagguaggggagggugcaagg

SEQ ID NO: 185988 - RNA, 36 nt, Homo sapiens
gaauacaggacuugggguuugggaagcagggagacg

SEQ ID NO: 185989 - RNA, 46 nt, Homo sapiens
uggccaggacagcauccucucccucccaggcaaugugggccaccag

SEQ ID NO: 185990 - RNA, 46 nt, Homo sapiens
ccuugacuuugaagcaauccugcugcagccuggcagcccuccagau

SEQ ID NO: 185991 - RNA, 46 nt, Homo sapiens
auccacuggggcauccgggugcuacagccacccccagagcaagaga

SEQ ID NO: 185992 - RNA, 68 nt, Homo sapiens
ggucaggugggagcuggaaguugcucacaauugaccaggaccucaugguggcacaguuuuccacaccc

SEQ ID NO: 185993 - RNA, 49 nt, Homo sapiens
caucgagggacaggcagaugugccugcauggucugaugugucuuaaggu

SEQ ID NO: 185994 - RNA, 51 nt, Homo sapiens
aaacucucucuuaucaagaucugccagacucauccuucucgcucugcaaac

SEQ ID NO: 185995 - RNA, 45 nt, Homo sapiens
ugcuggucagcugacagccagagaguggucuuugacucggcucag

SEQ ID NO: 185996 - RNA, 112 nt, Homo sapiens
agcuccucucggaugacucccuggcugucucuucuccccggcugagcccagaccaaugucgcauugucuaccugcaguacccaucucugaucccccaucaccaaugcagcca

SEQ ID NO: 185997 - RNA, 41 nt, Homo sapiens
cgcggcgggugacgggaccgcgcgcagggugcagagcaggg

SEQ ID NO: 185998 - RNA, 46 nt, Homo sapiens
cagccaaccaucuucauaacaagauuuguuuacaaguccuggauuu

SEQ ID NO: 185999 - RNA, 58 nt, Homo sapiens
gcaggcagccugcuccccugagcgcugggcuggugauggucguuggacucugugagau

SEQ ID NO: 186000 - RNA, 25 nt, Homo sapiens
ggguggguggacccaggcucccuuu

SEQ ID NO: 186001 - RNA, 47 nt, Homo sapiens; identical to SEQ ID NO: 116972

SEQ ID NO: 186002 - RNA, 46 nt, Homo sapiens
uuuguccuaacaguccacaguccugccccgacccaccccaucccuu

SEQ ID NO: 186003 - RNA, 40 nt, Homo sapiens
uuuuuuuuuuuccuccuaaaaggaauaucacgguuuuuug

SEQ ID NO: 186004 - RNA, 64 nt, Homo sapiens
guuaaguuuuuacguuuaaucugcuguuuaccuaaacuuguauguauaauuuuuggguggguau

SEQ ID NO: 186005 - RNA, 52 nt, Homo sapiens
uggcucugaaagcaccauguggaguggagguggagggagcgaggaaccauga

SEQ ID NO: 186006 - RNA, 66 nt, Homo sapiens
ucccgucccaagaacaugaccccauaccggucaccuccucccuaugucccaccuuaacccgcaagc

SEQ ID NO: 186007 - RNA, 42 nt, Homo sapiens
aucaucuuugcagacgaacuggacgacuccaagcccccaccc

SEQ ID NO: 186008 - RNA, 65 nt, Homo sapiens
uaccacccaggagagugcccucagaggcgccgcccacagaagugccugacagggacccugagaag

SEQ ID NO: 186009 - RNA, 45 nt, Homo sapiens
aagaagauugccuugguaaagaaacuggccuucgccuuuggagac

SEQ ID NO: 186010 - RNA, 42 nt, Homo sapiens
ccacugacaagcugaagcugacccugaaacugcgggagcagc

SEQ ID NO: 186011 - RNA, 45 nt, Homo sapiens
accaguggagugccccguggcggagaacccaaccagcgcccagag

SEQ ID NO: 186012 - RNA, 46 nt, Homo sapiens
cggacaccccggccagugccccgggucaccaccaaaguuuccauca

SEQ ID NO: 186013 - RNA, 46 nt, Homo sapiens
uauguggagccuacugcaguugcuaccccucccacaaccaccacca

SEQ ID NO: 186014 - RNA, 45 nt, Homo sapiens
ugggcccccaaccacggcuauccaggagcccccauccaggaucgu

SEQ ID NO: 186015 - RNA, 99 nt, Homo sapiens
gcggagcuucucagaaguagagcuucacaacaugaaauuagugccgguggugaauaacagacuauuugacaugucggccuucauggcuggcccgggaaa

SEQ ID NO: 186016 - RNA, 51 nt, Homo sapiens
uguuuugacggugauuuuggaugccgaccucaccaagaugaccccaaagca

SEQ ID NO: 186017 - RNA, 176 nt, Homo sapiens
cagauuuaucucauugucuuaguccauggcacagacacaggauaacccugagugugagucagcaccaaggcugauacuccaucagaggguccaucuccugcuucccugagcagaggacacacagucagcuugcaaugaggaggccuugacugccucaugugggagugccuccaggg

SEQ ID NO: 186018 - RNA, 45 nt, Homo sapiens
gaccccuugugaacaaagcacaccgggaaaugcggguuggcgaug

SEQ ID NO: 186019 - RNA, 66 nt, Homo sapiens
ucaccuucuuuuuaagccguggcuuguucucagagugaccuuguggucucuggggcaaccguauuu

SEQ ID NO: 186020 - RNA, 44 nt, Homo sapiens
cgagugaccauuccaacagauuugauugccuccaguggagauau

SEQ ID NO: 186021 - RNA, 46 nt, Homo sapiens
uuuuccaagugcuuacucuaauagaaacugaaaguugccuucugac

SEQ ID NO: 186022 - RNA, 46 nt, Homo sapiens
uuuuccagaacagugaaacuacaauauaaagguuagacuugagaac

SEQ ID NO: 186023 - RNA, 37 nt, Homo sapiens
uguaggguuuucugugaggccagugguuucagaaggg

SEQ ID NO: 186024 - RNA, 45 nt, Homo sapiens
gguggguuuuucugugggaauggugggcuuuucuuuggggacugu

SEQ ID NO: 186025 - RNA, 46 nt, Homo sapiens
gggagguggucacacugugaggggaggugggcacacugugaggggu

SEQ ID NO: 186026 - RNA, 47 nt, Homo sapiens
agugugaggggagguggucauagugugaggggagguggucacagugu

SEQ ID NO: 186027 - RNA, 43 nt, Homo sapiens
ggucauagugugaggggagguggucacacugaggggagguggu

SEQ ID NO: 186028 - RNA, 75 nt, Homo sapiens
gcgaguggagguagucacacugugaagggugguagucacacugagaggagguggucacacugaggggaagugguc

SEQ ID NO: 186029 - RNA, 45 nt, Homo sapiens
ggucacacugaggggagguggucauacugugagugaggagguagu

SEQ ID NO: 186030 - RNA, 80 nt, Homo sapiens
ggucacagugugaggggagguggucacacugaggggagguggucacagugugcggggagguggucauacugaggggaggu

SEQ ID NO: 186031 - RNA, 35 nt, Homo sapiens
ccaccugauuaccugauuuaaucagaugguaccuc

SEQ ID NO: 186032 - RNA, 66 nt, Homo sapiens
gaaguguauuuccugugcauuccaaguguugccugcaugccuguucugucugggccacauucacag

SEQ ID NO: 186033 - RNA, 56 nt, Homo sapiens
gagugcccucugccccuucuggcaacaugcacauuccugucuucugccugcucccu

SEQ ID NO: 186034 - RNA, 362 nt, Homo sapiens
accagggccugagcauaagaacugggacccuucuaggcagggugcaguggcucacgccuguaaucccagcacuuugggaggcccaggcaggcggaucaccugaggucaggaguucaagaccagccugaccaaccuggagaaaccccgucucuacuaaaaauacaaaaaauuagcugggcguggugguaggcaccuguaaucccagcuacuugggaggcugaggcaggagaaucucuugaacccgggaaguggagguugcggaccugagaucaugccauugcacuccagccugggcaagaagagcgaaacuccaucuuaaacaaacaaacaaaaaaaaaagaacugggacccuucugccaucu

SEQ ID NO: 186035 - RNA, 31 nt, Homo sapiens
cacaggugggauagagggugcugaucuugga

SEQ ID NO: 186036 - RNA, 65 nt, Homo sapiens
gggugcagagguugcaccagaucagggaagcaccccaagguagggaggggaugaaaacuuacuug

SEQ ID NO: 186037 - RNA, 42 nt, Homo sapiens
cgccgcccgcgguccuccgucgguucucucguuaguccacgg

SEQ ID NO: 186038 - RNA, 68 nt, Homo sapiens
aagaaugacuuauugaaggaucucuggauaacuugucuuaauugguuccaucuacuuuuguggagcac

SEQ ID NO: 186039 - RNA, 38 nt, Homo sapiens
agcucuucagguguuucuuguccaugggguggagucca

SEQ ID NO: 186040 - RNA, 71 nt, Homo sapiens
gagagcugagagauauauguuaacucugagaagaaagacugaucagcuucuaagagagcuaauuugaagcu

SEQ ID NO: 186041 - RNA, 47 nt, Homo sapiens
agagguguaugugcccacaguguuugagaacuauguggcagauaucg

SEQ ID NO: 186042 - RNA, 46 nt, Homo sapiens
ccagauaccgauguuauacugauguguuuuuccaucgacagcccug

SEQ ID NO: 186043 - RNA, 46 nt, Homo sapiens
guuucucacugugaugaugaagcaugguuacauuggcgaauuugaa

SEQ ID NO: 186044 - RNA, 119 nt, Homo sapiens
ccugguugggaauaagaaggaucuucggaaugaugagcacacaaggcgggagcuagccaagaugaagcaggcaugaucuggggcaggacugucuuguaguauucuugaacuagggcccc

SEQ ID NO: 186045 - RNA, 53 nt, Homo sapiens; identical to SEQ ID NO: 117068

SEQ ID NO: 186046 - RNA, 47 nt, Homo sapiens
auuuugaagugcuguuuauuaaucuuaguguaugauuacuggccuuu

SEQ ID NO: 186047 - RNA, 46 nt, Homo sapiens; identical to SEQ ID NO: 117070

SEQ ID NO: 186048 - RNA, 46 nt, Homo sapiens
gugccacuuaauguauguuaccaaaaauaaauauaucuaccccaga

SEQ ID NO: 186049 - RNA, 32 nt, Homo sapiens
aaaaaagaaaguguauuuggaaauaaagucag

SEQ ID NO: 186050 - RNA, 41 nt, Homo sapiens
auauuaccccuuuucggccccauguaucucaguaccccaug

SEQ ID NO: 186051 - RNA, 52 nt, Homo sapiens
aaacuuuuuuucuguaccaguuaauuuuuccaacuacuaauagaauaaaggc

SEQ ID NO: 186052 - RNA, 46 nt, Homo sapiens
cgcacuucucgaagagcaugaaguugggcucgaacccaccaccagg

SEQ ID NO: 186053 - RNA, 45 nt, Homo sapiens
gcaacaucguugcgacacaccggagaccaggugaugagcuugggg

SEQ ID NO: 186054 - RNA, 42 nt, Homo sapiens
cacagcugggcccuugagacagcagggcuucgaugucaggcu

SEQ ID NO: 186055 - RNA, 46 nt, Homo sapiens
cccggggcugcacugccacccugggcaacuucaccaaggccaccuu

SEQ ID NO: 186056 - RNA, 45 nt, Homo sapiens
ccuuugugacucccggcgccccuucucugcuagagacaacccaca

SEQ ID NO: 186057 - RNA, 45 nt, Homo sapiens
accagcuuugcaccacagcggcgggcagccugguggcagucagag

SEQ ID NO: 186058 - RNA, 44 nt, Homo sapiens
ucagcauaacacagcugggcgccacugugagcucugucggcccu

SEQ ID NO: 186059 - RNA, 45 nt, Homo sapiens
gccugcccacagccugugugggcauuuggugcccaaggaugaucg

SEQ ID NO: 186060 - RNA, 42 nt, Homo sapiens
ggugcccagcaagacuucucccucugaggccugcgcaccccu

SEQ ID NO: 186061 - RNA, 46 nt, Homo sapiens
auucccuagcugccggccaugugucugcaaugggcaugcagaugag

SEQ ID NO: 186062 - RNA, 45 nt, Homo sapiens
gaucagggugaguuggcugggcugagcacucacagcuuccucuua

SEQ ID NO: 186063 - RNA, 38 nt, Homo sapiens
ccugccaucccugccaugcaugcuucggggauugggac

SEQ ID NO: 186064 - RNA, 46 nt, Homo sapiens
gcuugcacuuaaucucacacugcggcagcucgaccagcaucuugac

SEQ ID NO: 186065 - RNA, 45 nt, Homo sapiens
caauuuaggugccuaugacagcauccggcaugcccauagccaguc

SEQ ID NO: 186066 - RNA, 45 nt, Homo sapiens
auaccucagcccuggcaguaccuagcccugugagcaacucggcaa

SEQ ID NO: 186067 - RNA, 42 nt, Homo sapiens
caccaggggaugcacccugugcuacaagcccuugugggggug

SEQ ID NO: 186068 - RNA, 46 nt, Homo sapiens
ccgcgcugugggggccucagcugcaauggggcagcggcuacagcag

SEQ ID NO: 186069 - RNA, 40 nt, Homo sapiens
gauccugauagcauugaaaugguggccacacgggugcuag

SEQ ID NO: 186070 - RNA, 43 nt, Homo sapiens
gcccagcgggcacaggguauugcccagggugccauccgggggg

SEQ ID NO: 186071 - RNA, 48 nt, Homo sapiens
cucugaaauugaaacgggcaggaaauagucuggcagccucuacagcag

SEQ ID NO: 186072 - RNA, 45 nt, Homo sapiens
cgcgguccucugggugaucaguaccagacggugaaggcccuagcu

SEQ ID NO: 186073 - RNA, 79 nt, Homo sapiens
agagggcccccaggacuggaggacaccacuaguaagaagaagcagaaggaucgagcaaaccaggagagcaaggauggag

SEQ ID NO: 186074 - RNA, 45 nt, Homo sapiens
uguagaugcugcuuucacagauacagacuguguggugcgguuugc

SEQ ID NO: 186075 - RNA, 26 nt, Homo sapiens
acccgggcugugggccccacaccacc

SEQ ID NO: 186076 - RNA, 56 nt, Homo sapiens
ccagagcagugcaccuucuguuucacggcuucucgcaucgacaucugccuucguaa

SEQ ID NO: 186077 - RNA, 52 nt, Homo sapiens
aggugcuccccacccccugacaggccaggaggaggcccgggcuguggagaag

SEQ ID NO: 186078 - RNA, 46 nt, Homo sapiens
gccccacagcccaguuaguggagacagcguggaggaggaggaagag

SEQ ID NO: 186079 - RNA, 45 nt, Homo sapiens
agguacucugugaguguauuccagccacccuuucagccaggccgc

SEQ ID NO: 186080 - RNA, 45 nt, Homo sapiens
augcccacacaccccaguucuucaucuauaaaauugauucaucca

SEQ ID NO: 186081 - RNA, 46 nt, Homo sapiens
aucgugcagcucaagcgcuucuccuuucguaguuuuaucuggcgug

SEQ ID NO: 186082 - RNA, 48 nt, Homo sapiens
cuuccuguacuuaaaaguguuaauaaaaccagacuauucaggcccaau

SEQ ID NO: 186083 - RNA, 85 nt, Homo sapiens
accagugggcuuuggcuucuccagccgccuccagugcugcgugauuugauucuguuguaccuucaauucuucugacccgcauuau

SEQ ID NO: 186084 - RNA, 48 nt, Homo sapiens
auaauuuuauucuaaaaauuguaauuuuuuuugcauuuuggaagugac

SEQ ID NO: 186085 - RNA, 45 nt, Homo sapiens
gcggagucaccccuuggaccccaucgacacuguggacuucgagcg

SEQ ID NO: 186086 - RNA, 41 nt, Homo sapiens
cuggucaugccuuuucuucugggcacgagugagaaggaggu

SEQ ID NO: 186087 - RNA, 49 nt, Homo sapiens
gcuauguggucacuccacacaccaugaaucuacuaaagcagcaccugga

SEQ ID NO: 186088 - RNA, 41 nt, Homo sapiens
aauggcaucuguuuucugcguuuugaugacaccaacccuga

SEQ ID NO: 186089 - RNA, 44 nt, Homo sapiens
ucagagggcgaggccacacuacggaugaagcuggugauggagga

SEQ ID NO: 186090 - RNA, 53 nt, Homo sapiens
cgggcacagaaguuguugauggccucaggugggaagccccgccgucgcagggc

SEQ ID NO: 186091 - RNA, 46 nt, Homo sapiens
uccagggccccagugguuguguagagagucuggaggugaccugcag

SEQ ID NO: 186092 - RNA, 46 nt, Homo sapiens
cguguagugaugccugcaggcagggaacucaggcaaccauccaacc

SEQ ID NO: 186093 - RNA, 45 nt, Homo sapiens
cuuccagcucacaccuuuccugggucuuccuucagugugacaguu

SEQ ID NO: 186094 - RNA, 43 nt, Homo sapiens
aggaagacccaggaaaggugugagcuggaagcacugaaccuac

SEQ ID NO: 186095 - RNA, 47 nt, Homo sapiens
ggucccaggggaggcccccaccuccccuucuauuguucuguggccca

SEQ ID NO: 186096 - RNA, 44 nt, Homo sapiens
gggccacaucagaacccgcccauccccagucccaggaggaagac

SEQ ID NO: 186097 - RNA, 47 nt, Homo sapiens
acacccaucaccuccagccugagggcgcaacugagaggaacugagac

SEQ ID NO: 186098 - RNA, 39 nt, Homo sapiens
ucacauguuuguuuuaauaacauuucauuucucccauuu

SEQ ID NO: 186099 - RNA, 44 nt, Homo sapiens
ucagauccggggcccggcugugcagguggaccacgcggaagggg

SEQ ID NO: 186100 - RNA, 42 nt, Homo sapiens
acggcggaccgcugcaguuggagagacagacccgcggggguc

SEQ ID NO: 186101 - RNA, 23 nt, Homo sapiens
gcuguacgcacagagauggugag

SEQ ID NO: 186102 - RNA, 42 nt, Homo sapiens
uuucagcuccuacuacaaccggguacacauccugggggugag

SEQ ID NO: 186103 - RNA, 52 nt, Homo sapiens
cugcuggucucauccucugcuuccuuugccuuuacccuauaccucucugcac

SEQ ID NO: 186104 - RNA, 46 nt, Homo sapiens
aggagccucgaccacaccucuuuggucagauguucguccgccugca

SEQ ID NO: 186105 - RNA, 46 nt, Homo sapiens
cgcacagcucucagaagcugcaggcggacgaacaucugaccaaaga

SEQ ID NO: 186106 - RNA, 61 nt, Homo sapiens
acuccacucaccuucagcuccugcaccgacaucaggaacccacggccaccaccuccucccc

SEQ ID NO: 186107 - RNA, 41 nt, Homo sapiens
auccccauccuugagguaagcaaaggccauggccgccucag

SEQ ID NO: 186108 - RNA, 42 nt, Homo sapiens
acccucccgcgguuccacccgcccuuuccacgcgggcugaag

SEQ ID NO: 186109 - RNA, 45 nt, Homo sapiens
aaugccaccuacaugucaaucacuccuaaaaguguuuguccaguc

SEQ ID NO: 186110 - RNA, 32 nt, Homo sapiens
ucccacaggggcauaugaggacuuugagcugu

SEQ ID NO: 186111 - RNA, 51 nt, Homo sapiens
gagugagggagugggugcuguaggaggaggugagaccuggggcaggugaca

SEQ ID NO: 186112 - RNA, 46 nt, Homo sapiens
gcaguugggcacuauaugaggaugagggugucauccgcugcuaccu

SEQ ID NO: 186113 - RNA, 42 nt, Homo sapiens
cacacagacaugauggcucucauugacaucacugugcggcac

SEQ ID NO: 186114 - RNA, 41 nt, Homo sapiens
aggagagucugaaugaaaguuugagagagcuugaaguuauu

SEQ ID NO: 186115 - RNA, 72 nt, Homo sapiens
aaagacggguuucugcaagauuacuucuguauucucuaugaagcacaaggccagcugacaagguagguaggu

SEQ ID NO: 186116 - RNA, 49 nt, Homo sapiens
ugcucuuucuaaagguaagaacaugagaaaaccuucaacucugggagga

SEQ ID NO: 186117 - RNA, 41 nt, Homo sapiens
cuauuugaagcugugaaugugcacgaggucuuccaggguaa

SEQ ID NO: 186118 - RNA, 46 nt, Homo sapiens
uccuaugugcuguagcucuccuuuggaaauaaaucacaggcaucug

SEQ ID NO: 186119 - RNA, 48 nt, Homo sapiens
aggcacuuagggcugaacuccuuugaaugggagccaaucggugcaggg

SEQ ID NO: 186120 - RNA, 46 nt, Homo sapiens
agggggucaagcuauuugcuguggguaaggaccgagcaggagugac

SEQ ID NO: 186121 - RNA, 45 nt, Homo sapiens
accucugcuccacgagaccuggugcugucugagccaagcagccaa

SEQ ID NO: 186122 - RNA, 46 nt, Homo sapiens
acgccaacagcaucggggaggcugugagcgggacagcucggaccag

SEQ ID NO: 186123 - RNA, 45 nt, Homo sapiens
cucugguccugguucugacuucugacuucugucuguaacuccuag

SEQ ID NO: 186124 - RNA, 41 nt, Homo sapiens
gguuuggggauccgggcuugugcucuggauuggagaaagga

SEQ ID NO: 186125 - RNA, 67 nt, Homo sapiens
gcagggcuguggcagacuccgcaagguaggcgaggacagugauggugggcggggucugucacugggg

SEQ ID NO: 186126 - RNA, 46 nt, Homo sapiens
cuucccggaagcccuggaccccaaggccccguuggccccccuggaa

SEQ ID NO: 186127 - RNA, 45 nt, Homo sapiens
gggagacccugggcggccuggccccccaggaccuguuggcccccg

SEQ ID NO: 186128 - RNA, 45 nt, Homo sapiens
caggcaaagcuggggacccagggagagacguaagugaggggagau

SEQ ID NO: 186129 - RNA, 25 nt, Homo sapiens
cuggucauucuuguuuucaggguga

SEQ ID NO: 186130 - RNA, 46 nt, Homo sapiens
agggcugggggugugggagaggcaggaaggccaggagagaggguga

SEQ ID NO: 186131 - RNA, 42 nt, Homo sapiens
agacagggaagccgggagccccaggucgagauggugccagug

SEQ ID NO: 186132 - RNA, 45 nt, Homo sapiens
gagagaaggaaucccaggaccccuggggccaccuggaccaccggg

SEQ ID NO: 186133 - RNA, 41 nt, Homo sapiens
ccagggagacccuggaguagggcugccugggccccgaggcg

SEQ ID NO: 186134 - RNA, 33 nt, Homo sapiens
ggugguguacucucugugggguccuguggcugu

SEQ ID NO: 186135 - RNA, 60 nt, Homo sapiens
gacaggaggaggcuuucugggguuuagggggaagggguucuguggcugacuauggagugg

SEQ ID NO: 186136 - RNA, 45 nt, Homo sapiens
ugcagggagaagcuggucccccaggccgccccgggcuggcaggac

SEQ ID NO: 186137 - RNA, 40 nt, Homo sapiens
cgggggccaaguucaugucuuuuuuucuccagggggagcc

SEQ ID NO: 186138 - RNA, 41 nt, Homo sapiens
gcaguguuggucccagaggccccgaaggacuucagggccag

SEQ ID NO: 186139 - RNA, 45 nt, Homo sapiens
ccggggcuuugugcgccaagagaugagucagcacuguggugagug

SEQ ID NO: 186140 - RNA, 46 nt, Homo sapiens
ggaggaguaccaggacccugaagcuccuugggauagugauggugag

SEQ ID NO: 186141 - RNA, 39 nt, Homo sapiens
ggucuccagaggccacgugcuauggcagacuguuuccag

SEQ ID NO: 186142 - RNA, 46 nt, Homo sapiens
aggcccagcgcggggcuaagugcuuuaugaacgcugguaugguggg

SEQ ID NO: 186143 - RNA, 46 nt, Homo sapiens
gcuucaccugcuccugcugcugccuuuacaagacgugccgccgacc

SEQ ID NO: 186144 - RNA, 36 nt, Homo sapiens
ugccccuuauccucagccuccaagugugccgcccag

SEQ ID NO: 186145 - RNA, 35 nt, Homo sapiens
auucccuggccucucuggcugccacuugguuaugu

SEQ ID NO: 186146 - RNA, 46 nt, Homo sapiens
aauuaugcuuccuaaaaucucaagccaaacucaaagaauggggugg

SEQ ID NO: 186147 - RNA, 66 nt, Homo sapiens
cacucaguucucuucccugcaguguuuucauuuuauuuuagccaaacauuuugccuguuuucuguu

SEQ ID NO: 186148 - RNA, 63 nt, Homo sapiens
agacugaaaccccuggguuguggagggaaauuggcucagagauggacaaccuggcaacuguga

SEQ ID NO: 186149 - RNA, 48 nt, Homo sapiens
gucuagggucuguacacuuguuuauaauaaaugcaaucguuuggagcu

SEQ ID NO: 186150 - RNA, 42 nt, Homo sapiens
agccacacuguauggacuaucccuggccacaccuggggagua

SEQ ID NO: 186151 - RNA, 25 nt, Homo sapiens
uggcuccaacugccaguguaaugug

SEQ ID NO: 186152 - RNA, 45 nt, Homo sapiens
uuucucauuugcuuucuggggacccuuguccaacagccccauccu

SEQ ID NO: 186153 - RNA, 65 nt, Homo sapiens
uugcuauaaccaaaagcaaccaaaagcaaaaaaaugacagcucccauucuaauaaaauagucaga

SEQ ID NO: 186154 - RNA, 42 nt, Homo sapiens
ccgccgccgggcaccgggcaccccccgagcaagcgggcccgg

SEQ ID NO: 186155 - RNA, 40 nt, Homo sapiens
gaggugggaagagggugucucuagcucuagggcaguagcc

SEQ ID NO: 186156 - RNA, 83 nt, Homo sapiens
gagcaggggcggugggcagggccaggugcgcaggggagaaacaaggcgccuuggaguucagguaaagaaaguuggggaggaug

SEQ ID NO: 186157 - RNA, 41 nt, Homo sapiens
augggguccucgccucggggucuggggguuggggaggguca

SEQ ID NO: 186158 - RNA, 48 nt, Homo sapiens
ugggcccuggcacuauucugaacugcaggagaggaaauagcaagagau

SEQ ID NO: 186159 - RNA, 41 nt, Homo sapiens
auauguggcugccaaugauccugcggucagcacgguggggc

SEQ ID NO: 186160 - RNA, 49 nt, Homo sapiens
gugucuggaugggcuuggaccaggaugcuggagggguggcacuuguguc

SEQ ID NO: 186161 - RNA, 45 nt, Homo sapiens
agcugggcugucugcaaguggcagccaugaguccugccaacauca

SEQ ID NO: 186162 - RNA, 71 nt, Homo sapiens
cuuggaccuggcagggccccgagacccuucccuuggcuggacagcacugcuguguguggcggagaggccga

SEQ ID NO: 186163 - RNA, 45 nt, Homo sapiens
aagcaggcccugagggacuauaagaagguucagauccagcuggag

SEQ ID NO: 186164 - RNA, 46 nt, Homo sapiens
ccuccgcacucugcucagugaccugguugcccaguauguggccaag

SEQ ID NO: 186165 - RNA, 94 nt, Homo sapiens
uuuucugccauuuaccccauagugguuuacaagugcacugcgcuaggugcuggggucacaauggggaggaagcugcugucccuggggaaggcag

SEQ ID NO: 186166 - RNA, 45 nt, Homo sapiens
gcccugcaugaacucuacaaguacaucaacaaguacuaugaccag

SEQ ID NO: 186167 - RNA, 47 nt, Homo sapiens
aggauggcacggcccagaagaugcagcugggcuaucggcuccagcag

SEQ ID NO: 186168 - RNA, 39 nt, Homo sapiens
cuggccugggcagcccuggaagcucggaggagaggccac

SEQ ID NO: 186169 - RNA, 39 nt, Homo sapiens
cuggccucggcccugcuggauccaccuccuagacccggg

SEQ ID NO: 186170 - RNA, 56 nt, Homo sapiens
acuguuccugaacacuggccuuggccacacugggauucggagaggaaggaggagag

SEQ ID NO: 186171 - RNA, 43 nt, Homo sapiens
aucuuuuuauuggguguagggauucaaucacaugcuucaaagg

SEQ ID NO: 186172 - RNA, 41 nt, Homo sapiens
cccucaaccaggccaggggcuccuuugacaucaguugugau

SEQ ID NO: 186173 - RNA, 63 nt, Homo sapiens
gcgggcgccggcaaccugaagauuaaauccaaacaaacguggcgggucggcaagagaagccgg

SEQ ID NO: 186174 - RNA, 64 nt, Homo sapiens
gcgccuucacgacgggcugcgacgcgggaggggggcugcaggcgaagagcaggcggcggcggug

SEQ ID NO: 186175 - RNA, 39 nt, Homo sapiens
aaguuggguaaaaagaccuggccuuaggaaagcagcaga

SEQ ID NO: 186176 - RNA, 82 nt, Homo sapiens
cuuguucucaucugggucgaugagcugaaagaugucauggucaagagaaucagaauggcuccucuucagagcuggacuacau

SEQ ID NO: 186177 - RNA, 65 nt, Homo sapiens
gccucugugugaagagaucuuuacccuccuggaguccaugagagugcaggcagccacgagauaca

SEQ ID NO: 186178 - RNA, 44 nt, Homo sapiens
gagugcuggagcuacacagggaaggggagucaaacagcuugcau

SEQ ID NO: 186179 - RNA, 37 nt, Homo sapiens
ucgcggggaggucgggcgacgggucgagcuuccaccc

SEQ ID NO: 186180 - RNA, 31 nt, Homo sapiens
acugagggacugucuacuuggagaaaaggaa

SEQ ID NO: 186181 - RNA, 49 nt, Homo sapiens
gucuacaguuguugauucugcuaucacugcugguaauggugcugcauga

SEQ ID NO: 186182 - RNA, 42 nt, Homo sapiens
ugggaggucucaacaaggaccagaugcauggggauagcagug

SEQ ID NO: 186183 - RNA, 42 nt, Homo sapiens
ggguaagcauccguugauccagaucaugggcacugggcaggc

SEQ ID NO: 186184 - RNA, 51 nt, Homo sapiens
gcucccagcuccccugccugggcgcugccuaaaacucucuaacgucuucuc

SEQ ID NO: 186185 - RNA, 80 nt, Homo sapiens
aggggagacgugccuucuagcuccaucuuggccagaaccaggcuggagagauguacuggccagugggaggcucaccacca

SEQ ID NO: 186186 - RNA, 44 nt, Homo sapiens
cugcugggacccacuuccugagguuuggggaagagaagcuccuc

SEQ ID NO: 186187 - RNA, 44 nt, Homo sapiens
guggccgccaggauggauccacucagcagggcaggaccgagccc

SEQ ID NO: 186188 - RNA, 70 nt, Homo sapiens
cuggaguugcucagccaggagaagaagaaacacaugggcaacaucuccuucuguggauucgugggggcac

SEQ ID NO: 186189 - RNA, 119 nt, Homo sapiens
aggugauauccaaggacauuacuucaggauccuccugugaguaccaacucccagacccaugcucuucccucggcaccaagcugccuuccugaggaggaggcauuagagcugggucuuag

SEQ ID NO: 186190 - RNA, 68 nt, Homo sapiens
cuccuccaaccucccacuccuucucaaugccguuucugaaaaucccaguuggaauccacgggcccucu

SEQ ID NO: 186191 - RNA, 41 nt, Homo sapiens
ucaccacucucugacacuuggccccauccagucacccagca

SEQ ID NO: 186192 - RNA, 46 nt, Homo sapiens
ugaacugaccugacaggcauccuucccuuggucauuauagccacag

SEQ ID NO: 186193 - RNA, 41 nt, Homo sapiens
ccagaaucucccuggaaaaagaaagacagucacuguaggaa

SEQ ID NO: 186194 - RNA, 46 nt, Homo sapiens
cugaggaagggggugccaagaauggguugcuccaaaagaacuagug

SEQ ID NO: 186195 - RNA, 45 nt, Homo sapiens
guggacaagggcaacgucacccaugaugaaggcccggccccagua

SEQ ID NO: 186196 - RNA, 42 nt, Homo sapiens
cuggggcugcagcagccagcacaggaacaggaggcaggcaga

SEQ ID NO: 186197 - RNA, 44 nt, Homo sapiens
ggcugacuuucuuuugaaaaaagaaguaguuuuuugggagaggg

SEQ ID NO: 186198 - RNA, 31 nt, Homo sapiens
aaaccucucuggcaguucauccugcugccca

SEQ ID NO: 186199 - RNA, 23 nt, Homo sapiens
aacaaaaggucucucaccggcaa

SEQ ID NO: 186200 - RNA, 31 nt, Homo sapiens
ccuaaagcgaaaauggcaauuuaagaagaaa

SEQ ID NO: 186201 - RNA, 38 nt, Homo sapiens
ccagucggggcggggagaccuuucaggugggcgggacg

SEQ ID NO: 186202 - RNA, 22 nt, Homo sapiens
ccuucuguuagaguucagcuga

SEQ ID NO: 186203 - RNA, 56 nt, Homo sapiens
agagcaguagauaaaaguagagauaauuagggaaggggaagaaauggcauuauaga

SEQ ID NO: 186204 - RNA, 43 nt, Homo sapiens
gacagauauuuagguuguuuuuagccuucuacaaacacugcug

SEQ ID NO: 186205 - RNA, 45 nt, Homo sapiens
ucaugggggaaguaauuacacaaaggugugaacaguaggaagggc

SEQ ID NO: 186206 - RNA, 93 nt, Homo sapiens
uuuccuuucuuguuuaacuuuguuuuuucagggaguuaaaauuugccuuuuacauuuacauaauuuucuguuuaccuguugcuuucccccuaa

SEQ ID NO: 186207 - RNA, 50 nt, Homo sapiens
cauuaugucucuugagucauauugcuccaaucuguagcuuucuuucugag

SEQ ID NO: 186208 - RNA, 42 nt, Homo sapiens
aagauggggacuccugcuucuggaaggaaaagaacaccugug

SEQ ID NO: 186209 - RNA, 43 nt, Homo sapiens
cuagcagggaaaaaugugcuuaugaaggaugcugaaggagaga

SEQ ID NO: 186210 - RNA, 55 nt, Homo sapiens
cuuuuaaagaucagagagacuuugaaccuaguuaugaugaagagagugaaccaau

SEQ ID NO: 186211 - RNA, 66 nt, Homo sapiens
aaaacauuggcacaggaggggaaauacuaaaagugucagaacuggaauaaugaaagaagugcugaa

SEQ ID NO: 186212 - RNA, 34 nt, Homo sapiens
ugagucauucucauuggcugguaguugaaacugg

SEQ ID NO: 186213 - RNA, 75 nt, Homo sapiens
cuacuagguuggaaucaguguuggcuccuugcuacuccugcuuauccauguugcuucaagcaucuaguaauaaug

SEQ ID NO: 186214 - RNA, 45 nt, Homo sapiens
gcagaagcaagagauauacgcaugagagaacuggaacgacaacaa

SEQ ID NO: 186215 - RNA, 44 nt, Homo sapiens
uaaauaacuugcauagucauuggcagaaccaguauuugaaggua

SEQ ID NO: 186216 - RNA, 46 nt, Homo sapiens
ccuaagaacacaguuugcuguaaucuguuaucuuuguccacuggua

SEQ ID NO: 186217 - RNA, 42 nt, Homo sapiens
uuuuuuaaaccagcugaauucuacauuauauuuuggaaaagg

SEQ ID NO: 186218 - RNA, 80 nt, Homo sapiens
aaaauugaaacagguuauuuccaguuuggcuuguuaaauccuaugccuguguaaaaugccacuggugcuauagagaggau

SEQ ID NO: 186219 - RNA, 45 nt, Homo sapiens
aaaggguuagauuuuuuuuaauuuagaaauuucuauagagaagca

SEQ ID NO: 186220 - RNA, 46 nt, Homo sapiens
ugcuauaguguacugagauugaaucauaucacuauuacugauuaug

SEQ ID NO: 186221 - RNA, 48 nt, Homo sapiens
aggucucugauucccugacugaccuggcauuaaaguaacuugaccuga

SEQ ID NO: 186222 - RNA, 107 nt, Homo sapiens
gauauuggcugcuuuuuuuaaggaaaaccacauugagaugugacaaguguuaggacuugucacagauuucuaacucugccgcauaaacuauaaaucuguaagguggu

SEQ ID NO: 186223 - RNA, 52 nt, Homo sapiens
aagggaggagagaagggagaauguaauggggaggaaauuaacgagaggcccu

SEQ ID NO: 186224 - RNA, 32 nt, Homo sapiens
agugaggagcggugugggaaggcagggcuagg

SEQ ID NO: 186225 - RNA, 32 nt, Homo sapiens
ucugaucgugccagucguggacgaagggagag

SEQ ID NO: 186226 - RNA, 75 nt, Homo sapiens
cucugcaaccuucagcaaaaucugucaccucugaauuucuuuuuccuuagcuauaaaacucaggguuuggacuag

SEQ ID NO: 186227 - RNA, 51 nt, Homo sapiens
acaauaaauaaauggauaaauaccguagugucagggagugauaaaugcuau

SEQ ID NO: 186228 - RNA, 58 nt, Homo sapiens
aagacuuugugguugguugcuauuagagacugguggucaggguauggcaugguaggga

SEQ ID NO: 186229 - RNA, 38 nt, Homo sapiens
uagcguguaagagagaaggcuggaaaaguagugagggg

SEQ ID NO: 186230 - RNA, 42 nt, Homo sapiens
agacacagggaaacaguauuuuccauuuaaaauuugaccugu

SEQ ID NO: 186231 - RNA, 46 nt, Homo sapiens
auaucuaugaccuuaaggaccagauacaggauguagaagggagaua

SEQ ID NO: 186232 - RNA, 41 nt, Homo sapiens
auguuuaaauguguaguacaguuuuugaauauuccgcagaa

SEQ ID NO: 186233 - RNA, 48 nt, Homo sapiens
aauaaauacagauugcuagacuuuacccucagauuuucuauucauugg

SEQ ID NO: 186234 - RNA, 677 nt, Homo sapiens
agguuuuacauuugggccaggcgcaguggcucauaccuguaaucccagcacuuugggaggcggaggugggcagaucaugaggucaggaguucgagaccagucuggccaacauagugaaaccccaucucuacuaaaaaauacaaaaaauuagccgggaguggugaugugugccuguaauuccagcuacgcgggaggcugaggcaggagaaucgcgugaacccgggagguggagguugcagugagccaagaucgcgccauugcacuccagcccgggcaauaaugugagacuccaucucgaaaaaaaaaaaaaguuuuauauuugagugaagucuuuuuuuuugguuuauaaugcuuuuuguuuguuuguuuguuuuugagacauggucucacucuguuacccaggcugggguacaguggcaugaucuuggcucacugcaaccucugccuccuggguucaagcaauucuccugccucagccuccugaguagcugggauuacaggcacccaccaccaugcccggcuaauuuuuguauuuuugguacaagagauaggguuuuaggguuuuaccauguuggucaagcuggucuugaacuccugaccucaagugauccaccugccucagccucccaaaguaccaggauuacaggcaugaggcaccgcacccggcugguuuauag

SEQ ID NO: 186235 - RNA, 79 nt, Homo sapiens
uuugaucuaccaaguagacacacucaaggauguuauugaagagcaggaggaacagauggcagaauuuuauagagaaaau

SEQ ID NO: 186236 - RNA, 29 nt, Homo sapiens
uauccuuacguuacaggaauuuggauaag

SEQ ID NO: 186237 - RNA, 32 nt, Homo sapiens
aguuuguagaccaaaaauuuaaagaacaaaag

SEQ ID NO: 186238 - RNA, 40 nt, Homo sapiens
aacuacuugucucuagcuucauuuuuaagauuuacauuua

SEQ ID NO: 186239 - RNA, 54 nt, Homo sapiens
cacuagcuagauggugcuagaaaugcacauuguuaauucacaggcagacuugag

SEQ ID NO: 186240 - RNA, 46 nt, Homo sapiens
cugugccauuguuucccuugcuaccuuaccuaaaaccaggcccuag

SEQ ID NO: 186241 - RNA, 61 nt, Homo sapiens
ugagaucugguauaugacugugggagugaguagcugagggcaagaagggauagauagcaag

SEQ ID NO: 186242 - RNA, 46 nt, Homo sapiens
acugcugcugagaaugcugagaaaguugaagaugaauugaaagcag

SEQ ID NO: 186243 - RNA, 112 nt, Homo sapiens
cccuucaaccugggugaugcuccuuggggcccuaccuagagggacugacuuuuguccauugacacaaaccccuuuuaguacuguuuugaguuuugucauuaaaacagccacc

SEQ ID NO: 186244 - RNA, 45 nt, Homo sapiens
aggagagcaaguuucaaauuacaaaccuguguguuggaguaaaua

SEQ ID NO: 186245 - RNA, 48 nt, Homo sapiens
ugugguuauuauguucauuauuaauaaugaugaucaugaucauuaggc

SEQ ID NO: 186246 - RNA, 56 nt, Homo sapiens
cuggaaggaguacucuucccuacagaacaccaaacuggcacugagcuguuugugau

SEQ ID NO: 186247 - RNA, 41 nt, Homo sapiens
ugcgcagccaguagcuccuuauauagccucccggagucaga

SEQ ID NO: 186248 - RNA, 51 nt, Homo sapiens
uaccucagagccuucucuuuacucuccaaagugaaagggaagcccccgucu

SEQ ID NO: 186249 - RNA, 44 nt, Homo sapiens
uuaaaaguccaauagcccauuuaauaaaguuguccuguugucuc

SEQ ID NO: 186250 - RNA, 51 nt, Homo sapiens
ccaguaccacagggacacuuggggccucucggaugagcacuuccagcccag

SEQ ID NO: 186251 - RNA, 42 nt, Homo sapiens
uaccauguaucauuacuugcaguuugccuauuauaaguguaa

SEQ ID NO: 186252 - RNA, 45 nt, Homo sapiens
guucuggaaugcaaaauacagugugaagagaaccucaccccaguu

SEQ ID NO: 186253 - RNA, 47 nt, Homo sapiens
ccagggagaucaaggacuucaaggauuucuaccuuuccauagcaggu

SEQ ID NO: 186254 - RNA, 41 nt, Homo sapiens
ugcucugcggagcgcuccggaaggagaaaaauggggucagg

SEQ ID NO: 186255 - RNA, 42 nt, Homo sapiens
ccagccucuucauaaugagaacgugaagauuuccgccacacg

SEQ ID NO: 186256 - RNA, 46 nt, Homo sapiens
agcagacauccugcacuacucuggccauggcauggaucuugacaag

SEQ ID NO: 186257 - RNA, 46 nt, Homo sapiens
gccagauauuaaccugauccuuucugggcacacacaugcugggcag

SEQ ID NO: 186258 - RNA, 41 nt, Homo sapiens
cggggagccuugagaaguuaugaauuuugguuuguucggaa

SEQ ID NO: 186259 - RNA, 566 nt, Homo sapiens
auuugaagggaagggaaggcaugcaggcagcuguagcacagguauggcuguagucauacaaaaagcuagguuaacaggagaaaagcauaacagauauguaaguuuuaucugacaugagagucuucagaaaagaagacccaaggaaaacuuuuuacacuuagauuccaugaaagguucugaccuaauggugguggacugaagugggaaacccucaaggccugccucaacagauucuucuuggccuuucuggguggcauuccuuccuucuggguauggagcaggaccccucugcaaugagggucuagaagggagaagggagaggugaccuuucuagguuuucuggcuugcuuugggagagagggguucuaauuucuaugacccacacugggggaagaugaauucugguuugacuugcuucaggggagaaggaggggugggcaacagaagagcaggagaaggccagagaaagaagauuugcuucuaaggccuuccgaucuccuuuaguucaaaguacuuagcaugccaaggugccauacuuugggguauuguuuucugagccccaauaa

SEQ ID NO: 186260 - RNA, 42 nt, Homo sapiens
ucuucggcuggcucaugagcugggacugcugguuauccugag

SEQ ID NO: 186261 - RNA, 45 nt, Homo sapiens
gaagccucuccucuaucagaauggagggccaguuauaacagugca

SEQ ID NO: 186262 - RNA, 137 nt, Homo sapiens
ccuccuccuccucuccccuucccaucuccacaugcuugaaucccacuaaucauuuuugccccuuguuuacaaaauaaacaaguauagacauaagaaagcagaaaaaacauaauuguuacucaaaccucaggagccau

SEQ ID NO: 186263 - RNA, 34 nt, Homo sapiens
uuugcuucauucuuugucaugagcacuuuuucau

SEQ ID NO: 186264 - RNA, 49 nt, Homo sapiens
aguuccuugcagcaacggauguggguuuuuuuuuuucuuugugucucac

SEQ ID NO: 186265 - RNA, 31 nt, Homo sapiens
acacaccugggcucccaugcacacacccggg

SEQ ID NO: 186266 - RNA, 30 nt, Homo sapiens
ggcuggggaccucacugagaaguauuuugc

SEQ ID NO: 186267 - RNA, 750 nt, Homo sapiens
gagcagaugcuuauaggagaguaggagauauaagacauguauuuaaaaacugcaauauauaauacaguguuaaaugcuacuuacagauucacuucuuauauggugagaauucacccggggaaauuucugucuccauuuucuucuccuuccaggccagauuaucuuuccaaaaguucaggugagagguagggugaugggagagaaugcacagauccucuugagacuauagccccuauuaaggcagcauggauauaugggagccccuauccuugagacacagcuaauguacuucaauaucaaaagagguaaagcuaagcucugguuucuuuauuuaaugcaucaucugaaaaaaguaaguuuccaguaaccaaaguguauaagaauuauuucucacuagaaaauaacuccguccuuauuugcaagagagaagaagauaaacuauuuuccuuuuuauguguggcccaauauacagacuaugugauuucagaaugaggaacaccagauuuugaaccuggacacuauuucuucaaccuuaagccaauuguguaaauucccuuuauauaaaaguagagguagccguacuuaccucacagacuuguacaguuuaaaaauaaauggcacucaauaaauguuuguuuucuucuuucauagucaaauaaaugaacaauaauuauuuauuuaccuaaaaaaaaaaaagagugagucuaugagcaaaucagucuacugauuguuaauuuguaaaacugggau

SEQ ID NO: 186268 - RNA, 73 nt, Homo sapiens
agccguuaacuauuauuuaucuuaaauguaagaaaaugugugucuacuuaaauagcugauguacauaggaaaa

SEQ ID NO: 186269 - RNA, 43 nt, Homo sapiens
cugcgaauuuguuuucugcaagccuaaugggguaaaugauguu

SEQ ID NO: 186270 - RNA, 42 nt, Homo sapiens
cagcaacccagcaccucucucuucaccccucaauggagucca

SEQ ID NO: 186271 - RNA, 46 nt, Homo sapiens
ucuggaccuucugguagagaacaugggacgugugaacuauggugca

SEQ ID NO: 186272 - RNA, 41 nt, Homo sapiens
ccaucugcccccuugucauuggcuuccuguagugaaugaca

SEQ ID NO: 186273 - RNA, 64 nt, Homo sapiens
aucuaggaggaagucugaauucugaaucuccuccccaccuucuuccuucagggcaagauccugu

SEQ ID NO: 186274 - RNA, 84 nt, Homo sapiens
aaaaccugcuaaagcugucauuguauauaccuuuuaggauggaaugagauaacauaucccaggguaaaaacaagagugaaauag

SEQ ID NO: 186275 - RNA, 43 nt, Homo sapiens
gaaaaauugaguugagaccugcccaaggucagacagcuaguaa

SEQ ID NO: 186276 - RNA, 67 nt, Homo sapiens
auucuacccugaacauaccucacagauccucccugucaugccacauuucacugauuggaauguggaa

SEQ ID NO: 186277 - RNA, 55 nt, Homo sapiens
ugugaggggcugacagcacaguaacgugcauacauaucugcagggcuggaaugga

SEQ ID NO: 186278 - RNA, 44 nt, Homo sapiens
uuccuccucaaguuuggugagaaaggaaccaagaaugggcaguu

SEQ ID NO: 186279 - RNA, 45 nt, Homo sapiens
cggaggucaaagccgugacggcgaggcauaagaaagcccuggagg

SEQ ID NO: 186280 - RNA, 61 nt, Homo sapiens
cuggggaaguugcuuguguggcuggaguuguacauuuuacaucugauccucauucccaguu

SEQ ID NO: 186281 - RNA, 47 nt, Homo sapiens
gggugagcuguguugccagugccuugacaaaagcaggauggauuagc

SEQ ID NO: 186282 - RNA, 55 nt, Homo sapiens
uuuaaaauucaaugcagagaaguuguugacuguaggggaaauaaaguuaauucaa

SEQ ID NO: 186283 - RNA, 63 nt, Homo sapiens
aguguaacgaagucuggauuucugauaccuugucauuugggggauuuuauuuuacuuuguugc

SEQ ID NO: 186284 - RNA, 160 nt, Homo sapiens
gcauaacacaccacugcuuuugguggaaaagugcagaauaguauguaccuuuuaugaagaaaaauguaauuuacaauauucagugagaauguuacugcugauuuucuuuuccaagguguagaauauucuuugauuuauagaauucauuuuugacccagau

SEQ ID NO: 186285 - RNA, 47 nt, Homo sapiens
acagacuugaacauuuucuccaguuguuuaguaaaagugaaagagaa

SEQ ID NO: 186286 - RNA, 45 nt, Homo sapiens
gguaucuuaguacugaaguuagcacuauguuuacaugcaaaagau

SEQ ID NO: 186287 - RNA, 44 nt, Homo sapiens
auuauuacugcuguuagcagucguuuucaccagguacuuacaga

SEQ ID NO: 186288 - RNA, 63 nt, Homo sapiens
ucugagaagaagcugcuguuucaaagauggaccucugaguagcuaauugauucaaguaguuuu

SEQ ID NO: 186289 - RNA, 49 nt, Homo sapiens
aaugugaugagagcuucuugaaccgguaaacuaguacaggucugagaaa

SEQ ID NO: 186290 - RNA, 45 nt, Homo sapiens
gcuguuuucgauuucuaaugugaagcaagacagagcacugcugua

SEQ ID NO: 186291 - RNA, 45 nt, Homo sapiens
augucguguuucacagcaaagaggguacagaaccaucacuggucc

SEQ ID NO: 186292 - RNA, 50 nt, Homo sapiens
uaggauauauaaaguaaaagcaccugauaacagggagacauuagaucaca

SEQ ID NO: 186293 - RNA, 46 nt, Homo sapiens
gauuuucguacacccccagguuuugaccgaacacguaaugcugaga

SEQ ID NO: 186294 - RNA, 51 nt, Homo sapiens
auuucugaaacuaauaugugagaaauuagaaaauaaaauuuuagaucaagg

SEQ ID NO: 186295 - RNA, 45 nt, Homo sapiens
ggugaugauaucaacaaauuucucuggaugguuaggauagcugaa

SEQ ID NO: 186296 - RNA, 46 nt, Homo sapiens
auaaaaucaugaggacucuagauguagauuauguuuugguuauuuu

SEQ ID NO: 186297 - RNA, 46 nt, Homo sapiens
auagaacuacguugguggauaauaacaccuggaauaacagccacau

SEQ ID NO: 186298 - RNA, 46 nt, Homo sapiens
cucuaguccaaguguaguccuggccucauacaaucaugauggguaa

SEQ ID NO: 186299 - RNA, 86 nt, Homo sapiens
gucugcaauugccuuuucaaauguuuuugagcacuauuugggggaugacaugaaaagggaaaauccaccuguggaggacagcagug

SEQ ID NO: 186300 - RNA, 250 nt, Homo sapiens
uguaagguguaauuauuggguaaaguauuucugcuacagguugaguauucaaaaucugaaacgcucuaaaaucaugaacuuguugagcaccaacaugaugcuaaaaggaaaugcuuauugaagcauuucagaauuucagauuagagaugcugaacugguaaguauaaugcaaauauucuaaaaucugaaacacugcugguucuaagcauuucagauaaaggauauucagucuguaguaauaauuccaaaa

SEQ ID NO: 186301 - RNA, 58 nt, Homo sapiens
auaagcaaauuaugcaugaaugacuggaacuaacaauuagacacauacuucaagaguu

SEQ ID NO: 186302 - RNA, 27 nt, Homo sapiens
uuuacaaaauaauaaaaaggcagauua

SEQ ID NO: 186303 - RNA, 42 nt, Homo sapiens
agacccuuuucuuuuuggguguaucacuagcugcaggugcug

SEQ ID NO: 186304 - RNA, 43 nt, Homo sapiens
cacaaauuguaaaucccuccccaguuuccuuguccauuuagau

SEQ ID NO: 186305 - RNA, 47 nt, Homo sapiens
auggauggauagaaaauuguaauagauggguauaguaguuuaguuag

SEQ ID NO: 186306 - RNA, 44 nt, Homo sapiens
cuucauaagccuuuaaucauauuuguuuauaauaaagcaaaauu

SEQ ID NO: 186307 - RNA, 57 nt, Homo sapiens
aaaugauuuuuaucauuauguaugccuguuaaguuaaucauauauuucucugcuggu

SEQ ID NO: 186308 - RNA, 45 nt, Homo sapiens
uucuugcugcuuuuacaagucuggaguuuguaaaauauaaguuuc

SEQ ID NO: 186309 - RNA, 47 nt, Homo sapiens
auaauacaugcguauguggcuagauccugauaauauaaugcuuagug

SEQ ID NO: 186310 - RNA, 43 nt, Homo sapiens
agacguauguguguuccuugcaccaacuuuuagcggccuuaca

SEQ ID NO: 186311 - RNA, 35 nt, Homo sapiens
auaguacgucaaaugaugauaaguauuauggagaa

SEQ ID NO: 186312 - RNA, 58 nt, Homo sapiens
gcaauccagugguuccacugagaagguauuaaucuaauuuugucauuccuuuguagaa

SEQ ID NO: 186313 - RNA, 60 nt, Homo sapiens
caaauauuuuagaagcuaauguaggacuguauagguagauccagauccagacuguaagau

SEQ ID NO: 186314 - RNA, 447 nt, Homo sapiens
gccaaacuggaacguuugcgagagaagguugguuucuuacuuuguaaaaggguugagcuuggaguuugaugcaccaaugaguuggcuugaacuaagugcuuugauaaaagguguuuggugucuuuuugucauccauuuuggggcuuaacauauuaaaugaaagguauauuuuaagauggaauauucaguaauucccagcauaauugcacaguccuuggaaguccaguaggcagcuuguuagguucuacaagggacccaggagauuugaugaugaugucucagaacuuaaauugugugguucccacaggcuguaauauaugcacugagguuguguugggccucuuugaggugggggcugggggucgugacuugacaggcuuuuuuuuuuuuuuuuuuuuuugacugaugacaccuuacccuuccuuuacaggauaagcacauugaaga

SEQ ID NO: 186315 - RNA, 76 nt, Homo sapiens
uucuccucuacuccccccagcucuuguuucaaacuguaauuaccugguuuguguuuauuguauuuaaguuccaaaa

SEQ ID NO: 186316 - RNA, 44 nt, Homo sapiens
cauauguguaguguccugccgcaaaggaguguguauguguguga

SEQ ID NO: 186317 - RNA, 33 nt, Homo sapiens
ccuuuuuagaccaaauagaaauuccuguuucuu

SEQ ID NO: 186318 - RNA, 32 nt, Homo sapiens
uuuuggguguuuuuuguuuguuuguuuguuug

SEQ ID NO: 186319 - RNA, 33 nt, Homo sapiens
aaucaaaaugaccacccaucaguugcaagagca

SEQ ID NO: 186320 - RNA, 23 nt, Homo sapiens
gugugccuuuaaaaaaaucuauu

SEQ ID NO: 186321 - RNA, 38 nt, Homo sapiens
aauggaauuguggcuuuugugucuuuuuuuuucuuuuu

SEQ ID NO: 186322 - RNA, 34 nt, Homo sapiens
uuuugagaagucguuugaaauuguuacuucagaa

SEQ ID NO: 186323 - RNA, 74 nt, Homo sapiens
aguugaugguuaagacuuuuaaccuucaauuacuaugggauuuucggaaacucugaagagaguagcugaaugag

SEQ ID NO: 186324 - RNA, 132 nt, Homo sapiens
caggugccccaacuuaagucuuaaaauacuggucuaucagaauaccucuucacaauccgggcuguagcuaacuaagcuuacuaguuggauaauagcugauuacuuugauuguuuugauggagcgaagagaug

SEQ ID NO: 186325 - RNA, 33 nt, Homo sapiens
ucuuccuauccauuacuacuuuuaaauccugcu

SEQ ID NO: 186326 - RNA, 46 nt, Homo sapiens
aacacucauauacucuaaccaccuagauucuacaauuaauauuuug

SEQ ID NO: 186327 - RNA, 45 nt, Homo sapiens
ucuauugaacaccagaggggcccacucauggacaauucaauuuag

SEQ ID NO: 186328 - RNA, 44 nt, Homo sapiens
gauggaaagauugcuuuaacuuuuuuuucgcaacuugcccaacc

SEQ ID NO: 186329 - RNA, 44 nt, Homo sapiens
gacagacguaccagaauuaaaauugacccuugcgccuuaugugu

SEQ ID NO: 186330 - RNA, 49 nt, Homo sapiens
guagucuaacccuaucauucuguauaggugggaaaauuuugaucuagag

SEQ ID NO: 186331 - RNA, 48 nt, Homo sapiens
ucuuagcauagcuaguuggagcuuuuuguagcuagagagacugaggug

SEQ ID NO: 186332 - RNA, 44 nt, Homo sapiens
gagagacaggaaacuuuaaacaguugaagaugagcuaagagagg

SEQ ID NO: 186333 - RNA, 47 nt, Homo sapiens
aacauaaguuuucuagcacuuuuccuaugacagugguaggcucaagg

SEQ ID NO: 186334 - RNA, 51 nt, Homo sapiens
ucaacauaaucagaacugccuuuauaagaauuaauuuggaagagauucacg

SEQ ID NO: 186335 - RNA, 92 nt, Homo sapiens
cccuuauuagcuaaaguaaaauuuacaucuguaagacuuacugaguugcugccaaaauggaacugaauucuuaaaagcaggaacaugccuau

SEQ ID NO: 186336 - RNA, 45 nt, Homo sapiens
cuuuguaggaauuccaguuuuucugaauucuucccuuuccuucag

SEQ ID NO: 186337 - RNA, 49 nt, Homo sapiens
ugcagucaaagaucaaaggcaaaaacgugauuuuagagaaagaaaagag

SEQ ID NO: 186338 - RNA, 47 nt, Homo sapiens
caugggggccuaugggaccagacaaaaccagaugucauaaugagggg

SEQ ID NO: 186339 - RNA, 44 nt, Homo sapiens
uggugggauauuauauguaaccuuguuauaaugggugcagaaga

SEQ ID NO: 186340 - RNA, 45 nt, Homo sapiens
uguguguuacuguuuugaaacagcuguuugucagagcuagggagg

SEQ ID NO: 186341 - RNA, 46 nt, Homo sapiens
ggcucaugccuccaucucuugaggccugccuuguguauugccaaug

SEQ ID NO: 186342 - RNA, 32 nt, Homo sapiens
gaggguggggguccugaggagcaagagguacg

SEQ ID NO: 186343 - RNA, 51 nt, Homo sapiens
gcuggauucagggcgcgccaguacgcgcaguagcggcccgcgagucggcag

SEQ ID NO: 186344 - RNA, 31 nt, Homo sapiens
gcgcgcacuucuacccgcuggagagugcgcg

SEQ ID NO: 186345 - RNA, 41 nt, Homo sapiens
caccgccaccaaacugagaugaucauuacgaaacagggcag

SEQ ID NO: 186346 - RNA, 50 nt, Homo sapiens
gggugggugcugagagaggggcacucaaaggggacuuuuagccuaaaguu

SEQ ID NO: 186347 - RNA, 45 nt, Homo sapiens
caucucccacggauucuccuagaucccaucagauugucccuggag

SEQ ID NO: 186348 - RNA, 45 nt, Homo sapiens
ucuuggauuuuuauguacagucuuagucauuuuuaauaaaugugg

SEQ ID NO: 186349 - RNA, 26 nt, Homo sapiens
cugcgcccaauuaaggccgccaggac

SEQ ID NO: 186350 - RNA, 45 nt, Homo sapiens
acuguccaagggauugcugaugauuaugauaaaaagaaacuagug

SEQ ID NO: 186351 - RNA, 24 nt, Homo sapiens
gcucagggccauccgggacuaugc

SEQ ID NO: 186352 - RNA, 44 nt, Homo sapiens
ggagaugacacccuguccucaggggucuuagagugugcagacag

SEQ ID NO: 186353 - RNA, 64 nt, Homo sapiens
uccaucaccccagaaagaaacacuguaccccuuagcagucaguccccauuucaccucaaccccc

SEQ ID NO: 186354 - RNA, 42 nt, Homo sapiens
cuggccaggccauggagggcacauuggaagcggggguagaca

SEQ ID NO: 186355 - RNA, 46 nt, Homo sapiens
cuguggguggcacgucacaguguguaaguauggucuugggugggca

SEQ ID NO: 186356 - RNA, 44 nt, Homo sapiens
gaagauaugugggacaggcuggcugggggaggggguauggauaa

SEQ ID NO: 186357 - RNA, 44 nt, Homo sapiens
acugcuuuacuguauaucccucucuuuuuuaguacccuuggggu

SEQ ID NO: 186358 - RNA, 43 nt, Homo sapiens
ggggagccugggcucccgaaggcagaucuggaggccuucuggg

SEQ ID NO: 186359 - RNA, 46 nt, Homo sapiens
agaagacagacaccuccgacaagaaguugcagcugauuaaggacua

SEQ ID NO: 186360 - RNA, 79 nt, Homo sapiens
aauccagagaguggggucuucuaucugaaaaugaagggugauuacuuccaguacuuugcugaagcugcaugugguaaug

SEQ ID NO: 186361 - RNA, 111 nt, Homo sapiens
cgguuaacuuuucuguauuuuacuaugagauucuuaauaacccagagcuugccugcacgcuggcuaaaacggcuuuugaugaggccauugcagaacuugauacacugaaug

SEQ ID NO: 186362 - RNA, 78 nt, Homo sapiens
aagauucauccaaaagacagcacccucauuauggaguuucuuagagacaaccuaacacuauggaccucagacagugca

SEQ ID NO: 186363 - RNA, 79 nt, Homo sapiens
auuuauguauacggaaucaucuguuuacagucuuuucacacugcagcauugggaaaacuucauuccuugauuugucuug

SEQ ID NO: 186364 - RNA, 52 nt, Homo sapiens
uaaucugaaccaguucugcaagugacuguguuuuguauuacugugaagauau

SEQ ID NO: 186365 - RNA, 44 nt, Homo sapiens
uuccacacaacuucuccauuucuacauucccucccauacucguc

SEQ ID NO: 186366 - RNA, 46 nt, Homo sapiens
uguaucacauauuauggaggucauauauaucuguggcaacagggac

SEQ ID NO: 186367 - RNA, 53 nt, Homo sapiens
ucuugcauccugaguuuauaauaauaaauaauauucuaccuuggaaacuugug

SEQ ID NO: 186368 - RNA, 43 nt, Homo sapiens
aggcaucuucuacauguuuuguacgcauuaaaauaauuucaaa

SEQ ID NO: 186369 - RNA, 59 nt, Homo sapiens
gccucagcauccugucucccauggagagaccccauuuccugccucgggggcccgaagaa

SEQ ID NO: 186370 - RNA, 48 nt, Homo sapiens
cccaucuccuggagggaggugcguuggaaauucuaggcccuucagcag

SEQ ID NO: 186371 - RNA, 47 nt, Homo sapiens
cugugaagacuauaauuuauuuccauaauuuauuuggagauugagga

SEQ ID NO: 186372 - RNA, 45 nt, Homo sapiens
agcuccgccagcgcuugaaagaggagaaguuggagaugcugcagu

SEQ ID NO: 186373 - RNA, 45 nt, Homo sapiens
cggcaccaccaugacugggcuguugaagaggaaauuugaccagcu

SEQ ID NO: 186374 - RNA, 52 nt, Homo sapiens
uugugcagagauccuccuggagacugugcccucccccacacagagcuccaca

SEQ ID NO: 186375 - RNA, 42 nt, Homo sapiens
ugggaguuugaagcaucaggcuguggauuugcacauuaguuu

SEQ ID NO: 186376 - RNA, 77 nt, Homo sapiens
aaggguuccccagcacuggggccucggccucagcuucaacuuccuuucccuuucccccuggugaccuccccgaaggc

SEQ ID NO: 186377 - RNA, 45 nt, Homo sapiens
uacaugaacucccaggcauggcgugccuggauauagauggaggaa

SEQ ID NO: 186378 - RNA, 53 nt, Homo sapiens
agacaugugacucuccuccugccccucuuaaauuaacugugacaggagcagga

SEQ ID NO: 186379 - RNA, 52 nt, Homo sapiens
gccuacauuccuuccucggagagaccuaccuucaccccagccguacccuguc

SEQ ID NO: 186380 - RNA, 45 nt, Homo sapiens
gugcguccgcgggugaguuuccuuuugacccaguugccugagaac

SEQ ID NO: 186381 - RNA, 43 nt, Homo sapiens
cugccguucacuccccggcacccugagcgggcgcgggggcugg

SEQ ID NO: 186382 - RNA, 49 nt, Homo sapiens
cacagaagaggcugguucuuacgauggcacccagugagcacucccaagu

SEQ ID NO: 186383 - RNA, 65 nt, Homo sapiens
agagagaggcucugagcccuuacucagauuuccucagauucaaagccccauguuccuggagcuag

SEQ ID NO: 186384 - RNA, 45 nt, Homo sapiens
ccuagagaaaacuugaauucauagaaaaaguagguacacguaaau

SEQ ID NO: 186385 - RNA, 56 nt, Homo sapiens
aaacaagucauuuugcaaacugagguucugauuugacguaaugaaaauuacugcag

SEQ ID NO: 186386 - RNA, 54 nt, Homo sapiens
agaaccaugaaacucaauggugugguuccagucugaaggccagcaggguugaag

SEQ ID NO: 186387 - RNA, 47 nt, Homo sapiens
agugauccuuuaccauguggcaggugacugacaucaaguacccugaa

SEQ ID NO: 186388 - RNA, 55 nt, Homo sapiens
ucagacuuucugcaaaugacaccaggauauuuauacuuuaggggaauuguugacu

SEQ ID NO: 186389 - RNA, 65 nt, Homo sapiens
agauggauagauaaauagguuagaggacccacuugaauuagaugcuacuucugggacaagcaaau

SEQ ID NO: 186390 - RNA, 28 nt, Homo sapiens
augauagauaguugauagacugacagau

SEQ ID NO: 186391 - RNA, 46 nt, Homo sapiens
aacuccagguuuugugcauauggcucaaugcucaaacagaaaccag

SEQ ID NO: 186392 - RNA, 27 nt, Homo sapiens
cuccagcggcggaggcgcgcacgcgug

SEQ ID NO: 186393 - RNA, 45 nt, Homo sapiens
gaccaauuuuccggcaugagguccaaaggagacauaggccacccg

SEQ ID NO: 186394 - RNA, 45 nt, Homo sapiens
gaugaaaucagugagcugcaugcacuugaaaggcauggccugucu

SEQ ID NO: 186395 - RNA, 48 nt, Homo sapiens
aucuucuuggcccaucguguggcugcccauuuuguauugaugucugcc

SEQ ID NO: 186396 - RNA, 49 nt, Homo sapiens
uggaguuugacauuguauguaucuauuuauuaaguucucaaugugaaaa

SEQ ID NO: 186397 - RNA, 65 nt, Homo sapiens
cgaauguccaucguuaagaaccugcagaaccuggaccccagccacaggauaagugaccgggacua

SEQ ID NO: 186398 - RNA, 44 nt, Homo sapiens
cauccagcccauguagucccggucacuuauccuguggcuggggu

SEQ ID NO: 186399 - RNA, 59 nt, Homo sapiens
cuccaaauaaacugccucuucaugucccugcucacucagugugagcucuacaaaaggau

SEQ ID NO: 186400 - RNA, 42 nt, Homo sapiens
agcgcaccugggcgcccugcuggcaagauacauccagcaggc

SEQ ID NO: 186401 - RNA, 58 nt, Homo sapiens
accuccggacgugagaauuacaggcuuggaucucaaaccgccgcggugagagccggga

SEQ ID NO: 186402 - RNA, 50 nt, Homo sapiens
augcaccugcuguguugacaucuguauuagucaagguucuccagagagag

SEQ ID NO: 186403 - RNA, 45 nt, Homo sapiens
caguuccuuuccccuuuauucuacaagaucuuuuccauuguaaac

SEQ ID NO: 186404 - RNA, 48 nt, Homo sapiens
uucucuuguacuuaaagacagugauuuuucaguuuucccgaccccuga

SEQ ID NO: 186405 - RNA, 22 nt, Homo sapiens
uggaauaaaacauuccagagua

SEQ ID NO: 186406 - RNA, 81 nt, Homo sapiens
acgauguaugguuuccugauuagauacauuccuucuccuucuuugauccguuccucccaugacucacagauccugcaguau

SEQ ID NO: 186407 - RNA, 51 nt, Homo sapiens
acacaaaauacuggugguguggauaaggcugguggcaaggaaauaagaaaa

SEQ ID NO: 186408 - RNA, 33 nt, Homo sapiens
ugauucugaagaagaggaggaauuggaagagga

SEQ ID NO: 186409 - RNA, 46 nt, Homo sapiens
aggaggaguuucacugcugucaucaucaucugacucagaacaggau

SEQ ID NO: 186410 - RNA, 47 nt, Homo sapiens
cacuguauuuauuucgugaaugagaucuagaugauggagaccuagac

SEQ ID NO: 186411 - RNA, 46 nt, Homo sapiens
ucugcuguaccauccucugcuccgacuucuagaguagcuucuugau

SEQ ID NO: 186412 - RNA, 115 nt, Homo sapiens
gaucgguauugauuaaaaagaacauaaaauaguaaguccucagagacagugcagguauuuauaguuaaggcugauugauucuuccuaaccuugcccacaagccugaaguaauaca

SEQ ID NO: 186413 - RNA, 30 nt, Homo sapiens
gaggcucagagcgggacaaaucacuuaggc

SEQ ID NO: 186414 - RNA, 69 nt, Homo sapiens
ugagcccugcgccgcccugggauagggaugggggacuggaccaguuggggaccccagacucacccccag

SEQ ID NO: 186415 - RNA, 45 nt, Homo sapiens
ccuagcaagaccucagccucgcgcgccggcgcccccaccacagga

SEQ ID NO: 186416 - RNA, 55 nt, Homo sapiens
ccacaccaucuggggcuuccagagcccuagcggaggcccucaaugucugaugggu

SEQ ID NO: 186417 - RNA, 27 nt, Homo sapiens
uuggguaagggcggggagguugggggg

SEQ ID NO: 186418 - RNA, 122 nt, Homo sapiens
uaaggaaagguggugcugaggcaguuuggagaaaaaacucaaggccuauaggagggaagguguugcuccagcuggguggaggugggugggugauggaguugggauggcggugcuggggcugg

SEQ ID NO: 186419 - RNA, 58 nt, Homo sapiens
cguccagggcaaggcugggggccugcuaggggcugggguugugaguuggaggguggag

SEQ ID NO: 186420 - RNA, 77 nt, Homo sapiens
cuuaggucauagacucacagaaacagggcccaaauagcagccggauuuucuucucuccugccuuccgggugcuuggu

SEQ ID NO: 186421 - RNA, 40 nt, Homo sapiens
gcaaccuugugcugaaggcuugguggagagccaggguaga

SEQ ID NO: 186422 - RNA, 49 nt, Homo sapiens
ugugaaauucucuugucuaaucugaauuugcauuccaugguguuaacau

SEQ ID NO: 186423 - RNA, 30 nt, Homo sapiens
aaugucaucuugaaauagaaauauguauuu

SEQ ID NO: 186424 - RNA, 28 nt, Homo sapiens
aauauaacuuguaaagcuucccacaauu

SEQ ID NO: 186425 - RNA, 42 nt, Homo sapiens
aaauuuuuaagaugaacuuaguucuaaagaagauaacaggcc

SEQ ID NO: 186426 - RNA, 45 nt, Homo sapiens
caggaauagcggguuuugcagcaauuguugcauauggauuauaua

SEQ ID NO: 186427 - RNA, 41 nt, Homo sapiens
aggaagaucagggaucaaaacucauucgaaaagcuaaagag

SEQ ID NO: 186428 - RNA, 46 nt, Homo sapiens
auggugcuaaaaaugaauggguuguacaggggaaacggcaaaauaa

SEQ ID NO: 186429 - RNA, 29 nt, Homo sapiens
uucaguuuugugcugcagugauguuaaaa

SEQ ID NO: 186430 - RNA, 48 nt, Homo sapiens
ugauuuguuacucucaaauuauaugauuagaacuuauuguuccugaua

SEQ ID NO: 186431 - RNA, 45 nt, Homo sapiens
auucaacuuucugacagaaaucugggacaacuacuguggguggau

SEQ ID NO: 186432 - RNA, 40 nt, Homo sapiens
aagcgaaacaagccgggggacugcgagccagggacucggg

SEQ ID NO: 186433 - RNA, 134 nt, Homo sapiens
cccggcuuguuucgcuuaccuagagcgagaaaaccucucacaccccaaccggcuuccgaucccugcaggcgcacccaguccucccggcuucuccccacccacagccgucccagccaaucagaggccagcggccg

SEQ ID NO: 186434 - RNA, 46 nt, Homo sapiens
agugcagagcggguccuggauuggcugggccggugagugcuggccc

SEQ ID NO: 186435 - RNA, 45 nt, Homo sapiens
cuauuuguaacuguuggaucgcauacaguccaguaguuucauagg

SEQ ID NO: 186436 - RNA, 97 nt, Homo sapiens
auuuauucauggaauguuugugugucucuuuugguggcccuaggguagagggagggcagcaguagaaaagugaauaaaaaccaguuccugacuguag

SEQ ID NO: 186437 - RNA, 128 nt, Homo sapiens
guucuuagaagcuacuggggaacaccaagguaaacaguaacaguacgaacagaugaacuguggugaggcauagggaaaaaccugcagaagcacaaggauggcggcagugaacaaccugacauggaaau

SEQ ID NO: 186438 - RNA, 116 nt, Homo sapiens
gcuucacagaggaggugaugguuaaacuggucuugaagaauaggaagaauucccaggcagagaaaaagggaaaaggcucaggggguucagggagggugagaagacaaggucaagug

SEQ ID NO: 186439 - RNA, 50 nt, Homo sapiens
uuaaucuguuaauuuguagaucccaucuugauuccauccagugauugcag

SEQ ID NO: 186440 - RNA, 70 nt, Homo sapiens
uugcuauucuaagaaagcauugccuucuacauuaguguuaggucauaugucagugucuugugaccguagu

SEQ ID NO: 186441 - RNA, 45 nt, Homo sapiens
cucccuccuucucuucucagccucugaacuggccuccugccuggg

SEQ ID NO: 186442 - RNA, 45 nt, Homo sapiens
cucccucauucccuucucagccucugaacuggccuccugccuggg

SEQ ID NO: 186443 - RNA, 52 nt, Homo sapiens
ucucuaccccucauguuuucugucccccccccacacacacacaccuacacuc

SEQ ID NO: 186444 - RNA, 45 nt, Homo sapiens
cucccuccuucccuucucagccucugaacuggccuccugccuggg

SEQ ID NO: 186445 - RNA, 40 nt, Homo sapiens
gaccccaaagagaagcuuguuacagcugcaguugguccga

SEQ ID NO: 186446 - RNA, 50 nt, Homo sapiens
ucuccucuggagucuccuuuccuuuaucugcccaucuccuacuccaugga

SEQ ID NO: 186447 - RNA, 51 nt, Homo sapiens
cuacacgaaugauuagagaauaagcaaaaggaacaaacagggucacuaggg

SEQ ID NO: 186448 - RNA, 62 nt, Homo sapiens
agaagcagggcuugucccacucauagcuuucuuuccucccucagcucaauguacuucuccag

SEQ ID NO: 186449 - RNA, 46 nt, Homo sapiens
ucaucuaacaggacaucagggggacucuuuggggugguuccugggg

SEQ ID NO: 186450 - RNA, 71 nt, Homo sapiens
ucagaugaagaagggagcagacuagaaaaugauuucuuggaaauaacagaugaagauaagaaaaaauccac

SEQ ID NO: 186451 - RNA, 45 nt, Homo sapiens
uuucucuccaguguggauucucugauggccaauaaggugagaacu

SEQ ID NO: 186452 - RNA, 42 nt, Homo sapiens
aaauaauauguaaaacauuuuuuacaguggacagacuggcuc

SEQ ID NO: 186453 - RNA, 29 nt, Homo sapiens
aggacaucaaauauauaagacagacaaaa

SEQ ID NO: 186454 - RNA, 45 nt, Homo sapiens
uuguaucaacucugcgaauacugggaaacacuuaacauuucuuag

SEQ ID NO: 186455 - RNA, 89 nt, Homo sapiens
uagaggcuaggcuccuuccccguagggagcuaggaaagaagggaaaugauacucacugagguauuggcucuucuccauugggagggugg

SEQ ID NO: 186456 - RNA, 96 nt, Homo sapiens
gggaaggcugucguucucagggaaagaaguauuaggugaacacacccggauccuaagggugacccagccuaaaagcucagggcuagucagcugggg

SEQ ID NO: 186457 - RNA, 46 nt, Homo sapiens
cauucccucagggaggagaauagaagacugagauuauuagagccug

SEQ ID NO: 186458 - RNA, 50 nt, Homo sapiens
ccauuucucacuuuuccuccuuguggcccaaaauugauaccugacagaga

SEQ ID NO: 186459 - RNA, 54 nt, Homo sapiens
gauaauucaauugggcauuuuacuuuaaauauuaaacucucauagcagcaacua

SEQ ID NO: 186460 - RNA, 42 nt, Homo sapiens
aucugugacuguccuuuugaguguaggacaaggacuguccuu

SEQ ID NO: 186461 - RNA, 47 nt, Homo sapiens
ugcucuacagggagcuugcugcacuccauguuuauuucugaaggcag

SEQ ID NO: 186462 - RNA, 45 nt, Homo sapiens
cacauuuggcaaaacuccuggaaacacaagaacaagagauagaag

SEQ ID NO: 186463 - RNA, 47 nt, Homo sapiens
acgagaacucuaugggcuaaaucuuggccugccuguguggaguuaaa

SEQ ID NO: 186464 - RNA, 48 nt, Homo sapiens
auagcuguggcagagaccgcauggcucccaaagccugaaauauuuacu

SEQ ID NO: 186465 - RNA, 47 nt, Homo sapiens
cuuuggagucuaaagcauuccaggaaaaagaacaacugagaucaaag

SEQ ID NO: 186466 - RNA, 46 nt, Homo sapiens
uggcugcaauggcaguccacaccuggccagggagaguugggggugg

SEQ ID NO: 186467 - RNA, 42 nt, Homo sapiens
aaccuuuuccaaguugaucuauccagugacguggccuggugg

SEQ ID NO: 186468 - RNA, 53 nt, Homo sapiens
uaguuguauuugaaauuugugguuuuuuaauuuauuuaaaauuggggggaggg

SEQ ID NO: 186469 - RNA, 43 nt, Homo sapiens
auauauagauauauauccauacauuuuauugucagaauuuaga

SEQ ID NO: 186470 - RNA, 51 nt, Homo sapiens
aagaaugaauggccuaggggguaaagaagccaccuagugguggagguaaag

SEQ ID NO: 186471 - RNA, 51 nt, Homo sapiens
aaaucuuguguuuaaagagauuuagaggaagccugaagaggaaaguggaca

SEQ ID NO: 186472 - RNA, 16 nt, Homo sapiens
caggcuuccauuguug

SEQ ID NO: 186473 - RNA, 45 nt, Homo sapiens
augacggcagggugaagagagacuuuaacgaugcuucuucggcgg

SEQ ID NO: 186474 - RNA, 45 nt, Homo sapiens
cgcuugaguccgacucggagcuggagucgcugcugcugucucggu

SEQ ID NO: 186475 - RNA, 42 nt, Homo sapiens
cagcagcagcgacuccagcuccgagucggacucaagcgacga

SEQ ID NO: 186476 - RNA, 42 nt, Homo sapiens
gaaaacagaaauaaguauagucaaauuguaggggguccaaaa

SEQ ID NO: 186477 - RNA, 49 nt, Homo sapiens
ucugugguguuuggaguuuccaucccggcuucuccuacagguuaaaaaa

SEQ ID NO: 186478 - RNA, 44 nt, Homo sapiens
uggcagugagauguucccagaauguuuggagcaauugaagugug

SEQ ID NO: 186479 - RNA, 38 nt, Homo sapiens
caacaagggcgaacgcugugaaggagaaaacuaaaggg

SEQ ID NO: 186480 - RNA, 58 nt, Homo sapiens
auuuggaaacuaauuuuuugaaaaggaguaaggaggguuguggucauaauagauugau

SEQ ID NO: 186481 - RNA, 53 nt, Homo sapiens
aguaaaaucguguuccaagauuuagauaugguagaaaaacaaagcccaugagu

SEQ ID NO: 186482 - RNA, 26 nt, Homo sapiens
agccuguuagggagauggugcaggga

SEQ ID NO: 186483 - RNA, 92 nt, Homo sapiens
gcauacucaugcauaucuaaaggaaggugacaucaugagugauaggggauacccucuuccaauaucuuguagccccuuucaugcuuaaaaug

SEQ ID NO: 186484 - RNA, 38 nt, Homo sapiens
aaaacaccacuguugcuuagcaacagggaaggcaguca

SEQ ID NO: 186485 - RNA, 45 nt, Homo sapiens
cagcagggagaccccuuagucccugagauaaggaaggccucagaa

SEQ ID NO: 186486 - RNA, 46 nt, Homo sapiens
gggagaguggucgugagcuggucuuggggcacaauuacccagagau

SEQ ID NO: 186487 - RNA, 48 nt, Homo sapiens
cucuccagucaacacagggcucccuguggugacaccaguggagaugag

SEQ ID NO: 186488 - RNA, 54 nt, Homo sapiens
gugcagugaggggaccuggguccuuugcuucugagaaugcucaacugaaagaga

SEQ ID NO: 186489 - RNA, 49 nt, Homo sapiens
gaacccccaaagaagucucccacccuagcagucccugcagaaugugugu

SEQ ID NO: 186490 - RNA, 45 nt, Homo sapiens
uaggugaugaugagugauaaggaaaaauagaaaggaauagggagu

SEQ ID NO: 186491 - RNA, 55 nt, Homo sapiens
ugcuguuugcugguuugcuuugcaaccucuaaaugaaagaacuuagcugcucagu

SEQ ID NO: 186492 - RNA, 47 nt, Homo sapiens
cggacuaggccagauggaggagaaggcuugccugcuacugcgcacag

SEQ ID NO: 186493 - RNA, 47 nt, Homo sapiens
acagaagccauaagaauggaacucccuauaacuuguggcccccaagu

SEQ ID NO: 186494 - RNA, 49 nt, Homo sapiens
gaacaucgccaccagucgaggggucaucggccacccugccuagcaguuc

SEQ ID NO: 186495 - RNA, 39 nt, Homo sapiens
augacauaguguggaccaagggcuuugccaguggggggu

SEQ ID NO: 186496 - RNA, 47 nt, Homo sapiens
auuuaaacuaaguccuggaugaugaauaacaguuaugugcauauaug

SEQ ID NO: 186497 - RNA, 42 nt, Homo sapiens
gcaagcagauaggauaaauagggacaaaguuagcugcugaag

SEQ ID NO: 186498 - RNA, 99 nt, Homo sapiens
gugagaccccaaagggagagcgaaaggaguuuacuagauggaagcagcagaaggaacagcacucuugggagagggaacaguagaagcagagaugggggg

SEQ ID NO: 186499 - RNA, 47 nt, Homo sapiens
aagacuugaaggagaugagggagggagccagcuagauaucugaggaa

SEQ ID NO: 186500 - RNA, 52 nt, Homo sapiens
aagagcaagacagggugagcagagagacagagaaggaugagaggcaucaaga

SEQ ID NO: 186501 - RNA, 24 nt, Homo sapiens
agcaagagagaacaagagauagug

SEQ ID NO: 186502 - RNA, 33 nt, Homo sapiens
agcagcuggaaggaccgagcugacauuaccuga

SEQ ID NO: 186503 - RNA, 49 nt, Homo sapiens
acauacgagaaaacugaggucgagagaagcuaaguaauuuguccaaggu

SEQ ID NO: 186504 - RNA, 43 nt, Homo sapiens
gcuacauggguucaaaucccagcucugucacucaggaacuggg

SEQ ID NO: 186505 - RNA, 80 nt, Homo sapiens
gugugguguguauuugugugugugugugugugagagagagagaaagagagagagagagagagagagagagagagagagag

SEQ ID NO: 186506 - RNA, 53 nt, Homo sapiens
ggcugcagggcucgacuggggggugugucuggggcggaggugggggcuggggc

SEQ ID NO: 186507 - RNA, 46 nt, Homo sapiens
gaucgagacagagcugggcaagaagacccucagcaaccuggagaag

SEQ ID NO: 186508 - RNA, 47 nt, Homo sapiens
ccagaccaucgaggacacaggcaccaucaugcgggagguucgagacc

SEQ ID NO: 186509 - RNA, 47 nt, Homo sapiens
gauacccagggcuggcuuuguuucauggaggaugaagcuaguggggu

SEQ ID NO: 186510 - RNA, 32 nt, Homo sapiens
cuaucugggaagcuggaccggacguuugcggu

SEQ ID NO: 186511 - RNA, 44 nt, Homo sapiens
ugguccuggggcagugccugcuauaucccugccuagaugucaga

SEQ ID NO: 186512 - RNA, 40 nt, Homo sapiens
auugugccaccuggacccuuucaccuucccagacucccaa

SEQ ID NO: 186513 - RNA, 42 nt, Homo sapiens
ggaggaggcggaccgaauccucauccauucgcugcgccaggc

SEQ ID NO: 186514 - RNA, 44 nt, Homo sapiens
agagcgcacuccuuuucuccaccucccccuuccuccccuucacc

SEQ ID NO: 186515 - RNA, 53 nt, Homo sapiens
ggcgagucggauggggaagggguucggguagagaauggggauggaguggggug

SEQ ID NO: 186516 - RNA, 44 nt, Homo sapiens
agacaggacagagagacagagacaaacagaccaagaaacagaaa

SEQ ID NO: 186517 - RNA, 43 nt, Homo sapiens
acauagagaaacagagauaccgagagaaacagagacacaguga

SEQ ID NO: 186518 - RNA, 41 nt, Homo sapiens
acugaggguaaauguaggcucaagugaucacccagugggga

SEQ ID NO: 186519 - RNA, 50 nt, Homo sapiens
uaugucuccgugacucuaugacucugugucccggaugccugguguggauu

SEQ ID NO: 186520 - RNA, 46 nt, Homo sapiens
gucagaugugaagauggccacagacccagagaacauuaucaaggag

SEQ ID NO: 186521 - RNA, 45 nt, Homo sapiens
cuggcuggaggagggagaguggaaaacaguacaguccggcauggg

SEQ ID NO: 186522 - RNA, 92 nt, Homo sapiens
acuaccugcuaagagcugaaaaacuagcuaaugaauggagaaaagaagaauggugcuucaagauggacagaaugaagagccaaugggaggga

SEQ ID NO: 186523 - RNA, 45 nt, Homo sapiens
ggccuuuguucaggcaggcauugcuggaggaaccaaggccagagu

SEQ ID NO: 186524 - RNA, 44 nt, Homo sapiens
acugcaccauggggaggggcugcccuuucugaaaccaccaugga

SEQ ID NO: 186525 - RNA, 44 nt, Homo sapiens
cuggguuugggcaguggagaggggacuuggauaggagcuuccag

SEQ ID NO: 186526 - RNA, 47 nt, Homo sapiens
ggcuccagaccaggccuccaaccaccccaggacggguggaggugugg

SEQ ID NO: 186527 - RNA, 52 nt, Homo sapiens
cagaccccuacccuuucccaaacccuucgguauuguucaaagaaccccccuc

SEQ ID NO: 186528 - RNA, 23 nt, Homo sapiens
uccaucccuccgugcacauuccu

SEQ ID NO: 186529 - RNA, 25 nt, Homo sapiens
acuccuccgaugcacagccugaguc

SEQ ID NO: 186530 - RNA, 39 nt, Homo sapiens
gggaggacauaggagugggagaaaacaacugaaaugaga

SEQ ID NO: 186531 - RNA, 28 nt, Homo sapiens
cuugcuccagcucgcccuccaguuccag

SEQ ID NO: 186532 - RNA, 92 nt, Homo sapiens
uaagucacaaaaugagggaaguggggaguuagauuucagaguccaggcccuagguugggacccacuccaaauaaucuccucggugugggugg

SEQ ID NO: 186533 - RNA, 45 nt, Homo sapiens
ccauaugugugugccuagguccuccuucugcacgauccaauagga

SEQ ID NO: 186534 - RNA, 42 nt, Homo sapiens
ggauuucuuccgaacccucauagcggcaauccucuaccugau

SEQ ID NO: 186535 - RNA, 42 nt, Homo sapiens
uggcagggcguggcgcggccugggcacaggagggcgggcugg

SEQ ID NO: 186536 - RNA, 20 nt, Homo sapiens
uacguggggacagccugcgu

SEQ ID NO: 186537 - RNA, 30 nt, Homo sapiens
aggcaccagggacuccagcccaugccaugg

SEQ ID NO: 186538 - RNA, 31 nt, Homo sapiens
gcggcaaaacacccucuuuggagucagccau

SEQ ID NO: 186539 - RNA, 335 nt, Homo sapiens
ugaggaugacuccaagguuuucuuuuuuuuuuuucuugagaugaagucuugcuguguugcccaggcuggagugcaguugcaugaucucagcucacugcaaccucagucuccuggguucaagcgauucuccugccucagccucccgaguagcugugauuacaggcacgugccaccaugcccagcuaauuuuuguauuuuuacuagugaugggguuucgccauguuggccaggcuggucuugaacuccugaccucaggugauccgcuggccucagccucucaaaguguugggauuacaggcgugagccaccgccccuggcugacuccaagguuuuua

SEQ ID NO: 186540 - RNA, 45 nt, Homo sapiens
uuuccagcccaugccccgcagcauggccagcccauaggccuccac

SEQ ID NO: 186541 - RNA, 45 nt, Homo sapiens
uugcuccucaucuggucuuggcaugcgggaggggccagugggggu

SEQ ID NO: 186542 - RNA, 45 nt, Homo sapiens
gggggcugcuuucucacucuuggcugcaggcccauccugucugug

SEQ ID NO: 186543 - RNA, 46 nt, Homo sapiens
cuagggcccauguacuggcagauggcaucguagugaagcuccacca

SEQ ID NO: 186544 - RNA, 41 nt, Homo sapiens
gcggaggucaggccggugaaggcggcaggaagcuggagcac

SEQ ID NO: 186545 - RNA, 65 nt, Homo sapiens
ggggucuaaggcagaggucuugagugggugcuggcguuggaaggagcaugcggcuggucuuggga

SEQ ID NO: 186546 - RNA, 28 nt, Homo sapiens
gcuagggggaauccuaggguagaguccc

SEQ ID NO: 186547 - RNA, 46 nt, Homo sapiens
cucugggguggucaaauagguugggguacaguuagaaggguaugag

SEQ ID NO: 186548 - RNA, 46 nt, Homo sapiens
cucuucagccgcccaccccaccccccaucuucacacccuagggcuc

SEQ ID NO: 186549 - RNA, 41 nt, Homo sapiens
gucugcaacuuguggugagccguccaguggacaaggguggg

SEQ ID NO: 186550 - RNA, 46 nt, Homo sapiens
gucccccugcccauuuaccauaccugggcuuagccagugcugccug

SEQ ID NO: 186551 - RNA, 42 nt, Homo sapiens
gacccgcagcgauggugccaccgcgucaucaacaaccuccuc

SEQ ID NO: 186552 - RNA, 47 nt, Homo sapiens
ucugcagagcguggggguagacccacaggucuuugaggaccaggacg

SEQ ID NO: 186553 - RNA, 51 nt, Homo sapiens
gaguacuuagggcagagaccgggaaauagacgguaaaguuggaggguuugg

SEQ ID NO: 186554 - RNA, 41 nt, Homo sapiens
gggcggcgcuugcaccuuccuguucagcaucgccgggccgg

SEQ ID NO: 186555 - RNA, 45 nt, Homo sapiens
cgccucguugcgccugcgcaaccuuaagaacaagauugagaacaa

SEQ ID NO: 186556 - RNA, 61 nt, Homo sapiens
ccugggaucuguacccaggaccuggagaauaccaccccacccccagcccauaauugggacc

SEQ ID NO: 186557 - RNA, 47 nt, Homo sapiens
aagagccaccuacauccagccccaaaacuggggcuucaggccagagc

SEQ ID NO: 186558 - RNA, 126 nt, Homo sapiens
gccaaaucuugaacucagaacccaaguguuccaugccccuguguggauggagucggguauccugacuguuggaccccugguccaggugaucccgacccucaccagucccauuugccucccuccagc

SEQ ID NO: 186559 - RNA, 42 nt, Homo sapiens
cguuuaagugaccugacgcuagagggggagcaguccuccagu

SEQ ID NO: 186560 - RNA, 42 nt, Homo sapiens
acccgugccacccgcacuaagcccuguggccugcccccagag

SEQ ID NO: 186561 - RNA, 45 nt, Homo sapiens
gcugccgccugcagcugaggucccaggaccccucucccgccggga

SEQ ID NO: 186562 - RNA, 42 nt, Homo sapiens
caaccaaccccugccuucuccucccgcacagcaggcccccca

SEQ ID NO: 186563 - RNA, 64 nt, Homo sapiens
aagaggggacagguacagaggaguagccaggaggaagguguggggagggggcuuguggccaggu

SEQ ID NO: 186564 - RNA, 61 nt, Homo sapiens
gucaagugaacauucuccuugcuacacuagagcuacagaauggaguugggacaagcacaga

SEQ ID NO: 186565 - RNA, 60 nt, Homo sapiens
gguuggcugggucuuccucacaccaggcuaacaugucaugacaagcugccgacuucaagg

SEQ ID NO: 186566 - RNA, 44 nt, Homo sapiens
gaggcagaagcuuaggaacuggguguggggguguggggcguuga

SEQ ID NO: 186567 - RNA, 47 nt, Homo sapiens
ggcacaccaacaaugcagggcaggguggugguggggggguagggggg

SEQ ID NO: 186568 - RNA, 27 nt, Homo sapiens
uccugguggcagacaggcaaggguuaa

SEQ ID NO: 186569 - RNA, 46 nt, Homo sapiens
cauuccucacuuucccaaucuauuugguaccugaauucugagaggg

SEQ ID NO: 186570 - RNA, 45 nt, Homo sapiens
ggcgcguccacugccccggccggccgaccgacaccgaccccgccu

SEQ ID NO: 186571 - RNA, 45 nt, Homo sapiens
ccgggguuagguugagggggggcgucgguccguucugggcggggg

SEQ ID NO: 186572 - RNA, 45 nt, Homo sapiens
aagccauggagcuagcacugcgcgggcgggcggcgucugggagau

SEQ ID NO: 186573 - RNA, 47 nt, Homo sapiens
agugcuagcuccauggcuuagcggaggaggcggcaguggcgagcugg

SEQ ID NO: 186574 - RNA, 42 nt, Homo sapiens
guagaggccagcgcggagggcccucgagccguguucgugcug

SEQ ID NO: 186575 - RNA, 44 nt, Homo sapiens
ggucugggucagguuuggggagcccuugacugcgucuagcgggg

SEQ ID NO: 186576 - RNA, 69 nt, Homo sapiens
aagucuugcugaauguugcuucucuuguucauucacacgcacucacaaggcuggucccaggcagcauau

SEQ ID NO: 186577 - RNA, 48 nt, Homo sapiens
cucuucccaacuuccugggugguuuuagggcuccaucugagggugagg

SEQ ID NO: 186578 - RNA, 43 nt, Homo sapiens
aauuccucuguaacaaccuagaucaucgcaguaguggacauag

SEQ ID NO: 186579 - RNA, 38 nt, Homo sapiens
caagugaauuauuuccaguucucuuugugaugcauuca

SEQ ID NO: 186580 - RNA, 349 nt, Homo sapiens
agcaggggguuggccgggcgcaguggcucacaccuguaaucccagcacuuugggaggccgaggcaagcggaucuugaggucaggagaucgagaccauccuggcuaauauggugaaaccccgucucuacuaaaaauacaaaaauuagccggacgugguggcgugugccuguaaucccagcuacucgggaggcugaggcgugagaaucacuugaacccaggaggcagagcuugcagugagcugagaucgcaccacuguacuccagccuggugacagagcgauacucugucucaaaaaaaaaaaaaaaguaggggguaugggggcugggagaacucugaauaggaagucagg

SEQ ID NO: 186581 - RNA, 45 nt, Homo sapiens
uugggaugcaggcguucuuauuauucugacuccuaagggacuaug

SEQ ID NO: 186582 - RNA, 33 nt, Homo sapiens
gcucaaaagccaacccuuaccccuucgcucaag

SEQ ID NO: 186583 - RNA, 44 nt, Homo sapiens
ccacagccucccaauaucacugcaggccacaccagccaccccag

SEQ ID NO: 186584 - RNA, 45 nt, Homo sapiens
agaguguagcugggguggcugguguggccugcagugauauuggga

SEQ ID NO: 186585 - RNA, 48 nt, Homo sapiens
gcagggggcuccaggaccccugccaugucgucaucuucuucaucgagg

SEQ ID NO: 186586 - RNA, 37 nt, Homo sapiens
gagguaagaggcuacagccaaaccuccucccacauuc

SEQ ID NO: 186587 - RNA, 45 nt, Homo sapiens
cuggguauacuuaagauugacgugcuccucuggaguauauccagg

SEQ ID NO: 186588 - RNA, 29 nt, Homo sapiens
cugcagguggaggcagagagagagcaggc

SEQ ID NO: 186589 - RNA, 44 nt, Homo sapiens
ccugccaguaccucccacuccagggcugcuuuccuuggccacga

SEQ ID NO: 186590 - RNA, 45 nt, Homo sapiens
cugauuacagggguggggccugaucacaucuccucuucccccagg

SEQ ID NO: 186591 - RNA, 50 nt, Homo sapiens
uccugggggaagaggagaugugaucaggccccaccccuguaaucaggcaa

SEQ ID NO: 186592 - RNA, 108 nt, Homo sapiens
ccugcaccuuccccaaaggaaccgcccagugcagguauuucagaaggagaaggcuggagaaggacaugagaucagggccugcccccuggggaucacagccucaccccu

SEQ ID NO: 186593 - RNA, 131 nt, Homo sapiens
cccugcucugcccaggcaaggaacagaagugaggaugagacccagccccuuccccugggaacucuccuggccuucuaggaauggaggagccaggccccaccccuucccuauaggaacagcccagcacaggu

SEQ ID NO: 186594 - RNA, 46 nt, Homo sapiens
gaucacagccccacccuugucccucagcaacaucccaucuaagcau

SEQ ID NO: 186595 - RNA, 46 nt, Homo sapiens
accuaggagggcucugagccaaccuugcucuuggggaaggggacag

SEQ ID NO: 186596 - RNA, 41 nt, Homo sapiens
cuccgcauacugagaaucuaggccaccccaaccucuguucc

SEQ ID NO: 186597 - RNA, 42 nt, Homo sapiens
ggcgaccuucugucgaagacuggugaguucuggugucgggaa

SEQ ID NO: 186598 - RNA, 46 nt, Homo sapiens
gacaaauacagggaaacaaggacagauacagcaacacauggcagug

SEQ ID NO: 186599 - RNA, 48 nt, Homo sapiens
gagggggagagacaaagagaagauugggaagagaaaugagucagagag

SEQ ID NO: 186600 - RNA, 117 nt, Homo sapiens
agcggaggaaaagacaggaagauaaugauuggggagagaggaaguagagauggggaaagggggagagauagaaaaggggagagggauugggagggagagagugaaaaagacggagag

SEQ ID NO: 186601 - RNA, 47 nt, Homo sapiens
agaaacagagagagggagaaaaugacaugggugggagaggacauagg

SEQ ID NO: 186602 - RNA, 45 nt, Homo sapiens
acuggaauguauuaaguaaaggagugaugucauaagaucugcagg

SEQ ID NO: 186603 - RNA, 38 nt, Homo sapiens
ugacaucccagccccuaaagauuucaaagucacccagc

SEQ ID NO: 186604 - RNA, 62 nt, Homo sapiens
ccauggacugagccaauuccuaccccccauccucucccuucaacccucauguuccccuaccu

SEQ ID NO: 186605 - RNA, 46 nt, Homo sapiens
ccuccuugcccugcaaagcagaaagcagcuuaggcauuggcuuggg

SEQ ID NO: 186606 - RNA, 43 nt, Homo sapiens
aguggcagacacacuuggacacaggguucagagaaaggaagac

SEQ ID NO: 186607 - RNA, 46 nt, Homo sapiens
gucgcaaucugaauccaaguuggugggcuuggggaaaaguugacaa

SEQ ID NO: 186608 - RNA, 37 nt, Homo sapiens
uucugauuaauaaagaaaaaucugugaaggagaaagu

SEQ ID NO: 186609 - RNA, 42 nt, Homo sapiens
accaggggagaaggcagcaggaaaagccaugucauguaggac

SEQ ID NO: 186610 - RNA, 51 nt, Homo sapiens
ggucugaccccuuucuaacucucagagauggggaaaguccuuggguggcag

SEQ ID NO: 186611 - RNA, 45 nt, Homo sapiens
cccggcgucuccugccagcuuccugcaaagcccaggagccccccu

SEQ ID NO: 186612 - RNA, 77 nt, Homo sapiens
cccagcccccugucuaccccuuuagauaaccccuuccccucuccagcccuacuaggaggcucuggccucuccuuucu

SEQ ID NO: 186613 - RNA, 125 nt, Homo sapiens
uccccagaacuccuguagaguauagacacccccccgggcuauucuuggcaacucuaggcagucccaagacaccuuucagccucuuuacaaccuccuggauccacagccaccccucaagaugcacc

SEQ ID NO: 186614 - RNA, 44 nt, Homo sapiens
uuucaagcaccucuggucccauuucuaccccucuggaugcccca

SEQ ID NO: 186615 - RNA, 39 nt, Homo sapiens
uccuuugcagugguggagaggagacuggggcauccagag

SEQ ID NO: 186616 - RNA, 78 nt, Homo sapiens
uucuccauguccccaaggcccuucucagucccucagaacauugcccaggccccuccuagguucuguaaauguccccca

SEQ ID NO: 186617 - RNA, 42 nt, Homo sapiens
ccuucuugcucuugggauagggagccagcuccucccggcgau

SEQ ID NO: 186618 - RNA, 46 nt, Homo sapiens
uggccccuguccgacuugucauggcuccgguccaacuuuucuucag

SEQ ID NO: 186619 - RNA, 45 nt, Homo sapiens
cuuggccgauuugguaaccacggaguuggggucauguggggagag

SEQ ID NO: 186620 - RNA, 40 nt, Homo sapiens
uguuaacgaaaaaagacacgcuggacgauccaucccggcu

SEQ ID NO: 186621 - RNA, 23 nt, Homo sapiens
auguugauggugauuauagacgg

SEQ ID NO: 186622 - RNA, 43 nt, Homo sapiens
ugcggcuucggggcaaggaggaucccuggaacucuaucaccag

SEQ ID NO: 186623 - RNA, 42 nt, Homo sapiens
ggcaccccggccccaggcuaccccagcuaucagcaguaccac

SEQ ID NO: 186624 - RNA, 43 nt, Homo sapiens
gcaccccagccccacacucacauguacgaaguucucaccccag

SEQ ID NO: 186625 - RNA, 56 nt, Homo sapiens
caccuucgaccugggccuggccacauggagcccuuccuuccagggggaaacccacc

SEQ ID NO: 186626 - RNA, 42 nt, Homo sapiens
agaaagagacaguaacaagauaaggaacaaggaaguugcaug

SEQ ID NO: 186627 - RNA, 56 nt, Homo sapiens
cacuggcggcguuggcccagaaggagcgggggcgggauaaagagagcaggaagcgg

SEQ ID NO: 186628 - RNA, 26 nt, Homo sapiens
caggaagaagaccuggaggacugcgg

SEQ ID NO: 186629 - RNA, 39 nt, Homo sapiens
cgcucccgggaggagcccgaggcgcagaggcacgugccg

SEQ ID NO: 186630 - RNA, 42 nt, Homo sapiens
uuggagcauguggccauugauguaacgaccacaguagaccug

SEQ ID NO: 186631 - RNA, 47 nt, Homo sapiens
agaucccugcaucagcaucgaaucagccauguccugaccuccagcug

SEQ ID NO: 186632 - RNA, 24 nt, Homo sapiens
cugcgugguguccugggggacgca

SEQ ID NO: 186633 - RNA, 43 nt, Homo sapiens
gcgccaguggcaagcugugcacaggcgaagguacuggggcaga

SEQ ID NO: 186634 - RNA, 61 nt, Homo sapiens
accugugacaggugagcagcucagccucuguggcagggcgcggugucagggugaggcagcg

SEQ ID NO: 186635 - RNA, 45 nt, Homo sapiens
ggguguggagcgaagcacugacgccuucagccagggcgcggaggu

SEQ ID NO: 186636 - RNA, 41 nt, Homo sapiens
gccgagcuucuucauuuugccuuucuucuuuaccuccgcua

SEQ ID NO: 186637 - RNA, 46 nt, Homo sapiens
acucagugcaccaacugccagacgaccaccacgacacuguggcgga

SEQ ID NO: 186638 - RNA, 43 nt, Homo sapiens
uucuaugggggacuacauuggugguucucagcuuuggcugcgu

SEQ ID NO: 186639 - RNA, 45 nt, Homo sapiens
gccuagcucccucuucuccucuccaccccaccagaggccagggag

SEQ ID NO: 186640 - RNA, 53 nt, Homo sapiens
gaggaaaagggaaggggggaagaagagagagaauggaaggaagaagggagagg

SEQ ID NO: 186641 - RNA, 67 nt, Homo sapiens
gaaaagaagaagguggaggagaaaaaggaagcaggagagaaugagaaaagaguggaaagagaaggaa

SEQ ID NO: 186642 - RNA, 327 nt, Homo sapiens
acaggggaagagaggccggaagugguggcucacaccuguaaucccaguacuuugggaggcugaggugggaggaucacuugaggccaggaguucaagaccagccugggcaacagagucauaccccauuucuacaaaaaaaaaacaaaaacuagccaggccugguggcacacaccuguagucccagcuacucaggaggcugaggcaggaggaucacugccgggaggcagugguugcagugagccgagaucgugccacugcacuccagccuggcaacagaggagacccugccucaaaaaaaaguguguguggaugggggagagggagaua

SEQ ID NO: 186643 - RNA, 49 nt, Homo sapiens
ggggaggagaggagauggggaaagggagaaaaggaugaacagaaaaggg

SEQ ID NO: 186644 - RNA, 36 nt, Homo sapiens
agagagagccagagagagaaacaugggaagacagaa

SEQ ID NO: 186645 - RNA, 44 nt, Homo sapiens
gaugcagagauguucagagagauaggagaggagagggagaaagc

SEQ ID NO: 186646 - RNA, 92 nt, Homo sapiens
guuucugugucuguaggguggagugacagggcuagacuagaaggcugucuucaaacugccccucacuccugcuuacaugacccaugguauag

SEQ ID NO: 186647 - RNA, 43 nt, Homo sapiens
gagauacacgcagguagcacugugaagaggcagagacuaacac

SEQ ID NO: 186648 - RNA, 29 nt, Homo sapiens
gacagagacagacagauggccggagaaaa

SEQ ID NO: 186649 - RNA, 103 nt, Homo sapiens
agggagcagauauaaggucuagggggcagauauggggcuuagggggagauagagguggaauuugaaggucagauaugggguuaagucagagagguuuggggug

SEQ ID NO: 186650 - RNA, 49 nt, Homo sapiens
ucauagaaaagucuggggaguucaaggguuuuucuggaggagagaugga

SEQ ID NO: 186651 - RNA, 23 nt, Homo sapiens
gacaaguuugggugaguggaaau

SEQ ID NO: 186652 - RNA, 45 nt, Homo sapiens
agauuugggguagaaaugggaguuggaaagacagguggguuggag

SEQ ID NO: 186653 - RNA, 46 nt, Homo sapiens
agcugguccccaaagugucagccagcccugaaucccuuuacagcuc

SEQ ID NO: 186654 - RNA, 41 nt, Homo sapiens
ugagacugaccugggcuggugguugcggaggguucggccgc

SEQ ID NO: 186655 - RNA, 47 nt, Homo sapiens
uaaaugaaaauagcagauaugguuucaugacuucacugggcuuuuca

SEQ ID NO: 186656 - RNA, 31 nt, Homo sapiens
aacaggcugucuuggggugaggguguggggg

SEQ ID NO: 186657 - RNA, 37 nt, Homo sapiens
gagagauggaaauggggagaaagagagugacagagau

SEQ ID NO: 186658 - RNA, 42 nt, Homo sapiens
gagagggcacaaaagaaaaggagagacaaagagggcgagaca

SEQ ID NO: 186659 - RNA, 15 nt, Homo sapiens
acugagaagggagac

SEQ ID NO: 186660 - RNA, 46 nt, Homo sapiens
agugggacuucucuucuuuuugcaaaagcugcugcaaacgcaguga

SEQ ID NO: 186661 - RNA, 41 nt, Homo sapiens
auuuucugauugaauggaugugguaucauucauagugauau

SEQ ID NO: 186662 - RNA, 48 nt, Homo sapiens
uauggaagacauggaagucaggccacaauggaucccaagaggaagauc

SEQ ID NO: 186663 - RNA, 32 nt, Homo sapiens
gccuuuccccuugaaggggggugaggaggaag

SEQ ID NO: 186664 - RNA, 38 nt, Homo sapiens
cguaacucucuuugcuguuagcaaguaugcgcaaccag

SEQ ID NO: 186665 - RNA, 46 nt, Homo sapiens
cagcuuuuccauucacuuugauccuuucuugcaaaaacugcucaaa

SEQ ID NO: 186666 - RNA, 42 nt, Homo sapiens
cccccuucgccacaagcuuuuucacaggagcuaugguggcag

SEQ ID NO: 186667 - RNA, 46 nt, Homo sapiens
cugcucccgccuccagacgaugaccaugccgcuggcgucacuggag

SEQ ID NO: 186668 - RNA, 43 nt, Homo sapiens
cagauccccugucccuacaggacucacccacgcaggcccccug

SEQ ID NO: 186669 - RNA, 79 nt, Homo sapiens
uuugcagacaacagagucagucugcugccgugcuggggucccuacggggugacugggucagcgcagacaauaauuaggg

SEQ ID NO: 186670 - RNA, 53 nt, Homo sapiens
ucaguauaccagggcgacagaaaucagacugacauuaugggggucagcguugg

SEQ ID NO: 186671 - RNA, 40 nt, Homo sapiens
ugauguaaaaaaaaaaaagucuaggggacacccauagggg

SEQ ID NO: 186672 - RNA, 43 nt, Homo sapiens
cugcccuuccugggcagcgcccgggugacacacagcgauucag

SEQ ID NO: 186673 - RNA, 68 nt, Homo sapiens
ggucucauguguuggcccucauggcaaagaauggagaucugguggggccgauggagggcuugagaaag

SEQ ID NO: 186674 - RNA, 70 nt, Homo sapiens
ccugaucaagaugcggcuguggccucagcccccuccucugagucccacaccucugacugcagguaaucag

SEQ ID NO: 186675 - RNA, 45 nt, Homo sapiens
ccauugcgcaugauguggucgcggugcuccagcaggauggccagg

SEQ ID NO: 186676 - RNA, 49 nt, Homo sapiens
ccuccuggguggaugguggagaugaggaagauggggaaucaggguggga

SEQ ID NO: 186677 - RNA, 46 nt, Homo sapiens
cuggcuguggccagguggucaacagcaucuucaaagguacuaccuc

SEQ ID NO: 186678 - RNA, 46 nt, Homo sapiens
aggcaggcgcugaugaccucuucuucuguuaccgcuggcugcugcu

SEQ ID NO: 186679 - RNA, 113 nt, Homo sapiens
guuugcuuuuguggcaucaugaaacgccuggccgccaacuuccacccugacggccgcgccauggccaccaaguuugcacacuugaagcuguugcugcgacacgcugacccuga

SEQ ID NO: 186680 - RNA, 59 nt, Homo sapiens
guuucaugaugccacaaaagcaaacaaaggcauggcccucaugguccaugacagcgagg

SEQ ID NO: 186681 - RNA, 46 nt, Homo sapiens
cacagguguccuacugccagggcaugagugaccuugccucacccau

SEQ ID NO: 186682 - RNA, 59 nt, Homo sapiens
augggugaggcaaggucacucaugcccuggcaguaggacaccuguggguggguaacggc

SEQ ID NO: 186683 - RNA, 62 nt, Homo sapiens
gagcagcucaagagcgagugggcccagcgagcgaacccugaggaccuggaauucauccgcag

SEQ ID NO: 186684 - RNA, 64 nt, Homo sapiens
guauccagauggacugacaggccgagagcggauggacuacaugaaacgcaagagccgcgaguau

SEQ ID NO: 186685 - RNA, 43 nt, Homo sapiens
uuacagggcacgaaguucucuuuaaggaggggcgagcagucgg

SEQ ID NO: 186686 - RNA, 50 nt, Homo sapiens
agggcuccacaccgccaugauagauccgcaggcgcaacuccucgggucgg

SEQ ID NO: 186687 - RNA, 24 nt, Homo sapiens
gguguuuucagggacccuagggac

SEQ ID NO: 186688 - RNA, 38 nt, Homo sapiens
uuaaucaguauaaaaugucucuuuguguuaaaugcuuu

SEQ ID NO: 186689 - RNA, 46 nt, Homo sapiens
uaggguuugggaaguuugacaauuuuaugauaaggaaaugcgcgua

SEQ ID NO: 186690 - RNA, 40 nt, Homo sapiens
cguguagauauucggcccucggaggacagugaguacucag

SEQ ID NO: 186691 - RNA, 43 nt, Homo sapiens
cuuauagacaaaggggaggggcuauggggcuggaggaggggcc

SEQ ID NO: 186692 - RNA, 95 nt, Homo sapiens
ggaccugagauuucggacauaaccugagcggcgaagcuugagggccaagugaugauggcgagggguagggagggccugagagccugagagcguua

SEQ ID NO: 186693 - RNA, 126 nt, Homo sapiens
cugucacacucaggcucaugggcaggcacaagaaggggaauaaaggggcugugugaaggcacugcugggagccauuagaacacagauacaagagaagccaggaggucuaugauggugacgauuuuu

SEQ ID NO: 186694 - RNA, 23 nt, Homo sapiens
acugugggagcaggacuagacuc

SEQ ID NO: 186695 - RNA, 83 nt, Homo sapiens
uccuugugcuugaugcugugaagcaccucacucaugcccagagcacgcuggaugccaaggccacaaaagccaagagcaagaag

SEQ ID NO: 186696 - RNA, 38 nt, Homo sapiens
cuauggggaugugcucuacuuccugacagagcaccgcg

SEQ ID NO: 186697 - RNA, 46 nt, Homo sapiens
ggugcucugucaggaaguagagcacauccccauagaucuggccugu

SEQ ID NO: 186698 - RNA, 51 nt, Homo sapiens
gaccacucagccuguggguggugaucgccuuucuccgccagcauccccucc

SEQ ID NO: 186699 - RNA, 54 nt, Homo sapiens
ucaccuggugaucgagggcugguucguucucuacuacgaagaccugcuuggaga

SEQ ID NO: 186700 - RNA, 45 nt, Homo sapiens
agcacgaccugacaacagccauguggucacgacuaagaccccugu

SEQ ID NO: 186701 - RNA, 48 nt, Homo sapiens
cuggcauauacuggcuggccucuucucugucacaggggucuuagucgu

SEQ ID NO: 186702 - RNA, 48 nt, Homo sapiens
cagcccacaaagacaugacuaccaacgcgggccccuugcacccauacu

SEQ ID NO: 186703 - RNA, 45 nt, Homo sapiens
ccacgccugguuccugugucucuuaccaaaccgugaccccggagc

SEQ ID NO: 186704 - RNA, 56 nt, Homo sapiens
cccaccgcccuuuugcgccugcgcgagacccccagcuaccgcacgguuguccagag

SEQ ID NO: 186705 - RNA, 39 nt, Homo sapiens
ggaaagaaaccaugaaagucugucuguacugcaguggga

SEQ ID NO: 186706 - RNA, 46 nt, Homo sapiens
gaauggcuggcgugcucgcagcgccuucaaacugcuacaacuggau

SEQ ID NO: 186707 - RNA, 56 nt, Homo sapiens
agagguaggugguagcccauucaucugguuacugauacuggccggcaucaguggac

SEQ ID NO: 186708 - RNA, 40 nt, Homo sapiens
aaaggggccuaaucaucuaagggauuaauggcgaaugggg

SEQ ID NO: 186709 - RNA, 46 nt, Homo sapiens
gaggcacgccugcacugucccgccugcggggaaaggagggaggucc

SEQ ID NO: 186710 - RNA, 381 nt, Homo sapiens
cuucguuugcucaaacaugaguggguauuuuuuuguuuguuuuuuuuguuguuguuguuuuugaggcgcgucucacccuguugcccaggcuggagugcaauggcgcguucucugcucacuacagcacccgcuucccagguugaagugauucucuugccucagccucccgaguagcugggauuacaggugcccaccaccgcgcccagcuaauuuuuuaauuuuuaguagagacaggguuuuaccauguuggccaggcuggucuugaacuccugacccucaagugaucugcccaccuuggccucccuaagugcugggauuauaggcgugagccaccaugcucagccauuaagguauuuuguuaagaacuuuaaguuuagggua

SEQ ID NO: 186711 - RNA, 23 nt, Homo sapiens
agguguuuuucaagauugaagag

SEQ ID NO: 186712 - RNA, 63 nt, Homo sapiens
uguccuugaggacugcccaggcuguauucccagcuauugcucaggagauuugucaggaagagg

SEQ ID NO: 186713 - RNA, 48 nt, Homo sapiens
ggaauuucuugagggaacacaucugugggaaaaaagcuggaagccuuu

SEQ ID NO: 186714 - RNA, 46 nt, Homo sapiens
acaguguguuuguguuuucaacccauugcaauaacuuugcugaaau

SEQ ID NO: 186715 - RNA, 62 nt, Homo sapiens
uuucuccaggauuuuggcaaagguugguguggcugugguuuugcuaaugcaccuccuagauu

SEQ ID NO: 186716 - RNA, 38 nt, Homo sapiens
cacagcuggucagcccagugcaaaccuuauuaucugcc

SEQ ID NO: 186717 - RNA, 40 nt, Homo sapiens
agugcggccuguccuguccuugccaugaggcugcggcagg

SEQ ID NO: 186718 - RNA, 46 nt, Homo sapiens
ucaucaacaauuucauccagccucaaaaauucccauagaugagaga

SEQ ID NO: 186719 - RNA, 58 nt, Homo sapiens
auggcugcuugauuuuguagagaaauuagaacccauaaccauacacaggcuaucaaca

SEQ ID NO: 186720 - RNA, 23 nt, Homo sapiens
ggauaagauauuuuauaucaaga

SEQ ID NO: 186721 - RNA, 26 nt, Homo sapiens
ucaauccaaccuggcuuggucuggca

SEQ ID NO: 186722 - RNA, 47 nt, Homo sapiens
cuccucucagguuuaucugaauuuaaacugugcuuucuaaagaccuu

SEQ ID NO: 186723 - RNA, 42 nt, Homo sapiens
guguccugggagacacccgaaggaagagacacagcagaugga

SEQ ID NO: 186724 - RNA, 63 nt, Homo sapiens
cuucuagcaccaauguguauuuccauugcucaacauccuuguuaacacuugaucuuguuauau

SEQ ID NO: 186725 - RNA, 54 nt, Homo sapiens
uguuuaaacaggaagaaacuaaggcuccugagaggugauggggcuagccaaagu

SEQ ID NO: 186726 - RNA, 32 nt, Homo sapiens
gaugguggugguaguggauggagucuaccucu

SEQ ID NO: 186727 - RNA, 37 nt, Homo sapiens
cuuugccuuccauggcuaguggugucacagccauggg

SEQ ID NO: 186728 - RNA, 42 nt, Homo sapiens
aaugaaccuacugaguucugguagaaggauagaggaugccca

SEQ ID NO: 186729 - RNA, 45 nt, Homo sapiens
caauacuauaaauauauauuuauguuuucacagucaccaagugua

SEQ ID NO: 186730 - RNA, 56 nt, Homo sapiens
aaaagauugucaagaauaacaaugagccgcucccagagauaaaauccauaggagac

SEQ ID NO: 186731 - RNA, 101 nt, Homo sapiens
uugccuaucaccucuucuuucuuauuuuagaaguuaugguacccaguauuuaaaauuuuuuaacaucacaaaucguauguuuuuaguauuuuuuauacuac

SEQ ID NO: 186732 - RNA, 48 nt, Homo sapiens
uggauuuugucuuugacauuuuuaacaugcauaccuaaaaucuaaagc

SEQ ID NO: 186733 - RNA, 44 nt, Homo sapiens
uuuuuaauauacuaccuuuccuuugguuagcauuugaaugauga

SEQ ID NO: 186734 - RNA, 62 nt, Homo sapiens
uacuuuucauauggcaauccacauaauuuaacucucuuaauaugaguuuucauggccccaaa

SEQ ID NO: 186735 - RNA, 46 nt, Homo sapiens
gccauuugugaguacaaugaaaacccaaaagguaugagcacauuug

SEQ ID NO: 186736 - RNA, 33 nt, Homo sapiens
aagcaagaagaaaacugugggagaugaugaaag

SEQ ID NO: 186737 - RNA, 44 nt, Homo sapiens
aaagaguauuuauuuuuuuuuuccauuguaaccuugccaugggu

SEQ ID NO: 186738 - RNA, 25 nt, Homo sapiens
uagguaagggagagguugagaaagu

SEQ ID NO: 186739 - RNA, 185 nt, Homo sapiens
agaaggagagggagaggaagaaggggagggagaaggggaggaagaagaggaaggggaaguggaaggggagguggaaggggaggaaggagagggggaaggagaggaagaggaaggagaggaggaaggagaagaaagggaaaaggagggggaaggagaagaaaacaggaggaacagagaagaggagg

SEQ ID NO: 186740 - RNA, 56 nt, Homo sapiens
ggaaggagaagggaaaggggaggaggaaggagaggaaggagaaggggagggggaag

SEQ ID NO: 186741 - RNA, 68 nt, Homo sapiens
gcagggccaucagaaggaaagaaaccaagagauggaggagggaggggaggaggagcauggagaaggag

SEQ ID NO: 186742 - RNA, 102 nt, Homo sapiens
uagaggagaaauggagaggccaggagagggagagaaggaacuagcagagaaggaagaauggaagaagagggauggggaagagcaggagcaaaaggagaggga

SEQ ID NO: 186743 - RNA, 42 nt, Homo sapiens
gcaaaaucagugggagaagcagaggaugggccugaagguaga

SEQ ID NO: 186744 - RNA, 46 nt, Homo sapiens
auacgguauuguugacuauaggcacaauguuauguuguucagaaau

SEQ ID NO: 186745 - RNA, 46 nt, Homo sapiens
gcagaggacucuaucagcacguaugcggcgaagagagaggguacaa

SEQ ID NO: 186746 - RNA, 46 nt, Homo sapiens
aauauguuuacuaaauugaugcuuccaaauuuuuucaacauuagau

SEQ ID NO: 186747 - RNA, 33 nt, Homo sapiens
uaaaaccugaaaaagugaaauuagcugccugug

SEQ ID NO: 186748 - RNA, 45 nt, Homo sapiens
aaauaauaaacuuuacauguuuggcaguaacaacuggggucaguu

SEQ ID NO: 186749 - RNA, 81 nt, Homo sapiens
uuuuccuuucugguacgaauuaguuuaugugugaucacccaccuugggauuuccccaaaagcuggaccuggccuacuauuu

SEQ ID NO: 186750 - RNA, 39 nt, Homo sapiens
ccuuuuggcugccaagaggccaggagagggugacaguag

SEQ ID NO: 186751 - RNA, 47 nt, Homo sapiens
acucgcggucaucccggccugggccuuuuaucucggugcugccgggg

SEQ ID NO: 186752 - RNA, 46 nt, Homo sapiens
uaacgccaugaaucgcuucauuggcgccgugaacaacauggaccag

SEQ ID NO: 186753 - RNA, 46 nt, Homo sapiens
ggcguggagguaggcggcaguggcggcugccuggaggagcgcacgc

SEQ ID NO: 186754 - RNA, 39 nt, Homo sapiens
uguaucuguuagugaggauguuggcuuugcgcgugaguu

SEQ ID NO: 186755 - RNA, 44 nt, Homo sapiens
auauucuaaaaaauaaaaaagcaaaugugucaacuaaauuggac

SEQ ID NO: 186756 - RNA, 46 nt, Homo sapiens
auuucgcugcaauuuuccaaacguggaaauugucaccauugcagag

SEQ ID NO: 186757 - RNA, 69 nt, Homo sapiens
ugagugaccuccuuaacuguccacgaaccucacacaaugcaguagauauuuuccagaaaggguacacau

SEQ ID NO: 186758 - RNA, 46 nt, Homo sapiens
uaauaaaacauggacuaaauuacugcucugcuuacugggagcgguu

SEQ ID NO: 186759 - RNA, 81 nt, Homo sapiens
acauguguugggcuaccccacauguucuggcuuuccccccagucuucagaaccugacagcucucugcuggccaugacugcu

SEQ ID NO: 186760 - RNA, 41 nt, Homo sapiens
gaauuuucagaacucaccucacguuuauggguggcucaaau

SEQ ID NO: 186761 - RNA, 42 nt, Homo sapiens
agcugccgcaguguccugaagcaacaggguuaccggccaggg

SEQ ID NO: 186762 - RNA, 45 nt, Homo sapiens
aguuccccucaggagaccacccagucucgcccuaugccgccggaa

SEQ ID NO: 186763 - RNA, 43 nt, Homo sapiens
cggccggagcccaguucggacuaugaucugucaccagccaagc

SEQ ID NO: 186764 - RNA, 46 nt, Homo sapiens
aaaccaaacacuugaucccucaggaguccaggcggggauugccacu

SEQ ID NO: 186765 - RNA, 46 nt, Homo sapiens
ccuccaggccgccugccaaacagcagaaaauuaaagaaaaccagaa

SEQ ID NO: 186766 - RNA, 75 nt, Homo sapiens
cccaggccacucagccugaggccauuccucaggggacuaacaucacugaagagaaaccuggcaggaaaagggcag

SEQ ID NO: 186767 - RNA, 83 nt, Homo sapiens
cucggacaugccucacagccccacccuccggguggacaggaaacgcaaagucucaggugacagcagccacacugagaccacug

SEQ ID NO: 186768 - RNA, 48 nt, Homo sapiens
guauaguguuggaaacaagcaccgugaucccuuugaagccccagagga

SEQ ID NO: 186769 - RNA, 31 nt, Homo sapiens
uccuaaggaaugauaaguggcauuuugaaga

SEQ ID NO: 186770 - RNA, 46 nt, Homo sapiens
ucacccuggaggaggccauugcagaacagaacgaaagugagagaug

SEQ ID NO: 186771 - RNA, 46 nt, Homo sapiens
augugcaaauucagcccagccgacugggaaagguugaaaggaaauc

SEQ ID NO: 186772 - RNA, 39 nt, Homo sapiens
ugucgagugcaggccgcccagccuccgcaucacccgccc

SEQ ID NO: 186773 - RNA, 42 nt, Homo sapiens
gggcgaaggugcccagccagugcccgggcaugcccggaagac

SEQ ID NO: 186774 - RNA, 46 nt, Homo sapiens
cugcccugggucaauccuuacauggagggugccacgccagccaucu

SEQ ID NO: 186775 - RNA, 46 nt, Homo sapiens
aacccccaaauggcuucagugcuauauacaaaacaccgccuggaau

SEQ ID NO: 186776 - RNA, 46 nt, Homo sapiens
gcacucuagguggccuuggguuuucuucggaaagaaauccagagau

SEQ ID NO: 186777 - RNA, 47 nt, Homo sapiens
gggaaacaucgucuauucuagcuuguguggacugggcucagagaaag

SEQ ID NO: 186778 - RNA, 28 nt, Homo sapiens
uaggaaaauccuuguaaaugauggugac

SEQ ID NO: 186779 - RNA, 46 nt, Homo sapiens
ucuauauacugcuuuaacucuaaaugucaggagugugggcccaggu

SEQ ID NO: 186780 - RNA, 45 nt, Homo sapiens
uggaugaacagcgagaggguccgcauguguggggcgagcgaagac

SEQ ID NO: 186781 - RNA, 53 nt, Homo sapiens
ucuguaaagaaacguuggggaaaggacaagauagccuaucccccggcuugcgc

SEQ ID NO: 186782 - RNA, 29 nt, Homo sapiens
guggccacaguaggcgggggugggguggg

SEQ ID NO: 186783 - RNA, 48 nt, Homo sapiens
cccccccaccccucauaucucucuccacccacccaaccgccccccgcu

SEQ ID NO: 186784 - RNA, 35 nt, Homo sapiens
uuggccaacacucacacacacucacacacacccag

SEQ ID NO: 186785 - RNA, 45 nt, Homo sapiens
gaccgagagcgggagcuaggcgggcggcggcggcggagggggagc

SEQ ID NO: 186786 - RNA, 26 nt, Homo sapiens
ggagccugggcucccagcggcaaggu

SEQ ID NO: 186787 - RNA, 23 nt, Homo sapiens
ucacgaaucccccccaccacuca

SEQ ID NO: 186788 - RNA, 49 nt, Homo sapiens
acuaguguguuaaaccgggaggaaggaggucucuggagugucaguggaa

SEQ ID NO: 186789 - RNA, 42 nt, Homo sapiens
gaggggaacucgggcugacuaaugggacgcgugugggccuua

SEQ ID NO: 186790 - RNA, 37 nt, Homo sapiens
ggggcgugcuuauggugguagcagagggacagggaca

SEQ ID NO: 186791 - RNA, 59 nt, Homo sapiens
gagagacuguucuuggagggcuggaaguggcugggaagaguucauggagaaagcaggau

SEQ ID NO: 186792 - RNA, 96 nt, Homo sapiens
cagucuccgagacaccaagugccaacaagggaccccaggcuggcuucccacagccagaugggguaguucuuguggccuggcagcuggcagccugac

SEQ ID NO: 186793 - RNA, 69 nt, Homo sapiens
gccagaguggguaggauuugccaaauaggguacccuuggaaggcaggacacaagagggaggagccauua

SEQ ID NO: 186794 - RNA, 29 nt, Homo sapiens
cuccccagggaaggugggggguggcuugc

SEQ ID NO: 186795 - RNA, 67 nt, Homo sapiens
ggcugaguacugaguguuuucaggucagacaaccugguuuggggcccaggagggucaucuguugcaa

SEQ ID NO: 186796 - RNA, 45 nt, Homo sapiens
cucaguuucuagucauuucuaguccuuuuggauaguaaaugcagg

SEQ ID NO: 186797 - RNA, 23 nt, Homo sapiens
agcacggagaguuuggggcgggg

SEQ ID NO: 186798 - RNA, 42 nt, Homo sapiens
gcaguaauggcuuucgcagucggaaugugugcuaggggaaga

SEQ ID NO: 186799 - RNA, 42 nt, Homo sapiens
gucaguuucucuucccuuuccguaguggaaaaaaacugaauc

SEQ ID NO: 186800 - RNA, 42 nt, Homo sapiens
cugcagccacacggaaacccagagccaugaaagccgggggau

SEQ ID NO: 186801 - RNA, 25 nt, Homo sapiens
gcgguuccucacauuugcugugaca

SEQ ID NO: 186802 - RNA, 22 nt, Homo sapiens
cuuuuaugaaaugcggugggag

SEQ ID NO: 186803 - RNA, 54 nt, Homo sapiens
agucaccgcccccucuaccaccaguauacagcuaucuuuauaugguacaaagcu

SEQ ID NO: 186804 - RNA, 43 nt, Homo sapiens
uguuucugguaguccagccugacaaagucagaggcugggguca

SEQ ID NO: 186805 - RNA, 54 nt, Homo sapiens
cucuccgcgcguguaggguccugaguucugccucccaggagcuguccggcgcuc

SEQ ID NO: 186806 - RNA, 47 nt, Homo sapiens
ccggagcggggcuacacaccacacaaacagccucccuuucccccgga

SEQ ID NO: 186807 - RNA, 43 nt, Homo sapiens
uauuauugauuccauccaccauucguagacgauaauagcacag

SEQ ID NO: 186808 - RNA, 47 nt, Homo sapiens
aagguauuugaaacagaacagcauguguaaaagcauggcgaugugag

SEQ ID NO: 186809 - RNA, 45 nt, Homo sapiens
agcagaagggugaaugaucagaucuguauuuugaagcaguuaugg

SEQ ID NO: 186810 - RNA, 33 nt, Homo sapiens
aauucaguggcuaauuagcuguguugcugagga

SEQ ID NO: 186811 - RNA, 68 nt, Homo sapiens
uggguuuaucugauguuuucucauuauuagauugggaaaaauacuacacagguaucucauccuuuuaa

SEQ ID NO: 186812 - RNA, 79 nt, Homo sapiens
aagggcuacuuuccaauuuugggcugacaggguugaaaucuaaaaaguuuggcuaccacugcuuuaaaggacaggaagg

SEQ ID NO: 186813 - RNA, 45 nt, Homo sapiens
auugcaaggaaaaccaggagccguggcugcaugaagaccaaagca

SEQ ID NO: 186814 - RNA, 52 nt, Homo sapiens
agccaccucacuccugauguguugucuguccuagaagaguggcuuccuuaac

SEQ ID NO: 186815 - RNA, 49 nt, Homo sapiens
aagaaauuccucuguuuucucugugaagcuggagaugagguuaucuggu

SEQ ID NO: 186816 - RNA, 33 nt, Homo sapiens
aaauagucccuuuauucucaucuuuaucuuuua

SEQ ID NO: 186817 - RNA, 48 nt, Homo sapiens
ucaguggugaauggggaaacauguauuauauuuaauaauugucaaggu

SEQ ID NO: 186818 - RNA, 45 nt, Homo sapiens
uuuggagcugcuuuuaagaacauuuuuacugauuucugcuaauag

SEQ ID NO: 186819 - RNA, 42 nt, Homo sapiens
aggacucgcaguggguaaccuguuucaucguccucgggcuac

SEQ ID NO: 186820 - RNA, 45 nt, Homo sapiens
ugcguucuuacucuuaaauuucaggcaguuccuuuuagucuugac

SEQ ID NO: 186821 - RNA, 45 nt, Homo sapiens
aaggcaaacucaguguuugaagaccuuucagucaccuugcgccag

SEQ ID NO: 186822 - RNA, 42 nt, Homo sapiens
ggaucauucuccugauuuauauucacuggagcuggcagguuu

SEQ ID NO: 186823 - RNA, 46 nt, Homo sapiens
guuugcagaugacauguacagucuuuauggugggaaugcaguggua

SEQ ID NO: 186824 - RNA, 54 nt, Homo sapiens
gcacagggaaacagaaaggcaccugggcucuggguggucagcacauguguugag

SEQ ID NO: 186825 - RNA, 49 nt, Homo sapiens
gcuucccagcuggcuccucccaaauccauccuacacauugucaucaaag

SEQ ID NO: 186826 - RNA, 49 nt, Homo sapiens
uucugccuaaagcuugucaauggcuccuuauugcccagaggcucauguc

SEQ ID NO: 186827 - RNA, 45 nt, Homo sapiens
cuucaucuccugcuguguuccuacuuuuaaaauucucuagccaga

SEQ ID NO: 186828 - RNA, 46 nt, Homo sapiens
auuggcuguuuuguuaaaauauaucuuuuagugugcuuuaaaguag

SEQ ID NO: 186829 - RNA, 80 nt, Homo sapiens
aacauugauuucauucuguuuaaugaauuuggaaauaugcacugaaagaaauguaaaacauuuagaauagcucguguuau

SEQ ID NO: 186830 - RNA, 50 nt, Homo sapiens
uguaaauaacucugaaacaagagaaaagguuuuuaacuuagaguagcccu

SEQ ID NO: 186831 - RNA, 58 nt, Homo sapiens
ugugguacaacuucauucuauagaauauuaaguggaagugggugaauucuacuuuuua

SEQ ID NO: 186832 - RNA, 45 nt, Homo sapiens; identical to SEQ ID NO: 118232

SEQ ID NO: 186833 - RNA, 46 nt, Homo sapiens
cugugcacccaggccuuacaguccaaccuuuuucugugucuggcua

SEQ ID NO: 186834 - RNA, 45 nt, Homo sapiens
cugucuuaucugcagaaauuugcugucaauauauaacccgccugc

SEQ ID NO: 186835 - RNA, 44 nt, Homo sapiens
guuaauucuuaagcaagaaacuuuuuucuugaugagacucacag

SEQ ID NO: 186836 - RNA, 47 nt, Homo sapiens
acaaaaaagaaaaaaaaaaaaccaacagcaacaaaacagagcccauc

SEQ ID NO: 186837 - RNA, 93 nt, Homo sapiens
cgagaagugacagcuguauuacucagagcuuuuacuucuuacaccuagaauauuaaaauauaaaacaaggggagaaaugugacagucuauuuu

SEQ ID NO: 186838 - RNA, 47 nt, Homo sapiens
ucacauuucuccccuuguuuuauauuuuaauauucuagguguaagaa

SEQ ID NO: 186839 - RNA, 41 nt, Homo sapiens
cagaaagauuugaccuuuggcccucuacugaagauuuugag

SEQ ID NO: 186840 - RNA, 92 nt, Homo sapiens
agggaaauguuuugucaaaaggcuacacuuggaacugaacaaagcagaaacaaaauugagcauugcauuauuuugugauuaaaaggggcagg

SEQ ID NO: 186841 - RNA, 52 nt, Homo sapiens
auuccaagcucuuuaaacgagugaaauagguuaacuuuauuuggaugaguua

SEQ ID NO: 186842 - RNA, 42 nt, Homo sapiens
aaggcugugaauuuuucugcuuggaggaagagcccaaccuug

SEQ ID NO: 186843 - RNA, 39 nt, Homo sapiens
aagggggcuuguaacuucaaagcaaccaagguugggcuc

SEQ ID NO: 186844 - RNA, 41 nt, Homo sapiens
acuccacuuucccuugcuccuagucacaacgaauaccacuc

SEQ ID NO: 186845 - RNA, 43 nt, Homo sapiens
aaauuauuuucuauauuuaacucaagcauuaauguauaaccag

SEQ ID NO: 186846 - RNA, 41 nt, Homo sapiens
uuauagaagacaguagaauguguuaccauaaagacugaaga

SEQ ID NO: 186847 - RNA, 46 nt, Homo sapiens
aagcccuccaccaacugaacuuucauguuuagcauuguagaggcag

SEQ ID NO: 186848 - RNA, 46 nt, Homo sapiens
aaaugaaaacaagucugugaauauucagaugacuacuucgaaguaa

SEQ ID NO: 186849 - RNA, 55 nt, Homo sapiens
cuuauuuaggauuauagcuggauaagaaaauugccuuuucauuguaagugcccag

SEQ ID NO: 186850 - RNA, 35 nt, Homo sapiens
aguaccuucaaacuagagaccaaaacugggcacuu

SEQ ID NO: 186851 - RNA, 45 nt, Homo sapiens
uaaaacacuacagaagugcuaaguguauugagaauuugcugcuga

SEQ ID NO: 186852 - RNA, 73 nt, Homo sapiens
accacccaagucaugcacuucuuagccuuuuacaagccaacagacugacaugaagauuguucacaguuccuaa

SEQ ID NO: 186853 - RNA, 44 nt, Homo sapiens
uaagcuuuuagccauguuucaccugagaaacgaacacccacacc

SEQ ID NO: 186854 - RNA, 46 nt, Homo sapiens
accaauaucggcaccaccauaaaccacgcaaggacgaacucuagau

SEQ ID NO: 186855 - RNA, 46 nt, Homo sapiens
ccuacagccaagaagauauauucaucuaagaaaucacgagccagca

SEQ ID NO: 186856 - RNA, 97 nt, Homo sapiens
agauggggaauuucaagaacuaaugaaauuggcacuuaaucagggaaaaauucaucaugaaaugcaaguuuuagaaaaagaaguagagaagagagac

SEQ ID NO: 186857 - RNA, 47 nt, Homo sapiens
uagaaaugcuggcaauuucaagaaaccaaaaguuguuacaggcugga

SEQ ID NO: 186858 - RNA, 49 nt, Homo sapiens
aaguucuuaagacauuuagaacaccaauuugugaggauaaauuccauuc

SEQ ID NO: 186859 - RNA, 45 nt, Homo sapiens
ccagcugcuucaggaaaaccacccucuugccccuguggcguccag

SEQ ID NO: 186860 - RNA, 52 nt, Homo sapiens
ggauuuagcggcugaguacuuccucuuguacauggccuuucuggaauacaua

SEQ ID NO: 186861 - RNA, 44 nt, Homo sapiens
aucuggagcauaaacaauacaugccacauaguguuuucuggaag

SEQ ID NO: 186862 - RNA, 30 nt, Homo sapiens
guauuuaagaagcaaugugggucagaacaa

SEQ ID NO: 186863 - RNA, 42 nt, Homo sapiens
gaacuauuuuuguacaaauuguuuaaaaguuauuuaugcaag

SEQ ID NO: 186864 - RNA, 46 nt, Homo sapiens
cuaucgaacagguagccauccgcuugguucuuuauaaagucaccau

SEQ ID NO: 186865 - RNA, 44 nt, Homo sapiens
ccagggcaaaugaaggcgcaugucucucagaacucagcguccca

SEQ ID NO: 186866 - RNA, 43 nt, Homo sapiens
cuggauccuuaggacuucuccagagcacuuugaaauaauugug

SEQ ID NO: 186867 - RNA, 35 nt, Homo sapiens
aaaagcgacuuagcaaccaaaguagagucauuugu

SEQ ID NO: 186868 - RNA, 46 nt, Homo sapiens
cugauguagguggaaccacagucauauucucugaagagaagccauu

SEQ ID NO: 186869 - RNA, 100 nt, Homo sapiens
ugguaaauccagguucuaaaccucagucuaacugaaaagccuuguucuuucuacuauaccaaagagccucucauuaaggagguauugcaggcaggccaug

SEQ ID NO: 186870 - RNA, 434 nt, Homo sapiens
ggggaaggggaaaggcccuaguaauaauaauaucaaugaugggcugggcacaguggcucacaccuguaauccuagcacuuugggaggcugaggcaggcagaucacgaagucaggaguuccagaccagccugaccaacauggugaaaccccaucuauacuaaaaaaaauauauaaaaauuagcugggugugguggcgugcaccuguaaucccagcuacccaggaggcuaaggcagaagaaucauuugaaaccgagagguggagguugcagugagcugagauugcaccacugcacuccagccugggcgacagagcgagacuccaucucaaaaaaaaaaaaaaaaaaccgaugaugaugaugaugacaacaaugaugauacucuccuaagaagagaagucagcaacugcaaggccagaaacaggcgaagacaaagua

SEQ ID NO: 186871 - RNA, 126 nt, Homo sapiens
aggaaaggaagaaaguuaaauagggcacucacaauagaagaugaauaaaaauggaugaaaguaaagagaaugaggaugaagagacagaaguccaauaaaagagaaaagaaaacagaaaaaagguaa

SEQ ID NO: 186872 - RNA, 52 nt, Homo sapiens
ggaagggacaagaagguugagagagauggaauaaaagaaaaggaaaugggac

SEQ ID NO: 186873 - RNA, 46 nt, Homo sapiens
guagauauggagagaaaagaaauauguuggguuuauugcuuagcga

SEQ ID NO: 186874 - RNA, 47 nt, Homo sapiens
auucucccauaacggauucaacuaugagaagagaaguggcagcaaua

SEQ ID NO: 186875 - RNA, 44 nt, Homo sapiens
cuggaagagaguugaaaaagauguaaauaaagcaaaaagacaga

SEQ ID NO: 186876 - RNA, 42 nt, Homo sapiens
aguauugucagcccuguacagagcaguguaaaaugcucagua

SEQ ID NO: 186877 - RNA, 52 nt, Homo sapiens
cccacccccagcacagcccuaccugccuccugccuuaccuucaccuccggcc

SEQ ID NO: 186878 - RNA, 42 nt, Homo sapiens
gcuccggccguucccgccguccccgccuguggcugcccccug

SEQ ID NO: 186879 - RNA, 42 nt, Homo sapiens
gaggaggcggcgauaaaguuggugugcuggucccgcgcgcag

SEQ ID NO: 186880 - RNA, 111 nt, Homo sapiens
ucacggaguuuaggucggugaagaguuugcauugggcuguugacauguaucucgauugcaguguguguuaccugaaguuaggugacuuguuuacuuuuugggucuuuuugg

SEQ ID NO: 186881 - RNA, 84 nt, Homo sapiens
gagccucauuuccugugugucugacaggggaggcuggggaggauucgggguguagucuuuuuuuauuuguguggaaaguuguug

SEQ ID NO: 186882 - RNA, 47 nt, Homo sapiens
ggggguuagggggaggguguagagguaaacauggaaauaaauaguag

SEQ ID NO: 186883 - RNA, 40 nt, Homo sapiens
cucuggaaagauuuaagcgucaguaauuguuggucuccug

SEQ ID NO: 186884 - RNA, 32 nt, Homo sapiens
uaaacaugauuuaaauuaaaagagcauuauuu

SEQ ID NO: 186885 - RNA, 47 nt, Homo sapiens
uaauucacguggaaaaguuuggccaaaucgauugcuuuugguuaugg

SEQ ID NO: 186886 - RNA, 54 nt, Homo sapiens
aaaaaaucuucacugcuucagacucagugcuugugagguguccuaccugcuuag

SEQ ID NO: 186887 - RNA, 70 nt, Homo sapiens
gaaugagcuggaguccugcuguaggaagucuugaauuauuuaguuucauccuucuuuuaacaguccucga

SEQ ID NO: 186888 - RNA, 57 nt, Homo sapiens
aguuuauucaaaccacugauuucucaucgucucccgaauguuuuugucagauucagu

SEQ ID NO: 186889 - RNA, 47 nt, Homo sapiens
ugaaaaccuuuuggguuuuuuuuuuuuuaaguaggguaaggauuuga

SEQ ID NO: 186890 - RNA, 374 nt, Homo sapiens
aacuagagagcauuugacugccaccucuagauacuuuuuguuuuuuuuuuuaauuugagacagucucacacuaucccccaggcuggagugcaguagagugaucucggcucacugcaaccucggucuuccagguucaagugauucuuaugccucagccucuugcguagcugggauuacaggugccugccaccacacccggcuaauuuuuguguuuuuauuagaggugggguuucaccguguuggccagacuggucucaaacuccugaccucacgugaucagcccaccauggccuccuaaagugcuggcuuugcaggugugagccgccgcaccuggccaauaucuuaagcuguuaagaaaaacugccugagagaug

SEQ ID NO: 186891 - RNA, 66 nt, Homo sapiens
cauugguuuguaaauuaucgugacaguaaauuaaaacaguauauuaauguacacuaugugcaagcc

SEQ ID NO: 186892 - RNA, 40 nt, Homo sapiens
ggauacuuuugaacuugauguuccuucagugaggguagga

SEQ ID NO: 186893 - RNA, 49 nt, Homo sapiens
uugcuugauugauuggugaaacauuuguugagcugcugugggugaggga

SEQ ID NO: 186894 - RNA, 59 nt, Homo sapiens
gggaaaaaauguaaaguguguggcauugggcuuggugcaugaaaggugcucaguauaag

SEQ ID NO: 186895 - RNA, 42 nt, Homo sapiens
uaaauauuuguugcuccugggaaauggaacugggcggcuggg

SEQ ID NO: 186896 - RNA, 35 nt, Homo sapiens
uuaauuaaaacuggaaacuuauuuaaaggaaacua

SEQ ID NO: 186897 - RNA, 39 nt, Homo sapiens
gaggcuacguguacuugcuacuuagugguuguuaaacaa

SEQ ID NO: 186898 - RNA, 60 nt, Homo sapiens
uuauuuauuucugcuaucguacuuuaaucuaccgaauuuaauuuuuuuuagagcauccug

SEQ ID NO: 186899 - RNA, 44 nt, Homo sapiens
guccucugacacauuuuacuggucaaauguaauagaagugugau

SEQ ID NO: 186900 - RNA, 40 nt, Homo sapiens
aaauggaucuugaaugauuaauagaauuuauaggguggug

SEQ ID NO: 186901 - RNA, 52 nt, Homo sapiens
gaauauccaugccuccucucccccacccucuagauugcauacuucuugagag

SEQ ID NO: 186902 - RNA, 45 nt, Homo sapiens
uagggcaagaugacucugagaaauguuccauacugucucccagag

SEQ ID NO: 186903 - RNA, 46 nt, Homo sapiens
gauaauaguggauuuagagggcagcagaugaaucaaaauauuagag

SEQ ID NO: 186904 - RNA, 81 nt, Homo sapiens
uuucccagucacaccauauguuuuaauuggcagcauuuauugcugcaguuguccucguccuaacccuuuugaugccuuuuc

SEQ ID NO: 186905 - RNA, 54 nt, Homo sapiens
uuauaaugguuguuguauucugaaucuccauugcagacuaucuugauucuaaag

SEQ ID NO: 186906 - RNA, 44 nt, Homo sapiens
gauaugaacuggaaaauaaguuuauaaagcugccucacauuuuu

SEQ ID NO: 186907 - RNA, 45 nt, Homo sapiens
gcuugccauuuuacuggguguugguguuucuugaauggguagaua

SEQ ID NO: 186908 - RNA, 44 nt, Homo sapiens
gaggauggucauugcuguuuauuuuguuuucuacuuuuucucac

SEQ ID NO: 186909 - RNA, 31 nt, Homo sapiens
aguguuguggguuugaaauggugcaucagua

SEQ ID NO: 186910 - RNA, 45 nt, Homo sapiens; identical to SEQ ID NO: 118411

SEQ ID NO: 186911 - RNA, 46 nt, Homo sapiens
uugcccacuuauaugaaacccagguaaguauuuuaacuuauucuau

SEQ ID NO: 186912 - RNA, 46 nt, Homo sapiens
uuuauaucuuacaggcagucuauugauaaaucagaagcaagugcag

SEQ ID NO: 186913 - RNA, 44 nt, Homo sapiens
auuuaauguuggaucuaguggacagugugguguuuaggcuagcc

SEQ ID NO: 186914 - RNA, 48 nt, Homo sapiens
aacaaauacaauuucuuguuuuuaaaguauguauuucucaacuuagag

SEQ ID NO: 186915 - RNA, 47 nt, Homo sapiens
ugaguauaucuuuguucccuuuguacagucucuaccgacauagauaa

SEQ ID NO: 186916 - RNA, 40 nt, Homo sapiens
aaaucacccaaaaugcaccauuaauuuacaguggcaucau

SEQ ID NO: 186917 - RNA, 48 nt, Homo sapiens
acuagcagagaagaauagaagagauugaccugugacauaguaggagau

SEQ ID NO: 186918 - RNA, 69 nt, Homo sapiens
gaaaguucaucaaagugaaaauguuugacuuacuggcaugaucagaaugcugaaauuuggaccguuuaa

SEQ ID NO: 186919 - RNA, 52 nt, Homo sapiens
cagcaaggcuggaaaacccuauggguuuuuuuuuuuuuuuuaucagagccua

SEQ ID NO: 186920 - RNA, 65 nt, Homo sapiens
gucacugacgaaugauugaggugaaauuaaauuuuauuuauauauaaguuugcugcuugggaggg

SEQ ID NO: 186921 - RNA, 40 nt, Homo sapiens
agcuauguucuguuccccaaguuacaaacuguguauagua

SEQ ID NO: 186922 - RNA, 46 nt, Homo sapiens
ggcuuaucuaacaguagcauuuuguuggauaaauguccaccuccaa

SEQ ID NO: 186923 - RNA, 30 nt, Homo sapiens
ucauucuguuuuauacaucuacccccccaa

SEQ ID NO: 186924 - RNA, 46 nt, Homo sapiens
ggucauaccauauugggcaugaacacaguucaacuauacaugaaag

SEQ ID NO: 186925 - RNA, 41 nt, Homo sapiens
aaauaacaacuucuguucaguuaacauaaauauuggcccag

SEQ ID NO: 186926 - RNA, 48 nt, Homo sapiens
uccaccuuccauuuaccuuuuagggauuucuaggugcuccagggagaa

SEQ ID NO: 186927 - RNA, 47 nt, Homo sapiens
uacaacaaauuaaauucaaguuaacaaauagaaaucuaagagcauag

SEQ ID NO: 186928 - RNA, 39 nt, Homo sapiens
gcccuauacaggcacgcaugcacacaucaauagcugucc

SEQ ID NO: 186929 - RNA, 69 nt, Homo sapiens
acucugaagcaaugucagacauugagggaagcucucauugcugcaggaaaagagauuauauggcauggg

SEQ ID NO: 186930 - RNA, 42 nt, Homo sapiens
cugucauugaagaaauuuaaggauaagccaaagacaggaugu

SEQ ID NO: 186931 - RNA, 46 nt, Homo sapiens
uauaucugacaaaacuggcaacaucuuacagacuacugacuugaag

SEQ ID NO: 186932 - RNA, 39 nt, Homo sapiens
aauaaaauuuaaaaaauuaacagccaagucacaaaggua

SEQ ID NO: 186933 - RNA, 41 nt, Homo sapiens
ucccagaguucagcgcggcaccagcccuuccgccacggccg

SEQ ID NO: 186934 - RNA, 45 nt, Homo sapiens
accaccagccucucacggaggcaucuuauguuaaccuaccuacca

SEQ ID NO: 186935 - RNA, 43 nt, Homo sapiens
uagaaguagagaucaggcaugaccucccauagguguucacgag

SEQ ID NO: 186936 - RNA, 61 nt, Homo sapiens
cauuucucgugaacaccuaugggaggucaugccugaucucuacuucuacagagauccugaa

SEQ ID NO: 186937 - RNA, 60 nt, Homo sapiens
gcuacuaagccugagguugcagacuggucugaagguguacaggugcccucugugccuauu

SEQ ID NO: 186938 - RNA, 49 nt, Homo sapiens
ugaauggguaggagcaaccacugacuggucuuaagcuguucuugcauag

SEQ ID NO: 186939 - RNA, 46 nt, Homo sapiens
acgagcuccgcgggcugggaccaugggcugcuucuucuccaagaga

SEQ ID NO: 186940 - RNA, 42 nt, Homo sapiens
ccauugaugacuguacuaacugcauaauuuuucugggacccg

SEQ ID NO: 186941 - RNA, 45 nt, Homo sapiens
uccacagaagccaauagaagcauuguuccaauaucccggggucag

SEQ ID NO: 186942 - RNA, 45 nt, Homo sapiens
auuuuauuuucacagaugguugguaaaggcuuuuuccuaguucag

SEQ ID NO: 186943 - RNA, 34 nt, Homo sapiens
gaugcucaaaggguuuuucgggaaaaagcaccug

SEQ ID NO: 186944 - RNA, 54 nt, Homo sapiens
auuaacuuccauguauaauuagaauuguuuucccuaguggguaaaugccaccaa

SEQ ID NO: 186945 - RNA, 45 nt, Homo sapiens
aggccagcuucuucagguggucagagcagccaauggugcccaaua

SEQ ID NO: 186946 - RNA, 35 nt, Homo sapiens
gaguggaugaacaaguacugauggaacuaaaaacu

SEQ ID NO: 186947 - RNA, 49 nt, Homo sapiens
guguuuguauuugccgaguucgccauuuccacacacaacacaaacaaga

SEQ ID NO: 186948 - RNA, 43 nt, Homo sapiens
uucagcaaauaaauauuauauaaacaagucuuaaaaacaagag

SEQ ID NO: 186949 - RNA, 65 nt, Homo sapiens
accaguucacgccggagccccgugagggaagcgucuccguuggguccggccgcucugcgggacuc

SEQ ID NO: 186950 - RNA, 358 nt, Homo sapiens
ccaagaaguguucggagagauggaaggugaggcaggagagggacggagcucagggggugcaggugugguuuucggcuaggagggccuuaggcagguaguaggcaacucaugagcuucaacuuugccaccccagugacucaccugaauaucuuaagaguuccaggcagacgauuuuagguuuuuacuuauauaagacuucgaaagcaaaaugcuguuaaggaaaaugugguccuuaaagaugaucuugucgucuuuggauguuuauagguaacaauuuugcuguauuuuuggcucuuauuuuauguccacagaccaugucugcaaaggagaagucgaaguuugaagauauggcaaaaag

SEQ ID NO: 186951 - RNA, 46 nt, Homo sapiens
uaugacagggagaugaaaaauuacguuccucccaaaggugauaaga

SEQ ID NO: 186952 - RNA, 44 nt, Homo sapiens
auaaacaaccauaugaacagaaagcagcuaagcuaaaggagaaa

SEQ ID NO: 186953 - RNA, 89 nt, Homo sapiens
ggcccuggcaggccaacaggcucaaagaagaagaacgaaccagaagaugaggaggaggaggaggaagaagaagaugaagaugaggagga

SEQ ID NO: 186954 - RNA, 57 nt, Homo sapiens
aauaaauggcuauccuuuaaugaugcguguggaaugugugugugugcucaggcaauu

SEQ ID NO: 186955 - RNA, 23 nt, Homo sapiens
uucacuuaucaggguuugcuuuu

SEQ ID NO: 186956 - RNA, 28 nt, Homo sapiens
gaauggaaacagaggaauuuagugagag

SEQ ID NO: 186957 - RNA, 40 nt, Homo sapiens
aaucuaaaaccuugaaugaggagacagauccagccaugac

SEQ ID NO: 186958 - RNA, 58 nt, Homo sapiens
guggucgccccguccgcuguggcgggaaagcggcccccagaaccgaccacaccguggc

SEQ ID NO: 186959 - RNA, 48 nt, Homo sapiens
guugcucaacgccccgccucauuggaaaaccaaaucagaucugggacc

SEQ ID NO: 186960 - RNA, 44 nt, Homo sapiens
ugcaggaaaugagcagacccaucaauaagaaauuucucagccug

SEQ ID NO: 186961 - RNA, 36 nt, Homo sapiens
caccccucggaggcaggguuuggggggcuuugggga

SEQ ID NO: 186962 - RNA, 42 nt, Homo sapiens
gagccuggggccggaacaaaaccuugggccccacccccagaa

SEQ ID NO: 186963 - RNA, 56 nt, Homo sapiens
aggagguggcagggacaaccacaaccacaacggccgggggaggagaaggcggcagc

SEQ ID NO: 186964 - RNA, 42 nt, Homo sapiens
ugccgccuucuccucccccggccguugugguugugguugucc

SEQ ID NO: 186965 - RNA, 46 nt, Homo sapiens
cccccaggaugugcuuuuagagacucacgcccaacaucucuagucu

SEQ ID NO: 186966 - RNA, 41 nt, Homo sapiens
agagcuccucaccauugaaugccguuaaagaccugccccag

SEQ ID NO: 186967 - RNA, 57 nt, Homo sapiens
cuggggguucaaggugccugauggggaagaugcugaggccucucaguagucucugaa

SEQ ID NO: 186968 - RNA, 46 nt, Homo sapiens
gaggaggacaucgguaaaaaccgggccgagguaucacagccccgcc

SEQ ID NO: 186969 - RNA, 44 nt, Homo sapiens
cggccugaaugucagguuuugugcugggggacuagaguaugcag

SEQ ID NO: 186970 - RNA, 29 nt, Homo sapiens
gucgucuugagaauuggaagcaggugggu

SEQ ID NO: 186971 - RNA, 42 nt, Homo sapiens
ugguggugcucaccaacaccccccuggaggaccagcugcgag

SEQ ID NO: 186972 - RNA, 45 nt, Homo sapiens
gaaguacagggcaugguugaacucaacggaaaucagcccauggag

SEQ ID NO: 186973 - RNA, 72 nt, Homo sapiens
uccguggaggcaucgucagucaggucaaaguaccuaagaagauuagcuuugugagugugucgaugggaucag

SEQ ID NO: 186974 - RNA, 43 nt, Homo sapiens
cuuuguggugacggacuucgccaaguuuucucgcccugcccag

SEQ ID NO: 186975 - RNA, 41 nt, Homo sapiens
gugcucagcauggccggccaccucggccccgcaaugaggug

SEQ ID NO: 186976 - RNA, 46 nt, Homo sapiens
gagcccugccagcagugcagcaaaauaaccuggacgaggaccucau

SEQ ID NO: 186977 - RNA, 54 nt, Homo sapiens
gggccauuggcugugagcugcucaagaacuuugccaugauugggcugggcugcg

SEQ ID NO: 186978 - RNA, 44 nt, Homo sapiens
cgguaaguggaggugggauccaggggaggauucugagcagagga

SEQ ID NO: 186979 - RNA, 42 nt, Homo sapiens
caaaugaauccacauauccgggugacaagccaccagaaccgu

SEQ ID NO: 186980 - RNA, 73 nt, Homo sapiens
gcgcaucuaugaugacgauuuuuuccaaaaccuagauggcguggccaaugcccuggacaacguggaugcccgu

SEQ ID NO: 186981 - RNA, 72 nt, Homo sapiens
cuaccggaagccacugcuggagucaggcacacugggcaccaaaggcaaugugcagguggugauccccuuccu

SEQ ID NO: 186982 - RNA, 82 nt, Homo sapiens
gacagagucguacaguuccagccaggacccaccugagaaguccauccccaucuguacccugaagaacuucccuaaugccauc

SEQ ID NO: 186983 - RNA, 39 nt, Homo sapiens
ucuuccuagcaaccccaugaagguagguaucacuguugu

SEQ ID NO: 186984 - RNA, 32 nt, Homo sapiens
ugaagaggccuucaaacucaucccgagcccac

SEQ ID NO: 186985 - RNA, 73 nt, Homo sapiens
gucugcagugggcucgggaugaguuugaaggccucuucaagcagccagcagaaaaugucaaccaguaccucac

SEQ ID NO: 186986 - RNA, 46 nt, Homo sapiens
gucuguggucgcugcagcaccaggcugcgcugcacagccuccagca

SEQ ID NO: 186987 - RNA, 46 nt, Homo sapiens
ggcugugcagcgcagccuggugcugcagcgaccacagaccugggcu

SEQ ID NO: 186988 - RNA, 45 nt, Homo sapiens
ggguguggacagcguuugggcccagaccagaacggcgcuccugag

SEQ ID NO: 186989 - RNA, 46 nt, Homo sapiens
ucaggagcgccguucuggucugggcccaaacgcuguccacacccgc

SEQ ID NO: 186990 - RNA, 58 nt, Homo sapiens
cugcaucuggacuaugugauggcugcugccaaccuguuugcccagaccuacgggcuga

SEQ ID NO: 186991 - RNA, 48 nt, Homo sapiens
gaccugcacagacugcaggaauguggccacagcagcucgguccugaga

SEQ ID NO: 186992 - RNA, 75 nt, Homo sapiens
caggcucucaggaccgagcugcuguggccacauuccugcagucugugcagguccccgaauucacccccaagucug

SEQ ID NO: 186993 - RNA, 78 nt, Homo sapiens
gugcaucuucacccuccauaguuuggggcugcgguuuacugacacccccaccccaccccaucugcauauuuuuucacc

SEQ ID NO: 186994 - RNA, 86 nt, Homo sapiens
aaaggaacaugaaggaguagacauuucagaaggaagauggggaccauggaaggggaaaugggaggagaucuauggagaggaagacg

SEQ ID NO: 186995 - RNA, 44 nt, Homo sapiens
ggggggagauggagaagauauaaaagggggagaguggggguaua

SEQ ID NO: 186996 - RNA, 54 nt, Homo sapiens
gagacacuaaggaacggaaaugaaaauguuaggagaaaguggagauggagagau

SEQ ID NO: 186997 - RNA, 57 nt, Homo sapiens
gggcaaaagguauucagguacaaaaaggauuuggaaaggagagacauccugggagag

SEQ ID NO: 186998 - RNA, 56 nt, Homo sapiens
ucaucugcaugaagaaagggacacugucagcccuuuagaucccaggcuaaggucug

SEQ ID NO: 186999 - RNA, 58 nt, Homo sapiens
cuagaggagcucaaagccacucugcccagcccagacaagcucccuggauucaagaugu

SEQ ID NO: 187000 - RNA, 46 nt, Homo sapiens
gcugcauccaaccuccgggcagaaaacuaugacauuccuucugcag

SEQ ID NO: 187001 - RNA, 45 nt, Homo sapiens
ugugccggucugcagaaggaaugucauaguuuucugcccggaggu

SEQ ID NO: 187002 - RNA, 46 nt, Homo sapiens
cagagcaagcugauugcagggaagaucaucccagccauugccacga

SEQ ID NO: 187003 - RNA, 46 nt, Homo sapiens
gccuuucuuugguuucucugaaccccuugccgcaccacgucaccag

SEQ ID NO: 187004 - RNA, 41 nt, Homo sapiens
cuccauccccccuacccccaugcagacguguuuagucagau

SEQ ID NO: 187005 - RNA, 41 nt, Homo sapiens; identical to SEQ ID NO: 118544

SEQ ID NO: 187006 - RNA, 24 nt, Homo sapiens
cugacccuauacucccaucccccu

SEQ ID NO: 187007 - RNA, 47 nt, Homo sapiens
acauccucgccgcucucgucguuacagcacagcucaagcaccagcgc

SEQ ID NO: 187008 - RNA, 51 nt, Homo sapiens
uguccgauacaccauccgcugaccccgucugcuccucuaggcuggccccuu

SEQ ID NO: 187009 - RNA, 52 nt, Homo sapiens
aagggguguggagagggguggacaaggggccagccuagaggagcagacgggg

SEQ ID NO: 187010 - RNA, 50 nt, Homo sapiens
uaauucuuuauuaggauucagguuucaaacaagguagaaggcaguggcaa

SEQ ID NO: 187011 - RNA, 46 nt, Homo sapiens
ggaggaugcggcgccaagccggagacggcaccagggagaacugugg

SEQ ID NO: 187012 - RNA, 45 nt, Homo sapiens
ucauccgaggacguggcugaagccuggucacucuccccaucagac

SEQ ID NO: 187013 - RNA, 46 nt, Homo sapiens
cuaggcugacacgacggaggcggcggcugaggggcuugucaaagau

SEQ ID NO: 187014 - RNA, 56 nt, Homo sapiens
ugagcuugcuuuugccuuuguagacgguggcauagguacccuggaaugugaggaag

SEQ ID NO: 187015 - RNA, 45 nt, Homo sapiens
cauguagcguaacgauguuggcguguuugagguccuugagcaggg

SEQ ID NO: 187016 - RNA, 48 nt, Homo sapiens
guccguuucugggagauuuguggguuggagugggugagugggggcccc

SEQ ID NO: 187017 - RNA, 32 nt, Homo sapiens
ugggaaaguaggaggcuggggagccaauaaga

SEQ ID NO: 187018 - RNA, 46 nt, Homo sapiens
ccgaaggcuggccuccuuuuguagcugaaucuccuuuagugcaaau

SEQ ID NO: 187019 - RNA, 44 nt, Homo sapiens
guaguugggggcugcccugugagggguguggcaucccuccagcc

SEQ ID NO: 187020 - RNA, 46 nt, Homo sapiens
gaccccuggcuggccgugggguagugguccugggggcugguaugau

SEQ ID NO: 187021 - RNA, 24 nt, Homo sapiens
ccuaggcagugccuggaagugacu

SEQ ID NO: 187022 - RNA, 24 nt, Homo sapiens
cugucgugugaaaauuaggcugca

SEQ ID NO: 187023 - RNA, 40 nt, Homo sapiens
cagcccaucuugacaaaaucuaaggcuccauggagccacc

SEQ ID NO: 187024 - RNA, 45 nt, Homo sapiens
gucuaaaucaggacugcuguguggucuaccgacucaucaaggggu

SEQ ID NO: 187025 - RNA, 54 nt, Homo sapiens
ucacccugguccaucacuucugcccagauuucaucuauuuuguccuuucacgau

SEQ ID NO: 187026 - RNA, 44 nt, Homo sapiens
auuugcuucuccccuuccguuucagagcauggacucuucacacc

SEQ ID NO: 187027 - RNA, 33 nt, Homo sapiens
guuuucucaucuguaaagaggggaugaugauac

SEQ ID NO: 187028 - RNA, 17 nt, Homo sapiens
agccccaccagggcaag

SEQ ID NO: 187029 - RNA, 45 nt, Homo sapiens
ugcagcugcugaagaggaucgggacgggcucguuuggcaccgugu

SEQ ID NO: 187030 - RNA, 42 nt, Homo sapiens
agauuuugcugagguccggggacagauagccacggcccacca

SEQ ID NO: 187031 - RNA, 46 nt, Homo sapiens
cuggacaccccuccucacccccaccugcccucagauccuggccaca

SEQ ID NO: 187032 - RNA, 48 nt, Homo sapiens
ucccccgccauucaaggacuccucucuuucuucaccaagaagcacaga

SEQ ID NO: 187033 - RNA, 41 nt, Homo sapiens
cucuugggguucagagccgcugagggguggggugaguccag

SEQ ID NO: 187034 - RNA, 57 nt, Homo sapiens
gaaccgagggguccuggaagugggaggggcucccaagguauugaaugagguugaggg

SEQ ID NO: 187035 - RNA, 39 nt, Homo sapiens
gguguuggguggcauuugaagauguggaucuucagaggg

SEQ ID NO: 187036 - RNA, 41 nt, Homo sapiens
gauuuggagacuccaaaagugagaaauggauucagggccca

SEQ ID NO: 187037 - RNA, 42 nt, Homo sapiens
cuuucgccagccucuucuccgacugauaccccacucugagaa

SEQ ID NO: 187038 - RNA, 44 nt, Homo sapiens
gccuucaaccuuccagagccagccccgcccaggcccagccuuag

SEQ ID NO: 187039 - RNA, 46 nt, Homo sapiens
ggucagagacugggauuugcuagagagagacaagguggaggcgugg

SEQ ID NO: 187040 - RNA, 71 nt, Homo sapiens
gagcacucagguggaguggguggaguccugggccagggaggcgagaucugggacaggcugggaggacuugg

SEQ ID NO: 187041 - RNA, 32 nt, Homo sapiens
uuccuccuccuucacauccuucuggcccaucu

SEQ ID NO: 187042 - RNA, 67 nt, Homo sapiens
agacugagaugggccagaaggaugugaaggaggaggaaaaguaugaggauggagugggaagagccag

SEQ ID NO: 187043 - RNA, 110 nt, Homo sapiens
augauaggaggacuaggacucgggccaggaguuuuagggauggguugguggcgggggggcgaguuuggcagggaaggcucugggcugggcaggaaguugcagaggguggg

SEQ ID NO: 187044 - RNA, 56 nt, Homo sapiens
cagcccagagccuucccugccaaacucgcccccccgccaccaacccaucccuaaaa

SEQ ID NO: 187045 - RNA, 96 nt, Homo sapiens
ucagccaggugccugggaggcccuggaggaggaaacuuucccagggccuuugaggaggaauucgaacugagugcaguuucucugggauucuggcac

SEQ ID NO: 187046 - RNA, 75 nt, Homo sapiens
ggccgcugccccaguagagcagcccuagcucccuugcuccucagacccagguccuaugcaggggucccacgaacu

SEQ ID NO: 187047 - RNA, 47 nt, Homo sapiens
agggguccccuuacuugagcugggggugcggaggucccccugcagcg

SEQ ID NO: 187048 - RNA, 62 nt, Homo sapiens
uggccuggcguguggggccggcugggccuggggguuucuggggcgggcccuggcgcugcugc

SEQ ID NO: 187049 - RNA, 42 nt, Homo sapiens
ggccagagacggaugucugacggguagccuguggggggcccg

SEQ ID NO: 187050 - RNA, 46 nt, Homo sapiens
cggcggcgcggccugggacgcgggcugcuggggcgcugagguggga

SEQ ID NO: 187051 - RNA, 46 nt, Homo sapiens
agcgacagcgggaugccuccccuggcaggggcucccauggccaggu

SEQ ID NO: 187052 - RNA, 45 nt, Homo sapiens
uuugggggacuggacaucugcgcaguggaagcgcuacauggcaag

SEQ ID NO: 187053 - RNA, 46 nt, Homo sapiens
cggcgauggcggcagggccugagcgcuagaggauaaauguccacgc

SEQ ID NO: 187054 - RNA, 31 nt, Homo sapiens
gaaguuugggagcuggggaacuggggauugg

SEQ ID NO: 187055 - RNA, 48 nt, Homo sapiens
cugggggcuaucagccacagcaacaacaggaugccagaagccaggggc

SEQ ID NO: 187056 - RNA, 42 nt, Homo sapiens
ggcuucuggcauccuguuguugcuguggcugauagcccccag

SEQ ID NO: 187057 - RNA, 44 nt, Homo sapiens
gguugacuucugguguccccacgaacuuggcccugaugacugca

SEQ ID NO: 187058 - RNA, 71 nt, Homo sapiens
cagggccaaguucguggggacaccagaagucaaccagaccaccuuauaccagcguuaugagaucaagauga

SEQ ID NO: 187059 - RNA, 64 nt, Homo sapiens
ucucgcaccaaccaguggccagaaguuucuguuuugaccaggaggaagauguuagaaaaugcug

SEQ ID NO: 187060 - RNA, 44 nt, Homo sapiens
gugcgagaaaguuggcugugaucuugggaugcuauaugacuuca

SEQ ID NO: 187061 - RNA, 45 nt, Homo sapiens
gcggggguguagacgaaccggaugucagcggcauccccuaaggcu

SEQ ID NO: 187062 - RNA, 76 nt, Homo sapiens
cuuaggggaugccgcugacauccgguucgucuacacccccgccauggagagugucugcggauacuuccacaggucc

SEQ ID NO: 187063 - RNA, 46 nt, Homo sapiens
gcugagcuaagcucaggcuguuccagggagccacaaaacugcaggu

SEQ ID NO: 187064 - RNA, 45 nt, Homo sapiens
accugcaguuuuguggcucccuggaacagccugagcuuagcucag

SEQ ID NO: 187065 - RNA, 46 nt, Homo sapiens
gcccuuaggguuggggagcagccacagggacacagaauagccagag

SEQ ID NO: 187066 - RNA, 77 nt, Homo sapiens
cagggagggacaggugaucacacgguauuggacacagggaaagggagcagccagaauuuguaagggagcagucucgg

SEQ ID NO: 187067 - RNA, 45 nt, Homo sapiens
cacuuuggguucuuggagaacauucuggggaaccaagaaacaauc

SEQ ID NO: 187068 - RNA, 39 nt, Homo sapiens
uuucccuguuuauccauccccugcaaacugcagaguggc

SEQ ID NO: 187069 - RNA, 45 nt, Homo sapiens
acuggaagcccuuuucagagccuuggaggagcugguccguccaca

SEQ ID NO: 187070 - RNA, 53 nt, Homo sapiens
gcagucccugcggucccagauagccugaauccugcccggaguggaagcugaag

SEQ ID NO: 187071 - RNA, 42 nt, Homo sapiens
ucuuucuuccggacaaugaaauaaagaguuaccacccagcag

SEQ ID NO: 187072 - RNA, 25 nt, Homo sapiens
gguccuucuacauauucccuacucu

SEQ ID NO: 187073 - RNA, 87 nt, Homo sapiens
ugcauaagaaacuggggacagaagaauucccucuaauugaucagaccuucuaccccaaucacaaagaaauggugaguuuggggaaaa

SEQ ID NO: 187074 - RNA, 40 nt, Homo sapiens
cagagcugugucgguaagcugcaagcugaccuugcugaga

SEQ ID NO: 187075 - RNA, 44 nt, Homo sapiens
aaaggucccaagguuagaauuuauucugggcagaacacugaaga

SEQ ID NO: 187076 - RNA, 74 nt, Homo sapiens
aagaacuuaggcauggaauguggggagacaacuuuucuucagaaaaagagccagggaccccaggaugccacaag

SEQ ID NO: 187077 - RNA, 45 nt, Homo sapiens
ggaaaaagauccauggagaaauugacauuaaaguagaacagguaa

SEQ ID NO: 187078 - RNA, 53 nt, Homo sapiens
cuggagugugccauugggaucaacacuugugaggaggguuggguugagcagag

SEQ ID NO: 187079 - RNA, 43 nt, Homo sapiens
cuccccagaauuguuuucuuaacaguagauccagugagcacau

SEQ ID NO: 187080 - RNA, 59 nt, Homo sapiens
ggaggugugaauauacagaacacacagaagacacuccauaaaugcucaggggagccauu

SEQ ID NO: 187081 - RNA, 48 nt, Homo sapiens
agacaaggaauaaaugcucacuggauccauuagaagaaaaggccuuug

SEQ ID NO: 187082 - RNA, 68 nt, Homo sapiens
ggaacagguacgcagcaggugccugauaauugcucccuggauccaucaagguuuaaggggcggagggg

SEQ ID NO: 187083 - RNA, 41 nt, Homo sapiens
cuuuaaauuauuaagcuggaugcuuccucugugccccgccc

SEQ ID NO: 187084 - RNA, 79 nt, Homo sapiens
ccugaggaagaggaacucuaacacuucucuccuccacucugagcccccugaccuuccaaaccucaauaaacuagccucu

SEQ ID NO: 187085 - RNA, 29 nt, Homo sapiens
agcuggugguggaggagaaacgaccaugu

SEQ ID NO: 187086 - RNA, 47 nt, Homo sapiens
cgagugccaccucccagcugcaggaaguggggagaaacuaagaagau

SEQ ID NO: 187087 - RNA, 39 nt, Homo sapiens
gccuaagucccccuugcccuucucugcugcccagcuccu

SEQ ID NO: 187088 - RNA, 45 nt, Homo sapiens
ccacccggacccacaucugcaacacagcugugcccugcccugguc

SEQ ID NO: 187089 - RNA, 44 nt, Homo sapiens
caggucacagggcaggggcucacagggccccaaggcccccagcc

SEQ ID NO: 187090 - RNA, 54 nt, Homo sapiens
ugcacccagcgugggucugcgggguuacagcagggaacugccaggcugagagga

SEQ ID NO: 187091 - RNA, 42 nt, Homo sapiens
cugggagccuugcucugucaccugcuccaaagggacccggac

SEQ ID NO: 187092 - RNA, 47 nt, Homo sapiens
ccgggucccuuuggagcaggugacagagcaaggcucccagggccccc

SEQ ID NO: 187093 - RNA, 46 nt, Homo sapiens
ccagagcacugcccauuccagcccacacagcgccgguaccgcagcu

SEQ ID NO: 187094 - RNA, 45 nt, Homo sapiens
uuacuauauaucccagauacaccgugggcauggggagcuugggga

SEQ ID NO: 187095 - RNA, 34 nt, Homo sapiens
gcagcuugguauuucccuaauuuugaugacagcu

SEQ ID NO: 187096 - RNA, 57 nt, Homo sapiens
gucccgcuuuaucuggguugauaggcuccuggaaucagcagggaaagaggaaccuag

SEQ ID NO: 187097 - RNA, 35 nt, Homo sapiens
cagaacaagaccaagaguaagacaggaaaugggga

SEQ ID NO: 187098 - RNA, 61 nt, Homo sapiens
caagaaggugcaauuguguguacgaaagcaggcgugagagacugcagcaaagacugagaaa

SEQ ID NO: 187099 - RNA, 47 nt, Homo sapiens
ggccccuccagccaguacuccaggucucccugucucucccccgcugc

SEQ ID NO: 187100 - RNA, 48 nt, Homo sapiens
agaggucacagaugggggccauucuugggucucucacccuguccaaaa

SEQ ID NO: 187101 - RNA, 42 nt, Homo sapiens
cagaccccggugcugcugacacccagcucgcugccuccuagc

SEQ ID NO: 187102 - RNA, 44 nt, Homo sapiens
caccgcagggcaggcgggcggccaugcggcuuccagcccugaga

SEQ ID NO: 187103 - RNA, 42 nt, Homo sapiens
ggagggacuucuggcucggccuuggugguuucuggcacaaac

SEQ ID NO: 187104 - RNA, 45 nt, Homo sapiens
ccggcuccacauuaagcucuuccgauuucagguuuggggccucgg

SEQ ID NO: 187105 - RNA, 42 nt, Homo sapiens
ccaggucauccugaccccgcccgaggccccaaaccugaaauc

SEQ ID NO: 187106 - RNA, 46 nt, Homo sapiens
aggcugguagaagagacauagcugucccguuaaaggagauaauggu

SEQ ID NO: 187107 - RNA, 46 nt, Homo sapiens
uuacugaauuucuauauuccaguccuuaccugcagaggcaagccgg

SEQ ID NO: 187108 - RNA, 46 nt, Homo sapiens
cccgagcgcauguacucguuccggcugcugcgugccaaaccgccug

SEQ ID NO: 187109 - RNA, 52 nt, Homo sapiens
gagagaaaggggaggaacuggggagggauauagauaaggggaaucuggcggg

SEQ ID NO: 187110 - RNA, 51 nt, Homo sapiens
gaaaaugaaauaacugguauaaauauuggggggaggagaaacccagcagug

SEQ ID NO: 187111 - RNA, 43 nt, Homo sapiens
uucauagucuucucuuauuccagaauauuucauauuccuagaa

SEQ ID NO: 187112 - RNA, 240 nt, Homo sapiens
gguuucagaggacagaaugaggaccagccauuauuaaccguguuuucaagauguuggcuauaggaauacggcaggaaaaugaaacguugugcauggcagggcagcaucacuuuggggaucucagagugggaguagaaagagucaguauuaauaaugcaguggugguuuucgccaaagcaguaagacaagaaaguaggugagauaguguuuaggggcccaauacuggucuuaggguaccaa

SEQ ID NO: 187113 - RNA, 45 nt, Homo sapiens
ggucugagagacuguaccuugucauaguaguaccgcaaggcccgg

SEQ ID NO: 187114 - RNA, 46 nt, Homo sapiens
cugguggaugcagaggagguggcccggcugugggggcuacgcaaga

SEQ ID NO: 187115 - RNA, 43 nt, Homo sapiens
gagaacauucagggacaguaacaggacagagagaucaggcauu

SEQ ID NO: 187116 - RNA, 64 nt, Homo sapiens
ggauuguugucuguugcguucucgacuguauccgcagcaccuggcccacaguaugcacucacca

SEQ ID NO: 187117 - RNA, 51 nt, Homo sapiens
ccagauagugcaggugauacauaggauaggauugcaggggcagggggagaa

SEQ ID NO: 187118 - RNA, 42 nt, Homo sapiens
uugggacuguuccugcaaccaaccuuuacugagccccuugug

SEQ ID NO: 187119 - RNA, 69 nt, Homo sapiens
guguggaaugcaguauaaaaagauacauguaugaaagauguuucuaagaaugccaguuuauauaugagu

SEQ ID NO: 187120 - RNA, 54 nt, Homo sapiens
ucuagcauuaccgccuauaccuucccacccccuuacugugcuccaaccacacug

SEQ ID NO: 187121 - RNA, 42 nt, Homo sapiens
uuaacagugagucuaccugaguuuguauuccugccuccucca

SEQ ID NO: 187122 - RNA, 53 nt, Homo sapiens
cacgccgauuggcucaaggacugacggacugugagcaacugaaaaggcucggg

SEQ ID NO: 187123 - RNA, 46 nt, Homo sapiens
caccauugacuucuuccccccauccucagacauuaaagagccugaa

SEQ ID NO: 187124 - RNA, 64 nt, Homo sapiens
ggccacucuggcuggagaagaauaagugaagggggaauguaagaggugaggucagagagguaau

SEQ ID NO: 187125 - RNA, 27 nt, Homo sapiens
uuaggauucuuuugggcgagaucugau

SEQ ID NO: 187126 - RNA, 42 nt, Homo sapiens
ggauggaguugccauuaucugagauggagaaguuaggggagg

SEQ ID NO: 187127 - RNA, 50 nt, Homo sapiens
ccucccuuagaguuucaguaauuuuuaucuuuucaaaccuuuccagccau

SEQ ID NO: 187128 - RNA, 79 nt, Homo sapiens
uagauuaacaacaucucacaagugugaguaccauugauuuaaacuucuuuguugguuguguuuuguguuuaugucuguu

SEQ ID NO: 187129 - RNA, 24 nt, Homo sapiens
uugggagcauagaugagggauuug

SEQ ID NO: 187130 - RNA, 68 nt, Homo sapiens
ccaaugggggacugcaaaagcggcgccuggagccuauggagaccguguguggcuggugggggugggau

SEQ ID NO: 187131 - RNA, 52 nt, Homo sapiens
uuaaugggauuuggcggguucuaagguaggcgcgacgcacagguggagguag

SEQ ID NO: 187132 - RNA, 47 nt, Homo sapiens
cauguuugcuuuuuuuucccuucccucauugucuccuucccaucuaa

SEQ ID NO: 187133 - RNA, 46 nt, Homo sapiens
gcauucaguaggucugaucuaacuucguaugcaggguacacugaag

SEQ ID NO: 187134 - RNA, 45 nt, Homo sapiens
guccaguuuauguugcuugucaaucucccauuucguuacuucaag

SEQ ID NO: 187135 - RNA, 48 nt, Homo sapiens
aauuggauuaaagucugaaggagugccaaggauagauuguguuucgaa

SEQ ID NO: 187136 - RNA, 26 nt, Homo sapiens
gcaugugggguaucuacagccauugg

SEQ ID NO: 187137 - RNA, 247 nt, Homo sapiens
aucuauagcuucuggcucaaguaagccuuuccuguuccauuuuggcuauuuucucccccaagauaggcugggcuguguuucuugguuugggaagauuccaguccccuagaaauugguccaaucuaccucagcaggucugccaaggucccagagcgaaaguuacaggcaaauggaccaguggcuaagaaagcuaagaagaaggccucauccagugacagugaggacagcagcgaggaggaggaggaag

SEQ ID NO: 187138 - RNA, 46 nt, Homo sapiens
uagccacugguccauuugccuguaacuuucgcucugggaccuuggc

SEQ ID NO: 187139 - RNA, 53 nt, Homo sapiens
ggcugcagccaaagcaucagagaguagcagcagugaagaguccagugaugaug

SEQ ID NO: 187140 - RNA, 27 nt, Homo sapiens
cauccucggagcuugagucagaaucag

SEQ ID NO: 187141 - RNA, 46 nt, Homo sapiens
cugacucaagcuccgaggaugagccaccaaagaaccagaagccaaa

SEQ ID NO: 187142 - RNA, 1015 nt, Homo sapiens
cuguuucuguucccaagaggcugggcuggggaccagauugcucuggggacuggaguuaaaauugccgauuuggcacaggggugaaaugguacuguuuguugaacuggagguguugauuacuggucuuuuaauuuuaaagguuuuacuaauaaauaacaagauuucauaggagcuaguaaauagagaaaguuauugcagcaagaaaaaauguguauuuuuuuuaaugguauccauuugguauuuugugacauuucauagacauuuuauguuuucacacaucccauuccacuguaaucacuuaaauaucuauuuguugugcuuuucacugccauuuuuacucuuguauguucauucuaugagacaaaugagaauuuuucuuuuuuucuguaacuugugaugaggguuagguuauuucucugaauggagguugaagugaaagauuuuagagggcguauugagauuauuuaugucaucuuuucuaagaagacaguuuuauuccugccaugggauaggaaagguauccuuugaugugguaaaccauggcuggcauucuccucgauggcugcucuaaaguugaaagaauugguggacuccuggccaggcacaguggcucacaccuauaaucccagcacuuugggaggcugaggcgggcggauugcuugaggucaggaguucaagaccagccuggccaacauggcgaaacccugugucuacuaaaaauauaaaaauuagcugggcaugguggugggcaccuguaaucccagcuacuccagaggcugaggcgggagaguugccugaaccacugcacacuagccugugcaacagagccagagccagacuccgucuccaaaaaaaaaaaaaaaaaaaaaaaaaaaaaugguggacuccuaaguucucugcucauaggaaggagguuuuucaugguccugacuugcccuaauacuccuuacucuuucuuuuucuuggguauuccagcucgagcagcaccuaaaauagccaaugguaaagcagccag

SEQ ID NO: 187143 - RNA, 72 nt, Homo sapiens
acuguaccuaaaaagcaaguuguggccaaggccccagugaaagcagcuaccaccccuacccggaagaguucu

SEQ ID NO: 187144 - RNA, 156 nt, Homo sapiens
cagguaaggcauauggaggcccucaguucagugagaugcucucaggcagcugcuaagggcuccccugaauccaauuuggggagcuguugauuccaucccuucugugucuagacucugacagcucugaggaugaugaagcuccuucuaagccagcug

SEQ ID NO: 187145 - RNA, 46 nt, Homo sapiens
cucaggguaguagggacagcagcucugauucagacagcuccagcag

SEQ ID NO: 187146 - RNA, 46 nt, Homo sapiens
ccuccucacugcuggagcugucugaaucagagcugcugucccuacu

SEQ ID NO: 187147 - RNA, 52 nt, Homo sapiens
caaggccaauggcaccucugcacugacugcccagaauggaaaagcagcuaag

SEQ ID NO: 187148 - RNA, 46 nt, Homo sapiens
auucuauuaaguuugacagcgagugaccugaggccaucuucgguga

SEQ ID NO: 187149 - RNA, 36 nt, Homo sapiens
cuuuuaggccaagcuggccugacgguauggcugcag

SEQ ID NO: 187150 - RNA, 21 nt, Homo sapiens
gcuaaggcauucuggugguag

SEQ ID NO: 187151 - RNA, 42 nt, Homo sapiens
uuucaauaugaagggcaacuccacccuugccacuacuagcaa

SEQ ID NO: 187152 - RNA, 46 nt, Homo sapiens
ucuggcaacaaugagucuaccuugaacuguucacagaaaccaucag

SEQ ID NO: 187153 - RNA, 48 nt, Homo sapiens
uuacccugaacauguuugcaagcauuuuuuuuaucaccugcaugagug

SEQ ID NO: 187154 - RNA, 42 nt, Homo sapiens
auggccuguuuguccucauugccaacauuuuauuuucgagac

SEQ ID NO: 187155 - RNA, 55 nt, Homo sapiens
uaauauucauagcaacaugcuauuuuggaauuagaaaacacuuacugaagacgaa

SEQ ID NO: 187156 - RNA, 45 nt, Homo sapiens
cagaagcuccgcaguguguuuaggguuccaauuacuuggcuccaa

SEQ ID NO: 187157 - RNA, 41 nt, Homo sapiens
uuuuucugauauguuuguacaagauugucauuagugagaca

SEQ ID NO: 187158 - RNA, 43 nt, Homo sapiens
uuauauccauuuuuaucaggauuuccucuugaaccagaaccag

SEQ ID NO: 187159 - RNA, 46 nt, Homo sapiens
ugcauauauguagaaccauacagaauuuagguggauaagggcuaga

SEQ ID NO: 187160 - RNA, 46 nt, Homo sapiens
aaguugaagguggauuauaguaaauguacaacugugcucacuaggc

SEQ ID NO: 187161 - RNA, 46 nt, Homo sapiens
ucuaucuuugcaaugugucauaaauucucuucuuuuucccccuuaa

SEQ ID NO: 187162 - RNA, 46 nt, Homo sapiens
ccacaccaucaccuucuagagaguccccucuuucugcaccuuaaga

SEQ ID NO: 187163 - RNA, 45 nt, Homo sapiens
ugugguugggggguauucuuggaauaaucguuguaugguagagau

SEQ ID NO: 187164 - RNA, 46 nt, Homo sapiens
augauguccuaagcugugaauacuauucaccuauccuugaccagug

SEQ ID NO: 187165 - RNA, 28 nt, Homo sapiens
augguuaucuuuccauauagugguagua

SEQ ID NO: 187166 - RNA, 46 nt, Homo sapiens
caaaggauaucuguaugcaguuggugggcgaaaugcagcaggugaa

SEQ ID NO: 187167 - RNA, 45 nt, Homo sapiens
cggacagaguaauuaugauacaaaaggaaaaacggcaguugauac

SEQ ID NO: 187168 - RNA, 44 nt, Homo sapiens
aggcccaugaguggaaaucguuagcccccauggaugccccaagg

SEQ ID NO: 187169 - RNA, 46 nt, Homo sapiens
cucauuaauuacgugcaaacgguggauuucaugagaacugacaaua

SEQ ID NO: 187170 - RNA, 83 nt, Homo sapiens
agcacaggggaguucuugaaacucccuuuugagcgucuugccuucgugcuuuccaguaauagccuuaagcacuguacugaacu

SEQ ID NO: 187171 - RNA, 46 nt, Homo sapiens
cuguguugaaguuggacggauugccaacaccuacaaucuaaccgaa

SEQ ID NO: 187172 - RNA, 168 nt, Homo sapiens
uugagaguacaaaagcagauacuggcugguccgagugcagugguguuuacaacuaauugaucacaaccaguuacagauuucuuuguuccuucuucacuuugacugcuucacucggcuagccagaaaaaaaaaaaaaaaagcagauacccauuuuuuucuaaaugggaa

SEQ ID NO: 187173 - RNA, 73 nt, Homo sapiens
ggaagaagaacagugguacguaaagugugaaucaguaacagugguauguaaaaugcgaaucaguaaagaaccu

SEQ ID NO: 187174 - RNA, 44 nt, Homo sapiens
cauuguaauuuuugagaaaaucuggcagaugauuaguuccagga

SEQ ID NO: 187175 - RNA, 41 nt, Homo sapiens
uuuaaugugcauuaaacuucauggugugagcaaagucgguc

SEQ ID NO: 187176 - RNA, 45 nt, Homo sapiens
augaugcuuucccugugcauagagucaugauggcaucugcuagug

SEQ ID NO: 187177 - RNA, 46 nt, Homo sapiens
uauaaaaggacuauuaaauuaucgcgaaaaggaauguuaagacagu

SEQ ID NO: 187178 - RNA, 65 nt, Homo sapiens
uaugguauacuagcauauggaaacagacaaaaauguucauguaaaucuuucaagaagagugagua

SEQ ID NO: 187179 - RNA, 47 nt, Homo sapiens
cccaaggcacagagacagaaaaguagagaacuaagauaaguguugag

SEQ ID NO: 187180 - RNA, 35 nt, Homo sapiens
auuguagugagaaggacauggguuucagccaaaac

SEQ ID NO: 187181 - RNA, 51 nt, Homo sapiens
cauuuuuguaucaaucuuaggugugguguugucaagagaacaagcuagaga

SEQ ID NO: 187182 - RNA, 70 nt, Homo sapiens
cuauuuaaaagucuauuaaaaauuauguuuucacaaauugagauuuuuaaggccaagcacuaacagggaa

SEQ ID NO: 187183 - RNA, 71 nt, Homo sapiens
gucuuuggaaugaucuacagaaagaagauucuguauucauucagaggacauauauuaagucuuucgugcua

SEQ ID NO: 187184 - RNA, 84 nt, Homo sapiens
uucaaagccauuaucuacuuuuuuacucuuagacuugaguuuucaaauugaugggccuguggagagcagagauauucuguuagg

SEQ ID NO: 187185 - RNA, 46 nt, Homo sapiens
cacucaaacguuugugguaucauucagcuuuuguuugggaagugug

SEQ ID NO: 187186 - RNA, 39 nt, Homo sapiens
gcaagcucacugcugcagauauagagacuucucaaaggg

SEQ ID NO: 187187 - RNA, 85 nt, Homo sapiens
aacaaauaacccuuuaaaauaauaguaaggaaaguugauauuauuuauuuauuuuuauuuggugcuuauaugcuaaauaugaacu

SEQ ID NO: 187188 - RNA, 55 nt, Homo sapiens
gagcuuuuauugugcucuacauuuuauaaaauaggcacaauuguuuugauuacau

SEQ ID NO: 187189 - RNA, 32 nt, Homo sapiens
uuauauaauaccuuacuaggguuagaagaaaa

SEQ ID NO: 187190 - RNA, 69 nt, Homo sapiens
caaguuucagaacuuuagauuaaauuuuaaucuagcauguauaacagauauucuaaacuucaugagaca

SEQ ID NO: 187191 - RNA, 51 nt, Homo sapiens
uuuauucuuuuagcuucuucagaucuuuuagucugaggaagccuggcaugu

SEQ ID NO: 187192 - RNA, 30 nt, Homo sapiens
acuagacuuguucuccuuuagucccugcac

SEQ ID NO: 187193 - RNA, 70 nt, Homo sapiens
uuauauaguauaaagcacuuaaaaaauuuugcuguaaugucauacuagaaaagugggauaucuuaaauac

SEQ ID NO: 187194 - RNA, 26 nt, Homo sapiens
uuuguacguaugcuuguguagcauca

SEQ ID NO: 187195 - RNA, 44 nt, Homo sapiens
acuguugguuguugguaguacacauagguagaauggaaaaauau

SEQ ID NO: 187196 - RNA, 53 nt, Homo sapiens
uaccaaaagcaacuuuauuauaaaaacaaaacaaaacaaaaccucacuaaaau

SEQ ID NO: 187197 - RNA, 48 nt, Homo sapiens
gaaaaucuuuuuaaauuugcaguguugcuuuaaaggcaaaauccagga

SEQ ID NO: 187198 - RNA, 42 nt, Homo sapiens
auuugugcaaauuauaucucuaugagcaguuauauuaugggg

SEQ ID NO: 187199 - RNA, 50 nt, Homo sapiens
aauggcauuaaaaauugaugauugauggugguguguuaaauaugguaaug

SEQ ID NO: 187200 - RNA, 60 nt, Homo sapiens
uuaaaguguuuaaugguaaucuaauuaccagugugaaaguacaaaggcauaccuaaggaa

SEQ ID NO: 187201 - RNA, 67 nt, Homo sapiens
aucuaccuuguggcaaaaugggggcgggggagcccccaaacagcaacauccaaaaaccuacaggauu

SEQ ID NO: 187202 - RNA, 85 nt, Homo sapiens
uuaaaacauccaggucaacuccacuuucuccagcauacauguaagugagagaaaauaggauauuaaagugggauuucauucauga

SEQ ID NO: 187203 - RNA, 50 nt, Homo sapiens
uuggaaugauugaaucaucauauugcuuuaggggacagaagaauuuaagg

SEQ ID NO: 187204 - RNA, 66 nt, Homo sapiens
gggaggagugggggggguggugaacaagaggggaaaggggagagaaggggagggcaguauugaauu

SEQ ID NO: 187205 - RNA, 46 nt, Homo sapiens
cuuuuaggguuuuagguguuuuagagugcugaggaugggguguagg

SEQ ID NO: 187206 - RNA, 45 nt, Homo sapiens
caugagagguaauuauaagugacuuaauaauuuauuaaaggaaaa

SEQ ID NO: 187207 - RNA, 44 nt, Homo sapiens
uaguacuuguugagaaugcagaguacugggccccaccuucagau

SEQ ID NO: 187208 - RNA, 46 nt, Homo sapiens
ugguguugagcagccaguguucauaugcuaaggcaggccagggacu

SEQ ID NO: 187209 - RNA, 42 nt, Homo sapiens
aaacaagccgauuucaaggauauauucaaaaaaucaacuuca

SEQ ID NO: 187210 - RNA, 39 nt, Homo sapiens
acagaacuuaacaaaaaccaaaucuucugguuaggagac

SEQ ID NO: 187211 - RNA, 44 nt, Homo sapiens
gcaguagugcuugugagaugacccagaaaaaaccaagacaguuu

SEQ ID NO: 187212 - RNA, 46 nt, Homo sapiens
cauuaaggagaugcuguuuugaauuuaucauuccaaaaaagaaaaa

SEQ ID NO: 187213 - RNA, 57 nt, Homo sapiens
agaaauaucuauauauacauauauuuaaaaaguuaaaauaaagaauagugacuuaug

SEQ ID NO: 187214 - RNA, 47 nt, Homo sapiens
ugaauaagauuucuaagggaauuuuauuuuacuucagacuguguuau

SEQ ID NO: 187215 - RNA, 97 nt, Homo sapiens
uguuacuuacucauuaaaauagcaagccuguuauuuccauauguggcugugaagcgauauacaaaaaucaauuuuagauguauuguagaauucagga

SEQ ID NO: 187216 - RNA, 52 nt, Homo sapiens; identical to SEQ ID NO: 118861

SEQ ID NO: 187217 - RNA, 42 nt, Homo sapiens
ugaaguagcucauuuguuuaaaaaaaacaguaggggcuagau

SEQ ID NO: 187218 - RNA, 42 nt, Homo sapiens
uacucauucaacagauuguuucucauagcccacaggauaaaa

SEQ ID NO: 187219 - RNA, 44 nt, Homo sapiens
uacuacaguaaacuggaagaguagguuggccgguauguacugag

SEQ ID NO: 187220 - RNA, 83 nt, Homo sapiens
ugcgugguuucuggucccuguaaugaaagaauauuuuuaaaaccauagacucaaauuaccauguaagauaucacagaagcaaa

SEQ ID NO: 187221 - RNA, 44 nt, Homo sapiens
cuuaagucauccugcucugaaccaucuuacauacaucagaagaa

SEQ ID NO: 187222 - RNA, 42 nt, Homo sapiens
acuuuguggaguaucuggauagaaaaauuagguuggaaaaua

SEQ ID NO: 187223 - RNA, 58 nt, Homo sapiens
gcuauaauauucaaaguaucacaggaggauagcaaacccauuaccuguaucuucuaag

SEQ ID NO: 187224 - RNA, 52 nt, Homo sapiens
acuauaggcugcaaguuguuuauuauuauuacuuuuuaagaauaacuucugu

SEQ ID NO: 187225 - RNA, 65 nt, Homo sapiens
aaaauagaaaauuauauauaugcaggguaaauaaucacauaagauagccucuguuaacaccucga

SEQ ID NO: 187226 - RNA, 49 nt, Homo sapiens
uucauuuauagcucgagucucaauuuuuucugagucccagacuaaaagu

SEQ ID NO: 187227 - RNA, 26 nt, Homo sapiens
uguacuaucaucugggcuagggugga

SEQ ID NO: 187228 - RNA, 57 nt, Homo sapiens
agagcgggugugagugagugagcugggcagauaguaagcaguauauaugagcuagua

SEQ ID NO: 187229 - RNA, 46 nt, Homo sapiens
aaaaccuuuucagggaguuacuaugagauauuuaaagcuucuucug

SEQ ID NO: 187230 - RNA, 47 nt, Homo sapiens
acuugguauaaaguaaguauuuacuguaugaaugaguuagagaauga

SEQ ID NO: 187231 - RNA, 47 nt, Homo sapiens
ugcauagaggggaauugguugcugcaauacuucguaaccgguauauu

SEQ ID NO: 187232 - RNA, 46 nt, Homo sapiens
auuaacaagagauauuuaaguaaaauuuacauuuugcuucccaaua

SEQ ID NO: 187233 - RNA, 37 nt, Homo sapiens
aagaugaaguucagucuuugccauaugagggucacca

SEQ ID NO: 187234 - RNA, 45 nt, Homo sapiens
gaaagcugaccuuucuuuuuuagucugaacaaacaagaagaggaa

SEQ ID NO: 187235 - RNA, 51 nt, Homo sapiens
aagacagucucagugucaaacauaugauaaucauuucuccauaucuggagc

SEQ ID NO: 187236 - RNA, 44 nt, Homo sapiens
gaaugguuucacuacuagaauggaugcaggagugaaaagugggg

SEQ ID NO: 187237 - RNA, 60 nt, Homo sapiens
ggcaaguccugaagucaguggauaaguuagaaaacugauagaguaauucaaacuaaagaa

SEQ ID NO: 187238 - RNA, 48 nt, Homo sapiens
gcugcagcaucggcccaugcuauuuugccagccauucggagacugcau

SEQ ID NO: 187239 - RNA, 64 nt, Homo sapiens
agacaaggauauacgggagaauuuugagaucucuuuaguugagugauauuuaguaguaagagag

SEQ ID NO: 187240 - RNA, 46 nt, Homo sapiens
uauguauagacaugaaagaggugauugagaaaaaauugccgaagga

SEQ ID NO: 187241 - RNA, 40 nt, Homo sapiens
aaagugaguugauaaaaugauuuccugugaaucuuaagua

SEQ ID NO: 187242 - RNA, 44 nt, Homo sapiens
aaaaaaaauucggccacugacuuuucagcuauuuaggguucaaa

SEQ ID NO: 187243 - RNA, 51 nt, Homo sapiens
gauaucuaaaaaaggcauguuagaaaacagauucuagagaaauaaagagaa

SEQ ID NO: 187244 - RNA, 55 nt, Homo sapiens
aaguacuuuugguaucauauagguacaguauccacgugaacauuuaugaacaagc

SEQ ID NO: 187245 - RNA, 59 nt, Homo sapiens
auguacugauugagcaggguggugacaagguggugcucccaggagccacaaaauaaagc

SEQ ID NO: 187246 - RNA, 61 nt, Homo sapiens
gagacaugauuccugaccuuccuuagccccagcgcccugcaugguuacauggggacaugag

SEQ ID NO: 187247 - RNA, 52 nt, Homo sapiens
uaaaccaaccuaugcuucuuuagcacaagagagucuuuuguggggguggggg

SEQ ID NO: 187248 - RNA, 47 nt, Homo sapiens
acucaugcaauaacuguaaauagaggacuggcugugugguucucaug

SEQ ID NO: 187249 - RNA, 47 nt, Homo sapiens
aaaggucuggacauuucuaaauucagaaacacaucuggcaccaagau

SEQ ID NO: 187250 - RNA, 42 nt, Homo sapiens
cuguuuuacuuuucacguguuugguguuccgaagugguuucu

SEQ ID NO: 187251 - RNA, 47 nt, Homo sapiens
cucauccgguuugcucauuguuguauucugagcacccagcacauggu

SEQ ID NO: 187252 - RNA, 49 nt, Homo sapiens
uagaucucccccucugaaggugaacagcagucacacacuugcccuguug

SEQ ID NO: 187253 - RNA, 48 nt, Homo sapiens
aagaaugauaucuuauuuucucauggaaauauguuuccuuuggaaggu

SEQ ID NO: 187254 - RNA, 46 nt, Homo sapiens
aggacuuggagguccugagaaagaauuuggguuugauucucagaac

SEQ ID NO: 187255 - RNA, 53 nt, Homo sapiens
acauacuucuugaauaaagaagauaggacugucaguagaagaauuucaaagcu

SEQ ID NO: 187256 - RNA, 25 nt, Homo sapiens
uuucugaugugguuuucuucuuugc

SEQ ID NO: 187257 - RNA, 23 nt, Homo sapiens
gaaaaccacaucagaaaggaugc

SEQ ID NO: 187258 - RNA, 27 nt, Homo sapiens
uaugggugggggaacugauauauccag

SEQ ID NO: 187259 - RNA, 29 nt, Homo sapiens
ggggccgccgcggcugcggcggccaccga

SEQ ID NO: 187260 - RNA, 35 nt, Homo sapiens
agccugugcccucgccuccaaccccuuuaaccugg

SEQ ID NO: 187261 - RNA, 46 nt, Homo sapiens
cccuucacccuccuccccuucaccugggcaccuguagaaacuuaag

SEQ ID NO: 187262 - RNA, 46 nt, Homo sapiens
uagggaacuuccuuaggcaaggacaggaagguauguaggaggagag

SEQ ID NO: 187263 - RNA, 45 nt, Homo sapiens
augugggagcuccagauuguccuggaugaagaaagggccacauau

SEQ ID NO: 187264 - RNA, 49 nt, Homo sapiens
auggacccagcuaaagugaagggggauggucagcagcaccacaugaaag

SEQ ID NO: 187265 - RNA, 41 nt, Homo sapiens
ucuuucauguggugcugcugaccaucccccuucacuuuagc

SEQ ID NO: 187266 - RNA, 110 nt, Homo sapiens
aagaggaggagaagugggaugcuaccucuccaaaagcugcuuccagcaagacuggaaaaugccaggaaaagaaaaggaaacauugccagauugaaucccaagaagaaacg

SEQ ID NO: 187267 - RNA, 46 nt, Homo sapiens
augccagagcugggccccacacccagagccuaaggagcccccagac

SEQ ID NO: 187268 - RNA, 38 nt, Homo sapiens
gaaagccaaggcaucaggucaagcacaguaucaacuaa

SEQ ID NO: 187269 - RNA, 50 nt, Homo sapiens
guguccacuaaaucaacucucugggaggugguggugagaguggcaaacug

SEQ ID NO: 187270 - RNA, 45 nt, Homo sapiens
uuuagcagauucacaaaugugucuguuuuccaaaagagcauuaaa

SEQ ID NO: 187271 - RNA, 51 nt, Homo sapiens
guuuguuaucaggucugccaaagcuuaugagaaaaucuggcaccuaaaauu

SEQ ID NO: 187272 - RNA, 45 nt, Homo sapiens
ucuucuaccuuggcuuugccagaacccaccugccauucuaucaug

SEQ ID NO: 187273 - RNA, 24 nt, Homo sapiens
cauuaucuaguugcagccuuggag

SEQ ID NO: 187274 - RNA, 56 nt, Homo sapiens
aguaucuacacacuguccagcacuugacuaaggggcauuucacaucaagcaaagga

SEQ ID NO: 187275 - RNA, 50 nt, Homo sapiens
ccuucaguggcaggacagccuguaaaguaccacaaguaugggaguguuau

SEQ ID NO: 187276 - RNA, 36 nt, Homo sapiens
ucauucacagcccaucacucuguuaaggugagagug

SEQ ID NO: 187277 - RNA, 54 nt, Homo sapiens
auguugccagaguguuguguuuaucagauuugauguuuggagcuagucugggca

SEQ ID NO: 187278 - RNA, 43 nt, Homo sapiens
uaggcggaaguauaggcauuauuucugcgcaagcaaacuccac

SEQ ID NO: 187279 - RNA, 68 nt, Homo sapiens
aggccagaaaaauaagacuucccccacaguagauagugccacuuauuuaguuaguuuuucugucuauc

SEQ ID NO: 187280 - RNA, 26 nt, Homo sapiens
gcuuuguacuguacuacugcugcuag

SEQ ID NO: 187281 - RNA, 78 nt, Homo sapiens
gacuggcgccgacccaagcgaucuggagagcggcgggcugcugcaugagauuuucacgucgccgcucaaccugcugcu

SEQ ID NO: 187282 - RNA, 42 nt, Homo sapiens
gcacgaucuuguagagcaggaagaugcagaggccaagcagca

SEQ ID NO: 187283 - RNA, 86 nt, Homo sapiens
gcuuggccucugcaucuuccugcucuacaagaucgugcgcggggaccagccggcggccagcggcgacagcgacgacgacgagccgc

SEQ ID NO: 187284 - RNA, 60 nt, Homo sapiens
agcggcgcgacuucacccccgccgagcugcggcgcuucgacggcguccaggacccgcgca

SEQ ID NO: 187285 - RNA, 51 nt, Homo sapiens
aagacgggaaggccaaugacaccgggaguagguuugaaauaugagggugug

SEQ ID NO: 187286 - RNA, 27 nt, Homo sapiens
agcuuugugcccgguggauagugaugu

SEQ ID NO: 187287 - RNA, 53 nt, Homo sapiens
gcagauggggaaaggcuggaaggugaacaaggaggaagggggcuguuugaggg

SEQ ID NO: 187288 - RNA, 53 nt, Homo sapiens
uggcaagcuuuuaagguaauaugguauuuagucuauagcaggagagaaaggau

SEQ ID NO: 187289 - RNA, 36 nt, Homo sapiens
gccagagcugcaaaugagucucgggugguccgggag

SEQ ID NO: 187290 - RNA, 46 nt, Homo sapiens
uagaggauguccacauggacggugcucauuccacacuggccugaga

SEQ ID NO: 187291 - RNA, 31 nt, Homo sapiens
gacuguaguuugcagagucauugagaggaug

SEQ ID NO: 187292 - RNA, 41 nt, Homo sapiens
ccaaaaaacagauaaugaagacugaucucuguguuaucuau

SEQ ID NO: 187293 - RNA, 25 nt, Homo sapiens
uggcaaggccccuggaugcaucucu

SEQ ID NO: 187294 - RNA, 47 nt, Homo sapiens
gaugcauccaggggccuugccacauuuugccuggauaaggaagcacu

SEQ ID NO: 187295 - RNA, 46 nt, Homo sapiens
ugagacucccagucacucagagucuccugcugggcagcagugaggu

SEQ ID NO: 187296 - RNA, 45 nt, Homo sapiens
ugggagucucaguucacuuguaagcauuuuuaaaauugugucugg

SEQ ID NO: 187297 - RNA, 39 nt, Homo sapiens
ugccucuagacuuggaaguuauauguagccugcuugaga

SEQ ID NO: 187298 - RNA, 47 nt, Homo sapiens
uuaaguguagcugaggugucacaacagcaucuggggcuagccuuaaa

SEQ ID NO: 187299 - RNA, 49 nt, Homo sapiens
acagagaaaaaccuaugggugguuaaaggaagugguaaaggagccagga

SEQ ID NO: 187300 - RNA, 110 nt, Homo sapiens
gugaagucaggauuggcaagaaaaaaaaaaaagguuucccugaaaaucuuucagaaagagaguucaauccaauuguggggauagaagccauauuguagggaggaagaagg

SEQ ID NO: 187301 - RNA, 46 nt, Homo sapiens
gcaaagggcacugaagguuuauaagcgaaggaaugacacaguaaaa

SEQ ID NO: 187302 - RNA, 49 nt, Homo sapiens
aaugaagagaccaaguuggcaggaguagaguuaacauuuagaaguuagu

SEQ ID NO: 187303 - RNA, 43 nt, Homo sapiens
uaucuccuacuaacuucuaaauguuaacucuacuccugccaac

SEQ ID NO: 187304 - RNA, 70 nt, Homo sapiens
ggcaaacugcugaaggagggggaggagcccacuguguacucagaugaggaagaaccaaaagaugagagug

SEQ ID NO: 187305 - RNA, 44 nt, Homo sapiens
uaacuucuuagaaugcaugauguguuugugugucacaaauccag

SEQ ID NO: 187306 - RNA, 46 nt, Homo sapiens
aucuguaguuaguacaggaugaauuuaaauguguuuuuccugagag

SEQ ID NO: 187307 - RNA, 46 nt, Homo sapiens
augauuuuaccucaaaucagaaaacaaaaugaugugcuuuggucag

SEQ ID NO: 187308 - RNA, 45 nt, Homo sapiens
cuuaucuaugaaaaagcaaagcacuaucacaaggaauauaggcag

SEQ ID NO: 187309 - RNA, 70 nt, Homo sapiens
cuucgucaaaucuucaauggaaccuuugugaagcucaacaaggcuucgauuaacaugcugaggauuguag

SEQ ID NO: 187310 - RNA, 48 nt, Homo sapiens
auugcucgaucucuugguaaauacggcaucaucugcguggaggauuug

SEQ ID NO: 187311 - RNA, 46 nt, Homo sapiens
ugaagaaaaagaccacccauuuuguagaagguggagaugcuggcaa

SEQ ID NO: 187312 - RNA, 49 nt, Homo sapiens
augggcgcuaccgccgucuuggagauggcugcggccacuccaccugcca

SEQ ID NO: 187313 - RNA, 45 nt, Homo sapiens
gcuuaucugcagugaucugcuugcuggcaugcugcaccuaacaga

SEQ ID NO: 187314 - RNA, 46 nt, Homo sapiens
guacgggcaaaaucaagaggguacacaaaacacagggauguggccc

SEQ ID NO: 187315 - RNA, 46 nt, Homo sapiens
aaacuuacccuuugcagugucauagauaccgaaguaggcggcucgg

SEQ ID NO: 187316 - RNA, 38 nt, Homo sapiens
uaaaauaauagaugccuggauaggcauagcuuaucucu

SEQ ID NO: 187317 - RNA, 47 nt, Homo sapiens
cucugcaacacagggauugggaauugaucggggcgagggggcacaca

SEQ ID NO: 187318 - RNA, 49 nt, Homo sapiens
gaugccuuuuuuuuucucccagucuaugagaaaagucaccucugucccc

SEQ ID NO: 187319 - RNA, 45 nt, Homo sapiens
cauccggcuaguagaaaccuuuguguguuuguacgugucgggcag

SEQ ID NO: 187320 - RNA, 45 nt, Homo sapiens
ccugcccgacacguacaaacacacaaagguuucuacuagccggau

SEQ ID NO: 187321 - RNA, 62 nt, Homo sapiens
ggguggguggccucuuuuugccugggaagggguggaagagagccagggacacuugcauugac

SEQ ID NO: 187322 - RNA, 48 nt, Homo sapiens
uuaugucuuuuucuacguaagcagauugaggaucagaaaguuaaagcg

SEQ ID NO: 187323 - RNA, 35 nt, Homo sapiens
augugagaacacaagaacauaaaaugccacccugu

SEQ ID NO: 187324 - RNA, 41 nt, Homo sapiens
ucaggggauacaagagauucaacgccuggcacauaguaagu

SEQ ID NO: 187325 - RNA, 39 nt, Homo sapiens
agacagcaggagaaaaggaaacgagguuugacgggagac

SEQ ID NO: 187326 - RNA, 61 nt, Homo sapiens
uugaagccaacagcgugaacuucagccucacaccaacugggcugcagauucaacucaaaug

SEQ ID NO: 187327 - RNA, 38 nt, Homo sapiens
aaccaaucuuucugaugaaaagggggcuagcugggguu

SEQ ID NO: 187328 - RNA, 32 nt, Homo sapiens
ccuguuuggccucuuugauccugaacccaaga

SEQ ID NO: 187329 - RNA, 43 nt, Homo sapiens
caaaauccucugagaaaaugacauuuucucagacaaaaucaag

SEQ ID NO: 187330 - RNA, 79 nt, Homo sapiens
aggucacaaucauguuaccauaucaagcugaaaaugucaccacuaucuggacaguuggacauguuuuuuugggaauaua

SEQ ID NO: 187331 - RNA, 36 nt, Homo sapiens
agaagacauggagagaggcggagccaaacacacacu

SEQ ID NO: 187332 - RNA, 44 nt, Homo sapiens
uugguccauggagggagugacuaucuagugggagccacagaaga

SEQ ID NO: 187333 - RNA, 28 nt, Homo sapiens
gaucaaggaccacccagcagaagcagga

SEQ ID NO: 187334 - RNA, 40 nt, Homo sapiens
guguuuuggagguuuuccuaugaggacugggugauagauu

SEQ ID NO: 187335 - RNA, 51 nt, Homo sapiens
auaacaugauauguuaguauuuaguuucucuauuuucuuuauuaacuugua

SEQ ID NO: 187336 - RNA, 31 nt, Homo sapiens
uaaagugcaaagucaagacaguugcauagag

SEQ ID NO: 187337 - RNA, 66 nt, Homo sapiens
agaaaccauaaccuuacaguuccuuaaccucaacuccagacagugaccuuuaccuuuccugcacuu

SEQ ID NO: 187338 - RNA, 42 nt, Homo sapiens
ugagcuagcaagaacugggaaaaagaggggugggggucccag

SEQ ID NO: 187339 - RNA, 39 nt, Homo sapiens
auuggcugugguuugaaucuuucuacugucagaggagac

SEQ ID NO: 187340 - RNA, 36 nt, Homo sapiens
uuuuuggacaaaauauuauggugugucauaggaaaa

SEQ ID NO: 187341 - RNA, 38 nt, Homo sapiens
ugaauuuuucuguauuuagguuuucuguacuauuuuuu

SEQ ID NO: 187342 - RNA, 47 nt, Homo sapiens
auaaccaggccuuuuucuaagcccuagacuagaggcaagcauuuaga

SEQ ID NO: 187343 - RNA, 51 nt, Homo sapiens
uaaugauuugggaaccaugauucuaguuuguacacuaaaugaacauuaagg

SEQ ID NO: 187344 - RNA, 45 nt, Homo sapiens
guuuuucaaucacuuuggcauucugugcauaugagucagcaacuu

SEQ ID NO: 187345 - RNA, 46 nt, Homo sapiens
caugggcaaguucaguucugucaccgugucuaccauugaugaagag

SEQ ID NO: 187346 - RNA, 45 nt, Homo sapiens
cugcuccauccacaaugaagguaacaggagcauucuuuggcuggg

SEQ ID NO: 187347 - RNA, 44 nt, Homo sapiens
accugaaggcauugaacgacaguacaggaagaaaugugcaaagu

SEQ ID NO: 187348 - RNA, 31 nt, Homo sapiens
ugaaccaaugaguugaccuaugaaaugaaaa

SEQ ID NO: 187349 - RNA, 46 nt, Homo sapiens
agauguguaacuuuacuccuaaaaaaagaaauucaaauuaaaagau

SEQ ID NO: 187350 - RNA, 40 nt, Homo sapiens
aagacaaaugacaaacuagagaauaaacaaggccccuuaa

SEQ ID NO: 187351 - RNA, 41 nt, Homo sapiens
aauacuggucuucugaacgaaaggaaaaacaggugggagug

SEQ ID NO: 187352 - RNA, 40 nt, Homo sapiens
auaucacaucuauuguugaacaggucaguuggucccaaua

SEQ ID NO: 187353 - RNA, 50 nt, Homo sapiens
agaaauugcccaugaggccccgggaccggucccgugugauugaugcugcc

SEQ ID NO: 187354 - RNA, 66 nt, Homo sapiens
uacuguuugugcggccagaugguccuagugcugggugaguagccgggaacugcgggggcgucugca

SEQ ID NO: 187355 - RNA, 46 nt, Homo sapiens
cuucucgccgucgucauauuccucccggucccgagugucagagcag

SEQ ID NO: 187356 - RNA, 57 nt, Homo sapiens
ucugacacucgggaccgggaggaauaugacgacggcgagaagccccuccauguuuac

SEQ ID NO: 187357 - RNA, 41 nt, Homo sapiens
uaacugauauguuggaguuaaugggagauagaaauccuuga

SEQ ID NO: 187358 - RNA, 115 nt, Homo sapiens
ugucugaaggucacgaucauguuaccauaucaagcugaaaaugucaccacuaucuggagauuucgacguguuuuccucucugaaucuguuaugaacacguugguuggcuggauuc

SEQ ID NO: 187359 - RNA, 73 nt, Homo sapiens
aaaaggagacauuggagaagaaccaagcugggucuauaaggaauugcacaugagauggcacacauauuuaugc

SEQ ID NO: 187360 - RNA, 42 nt, Homo sapiens; identical to SEQ ID NO: 132537

SEQ ID NO: 187361 - RNA, 55 nt, Homo sapiens
ugcccccagagaaguugugagggucagagacuugcuuggcuugauggcuuagcau

SEQ ID NO: 187362 - RNA, 45 nt, Homo sapiens
cuagccauucccaguguggucgucugaguccuugggggaccacag

SEQ ID NO: 187363 - RNA, 87 nt, Homo sapiens
guggaggguaaucaggaggguauugugggcuacugguuuucgaaaaggguuuagcuuggcguggagaagcgaaccgcauuuuuagau

SEQ ID NO: 187364 - RNA, 33 nt, Homo sapiens
cuaauuccuuauggacuuaagcaggugacuuuu

SEQ ID NO: 187365 - RNA, 42 nt, Homo sapiens
uggcuacugcguacauccacagguucacuaacgggggcaagg

SEQ ID NO: 187366 - RNA, 47 nt, Homo sapiens
aaggacccagaaguaggguuuuggccuagguaacggggcagagaugu

SEQ ID NO: 187367 - RNA, 45 nt, Homo sapiens
ggcagccacggcuguuucggagcucaggacucuaaaauggcagag

SEQ ID NO: 187368 - RNA, 49 nt, Homo sapiens
auaugcauggauguaagugaagucgaaguggaagccaguaagccugaug

SEQ ID NO: 187369 - RNA, 38 nt, Homo sapiens
aggauaagaagaagaguccgaacccgagcagggagcag

SEQ ID NO: 187370 - RNA, 41 nt, Homo sapiens
ccagucugagcacuauugacuauuuuuuucagacucugaau

SEQ ID NO: 187371 - RNA, 45 nt, Homo sapiens
gcuuccuuauaauuguugucuuuaucucuuauaugauuggaagaa

SEQ ID NO: 187372 - RNA, 52 nt, Homo sapiens
guguaucagaugcuuuagaaauguaauuguauuuaauccucaaauaccuuau

SEQ ID NO: 187373 - RNA, 47 nt, Homo sapiens
uguaaagagaagcuguuggcauuaaaaugagcuagauaaucagcccu

SEQ ID NO: 187374 - RNA, 117 nt, Homo sapiens
uuaguauugaaagauagaaauauucuaugaacuaauuaggacagauuguguuguguuucucuaccucaucuuguugaucucuggagcauuaaaaucuauuuaguguugucaucagug

SEQ ID NO: 187375 - RNA, 37 nt, Homo sapiens
guuuuuaagauaauuguuuguuuuucagcaauauaga

SEQ ID NO: 187376 - RNA, 43 nt, Homo sapiens
ucuaguguugcuggcuuauuuuauuggucucaagcaccaucau

SEQ ID NO: 187377 - RNA, 33 nt, Homo sapiens
gagagagagagagagagugugugugugugugug

SEQ ID NO: 187378 - RNA, 50 nt, Homo sapiens
uugucaaauuaccguguaccaccuaauguuuauaggagaaagcaaaauac

SEQ ID NO: 187379 - RNA, 72 nt, Homo sapiens
uauucauuaugguagaaucauuuuuaauucacgugcuuuguguucaguuuuguggucugagagauguaccaa

SEQ ID NO: 187380 - RNA, 75 nt, Homo sapiens
guugauagugauguauuuuauuauuuucuuuuucuuaagaaaugccaguguguccuagaaccuagauaacgaagu

SEQ ID NO: 187381 - RNA, 48 nt, Homo sapiens
gcuugccagugccaauugagggcauuaguacuuugugcucauaaauug

SEQ ID NO: 187382 - RNA, 42 nt, Homo sapiens
cuuuuaaauugcaauauauaagacuauuccaacugggcauuu

SEQ ID NO: 187383 - RNA, 45 nt, Homo sapiens
auaguagauuugaacaggggcugguauuauuauguucuuagcaau

SEQ ID NO: 187384 - RNA, 69 nt, Homo sapiens
ugugcucuuucucuuacuuugaaacuuugguuuuuauguacauagaauuaaaaauaucacccaaagaga

SEQ ID NO: 187385 - RNA, 35 nt, Homo sapiens
gugcaacaaagagcagacuguuucagugucuggag

SEQ ID NO: 187386 - RNA, 49 nt, Homo sapiens
aaaccgauuuuaucugaaggaagugaacaucagcauguauuugguuaau

SEQ ID NO: 187387 - RNA, 45 nt, Homo sapiens
uugcucucucaaauaccccuuuucccacuuguuuccuaagagaau

SEQ ID NO: 187388 - RNA, 39 nt, Homo sapiens
guuauauguuuagugaaaauguggaaaagucauugggac

SEQ ID NO: 187389 - RNA, 50 nt, Homo sapiens
ugagcugggccuucaaggaugggucugauuuguauugguagggagauaag

SEQ ID NO: 187390 - RNA, 45 nt, Homo sapiens
caaccccaauacaacucacuccacaggcagcugccguucucacac

SEQ ID NO: 187391 - RNA, 40 nt, Homo sapiens
ugccaucuccuacuacaacaccuacuccaaaggaaaaacc

SEQ ID NO: 187392 - RNA, 42 nt, Homo sapiens
gaaugauguuguccaacacuacugggauguucuuguacaagc

SEQ ID NO: 187393 - RNA, 31 nt, Homo sapiens
uaguugccuagaccuggggauuaauaacuca

SEQ ID NO: 187394 - RNA, 55 nt, Homo sapiens
guaaccauuucagaccauggcacugugacauauaauggaagcauuuguggggaug

SEQ ID NO: 187395 - RNA, 45 nt, Homo sapiens
cauugguucuugggaguuuuuguaggacuugauuaagggcaaaug

SEQ ID NO: 187396 - RNA, 50 nt, Homo sapiens
cuuaauuugacagauucagaaaaugccacuugccuuuaugcaaaauggca

SEQ ID NO: 187397 - RNA, 46 nt, Homo sapiens
auuuucugucauaauuuagguguggggugauagauugggaguagaa

SEQ ID NO: 187398 - RNA, 46 nt, Homo sapiens
cacacuggaaacuaaaugcccauuaaagguagcauagauaaguagu

SEQ ID NO: 187399 - RNA, 47 nt, Homo sapiens
acugcuccuugagggcuuuuauagucagggaaagcuuuguggagaaa

SEQ ID NO: 187400 - RNA, 55 nt, Homo sapiens
uuacuuacuguauacuauaauuuaccauggcacaccaguuuguuaugaagugaca

SEQ ID NO: 187401 - RNA, 55 nt, Homo sapiens
gacaaaaaaauccccagacguuucaguuaggagggccucccagaugugagguuuu

SEQ ID NO: 187402 - RNA, 101 nt, Homo sapiens
aagggcgaaggaaccuaagguagcuggggcaauuuccaggaaagaaaacuuggacccaaccucuggagacuaagggguucagggggaacuuugauggggag

SEQ ID NO: 187403 - RNA, 71 nt, Homo sapiens
agccugaggggcaggggcagugacaggguugggcauuuugaagguuggaauuugagacugugaagaaagga

SEQ ID NO: 187404 - RNA, 111 nt, Homo sapiens
agaguuuugaagaugguggaaaaacuauggggugagauaggaaauuaagagagaagaccaugccugccuggaguagcuugggagaagugugugggugggggacagauggga

SEQ ID NO: 187405 - RNA, 37 nt, Homo sapiens
aggggccgguaacgggggguggacgccgagggaguag

SEQ ID NO: 187406 - RNA, 47 nt, Homo sapiens
gaaggacauucaaaccccaaagcagcagccaauggcauauaacugua

SEQ ID NO: 187407 - RNA, 44 nt, Homo sapiens
ggacugaaauauugguggguuuugaugcccagugaaaccuggga

SEQ ID NO: 187408 - RNA, 54 nt, Homo sapiens
uuacaugauuuacaacuuaauauuacuguauauauaaccugacacacaaugagg

SEQ ID NO: 187409 - RNA, 48 nt, Homo sapiens
aucaaaacauaauuguuuuaauucuacagcuguaggagcuuuguauug

SEQ ID NO: 187410 - RNA, 40 nt, Homo sapiens
gaauguuuuacuuguugcuccauuuuuuucucccuacccc

SEQ ID NO: 187411 - RNA, 41 nt, Homo sapiens
guauaaauguuaauaagaagaaaaauacugcuuugcugaaa

SEQ ID NO: 187412 - RNA, 47 nt, Homo sapiens
accaauacagcuuauagcaccaauaggugucugugauggagaacagc

SEQ ID NO: 187413 - RNA, 47 nt, Homo sapiens
aucuacuacauuccuauucuaauccuccauuccaagaaggccaaaua

SEQ ID NO: 187414 - RNA, 45 nt, Homo sapiens
ugcugcccucccccacucaccuuuuauuuucuauucuauagaaag

SEQ ID NO: 187415 - RNA, 64 nt, Homo sapiens
ugcacugaccaugaauuuguauuuuaccccucuguguaaucucuuaggaacaaagggaugacaa

SEQ ID NO: 187416 - RNA, 49 nt, Homo sapiens
aguguucucucaccaccuuuucacuuaaugauagaaacauaaaaugagu

SEQ ID NO: 187417 - RNA, 46 nt, Homo sapiens
auaaagaaaagauagaaaagaaagagaaacgggacaguucaggagg

SEQ ID NO: 187418 - RNA, 90 nt, Homo sapiens
ucaaaacauaaaagugaaaguccuugugaaucuccuuauccaaaugagaaagacaaggaaaaaaauaagucaaaaucuucaggcaaagaa

SEQ ID NO: 187419 - RNA, 45 nt, Homo sapiens
aacaacgaccgugaagugccaccggacuuaaccaagagacguaaa

SEQ ID NO: 187420 - RNA, 56 nt, Homo sapiens; identical to SEQ ID NO: 119210

SEQ ID NO: 187421 - RNA, 49 nt, Homo sapiens
cuccuuuagugugcuugccuugguuuuuaaaaauuacagugauucaagu

SEQ ID NO: 187422 - RNA, 49 nt, Homo sapiens
agcaaagguuugagucuuuuaaaaucaucaugccuaaguaaaccaaaug

SEQ ID NO: 187423 - RNA, 49 nt, Homo sapiens
uauuuuguuuucuuguuaauacaaugccacugaauuuuucagcuaggau

SEQ ID NO: 187424 - RNA, 44 nt, Homo sapiens
uucaaggacuuagcacuaauuuuguaguguuucaaagugcaaga

SEQ ID NO: 187425 - RNA, 45 nt, Homo sapiens; identical to SEQ ID NO: 119215

SEQ ID NO: 187426 - RNA, 45 nt, Homo sapiens
gguccuugaaaucaccuguucccagaucagauauuccagagccug

SEQ ID NO: 187427 - RNA, 49 nt, Homo sapiens
accacuguccccaacgcagaaucaaaaucaacucaagaaagggaaagag

SEQ ID NO: 187428 - RNA, 50 nt, Homo sapiens
uacuacuccagaggccaggguacuugguaaagaugguaaagaaaaaccaa

SEQ ID NO: 187429 - RNA, 46 nt, Homo sapiens
aagcaacaaagcuguuaaagaaaaugacaaagaaaaagggaaagag

SEQ ID NO: 187430 - RNA, 45 nt, Homo sapiens
aauaaagcuucuaguaccacaccuaaagggaauucaagcaaugga

SEQ ID NO: 187431 - RNA, 49 nt, Homo sapiens
acuuauuaaaaauugguauuuuuuaauucucuagaaccacauaguagaa

SEQ ID NO: 187432 - RNA, 54 nt, Homo sapiens
cuucaggagauuaugggagauuaugcgaucauguuuccacaggcuggugagagu

SEQ ID NO: 187433 - RNA, 51 nt, Homo sapiens
ggaaagaagaguacacaaaaucugccaagaagaaaaagagaagaggccaga

SEQ ID NO: 187434 - RNA, 45 nt, Homo sapiens
uacugcccuucaggacaagcuucuugaagaagaaaagaaacagau

SEQ ID NO: 187435 - RNA, 58 nt, Homo sapiens
aaagguaaugugcauauaguuagaaaagugucuaauugaauucuuuguagcccccaaa

SEQ ID NO: 187436 - RNA, 47 nt, Homo sapiens
ggauaguaauguaaaaaaugguacuuaaaaaagauuacucaugacag

SEQ ID NO: 187437 - RNA, 46 nt, Homo sapiens
aguuaugauggggccagauuauguaggcauuggaagucagggagaa

SEQ ID NO: 187438 - RNA, 54 nt, Homo sapiens
cauugacaauguaugaccuugcaguuccacacaccagcuaugaacgagaaguca

SEQ ID NO: 187439 - RNA, 46 nt, Homo sapiens
gucugcuuauggcucagcagagaaaugggguaaucuuucaggaagg

SEQ ID NO: 187440 - RNA, 47 nt, Homo sapiens
gguaaauuugugucuucccuugugcagggugguuauuuuggucagau

SEQ ID NO: 187441 - RNA, 83 nt, Homo sapiens
aagaagugguacaaaaaauggcaggaauagaaauuacagaggaaaugacaauggagcaacuagaggcuaugacugguggagag

SEQ ID NO: 187442 - RNA, 63 nt, Homo sapiens
ugguuuuagcucauuuugacuaccaaguuaauguuuucauaguuguuguguuuacauauggau

SEQ ID NO: 187443 - RNA, 45 nt, Homo sapiens
auauacuuucuuucagguagcuugucugagccucaguuuugggaa

SEQ ID NO: 187444 - RNA, 41 nt, Homo sapiens
aguuucagucugauggaagcaaacaagaagauaaagaaaaa

SEQ ID NO: 187445 - RNA, 44 nt, Homo sapiens
uuuuauuacuuuauuuuauauuuauuuuauucugcaaagcuuuc

SEQ ID NO: 187446 - RNA, 21 nt, Homo sapiens
uaagauuuuuauugaaauaaa

SEQ ID NO: 187447 - RNA, 427 nt, Homo sapiens
caguguguccuaaccauaugcagucaaguguugcuuaaugacaggugagaaaugcaucauuaggugauucgucauugugcaaacaucagagaguguacuuauacaagccuagaugguaugaccuacuacauaccuagacuauaugguauggcccguuacuccuaggcuacaaaccuguacagaauguucccguacugaauacuguggggaguuguaauacacuguuaaauauuuguguaucugaacauaucuaaacauuuaaaagguaauaccuugcacuaagauguuaggacagccaugauaucacuaggcaauaggaauuuuuuagcucuaauauaauguuauaugacccuggucauauaugugguccaucaaccgaaacauuguuaaauggugcauaacuguauauauuaauauaaacccaaau

SEQ ID NO: 187448 - RNA, 24 nt, Homo sapiens
uugguccucaccuuucucacgauc

SEQ ID NO: 187449 - RNA, 45 nt, Homo sapiens
guuaaugcuuugcaaaacaagagagcaccaaaacaagcugagagc

SEQ ID NO: 187450 - RNA, 36 nt, Homo sapiens
uucugaaaaaauggaugagcgagagaaagaaaagga

SEQ ID NO: 187451 - RNA, 44 nt, Homo sapiens
agcauuaugcuggagagaccugggguggcuaugcuaauaucaaa

SEQ ID NO: 187452 - RNA, 76 nt, Homo sapiens
cagguuggcugaaauuuaacuugugcaugauuaauuaaaauuuaaauuagggcuuuggagacuguggguuugagag

SEQ ID NO: 187453 - RNA, 46 nt, Homo sapiens; identical to SEQ ID NO: 119256

SEQ ID NO: 187454 - RNA, 53 nt, Homo sapiens
ccaguugcuuuuuccugcauuucuucaaagauguaucauucaaaaggugugaa

SEQ ID NO: 187455 - RNA, 29 nt, Homo sapiens
agaucauacuuuuauuuuguuauucauug

SEQ ID NO: 187456 - RNA, 46 nt, Homo sapiens
caagucauagacaccauacaaguggccauagcuugaagauggcaaa

SEQ ID NO: 187457 - RNA, 43 nt, Homo sapiens
gaaugaagguuaugccaagcugauugcugaauuggggcaagau

SEQ ID NO: 187458 - RNA, 46 nt, Homo sapiens
auggggccucugggcugggguagguaauuggugaugcugggcacua

SEQ ID NO: 187459 - RNA, 25 nt, Homo sapiens
gugguuugccauuuaaauuggaaaa

SEQ ID NO: 187460 - RNA, 986 nt, Homo sapiens
caugacuuucauaauagaggauauacuuuuuuuuuuuuuuuuuuuuuuuuaaaguagacagggucucuuuccauugcccaggcuguaaugcaguggugguguaaucauagcucacugcggcuucaaacuccugggcucaagcaauccugccacuucagauucccaaguagcugggacugcaagugugcaacacugcuccuugcuuauuuauuuauuuauuuauuugagauggaguuucacucuuguugcccaggcuggagugcauuggugcaaucucagcucacuguaaccucugccucccggguucaaacgauucuccugccucagcuucccaaguagcugggauuacaggcaugugacaccaugccuggcuaauuuuguauuuuuaguagagacgggguuucaccauguuggucaggcuggucuugaacuccugaccucaggugaucugccugccuuggccucccaaagugcugguauuacaggugugagccacugugcccagccuuauuuuuuuaauuuauuuuuuguagagaugaggugucuugcuauauugccuaggcuggucucauauucuugaccucaagcaguccuuucgccucaggcucccaaauuguugggauuacugucaugagccaccuugcauagcugaggauauacuuuuuaaagaacauuugggccaggugcgguggcucacgccuguaauccuagcacuuucggaggcugagguggguggaucacuugaggucuggaguucgagaccagccuggcuaauauggugaaacuccaucucuaccaaaaaaaaaacaaaaacaaaaaaaaauuagcugcgugugguggcgugugccuauaaucccagcuacucaggaggcugagguacgagaaucgcuugaacccgggaggcagaggcuguagugagccaagaucacaccacugcacuccagccugggugacagagugaaccuuguuucauaaaaagaacauuu

SEQ ID NO: 187461 - RNA, 46 nt, Homo sapiens
ugucaugggaaacauucaaaggaguuguuuacugcauaucacagau

SEQ ID NO: 187462 - RNA, 55 nt, Homo sapiens
uaguuuaagcuugugacucuguuuccuuuuuacuggaaaaugggaacaaguaaga

SEQ ID NO: 187463 - RNA, 44 nt, Homo sapiens; identical to SEQ ID NO: 119280

SEQ ID NO: 187464 - RNA, 54 nt, Homo sapiens
gcggcaagggcggcaguggcggugcagaccuaggcgagagcgggaagagugucu

SEQ ID NO: 187465 - RNA, 42 nt, Homo sapiens
cgcgcgggguggaggcuggaagggggcggaggggagaagggg

SEQ ID NO: 187466 - RNA, 53 nt, Homo sapiens
uaauuuguacuccuccaagcagagagagugagugguccuuuggucaaugaaaa

SEQ ID NO: 187467 - RNA, 60 nt, Homo sapiens
gaacuucuugguucucuuuuugacgaucuugggcuucacaaggggucugagggcggccau

SEQ ID NO: 187468 - RNA, 32 nt, Homo sapiens
cuggcaaggaacuaacuccuuuaacacuaaaa

SEQ ID NO: 187469 - RNA, 42 nt, Homo sapiens
acugaaaaggguggagguggggguucccgaugaaucccagua

SEQ ID NO: 187470 - RNA, 46 nt, Homo sapiens
ucacaguucagccaagguucuaacccgcuaucuggagacuggccau

SEQ ID NO: 187471 - RNA, 46 nt, Homo sapiens
cacugauccuuucuggcaaauauaagaagcaucaucccaacaaggc

SEQ ID NO: 187472 - RNA, 25 nt, Homo sapiens
augcaaaaggugguguugugaaaua

SEQ ID NO: 187473 - RNA, 47 nt, Homo sapiens
ggauucuaaagucuuuuaaggauugagagcuacuggugcuagaagaa

SEQ ID NO: 187474 - RNA, 40 nt, Homo sapiens
ugguuagaaaacagaaaguuaaaccaaggggaugggaguc

SEQ ID NO: 187475 - RNA, 61 nt, Homo sapiens
aauacuucaggcuugauggaaguucuaaucuuaaggugcuaaaacucguaagccuuaaggu

SEQ ID NO: 187476 - RNA, 44 nt, Homo sapiens
ccuuucaauuuagucccaagaaauaucucuuuugggggcgaaug

SEQ ID NO: 187477 - RNA, 46 nt, Homo sapiens
uuguauucagagaauuuuaagaguucucgaaggaaugccaucaagu

SEQ ID NO: 187478 - RNA, 40 nt, Homo sapiens
cuacaagacgagagaaagacaagcggaaacuucugucaga

SEQ ID NO: 187479 - RNA, 42 nt, Homo sapiens
uccuuguguaaaauuugaauaauaacaggaaaaggauagugg

SEQ ID NO: 187480 - RNA, 43 nt, Homo sapiens
agucaguccugcugaggaaggaggugacaucugcccuugguau

SEQ ID NO: 187481 - RNA, 25 nt, Homo sapiens
gcagcauggcugaccaacugacuga

SEQ ID NO: 187482 - RNA, 42 nt, Homo sapiens
cuucugugggauucugccugagaccucauuacaguuccuagu

SEQ ID NO: 187483 - RNA, 46 nt, Homo sapiens
uaauggcacaauugacuucccugaauuucugacaaugauggcaaga

SEQ ID NO: 187484 - RNA, 67 nt, Homo sapiens
cuucaccaugugaugacaaaccuuggagugaaguuaacagaugaagaaguugauuaaaugaucaggg

SEQ ID NO: 187485 - RNA, 42 nt, Homo sapiens
uaagcccuucugcacaucuaaacuuagguggaguuggucaaa

SEQ ID NO: 187486 - RNA, 41 nt, Homo sapiens
uccuuuccccugggggucauggguguccccaugcccacaua

SEQ ID NO: 187487 - RNA, 54 nt, Homo sapiens
gugucuccugccucaucggccugccaugaccugcagccaagcccagccccgugg

SEQ ID NO: 187488 - RNA, 54 nt, Homo sapiens
uccagguccccuccgcccuagucccugccugucucaucuaacgccccaaaccuu

SEQ ID NO: 187489 - RNA, 25 nt, Homo sapiens
uggcugccucuuccccagcaccauc

SEQ ID NO: 187490 - RNA, 37 nt, Homo sapiens
ggacucacaaaaaccaaggagccaaggaaggaacaga

SEQ ID NO: 187491 - RNA, 45 nt, Homo sapiens
ggacuaacgccaggaccauggcuggagucacagggaggugggagc

SEQ ID NO: 187492 - RNA, 41 nt, Homo sapiens
uccuuaauaaaucuuccauguuuaagauguuggccugaaga

SEQ ID NO: 187493 - RNA, 45 nt, Homo sapiens
uucucaauaagaauuuaugagaugccagcggcauagcccuucaca

SEQ ID NO: 187494 - RNA, 74 nt, Homo sapiens
guaccuuccacuuguuguauuuauuaguguagcuucuccuuugucucccauccacucugacaccuaagccccac

SEQ ID NO: 187495 - RNA, 50 nt, Homo sapiens
uuuaauuagggcuaugagagauuucaggugagaaguuaaaccugagacag

SEQ ID NO: 187496 - RNA, 40 nt, Homo sapiens
uaggggcaaagacagaggucaggggauuguauuagaguua

SEQ ID NO: 187497 - RNA, 44 nt, Homo sapiens
uguggaagagaaaggagagggcuuuguugaaugcuuguggagca

SEQ ID NO: 187498 - RNA, 45 nt, Homo sapiens
gaacauauccuccgcuggcaguaugucccugugaagccuucuuaa

SEQ ID NO: 187499 - RNA, 60 nt, Homo sapiens
cucuucacccuugcccgagugagagcuuagcucuugccaguguguaacacgggagaggga

SEQ ID NO: 187500 - RNA, 45 nt, Homo sapiens
cacaaucuaugucuucgccuucaacaucgucuauguggcccucag

SEQ ID NO: 187501 - RNA, 45 nt, Homo sapiens
ccuggguggggaauuguguuggaaagaggaacuaccgcuacuucu

SEQ ID NO: 187502 - RNA, 87 nt, Homo sapiens
uguuuucuuccaguacuuuuaugcuuagaaaguccuucugcauauagaggacaaauaaacauuuauucuuuauaguuauuuuaugga

SEQ ID NO: 187503 - RNA, 59 nt, Homo sapiens
ugaacuagauuuagauagggaaauuuagauaggcaacaagcuccugaaaaacugcaaau

SEQ ID NO: 187504 - RNA, 53 nt, Homo sapiens
gcaagaucuuccggccuccccgggccucccauugcagcaucugugacaacugu

SEQ ID NO: 187505 - RNA, 56 nt, Homo sapiens
uaucaagaauuuccagauaaacaaccagauugugaaacugaaauacuguuacacau

SEQ ID NO: 187506 - RNA, 29 nt, Homo sapiens
uaugauagguaaaaaugguaucuuugugc

SEQ ID NO: 187507 - RNA, 85 nt, Homo sapiens
ugccaugcucuuccuuuucuccauggcuacacuguugaggaccagcuucagugacccuggagugauuccucgggcgcuaccagau

SEQ ID NO: 187508 - RNA, 51 nt, Homo sapiens
gaguaguggaaaauaggguaauccacaagcuagugauauguaagaaccuua

SEQ ID NO: 187509 - RNA, 46 nt, Homo sapiens
uuuguuuucaagaaugaucuuagugaugggcaguggccaggaagau

SEQ ID NO: 187510 - RNA, 44 nt, Homo sapiens
gauuacauugauaaaagaacaaacaaaccaaaaaacauagcaag

SEQ ID NO: 187511 - RNA, 53 nt, Homo sapiens
uccuuaaagccauacuuaccagcugcuacuggagcaguuucaagcagccagca

SEQ ID NO: 187512 - RNA, 26 nt, Homo sapiens
gagaaaaaucaagcaaugugugcucu

SEQ ID NO: 187513 - RNA, 46 nt, Homo sapiens
cuacugaaaggcuaucgugguauucagucaaauucaacuuccugau

SEQ ID NO: 187514 - RNA, 35 nt, Homo sapiens
ugaaugagugugugugugugcauaugugcacgcac

SEQ ID NO: 187515 - RNA, 46 nt, Homo sapiens
ccuuggagugauuuuuuuucugugguguaauaccucguacucgagc

SEQ ID NO: 187516 - RNA, 71 nt, Homo sapiens
cuugauagacuugggaaauaagaaaguuugucuuaauuacucaccucucccuuuuaguggucuccuuagaa

SEQ ID NO: 187517 - RNA, 45 nt, Homo sapiens
cuucguggucaucacagaguauguacuuccuaaaaagaccaauac

SEQ ID NO: 187518 - RNA, 36 nt, Homo sapiens
uuuuaucauaccuucuuuuagagaacaaacacgaau

SEQ ID NO: 187519 - RNA, 54 nt, Homo sapiens
cccagauucuggcagccaggaggugcugucugaauugagaguacuaucucagaa

SEQ ID NO: 187520 - RNA, 69 nt, Homo sapiens
auugaaggaaaaccaucaguccaggaagcaaaaagcaaguucagaggggacuauuccccagguccagag

SEQ ID NO: 187521 - RNA, 49 nt, Homo sapiens
aaagaagaauguuuucaaaauaaggagcuucccagaccuguguuagaag

SEQ ID NO: 187522 - RNA, 46 nt, Homo sapiens
agcuuuugcuggggaugaugucaucagagauuucuugaaagagaag

SEQ ID NO: 187523 - RNA, 65 nt, Homo sapiens
accauccagacccccauaggauccacauggaacacccagagggcuuuccaaaagcugacuacucc

SEQ ID NO: 187524 - RNA, 74 nt, Homo sapiens
auugaguugcuggaggagugacagccaggagcccugacuucacuuccuuugguccaguuuuacucugauacagg

SEQ ID NO: 187525 - RNA, 43 nt, Homo sapiens
ggggcucugcccagguaaagggggcgccgugaggcgggggugg

SEQ ID NO: 187526 - RNA, 30 nt, Homo sapiens
agggggcuggguagucguccccagaaggac

SEQ ID NO: 187527 - RNA, 48 nt, Homo sapiens
ggguuccggggagggagauggggggguggcgacgacgguggggggggg

SEQ ID NO: 187528 - RNA, 45 nt, Homo sapiens
gggccgggcgcggcggggagggggcuuaaauugaaggaagaugag

SEQ ID NO: 187529 - RNA, 44 nt, Homo sapiens
agcggaucgcggccggggagugggagggcuuaguggugggcuuc

SEQ ID NO: 187530 - RNA, 25 nt, Homo sapiens
ggucgaggggaaaggugggagggaa

SEQ ID NO: 187531 - RNA, 50 nt, Homo sapiens
cacaguuuaggguacuuuaauugaauggugaugucaccaugugguacuaa

SEQ ID NO: 187532 - RNA, 50 nt, Homo sapiens
uacugaauggggggagggauucacuguccuaaauagaguggccuugaaag

SEQ ID NO: 187533 - RNA, 44 nt, Homo sapiens
gggccaaucagcaucagaaucagagugaagaaauucgaggucaa

SEQ ID NO: 187534 - RNA, 40 nt, Homo sapiens
caugucaaggucauauuuucccuggucaaugaauuaugau

SEQ ID NO: 187535 - RNA, 49 nt, Homo sapiens
cuuuuccaaguuuuguggagaagugcaccguauaugacuaugaucgcag

SEQ ID NO: 187536 - RNA, 32 nt, Homo sapiens
augaauauuuuccggcucuuucauuuuuuaaa

SEQ ID NO: 187537 - RNA, 50 nt, Homo sapiens
uagagaggagaauaagaaccagugcuguggaagagguagggaguaaauac

SEQ ID NO: 187538 - RNA, 58 nt, Homo sapiens
auuugggagucaucagugcaucaaggggcgagcugaaacuguggaagcucaugagcug

SEQ ID NO: 187539 - RNA, 79 nt, Homo sapiens
augggugggggaagccagagagagccagcaaaaggcagacuaggaggaaaagagacagagggagaccggggagggaccg

SEQ ID NO: 187540 - RNA, 53 nt, Homo sapiens
aaggagggggagagggaggagagaaugaaugggagacugagggaaauggggaa

SEQ ID NO: 187541 - RNA, 90 nt, Homo sapiens
cugccuuaggacuuucucaugcacuguucccucagccuggaaugcuuuucucccaaauauccacguggcuacuccuuuaccucauuccga

SEQ ID NO: 187542 - RNA, 45 nt, Homo sapiens
cuauccuguucaccguauuucagauaguagcccuccccaccuaga

SEQ ID NO: 187543 - RNA, 49 nt, Homo sapiens
uguguugaaaguggacaaucucugaaaauugaaaaauggauacaugaaa

SEQ ID NO: 187544 - RNA, 41 nt, Homo sapiens; identical to SEQ ID NO: 119385

SEQ ID NO: 187545 - RNA, 74 nt, Homo sapiens
caccagagggauagcugcauacaauagggccuggggagggacccuggggaggagaagacucuuaguuguuucua

SEQ ID NO: 187546 - RNA, 42 nt, Homo sapiens
agaucugacguuucuuggguaaaucuuagaaaugugugugcg

SEQ ID NO: 187547 - RNA, 38 nt, Homo sapiens
aggggcacacagagcaguccugugccuugcccacccag

SEQ ID NO: 187548 - RNA, 23 nt, Homo sapiens
gggagggaggcagucugaugcca

SEQ ID NO: 187549 - RNA, 40 nt, Homo sapiens
cuaugaugcuuaccugaaauuuggagaagacuuuaaacag

SEQ ID NO: 187550 - RNA, 46 nt, Homo sapiens
aguggcagcaaugcccggggggcagacccagauggcagugcuacag

SEQ ID NO: 187551 - RNA, 46 nt, Homo sapiens
cucgagugaaacaggaaagcguaggggucuuugcuugcaagaacaa

SEQ ID NO: 187552 - RNA, 48 nt, Homo sapiens
ugugacggaaucucugccgcccaagaagaugaagugcggcaaagagaa

SEQ ID NO: 187553 - RNA, 45 nt, Homo sapiens
cccaggaauccaccaagaaaagccccaggggggcuucagauucag

SEQ ID NO: 187554 - RNA, 382 nt, Homo sapiens
aacuuuguuuauuuucuuucuuucuuucuuuuuuuuuuuuuuuuuuuuuuuuuuuuugagauggagucucacucugucacccaggcuggagugcaguggcacaaucuuggcucacugcaaacucugcaucccagguucaagugauucuccuuccucagccucccaaguaucugggacuacaggugagugccaccacgcccggcgaauuuuuguauuuuuaguagagucgggguuucaccauguuggccaugcugggcucgaucuccugaccucaggugauccacccaccucggccucccaaagugcugggauuacaggcgugagccaccaugcccagcagaacuuuguugaggugcagcagccucagaguccuaugggcagu

SEQ ID NO: 187555 - RNA, 45 nt, Homo sapiens
aauuuaggauguacuuucguuguuagcagaguugaaggaaagagu

SEQ ID NO: 187556 - RNA, 52 nt, Homo sapiens
aaaggaguauauccucccuugcccugucugagaccccaauugcccucuccua

SEQ ID NO: 187557 - RNA, 48 nt, Homo sapiens
uuaauacuugauguugucugguauauuggacucuguaaagcacauaug

SEQ ID NO: 187558 - RNA, 109 nt, Homo sapiens
ggucaguaaggggagaacaguauccccauuuuauagaugaggagacugcacugaaggaacuuucccgaacgguacagcuaauaacuggcagagccugaacuugaaccca

SEQ ID NO: 187559 - RNA, 29 nt, Homo sapiens
agacagugacaugggaagccaggaagucu

SEQ ID NO: 187560 - RNA, 42 nt, Homo sapiens
gcuaagcgucgaaaggugagaaagacccaacgggacacccag

SEQ ID NO: 187561 - RNA, 38 nt, Homo sapiens
ugcccggcaaaugugggacaccaaugaggaggaggagg

SEQ ID NO: 187562 - RNA, 26 nt, Homo sapiens
acuggggaguaccugacagagcaaga

SEQ ID NO: 187563 - RNA, 49 nt, Homo sapiens
uuggagcaccgccucaggaacaggaaccuucucuugcccaacaaagucc

SEQ ID NO: 187564 - RNA, 59 nt, Homo sapiens
cucccaaauaaccuggaagagccagccugccuugaaaauucagaaaagccaucaggaaa

SEQ ID NO: 187565 - RNA, 38 nt, Homo sapiens
aguaaacaaaagauuguuaaaacuuuuauuguggucaa

SEQ ID NO: 187566 - RNA, 40 nt, Homo sapiens
ggcuccauggacauugacuaucugcauuuccugaaccuua

SEQ ID NO: 187567 - RNA, 45 nt, Homo sapiens
ugcuaugcugcagagugaaccacaguuuaagguucuuuugcaacc

SEQ ID NO: 187568 - RNA, 72 nt, Homo sapiens
uaggccuuucuccacggcucccccucugcuggggaagaucuuggagagcaaggaggccagggaagcaagagu

SEQ ID NO: 187569 - RNA, 44 nt, Homo sapiens
guuggcaggggcgggagucggaggaaagacuggucccagcagau

SEQ ID NO: 187570 - RNA, 61 nt, Homo sapiens
aaagccgggccaggcauugcaggggacaggagaagacauuugccucagcuauacccaagga

SEQ ID NO: 187571 - RNA, 51 nt, Homo sapiens
uuacaauuaguucucaucucccugucgucgucauuguuaucgugguugcug

SEQ ID NO: 187572 - RNA, 32 nt, Homo sapiens
uuuuucgcauuuggguguauauucuggcugcc

SEQ ID NO: 187573 - RNA, 40 nt, Homo sapiens
gaacuaccacagccccagaguaacgaaucagaccagggaa

SEQ ID NO: 187574 - RNA, 61 nt, Homo sapiens
aggucgaauggguaaaggagcauuuuuuuauucagcagacuuucucuguguaugaguguga

SEQ ID NO: 187575 - RNA, 47 nt, Homo sapiens
auggaacaucuuuaaccgaaugccaauagcaaggaagguaggugccu

SEQ ID NO: 187576 - RNA, 72 nt, Homo sapiens
uuugcuuccauguuuauuuguuuugggggcuggccacaggaacugguauccgaucagagagugagacagagu

SEQ ID NO: 187577 - RNA, 51 nt, Homo sapiens
ugggccccgauguuggcuaugaagcuauuggucuuguggacaguaguuugc

SEQ ID NO: 187578 - RNA, 64 nt, Homo sapiens
uggcuggagaaaauaugacuggagcugcuaagccguacuggcaucagucaauguucugguaaua

SEQ ID NO: 187579 - RNA, 83 nt, Homo sapiens
aggagaugcugcaugcuucuacgauauaaaguugggaaggaggcggguagagcaccaugaucacgcuguugugaguggaagau

SEQ ID NO: 187580 - RNA, 46 nt, Homo sapiens
uagguugcuuugggggagucuaaauagccacaaagaugaacaaagg

SEQ ID NO: 187581 - RNA, 48 nt, Homo sapiens
gccuucagauggaucugcuguucccuuugcucaaacuugaauccggag

SEQ ID NO: 187582 - RNA, 44 nt, Homo sapiens
aacagccuaaccaaauagggucagaguguuuggaggcugagggu

SEQ ID NO: 187583 - RNA, 45 nt, Homo sapiens
cuuccggguaaaugcagagcuacaagcacgcucuaacaucugggu

SEQ ID NO: 187584 - RNA, 45 nt, Homo sapiens
auaguggcagcugugggccuggagcccaauguugaguuggccaag

SEQ ID NO: 187585 - RNA, 50 nt, Homo sapiens
gugcaauccguuggagucagcaguggcaaguuacuuaucaagcugaaaga

SEQ ID NO: 187586 - RNA, 51 nt, Homo sapiens
gaaagauccuccccgaauaccucagcaacuggaccauggaaaaagucagac

SEQ ID NO: 187587 - RNA, 72 nt, Homo sapiens
ucacgggaagucaaaucaauuacgauuaucggugggggcuuccuugguagcgaacuggccugugcucuuggc

SEQ ID NO: 187588 - RNA, 74 nt, Homo sapiens
gccccuuuuggaaauuaauggacuaaacugaugugauccugcagauuggagacuuuagaagcuuggagaagauu

SEQ ID NO: 187589 - RNA, 94 nt, Homo sapiens
uagaacaaggcuugucagccucugcaguauuggcauuuugagcuggauaauuguagugggggcugucuuaugccauuguaguauguuagcagca

SEQ ID NO: 187590 - RNA, 48 nt, Homo sapiens
uccugauguguuugauucauuggaaccccuuacagccucuuggcauuu

SEQ ID NO: 187591 - RNA, 50 nt, Homo sapiens
aagugcccacccgggacuugggagauccaaguucuauuuauggcucuucu

SEQ ID NO: 187592 - RNA, 64 nt, Homo sapiens
uacuccaagaagucugucugccauugauagggcuggagcagaggugaagaguagaacaacgcuu

SEQ ID NO: 187593 - RNA, 47 nt, Homo sapiens
gauggcucucaaauaaccuaugaaaagugcuugauugcaacagguga

SEQ ID NO: 187594 - RNA, 66 nt, Homo sapiens
acucacuucuccuguaaggggacauuagacagagaagauggauauagguuuguugauaagccggua

SEQ ID NO: 187595 - RNA, 66 nt, Homo sapiens
uguuccaauagggacgcauucucugaaggagcaaagcccagaguagaugagauacacagcauaagu

SEQ ID NO: 187596 - RNA, 50 nt, Homo sapiens
agccaguauggugauguguguuuccauuaccauuuaugucuguccugcca

SEQ ID NO: 187597 - RNA, 46 nt, Homo sapiens
gccucauauugagaauggugguguggcuguccucacugggaagaag

SEQ ID NO: 187598 - RNA, 50 nt, Homo sapiens
gacccaaaugucacaaagacacugcgauucaaacaguggaauggaaaaga

SEQ ID NO: 187599 - RNA, 47 nt, Homo sapiens
aaacaguuugggugcugugauuuauggaugucuuguagaagcaaugg

SEQ ID NO: 187600 - RNA, 43 nt, Homo sapiens
cuacaagacuaugaaagaggaugaaaaaagauacaaugaaaga

SEQ ID NO: 187601 - RNA, 42 nt, Homo sapiens
auuagucucaagagaacuaugaacuuaaaaucaguguucaga

SEQ ID NO: 187602 - RNA, 42 nt, Homo sapiens
ugaaguccuaccagauauagcuaaagccacaagucuaaugau

SEQ ID NO: 187603 - RNA, 45 nt, Homo sapiens
aaacggacaagaaaaguagauaguucuugccuauugugagucaaa

SEQ ID NO: 187604 - RNA, 45 nt, Homo sapiens
uguguuaguccuuauugugggcuuaucaacaguaggagcuggugc

SEQ ID NO: 187605 - RNA, 45 nt, Homo sapiens
gaugauauuuuucuugaucauuuaacggugaauaucugugggcaa

SEQ ID NO: 187606 - RNA, 24 nt, Homo sapiens
uuaaaaacuucagcaacuuaagag

SEQ ID NO: 187607 - RNA, 45 nt, Homo sapiens
caaccauuuuauuucauguggugaugaagaguucuaaaagcaggu

SEQ ID NO: 187608 - RNA, 56 nt, Homo sapiens
acacuuguucuuuguccuuuggccgugcaccaaaguaugacaucaucugccuuuaa

SEQ ID NO: 187609 - RNA, 44 nt, Homo sapiens
cuucuuuucguacugcguuacuucaugggggcaaugaaugaucc

SEQ ID NO: 187610 - RNA, 42 nt, Homo sapiens
uagguagagcuaaggauaguuugcuagccuccagguccuuaa

SEQ ID NO: 187611 - RNA, 47 nt, Homo sapiens
cgcauuguauuuuguucuccauuaaguuguuucaucaaauuuuagag

SEQ ID NO: 187612 - RNA, 96 nt, Homo sapiens
agugaaacagaaacggugcagggcaaguaaggagucgguugguuguguaccagacacccagagaauuggcccagacuuaauuggagaugccugagc

SEQ ID NO: 187613 - RNA, 48 nt, Homo sapiens
gccuaaguuucuuguguaaaugaggguguuaucugcucagccuuccaa

SEQ ID NO: 187614 - RNA, 43 nt, Homo sapiens
gccggggcucacgguguuugacccgucggucgugcgugagagg

SEQ ID NO: 187615 - RNA, 48 nt, Homo sapiens
uuaaauugcaguuuauaguuaaaaaauuagggcugaguugagauggcg

SEQ ID NO: 187616 - RNA, 45 nt, Homo sapiens
aaacuuguuuuuuuguaacagccccccuggaaugauaucuucuuu

SEQ ID NO: 187617 - RNA, 42 nt, Homo sapiens
cuuccucuagugugucuagcuucuuuaauguaaggcuauaag

SEQ ID NO: 187618 - RNA, 41 nt, Homo sapiens
caaaaaccuaaugcucccauuugcuuaaaaucaagugcuac

SEQ ID NO: 187619 - RNA, 46 nt, Homo sapiens
caucugaaauuuagauggaaaaaaugaaguguuugggaaucuaaag

SEQ ID NO: 187620 - RNA, 45 nt, Homo sapiens
uccacuauaccccauuggccaucugacagaaacaaggaucugggg

SEQ ID NO: 187621 - RNA, 46 nt, Homo sapiens
agggcuuccuuaugaacugacugaaggggacaucaucuguguguuc

SEQ ID NO: 187622 - RNA, 65 nt, Homo sapiens
ggagcuucuguucuagaucagucccaggacaugguucuagaauguucugugggagauccaagagg

SEQ ID NO: 187623 - RNA, 112 nt, Homo sapiens
cucgugcgggacaagaaaacugggaaauccaaaggauucuguuuccucugcuaugaagaccagaggagcacaauucuggccgucgacaauuuuaaugggaucaaggugagug

SEQ ID NO: 187624 - RNA, 60 nt, Homo sapiens
gaguggaucaugugucuaacuaucgggcuccuaaggacucagaagaaauagaugauguga

SEQ ID NO: 187625 - RNA, 40 nt, Homo sapiens
agagcucugaagaugaaaaaccaacaaaaaagcacaaaaa

SEQ ID NO: 187626 - RNA, 54 nt, Homo sapiens
ggagguacaggcagagcaaccauccucuucgucacccagacgcaagacaguaaa

SEQ ID NO: 187627 - RNA, 61 nt, Homo sapiens
agaagcacagcagcaagaacucagagagagcucagaagucagagcccagggaggggcagaa

SEQ ID NO: 187628 - RNA, 47 nt, Homo sapiens
gaaacccaagcacgagcacaaguccucaagcaggagggaggcaagag

SEQ ID NO: 187629 - RNA, 46 nt, Homo sapiens
cagaugcacauucuagcugguauaaugggcguucugaagggcguag

SEQ ID NO: 187630 - RNA, 47 nt, Homo sapiens
augcagucaaauucaguugggugguuacuauuuuuguaucuaaaacu

SEQ ID NO: 187631 - RNA, 249 nt, Homo sapiens
accagcuggaauccuggggaugaccucacucccucagccuuggauggcagccccaccccuucagcccagggcaauagcccugcccccaagaauucuggaggugguucugcccccucaggcauaggaaguggcucuguccccuggagccuuggagguggcucugcccucucugccuuggauggaaacccgcccucucaggccuggcaguggccucacccccucagcccuggauggcagcaccaccgucuc

SEQ ID NO: 187632 - RNA, 75 nt, Homo sapiens
cacucccucagcuuuggauggcagcaccaaucccucagcccugggcagugggcccaccgucuggaacccugauga

SEQ ID NO: 187633 - RNA, 46 nt, Homo sapiens
acaccucaauguaccggugucccaugcuuucccugucuuuuuucag

SEQ ID NO: 187634 - RNA, 45 nt, Homo sapiens
uguagaugaaauggacaccugcggccccaucaugaaucgugcagu

SEQ ID NO: 187635 - RNA, 44 nt, Homo sapiens
acucuugcuccaagggacaggaagaagagacagaugccuacaaa

SEQ ID NO: 187636 - RNA, 42 nt, Homo sapiens
aaagcaaaaugccaagaguggaauacauuuaugcaaguugag

SEQ ID NO: 187637 - RNA, 29 nt, Homo sapiens
gaaguuuuccacgagcugucaucuugcua

SEQ ID NO: 187638 - RNA, 45 nt, Homo sapiens
gaagucgugggucggggccucaguuccuccuggugugggcaggac

SEQ ID NO: 187639 - RNA, 46 nt, Homo sapiens
gagugaggacuuagaaugaaccagccccugccgggcgguccuggca

SEQ ID NO: 187640 - RNA, 54 nt, Homo sapiens
gaggcguggggcuccaagcuaggucuucuugccuucuccucuaagaccuuaaga

SEQ ID NO: 187641 - RNA, 44 nt, Homo sapiens
uuucuggagcacuacugccaucgugaggaugaaguuucaugaaa

SEQ ID NO: 187642 - RNA, 56 nt, Homo sapiens
aagucguggggcggggccucacuuccuccugguguggucaggacuugagggaccca

SEQ ID NO: 187643 - RNA, 35 nt, Homo sapiens
uaucucugaguggcguuuuuucacacaggaagggc

SEQ ID NO: 187644 - RNA, 44 nt, Homo sapiens
aaaugggaagacuugguugagcggaaacugaguucuugaaaaga

SEQ ID NO: 187645 - RNA, 45 nt, Homo sapiens
gagccccacuaaauagcgaccucccucucaacauacaaggccuac

SEQ ID NO: 187646 - RNA, 36 nt, Homo sapiens
guuuguguuacacuguuauauaaugaaacuguaaga

SEQ ID NO: 187647 - RNA, 56 nt, Homo sapiens
ccucuuuguuacuaaugugaaaauacaggacugauuccuaacugauaaacaguaac

SEQ ID NO: 187648 - RNA, 36 nt, Homo sapiens
auggcguaggguuucguuaaacgacauccucacgau

SEQ ID NO: 187649 - RNA, 60 nt, Homo sapiens
cuucacacuccagguucuauagcaagauaccgccaauguccaggucuuuuuuaaagccuu

SEQ ID NO: 187650 - RNA, 45 nt, Homo sapiens
ucgugggucggggccucaguuccuccuggugugggcaggacagca

SEQ ID NO: 187651 - RNA, 35 nt, Homo sapiens
gaacuggaauuuggcgguaucuugguguagaaccu

SEQ ID NO: 187652 - RNA, 45 nt, Homo sapiens
agaagucguggggcggggccucacuuccuccugguguggucagga

SEQ ID NO: 187653 - RNA, 62 nt, Homo sapiens
uguucccaauacaagaagacucuuugacaucauaauaaaauacugcagauacgaugcugagu

SEQ ID NO: 187654 - RNA, 29 nt, Homo sapiens
ccucuaagaccuuaagauagaccuggaca

SEQ ID NO: 187655 - RNA, 34 nt, Homo sapiens
agucagaaguuuuccacgagcugucaucuugcua

SEQ ID NO: 187656 - RNA, 41 nt, Homo sapiens
aaaaagaaaaagcacagcaguaagaccagcuggcuccaaac

SEQ ID NO: 187657 - RNA, 55 nt, Homo sapiens
guagcaagaugcuaguucgagaaagccugcugacucuugcuccaagggacaggaa

SEQ ID NO: 187658 - RNA, 38 nt, Homo sapiens
ucuugguauagaaccuggagugugaagguucuaauacc

SEQ ID NO: 187659 - RNA, 120 nt, Homo sapiens
auauccaaguguaaaaaccuguuguuggcgaggccggacagagccaacagcugccagaaguccgggcacaggaaguugucggguggggcuuccguugaggaaaacuuucagggcccagug

SEQ ID NO: 187660 - RNA, 35 nt, Homo sapiens
aauguuguaacgggaaucaaaccauucugguuggc

SEQ ID NO: 187661 - RNA, 55 nt, Homo sapiens
aauuuuguauucccacacauuuugguuuacauuaagagacuaucuggucagagag

SEQ ID NO: 187662 - RNA, 45 nt, Homo sapiens
uggagacagugcaccauaacuuaacuuagaauugugagugacaga

SEQ ID NO: 187663 - RNA, 52 nt, Homo sapiens
gaugagaaccaaaaccgagugaagaggauugaagaugaacccacauuuuaaa

SEQ ID NO: 187664 - RNA, 36 nt, Homo sapiens
uacccaaacagugaacugccaauaauuuauaccagc

SEQ ID NO: 187665 - RNA, 40 nt, Homo sapiens
caagagggcuugagugaaaguguuuuaagugggaaaaaaa

SEQ ID NO: 187666 - RNA, 45 nt, Homo sapiens
gcuagacgaggcggaaggugggcggaaaucugcgaacuggggagg

SEQ ID NO: 187667 - RNA, 40 nt, Homo sapiens
aggguggggaagggaugguaaugcccuuccuauaggaacu

SEQ ID NO: 187668 - RNA, 61 nt, Homo sapiens
gccaaggccauggccacccgcuggcuccucugucucuccgcugccccagcgcugcugcucg

SEQ ID NO: 187669 - RNA, 47 nt, Homo sapiens
uccuccggggccacgcgcagcucguuguagaagguguggugccagau

SEQ ID NO: 187670 - RNA, 51 nt, Homo sapiens
cuaauacugaagaguguccuuuaaugacugaucccugaucaaggcuuuggc

SEQ ID NO: 187671 - RNA, 90 nt, Homo sapiens
cuggagguaaaccugccagcagcccaggcacaccucucucaaaaguugacuuucaaacagugcccgaaaauccaaaacgaaagaaauaug

SEQ ID NO: 187672 - RNA, 46 nt, Homo sapiens
aaggccagacagucuuuaaaggggcaagcagaagacagcagcaaaa

SEQ ID NO: 187673 - RNA, 46 nt, Homo sapiens
ccaccucuucccuugagugaggauggagaaauuacagauuuccaau

SEQ ID NO: 187674 - RNA, 45 nt, Homo sapiens
aucaacugaaagauaacauggaaaaacucaacacaauuuggaagc

SEQ ID NO: 187675 - RNA, 38 nt, Homo sapiens
auccucuagaaaucaaggaacaauucaucuguuacuga

SEQ ID NO: 187676 - RNA, 43 nt, Homo sapiens
ucuuaacuguauuuuugagggcagagagaagaaauaucaagag

SEQ ID NO: 187677 - RNA, 49 nt, Homo sapiens
cauuaccaaauucuuuggaaacucuuccccuugggaccaacacuuagua

SEQ ID NO: 187678 - RNA, 39 nt, Homo sapiens
uguccuccauauccuagaaaggggauuggaaagggaaau

SEQ ID NO: 187679 - RNA, 46 nt, Homo sapiens
uaaaguuaaaugaagucauaaagguaggcuucuaaucugauagaau

SEQ ID NO: 187680 - RNA, 43 nt, Homo sapiens
uuuacaucuugaaauauauugcauuccucuuguuccacaaguu

SEQ ID NO: 187681 - RNA, 87 nt, Homo sapiens
ucauucauaugagaaauuuauauaacucacauuaaacacaucagaucaacuggaaaauuagaguaauuaaauguuagaggggaauga

SEQ ID NO: 187682 - RNA, 45 nt, Homo sapiens
uuuccagagcuagacugggguuaggguugagguauuagggguaga

SEQ ID NO: 187683 - RNA, 23 nt, Homo sapiens
auuuaaacccaguggauauuuug

SEQ ID NO: 187684 - RNA, 1557 nt, Homo sapiens
aguaaguacaguaaguccucacuuaaugucuucaauaaguuccagugaacugcaacuuuugaagcaaaaugacuuaugacaaaaccaaauuuaccauuggcugauugauauaagcaagaguuaggucuccauggcguauauuucuggucaugaaaacaucaccaaacuucuaaauaaagacugaaaacacuuuuacuauuaaacacugaaauaaaggugagcuaucuauaccuuuaagaaagguuaacaaaaacaagauacaauaauuacccagcucuuggugaaucagugagucgugguggucauuguggugguggguuuauuuguuuuuauuauuguuaccuuuuuuuuuuuuuuuuuuuugaggcagagucucucucugucaccgacacugaagugcaguggugugaucucggcucacugcaaacuccgccucccagauucaagcaauucuccugccucagccucccgaguagcuaggauuacaggcuccugccaugaugccuggcuaauuuuuuuguauuuuuaguagagauggcguuucaccauguuggucaggcuggucuugaacuccugaccucaaaugauccgcccgccuuggccucccaaagugcugggauuacaggcgugagccacugcguccggccuuauuauuauuacuuuuuaagaguuggggucuugcugugucacccgggcuggagugcugugauguaaacauggcucacugcagccucaaacuccugggcucaagugauccucccaccucagccuccagaguagcugggacuacaggugugugccaccaugccuggcuaauucuuuuuaaaaaauuguggagacaaggucucaccacguugcccaggcuggucuuuaacucuuggcaucaaacaacccucccaccucagccuuccaaagugcuaguuuuacaggcaugagccaccauucccagccgugaugguggauuuaaauuaaggaagaaacauuugcaaagugaaaauucuaagaaguaucuccuaccaccaugcaguucaaaaacaaucacaaauauggcaagcucacugagcacuuuagcacaacgucauuuauuguugugcauuuguaugauuaucauagacuuucugaauuuuuauuuuacaauauuuuguauucauucauugagucauuuucuaaccuacuuacucuguuucaagcggucacagguggcuggaucuuaucccagcagcucagggugcaaggcuggaaccaacccugggcaggacauuacaucaccaggugcacucacacacacacccacgcugacucacacugggaccauuuaggcaugccaguuaaccccaucuacacaucuucuggaugugggaggaagugaguaccuggagaaaacucaugcagacuccacccagacaguagccccagccgggaauugauuuuuuuuuuuccucaucaauuuuauaaggaaacaauguuguagaaaaugaccuuauuugaggaccugcaguaaaucuaugcuuucucauucagauaucugacucuaguccauguuacuagacucaaaua

SEQ ID NO: 187685 - RNA, 47 nt, Homo sapiens
uuuuaauguucuucuaacuaaucuuucuaugaaaaauauccauauuu

SEQ ID NO: 187686 - RNA, 45 nt, Homo sapiens
agaagagaaaaaaccugauauguggcauuugucaauuucuaaggu

SEQ ID NO: 187687 - RNA, 45 nt, Homo sapiens
guuuauauggguacaggagagagauuaaauuauagcagaaauuuu

SEQ ID NO: 187688 - RNA, 35 nt, Homo sapiens
ggggaaaauaaaauacaaaauccuucuguuuggau

SEQ ID NO: 187689 - RNA, 65 nt, Homo sapiens
uggccuaugaucuggauguggaugaugcgccuggaaacagucagcaggcaacuccgaaggacaac

SEQ ID NO: 187690 - RNA, 37 nt, Homo sapiens
ccaccuuugcuuuaggacaagcuaaauaacacccuga

SEQ ID NO: 187691 - RNA, 40 nt, Homo sapiens
gcugaaggaaagaggagaaauggacagcaucaaaagagau

SEQ ID NO: 187692 - RNA, 47 nt, Homo sapiens
gguuccagcuaucacagaauggaacauucuuucuuccuggauggcaa

SEQ ID NO: 187693 - RNA, 456 nt, Homo sapiens
aucauguaaguugaggcuugaaagauacaauuguggggccggucacaguggcucacuccuguaaucccagcacuuuaggaggccgagacaggcagaucaccugaggucaagaguucgagaccagccuggccaacauggugaaaccccaucucuacucaaaauacaaaauuagccuggcaugguggugcaugccuguaaucccagcuacuugggaggcugaggcaggagaaucucuugaacccgggaggcagagguugcaaugagccgagaucacaccauugcacuccagccugggcaacaagagugaaacucugucuaaaaaaaaacaaaacaaacaaacagaaagauacaauuguggauagaaaagagaggguaggugggagacagaaagacagaggggggaggaaggagagaaagagaaagagaaagggagagagagagaaaaggauagaaaga

SEQ ID NO: 187694 - RNA, 40 nt, Homo sapiens
gaagugcugagaggagaacaguaagggaauggaaacuggu

SEQ ID NO: 187695 - RNA, 41 nt, Homo sapiens
uucagaggcucaacuuacuuucucuaaucucuuggcaaaga

SEQ ID NO: 187696 - RNA, 47 nt, Homo sapiens
gagaaagaagcuauagagaaaggaaaagaaaaaguagugagauaaag

SEQ ID NO: 187697 - RNA, 26 nt, Homo sapiens
gccaaguagucugaaaaagcaaguau

SEQ ID NO: 187698 - RNA, 49 nt, Homo sapiens
aaacacuuccacccacuccacccugaauauuaaaagggcaagguuagga

SEQ ID NO: 187699 - RNA, 42 nt, Homo sapiens
gauagagccagccaggucacuaggcacccaugcuaggguuua

SEQ ID NO: 187700 - RNA, 50 nt, Homo sapiens
gauacacagagggguauagaauacugaagagcuaacacaaucaagggcac

SEQ ID NO: 187701 - RNA, 56 nt, Homo sapiens
uaauagcucauauuuuuugagugcuuacuaugugcccggcacaguuuuaagcauuu

SEQ ID NO: 187702 - RNA, 53 nt, Homo sapiens
gcccauagaaguuccuaguguaguugggggucuugggggguggugggcaaugg

SEQ ID NO: 187703 - RNA, 52 nt, Homo sapiens
ucaauaugcuucaagcauuuaccaacaugauggucagguaauucccagugcc

SEQ ID NO: 187704 - RNA, 44 nt, Homo sapiens
aaccuacaucuccaaucuuuucucucacuaaccccuacuccauc

SEQ ID NO: 187705 - RNA, 45 nt, Homo sapiens
auucaggaugagcuucagagaagagucguucuccaaauaacagug

SEQ ID NO: 187706 - RNA, 70 nt, Homo sapiens
ccuugcagguucucuguucucuucucuugagcuauaguucuauauagaaaagaucucauuuuccccauuc

SEQ ID NO: 187707 - RNA, 72 nt, Homo sapiens
caaaauguugccuggucccagcacugaucccugagacauaccgcuguucauacuucuccagaaaagucuaug

SEQ ID NO: 187708 - RNA, 52 nt, Homo sapiens
cugcggugaugaugaagaugagugcauuggaggcucuggugauggaaugaua

SEQ ID NO: 187709 - RNA, 69 nt, Homo sapiens
aaccaugucuaugcccaaagguagaguucuggauaaaaaccuggaugaggaaggguuugaaaguggaga

SEQ ID NO: 187710 - RNA, 56 nt, Homo sapiens
gucccgugaaauucguaaugcauuggccaugugacugaaaagccagacaccgcaga

SEQ ID NO: 187711 - RNA, 31 nt, Homo sapiens
ucagacuggucaaagggacagagguuggaaa

SEQ ID NO: 187712 - RNA, 92 nt, Homo sapiens
uauccugaaaaaaaucauuaucacauacucaaauacagcaugcaugcacacacacacauucauucauucuggcaguauguccuaaacugugu

SEQ ID NO: 187713 - RNA, 46 nt, Homo sapiens
accagugcaccugucuuguauuggaaaggaaauaaaugucaaagug

SEQ ID NO: 187714 - RNA, 58 nt, Homo sapiens
acagaggagaaaagacuggcaggcgagggaacaagcaauucauuuuuaggcuugagaa

SEQ ID NO: 187715 - RNA, 45 nt, Homo sapiens
uauggaagaaauuacauaugagaugguuccuggaagauaaucaga

SEQ ID NO: 187716 - RNA, 61 nt, Homo sapiens
agaaauauuauucuggaugauggcaagaucucagagaguuuugggggcccugucugugugg

SEQ ID NO: 187717 - RNA, 27 nt, Homo sapiens
gccagcagcgugaaggauguuuuaaag

SEQ ID NO: 187718 - RNA, 41 nt, Homo sapiens
agaggcaguuuguuauagcugcauauggaugcucgaaggca

SEQ ID NO: 187719 - RNA, 50 nt, Homo sapiens
cauucuagauacuguuuuucuucauauuauuacaauaugaagaguuagca

SEQ ID NO: 187720 - RNA, 47 nt, Homo sapiens
uuaguuguaaagcaucacugguaugugacugagagucucagugagac

SEQ ID NO: 187721 - RNA, 47 nt, Homo sapiens
agguuaaaaaggacuguuuugggauugugauguucacugcuccacau

SEQ ID NO: 187722 - RNA, 49 nt, Homo sapiens
aagcucuuuccuauccauuagauaacgugaucuuuauaaccacucagag

SEQ ID NO: 187723 - RNA, 46 nt, Homo sapiens
uuauuguucccaaggaaaaaucuauccauuuauuguuuccccauuu

SEQ ID NO: 187724 - RNA, 46 nt, Homo sapiens
cucuuuuauguccucagugucaguccuggaauuugcuaggccaugu

SEQ ID NO: 187725 - RNA, 60 nt, Homo sapiens
uucuccccuccuccuuccaaggcagaguucauguguaacauucccacgaucagaaaugag

SEQ ID NO: 187726 - RNA, 76 nt, Homo sapiens
caucccaaaauagcuuuucacuuuguuuccugggaauucucagcugccuccuugcagguuaugguuacuguugaua

SEQ ID NO: 187727 - RNA, 107 nt, Homo sapiens
aaauacuucuccucucucucucucucucucucucucucucucucucucugcauguaugccccaugugcguccauccagaugaacuauagcuaggccauuuaugagca

SEQ ID NO: 187728 - RNA, 46 nt, Homo sapiens
ccaugagcugaaaaugaagggcccugagccaguggucagucaaauu

SEQ ID NO: 187729 - RNA, 22 nt, Homo sapiens
aagcagacaguauuauuaccua

SEQ ID NO: 187730 - RNA, 61 nt, Homo sapiens
aggcacuuaaauaauugauagcugguguugauguugucauuacuauuauaccaugguugag

SEQ ID NO: 187731 - RNA, 29 nt, Homo sapiens
aagcaggucccagcauauccacacccuca

SEQ ID NO: 187732 - RNA, 50 nt, Homo sapiens
uuauuuucaaaacgacuuuuauuguuaauauauacuauccaggaaagaaa

SEQ ID NO: 187733 - RNA, 46 nt, Homo sapiens
ggaaaacgacacccuuugcuggaauggacaagaacucguggagagg

SEQ ID NO: 187734 - RNA, 43 nt, Homo sapiens
uggaaggccuugcauggguucaauuuuucuugccauguguggu

SEQ ID NO: 187735 - RNA, 49 nt, Homo sapiens
agauugaggaaggaaaggagggcguucugggcaaagggaacacuaugag

SEQ ID NO: 187736 - RNA, 44 nt, Homo sapiens
cuagcacuccucaugcccaugcccaagcuccguccucugugguu

SEQ ID NO: 187737 - RNA, 49 nt, Homo sapiens
cauucucaacaacgccaauauagaucugcuuauuauccugaagaucucu

SEQ ID NO: 187738 - RNA, 51 nt, Homo sapiens
ugcuuugguuauuugugcuuucauugucauaucuaagaggacauugucaaa

SEQ ID NO: 187739 - RNA, 54 nt, Homo sapiens
acauacaggugucagucaugaugucaauaugcagagaggagcaaaucagaaagu

SEQ ID NO: 187740 - RNA, 59 nt, Homo sapiens
aguccaaucucauucuuuuaccagugaagaaacagauaaccagauggggagaugcaugu

SEQ ID NO: 187741 - RNA, 43 nt, Homo sapiens
uagacuauuagggggauauagaacuaauuaagagaccugaaca

SEQ ID NO: 187742 - RNA, 35 nt, Homo sapiens
uauauggcuaauuuaaaaaucaacuuacaggggaa

SEQ ID NO: 187743 - RNA, 46 nt, Homo sapiens
agaggcuauuggaugaaaaaggaaacaaaccuaucagcccagcaac

SEQ ID NO: 187744 - RNA, 44 nt, Homo sapiens
ggccuucucucacauggaggcacucaucuuugggguacucucau

SEQ ID NO: 187745 - RNA, 46 nt, Homo sapiens
uauccaaaauguggaggguggauuaggcuauuucagcuugucuuua

SEQ ID NO: 187746 - RNA, 46 nt, Homo sapiens
gucucuuuucaacaauccaugauucuauccaguauguccagaagaa

SEQ ID NO: 187747 - RNA, 52 nt, Homo sapiens
gucaugcaaggcuguauggcaggugugguggagauugacaaguacuggagag

SEQ ID NO: 187748 - RNA, 46 nt, Homo sapiens
aagucacugcaagucacuaggaucuuccuucaggcucugaaucuug

SEQ ID NO: 187749 - RNA, 46 nt, Homo sapiens
gccaagaacuacaccaaugccauguucaagaacaacuacccaagcc

SEQ ID NO: 187750 - RNA, 46 nt, Homo sapiens
cucuucagauaguugcugaagucccuaacaacugcuguagaccaga

SEQ ID NO: 187751 - RNA, 42 nt, Homo sapiens
gcugugacuggaaaggaauaauagccagugugaacaaagaca

SEQ ID NO: 187752 - RNA, 50 nt, Homo sapiens
aaagagaauaaagagaggguggagaccaagagaggaguggagaaagaggg

SEQ ID NO: 187753 - RNA, 45 nt, Homo sapiens
gaacagagaaggaaagggacaugggaaaaaugaaaagaacaagag

SEQ ID NO: 187754 - RNA, 46 nt, Homo sapiens
gguccauagucuuucaacucagggaaggaucuuggggcuuauccau

SEQ ID NO: 187755 - RNA, 46 nt, Homo sapiens
aggugccgaaagcuggaguucugaacuccaggagcuuagggggaaa

SEQ ID NO: 187756 - RNA, 36 nt, Homo sapiens
ccuuccuguggaaucaggaagaggaggagugaugga

SEQ ID NO: 187757 - RNA, 42 nt, Homo sapiens
ucaguauagggaauuguguaugguaaggcauaggaggcagca

SEQ ID NO: 187758 - RNA, 45 nt, Homo sapiens
aauggaaauauggaugugacugauacagggcccuuaauguugagg

SEQ ID NO: 187759 - RNA, 113 nt, Homo sapiens
acagaaaacaagcaaaaaacccaaaaaccaaaaaccgaaaaacaaaaaacaaaacaaaacaaaaaaacaaaaaacagcccccaccaauuucaguugggacaguccuuauaucu

SEQ ID NO: 187760 - RNA, 58 nt, Homo sapiens
aggcugugaacugauaagagaaugcuguuucauuuaaaagcagacagagccuuguuug

SEQ ID NO: 187761 - RNA, 46 nt, Homo sapiens
aguagagcacuaguuucauuuaaaagaucccuagaaggagucaggu

SEQ ID NO: 187762 - RNA, 58 nt, Homo sapiens
cuaaccauguuuauauuauguuggacaggacaccaguagaagggaagggacugucagg

SEQ ID NO: 187763 - RNA, 49 nt, Homo sapiens
uaaaauggagauaacaaacucacaggauuguugugaagaucaaauguga

SEQ ID NO: 187764 - RNA, 47 nt, Homo sapiens
uuccucucagagagguagcuggacugggcaaagcucuggaucuguac

SEQ ID NO: 187765 - RNA, 71 nt, Homo sapiens
cuugauugaagcuuuauguagcuccaguucagcgguucaaagcuuugaagggaaagaccauucuguuggaa

SEQ ID NO: 187766 - RNA, 48 nt, Homo sapiens
acaagacucguaucagagaugaagaacaguuuauuacucacagcagua

SEQ ID NO: 187767 - RNA, 45 nt, Homo sapiens
agcacugcuuuaacuuugguaguaccaauauuucaguuaagccag

SEQ ID NO: 187768 - RNA, 50 nt, Homo sapiens
auucaucuuauaacuaaaaguuuguacccuuugaccagcuauuccucauu

SEQ ID NO: 187769 - RNA, 76 nt, Homo sapiens
aaaaagggaaguuuguauuucuguuccuucugcuguuaccuacaaccuccccgucuucugaacugggacccucagg

SEQ ID NO: 187770 - RNA, 54 nt, Homo sapiens
ucauuugugcuucuccugaccaacaccuuaucuauuccaaauuagcauauauaa

SEQ ID NO: 187771 - RNA, 45 nt, Homo sapiens
agagaggaagacccuggaaaguuuguaaucagcggauuaagugaa

SEQ ID NO: 187772 - RNA, 54 nt, Homo sapiens
ugaugaaguuucaauugauacaacuauaucaaagcuugugguagcaaaucuuag

SEQ ID NO: 187773 - RNA, 45 nt, Homo sapiens
ucggaugucugcuuucagcaagugcaugcgcagugggaccugaaa

SEQ ID NO: 187774 - RNA, 48 nt, Homo sapiens
ugauauuauggugaauuauggacacauuauuguuacaccuugacaggu

SEQ ID NO: 187775 - RNA, 44 nt, Homo sapiens
ugagauuuuucuguuacuuuauuaccagguggaaaagauuugaa

SEQ ID NO: 187776 - RNA, 91 nt, Homo sapiens
aauaugaaaauguauagcugauuucaucauggauuugcaugcaaauaaggaugaagcagucuaugggagggggaaaacaacagguagagaa

SEQ ID NO: 187777 - RNA, 47 nt, Homo sapiens
aagaggaauaugagggaaacagagcagauuagggaaaacugaggaga

SEQ ID NO: 187778 - RNA, 45 nt, Homo sapiens
gucuaagguuauguagcuucuauaagagcauagcuaggacugaga

SEQ ID NO: 187779 - RNA, 46 nt, Homo sapiens
gucagaagaagggggauuuagagagaaguguuacuuguguggugga

SEQ ID NO: 187780 - RNA, 47 nt, Homo sapiens
uuuaucccuuuaucuauaaguacuuuuuaaaacaagggcugacagcu

SEQ ID NO: 187781 - RNA, 36 nt, Homo sapiens
uccacuuauuaaacucugacauaugucaugcccugu

SEQ ID NO: 187782 - RNA, 368 nt, Homo sapiens
aaaaggcguaguguguuaucucucuuaggaauauuuuuggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccgaccugggcgacagagcgagacuccgucucaaaaaaaaaaaaaaaaaaggaauauuuuuauguuaacuaggg

SEQ ID NO: 187783 - RNA, 42 nt, Homo sapiens
gcuuacuuuccuaauucuaugaugggaaauuucuucagaguc

SEQ ID NO: 187784 - RNA, 49 nt, Homo sapiens
ggacagacaaggcugcugggacaugugagcauuggguauucauagagau

SEQ ID NO: 187785 - RNA, 45 nt, Homo sapiens
augguugcagugauaggcuugaauuuuugaugacagagggagaaa

SEQ ID NO: 187786 - RNA, 45 nt, Homo sapiens
acugcugaaggaggugaaggggaccauuucccauaacacagagau

SEQ ID NO: 187787 - RNA, 48 nt, Homo sapiens
ccucccuugcucuagacuuuaccuguaccccuuuaaaugagccuauua

SEQ ID NO: 187788 - RNA, 22 nt, Homo sapiens
cagcagaggaagggagggagga

SEQ ID NO: 187789 - RNA, 45 nt, Homo sapiens
cuaagagugaaaaggacaggauuggguuuaggacuuaggaaaugu

SEQ ID NO: 187790 - RNA, 34 nt, Homo sapiens
gaaggcagagagauugaagaagaagcaguguaaa

SEQ ID NO: 187791 - RNA, 127 nt, Homo sapiens
auugagacuuauagagaaauccaggaauuauccacauaacucaucauaauggaaaucaugaaagcaggaaaauuuaccaaagaagauauuuuagaaaaaagacccagcaaagaaauagagcaugaga

SEQ ID NO: 187792 - RNA, 68 nt, Homo sapiens
guaagaaacauugaggaaaagagaacugauagaauuugugacuauauggauggggaugagcaagagga

SEQ ID NO: 187793 - RNA, 64 nt, Homo sapiens
gcgguaggauucuacuuaucauguacuguacaguugcacuacuugaggaugaugaacuuccacu

SEQ ID NO: 187794 - RNA, 47 nt, Homo sapiens
cuaccccauguccccaaacaaaaacaaaacaauacugucaaaaggac

SEQ ID NO: 187795 - RNA, 62 nt, Homo sapiens
uauaugauuuuuuuccuuguuaucaaauagaagauugaaugagcaaagcuaaauaggugggc

SEQ ID NO: 187796 - RNA, 64 nt, Homo sapiens
aauauagaccaauuaaagauauacagagcuggaaagcugauauuauuauuauuauuauuuggua

SEQ ID NO: 187797 - RNA, 68 nt, Homo sapiens
agagcaggaaaagcccuuugcaauaccaugagggauucaggaagguauuuuagaauuuggagggguuu

SEQ ID NO: 187798 - RNA, 59 nt, Homo sapiens
ugucagcgacaaauggugcaugugcacauaauacugaugaggauuguggguacgcagug

SEQ ID NO: 187799 - RNA, 46 nt, Homo sapiens
agagaauggauugcaagauuguuaucgcuggaaucauuguggggga

SEQ ID NO: 187800 - RNA, 42 nt, Homo sapiens
aacuguaaaugcucacagaaaagguauagaaaaaauuguaca

SEQ ID NO: 187801 - RNA, 60 nt, Homo sapiens
gggugggacuuggaauggggagaugauaaucaaaggguacaauguuucaguuagacagga

SEQ ID NO: 187802 - RNA, 48 nt, Homo sapiens
uacaaauggccaacagguauaugaaaaaaaugcucaacaucacuaauc

SEQ ID NO: 187803 - RNA, 32 nt, Homo sapiens
uacaugaguuacuuuugugggcaggauauagu

SEQ ID NO: 187804 - RNA, 44 nt, Homo sapiens
uccccaaauaccucacagcgcaauggcuuuagaaaccauugaga

SEQ ID NO: 187805 - RNA, 64 nt, Homo sapiens
uugaagaagacugaugauacgcaguuugaggaagagacgcuuugaccaccagaagaaauaugua

SEQ ID NO: 187806 - RNA, 54 nt, Homo sapiens
gguccagugacccacuuuguugucacacaguuugugaccagaggaagaaaugau

SEQ ID NO: 187807 - RNA, 52 nt, Homo sapiens
cauuucauuauuccuugguucuuucugguguuuuccuuuuuacuucccaauu

SEQ ID NO: 187808 - RNA, 49 nt, Homo sapiens
agggacuuaugaaauugugaggaaaaaacaaacccaaacaucuucaggg

SEQ ID NO: 187809 - RNA, 24 nt, Homo sapiens
gguuuagacccuucaagucuuggu

SEQ ID NO: 187810 - RNA, 45 nt, Homo sapiens
guaaaaccccaugaaaaaauaauaugcaucuguuauuuuuaaaau

SEQ ID NO: 187811 - RNA, 47 nt, Homo sapiens
ggcauauuugccuaaugcuacaaaauuuuaaacuugauacuacucaa

SEQ ID NO: 187812 - RNA, 78 nt, Homo sapiens
ucauuaguacaguaggggacagaucuguucuuauacucucauauagcaaacaagaacauaauuaacauugacuguaua

SEQ ID NO: 187813 - RNA, 49 nt, Homo sapiens
ugaacuuuuaaaaagaucuugaugcuuaauguuaaaucauccuccagaa

SEQ ID NO: 187814 - RNA, 45 nt, Homo sapiens
ggggcccggagaccagaggagagaaacaauaccaaaguuucuggg

SEQ ID NO: 187815 - RNA, 59 nt, Homo sapiens
gacugauucagcucaguuauuuauugaguaucuuucaagaaaggcacaauaauggaaua

SEQ ID NO: 187816 - RNA, 124 nt, Homo sapiens
ucacagagcaggcaacuggguugguauacagugcaacauaucaggguaggcagggccaacguuuuaguaaaagaagaaagaaagcauauuugccauaaagaucaagucagaaccagugcuacgg

SEQ ID NO: 187817 - RNA, 46 nt, Homo sapiens
uacaauugccuucuagagccauuuaaaguggccaguuggguucuau

SEQ ID NO: 187818 - RNA, 36 nt, Homo sapiens
uaaauagguagcauugucuucauuugauguaugagg

SEQ ID NO: 187819 - RNA, 45 nt, Homo sapiens
gagaagacugcugacaauauggguaagcucaccuugaucuuuugg

SEQ ID NO: 187820 - RNA, 69 nt, Homo sapiens
uccaaagcaaaacacaaaggaagcaagauuagaaaauuaaguguggagggggaacauuugaguauagua

SEQ ID NO: 187821 - RNA, 42 nt, Homo sapiens
cacacacuuauuauuccuuucccagacaucuuuaauacagac

SEQ ID NO: 187822 - RNA, 46 nt, Homo sapiens
aauucucuguagggacauacuagggugaguuaauuguacccugagu

SEQ ID NO: 187823 - RNA, 47 nt, Homo sapiens
guaauaacaccauuagguauuauuauccccauuuuacagauguggaa

SEQ ID NO: 187824 - RNA, 31 nt, Homo sapiens
auaguucucccucucuaaaugccagauuaaa

SEQ ID NO: 187825 - RNA, 47 nt, Homo sapiens
ucugagccauucauuaaacaaaauuaaaucagaugagugcugugaag

SEQ ID NO: 187826 - RNA, 45 nt, Homo sapiens
agacuggcuguaugaaaucuccagauagacaugcuguugaucaaa

SEQ ID NO: 187827 - RNA, 49 nt, Homo sapiens
acaaaauggaggcuuaaagagauuaggugacuuguuuaaaguagcaccc

SEQ ID NO: 187828 - RNA, 24 nt, Homo sapiens
aaaagguugguauaagucuagaga

SEQ ID NO: 187829 - RNA, 76 nt, Homo sapiens
uucuaacacccagcuaggaagaugaugaugaugauggaggugguggugguggugaugauagcagacacuuauaugg

SEQ ID NO: 187830 - RNA, 41 nt, Homo sapiens
aaguaugucucccuaagggcccaacaugcugcucaagaaag

SEQ ID NO: 187831 - RNA, 39 nt, Homo sapiens
gaaaugcauuguuugcccuguuugccaugugugagugug

SEQ ID NO: 187832 - RNA, 44 nt, Homo sapiens
ggcaaaacuugaugaauuucauuccuaaauuaagaaaaucugga

SEQ ID NO: 187833 - RNA, 45 nt, Homo sapiens
agauugaaauuuauaggagauaaaucugaacucuaugucugcaga

SEQ ID NO: 187834 - RNA, 39 nt, Homo sapiens
acuuuuucugaagauaaucauaaagcuuuaagcuuagac

SEQ ID NO: 187835 - RNA, 23 nt, Homo sapiens
uuguucaccacuuuggcaaggug

SEQ ID NO: 187836 - RNA, 41 nt, Homo sapiens
gaaacauuuagauauuauuaggcagaaacauuuagguuggg

SEQ ID NO: 187837 - RNA, 30 nt, Homo sapiens
aaaaaggaaaaaaaaaaaaaaagccuaggu

SEQ ID NO: 187838 - RNA, 45 nt, Homo sapiens
uggauaauugagucucuucuucuuaauuauuucaggcaugcaggu

SEQ ID NO: 187839 - RNA, 80 nt, Homo sapiens
cacccacaguuaaggggaacaacggauguucugugcacucucaucacagcccuccuggggcucaauauaccucugaagcu

SEQ ID NO: 187840 - RNA, 417 nt, Homo sapiens
uggugaauuugaagcauauuuauuuauucucauuggcccugggagccuuguugccccucauuuauuuauuuauuuauuuauuuauuuauuuauuuauuaucauuuuuugagacagagucuugcacuguugccugagcuggagugugguggcacaaucucggcucagugcaaccucugcuucccagguucaagagauucuacugccucagcuacccgaguagcugggauuacaggugcccaccaccacacuuggcuaauuuuuguauuuuuaguagagauggcguuucaccacguuggccaggcuggucucgaacuccugaccucaggugauccgccugccucagccucccaaagugcugggauuucaggugugagucaauuuugcucccuggcgaguugccccucuuuaaaacuuac

SEQ ID NO: 187841 - RNA, 46 nt, Homo sapiens; identical to SEQ ID NO: 119897

SEQ ID NO: 187842 - RNA, 65 nt, Homo sapiens
uuaagaguuaucuuauuacucauuucuaagaaaauugaagauaaucacuuauaacuugugcacac

SEQ ID NO: 187843 - RNA, 92 nt, Homo sapiens
aggagugagacacaaucccuuuugucaaggagcucacagucuaguggggaagcauacaaguaaacaggcuucccaggaaacuuguaggauua

SEQ ID NO: 187844 - RNA, 49 nt, Homo sapiens
ugaaugccauacaccacuuuugucgggggagggggguaguguaagggau

SEQ ID NO: 187845 - RNA, 45 nt, Homo sapiens
caaauucaucugccuucuugacaggcuggauccuaaaggggagau

SEQ ID NO: 187846 - RNA, 45 nt, Homo sapiens
ggcgcagcccccgccgccgccgccggacgccaccugucaccaagu

SEQ ID NO: 187847 - RNA, 68 nt, Homo sapiens
cugggaccaugagacagccaaucuaugccuuaagccucuaaugccaaaacuuuugagucagauaagag

SEQ ID NO: 187848 - RNA, 45 nt, Homo sapiens
gccauaacggagccggccggcgcgcgggcugacugcucaggagga

SEQ ID NO: 187849 - RNA, 50 nt, Homo sapiens
cacuacuaacuuaaaaguuuagagauuaagagcagaaucuggggugagac

SEQ ID NO: 187850 - RNA, 44 nt, Homo sapiens
gugauauugggcaaguuacuucaacuaucugugccuccaagguc

SEQ ID NO: 187851 - RNA, 47 nt, Homo sapiens
gaccugcauacuacaagucuacuuuguuuucuauccauuguuuguau

SEQ ID NO: 187852 - RNA, 29 nt, Homo sapiens
cauaaccugguucaucaucacuaaucuga

SEQ ID NO: 187853 - RNA, 47 nt, Homo sapiens; identical to SEQ ID NO: 119926

SEQ ID NO: 187854 - RNA, 48 nt, Homo sapiens
aaaguuucacaacaauccugugagggagacgauauccccauuuuacaa

SEQ ID NO: 187855 - RNA, 35 nt, Homo sapiens
auaauuucacagaaguuuuacauguuaaaguuuuc

SEQ ID NO: 187856 - RNA, 40 nt, Homo sapiens
gagcuuugccccuccuguucauuucauauaccacuguuag

SEQ ID NO: 187857 - RNA, 42 nt, Homo sapiens
gggaaggacaggucuaacagugguauaugaaaugaacaggag

SEQ ID NO: 187858 - RNA, 72 nt, Homo sapiens
uaacuuaguaugcaccauccuaaagguaagccagggagagaaauuccucugcaucaguuuuaauggugggcu

SEQ ID NO: 187859 - RNA, 89 nt, Homo sapiens
ugcaaugucuucuuuuuugaaaggauauaauugacacuggcaaaacaaugcagacuuugcuuuccuuggucaggcaguauaauccaaag

SEQ ID NO: 187860 - RNA, 25 nt, Homo sapiens
uuucagauaagguuacugaggcaua

SEQ ID NO: 187861 - RNA, 45 nt, Homo sapiens
ucauuaaaaacauuaagucucugaucagucugcaguuuuuaugua

SEQ ID NO: 187862 - RNA, 49 nt, Homo sapiens
uuugugucauuagugaaacuggaaaagcaaaauacaaagccuaagauga

SEQ ID NO: 187863 - RNA, 42 nt, Homo sapiens
aaauucuuagaagauacaugcaaaaagcucuacuaagcagau

SEQ ID NO: 187864 - RNA, 54 nt, Homo sapiens
ucuucuaagaauuuuaucuguuuuguacuuuagaaaugucaguugcugcauucc

SEQ ID NO: 187865 - RNA, 70 nt, Homo sapiens
aaaaauucucuuaaaccacagcacuauugagugaaacauugaacucauaucuguaagaaauaaagagaag

SEQ ID NO: 187866 - RNA, 37 nt, Homo sapiens
aaaaaaaucccuucccaaucagaauaccacccacagg

SEQ ID NO: 187867 - RNA, 74 nt, Homo sapiens
uuaagaauaaaaacacuagcagugaguuaggacaucuaaugcuuuuaaagauagauguauaugucgcaacgaua

SEQ ID NO: 187868 - RNA, 46 nt, Homo sapiens
acuuuuuuuuuuuaccaugacauaguguauuuguuaccacuggauc

SEQ ID NO: 187869 - RNA, 47 nt, Homo sapiens
aauuucagucuaaggggaaauauguaaacuaggggaucgagguggcu

SEQ ID NO: 187870 - RNA, 45 nt, Homo sapiens
ggcauaugcaaaauuaaaagacaaaacguuguagaguaugaacag

SEQ ID NO: 187871 - RNA, 26 nt, Homo sapiens
agaggugacaugcgauuuuuuaaaaa

SEQ ID NO: 187872 - RNA, 62 nt, Homo sapiens
aaggaagggcuggggaggcggagagacagaccgagcgagcgacacacggacagcgacggaca

SEQ ID NO: 187873 - RNA, 46 nt, Homo sapiens
ucaacuagaaguacagguuauuucacacgaaacaaugaacaaguga

SEQ ID NO: 187874 - RNA, 60 nt, Homo sapiens
uaggagaggaggagggaaggaggaugaugaugaggaagggaggaugauggugaggcagga

SEQ ID NO: 187875 - RNA, 47 nt, Homo sapiens
gaagagggagggaaaaggauagguggaaaagcaggaggacagagagg

SEQ ID NO: 187876 - RNA, 46 nt, Homo sapiens
gagagaggagggagaagaggagggggaggaaacuaggcagcggcgg

SEQ ID NO: 187877 - RNA, 167 nt, Homo sapiens
gcacaucccguaccgcgagcacaagagccugacgggcacggcgcgcuacaugagcaucaacacgcaccugggcaagggugagcugcgcgcgcgcggcggggggcgggcgcccggaccccgcugaggcugcgccccuguccccgcagagcagagccgccgcgacgacc

SEQ ID NO: 187878 - RNA, 45 nt, Homo sapiens
aagcccgacuaugacuaccugcggaagcucuucaccgaccucuuc

SEQ ID NO: 187879 - RNA, 43 nt, Homo sapiens
aggagagggcuuggcagcggcggcaguggguggucuguccagu

SEQ ID NO: 187880 - RNA, 44 nt, Homo sapiens
cagggacuguggccagcccagauaccuccgaggugaguccagau

SEQ ID NO: 187881 - RNA, 32 nt, Homo sapiens
gaaaauaaggaaaagacuuucuccagguagug

SEQ ID NO: 187882 - RNA, 33 nt, Homo sapiens
uuaaaaauaaggaaaaaaccuuuguacagguag

SEQ ID NO: 187883 - RNA, 45 nt, Homo sapiens
guccaggggcuguguccagcucggauaccuccgaggugaguccac

SEQ ID NO: 187884 - RNA, 22 nt, Homo sapiens
agcgcaggggacaucgcggcgg

SEQ ID NO: 187885 - RNA, 45 nt, Homo sapiens
agaaauguauaccaaggcuucucucaaaacuaguaaccagaaaau

SEQ ID NO: 187886 - RNA, 66 nt, Homo sapiens
uggguuuuuaaaaguuuguuauuggacuugaauggauuuuugagacuagguuaauuauuuuugagg

SEQ ID NO: 187887 - RNA, 39 nt, Homo sapiens
ggacaugcauaaaaauuaaauggauuuccuaguggaguu

SEQ ID NO: 187888 - RNA, 5239 nt, Homo sapiens
aagguuaaugaaaaacagguagguaguaaaaucguaguaccagaauggguaauguuuuuacaaaucucacaacauaaccagauguuaacuggaacuguauacagucaugggcugcaugacaauguuuaaguaaacaauggaccacauaaaugaaugacgguggucccauaaaauuauaauggagcuaaaaaguccugugcuaaugucauagugcaacacauuacucacguuuguggcaaugcugguauaaacaaaccuauugugcugccaaucauauaaaaguguagcacaugcaauuauguauagaacauaauacuugauacuauaauaaguuaauauguuacugguuuaugaauuuacuauacuuuuaaucauuauuuuaaaguguauaccuucuacuuuuuuuuuuuuuuuuuuaaaguuaacuguaggccaggcaugguggcucacgccuguaaucccagcugaggcgggcagaucacgaggucaggagaucgagaccauccuggcuaacguggugaaacuccaucucuacugaaaauacaaaaaaauuagcugggcgugguggcgggcgccuguagucccagcuacccgggaggcugaggcaggagaauggcaugaaucugggagccgaagcuugcaguaagcugagauugcgccacugcacuccagccugggcaacagagugagacucugucucaaaaaaaaaaauuuuuuuaacuguaaaacagccucaaggcagccccuacaggagguauuccagaagaaggcauuguuaucauaggagauaacagcucccuguguguuauugccccuaaagaccuuccagugggauaagguauggagguggaagacaaugauauugaugauccugacccuaggcuaguuagccuaggcuaauguugguguuggugucuuaauuuuuaacaaaaaaguucaaaaaguagaaaaguuauauuugguuuuugugauuuuuuuuuuuaagacaaggucucacugugucacccacacuggagugcaguggcacaaucuuggcuuacugcaaccucugccuccagggcucaagugauccucccagcucggccucccaaguagcugagacuacagauguauaccaccacacccagcuaauuuuuuuuuuuuuucuuguagaggugggguuuugccauguugcuuaggcuggucucagaccugggcucaagugauccauccaccugccucagccucccaaagugcugggauuacaggcaugaaccacugcacccagcccccaaaaauuuaaaauuagcuaguacaaccacuaugaaaaccaguauggagacuucucaaaaaacgaaaaauagaaaucuacccaaaggaaaagaaaucaauauaucagagggauaccuguacucauaaguuuacuugcagcacuauucacgcacaauagcuaauagaaucaacuauguguccaucaguggauaaauggauaagaaagaauuaaaucaugucauuugcagcaacauggauggaauugaaggucaguaucuuaagugaaauaagccaggcacaaaaagaaaaaauaucacauucucacuuauaugugggagcuaaaauauuugaacacauggaaguagagaguggaaaaauagggcugggcgugguggcuuaugccuguaaucccagcacuuugggaggccgaggcgggaggaucacuugagccuaggaguucaaugcaagccugggcaacauacccauugcuacaaaagauaaaaaauuagccaggcaugguggcgugugccuaaaaucccagcuacucgggaggcugaggugggaggauugcuugagcccaggggguugaggcagcaugaucgcaccacugcacuucagccugggcaacagagcaagacccuaucucaagaaaaaagagagaauggaaaaauagguaacagagacugggaacggugaggggcaaggaggaggaugaagagaguuaaaggguacaaacccauacacaguaagauaaaaggaauaaauucaguguuucauagcagaguaggaugaccacccuuaacaaaaaccuauuaauacucaggugauggacacccugaauccccugacuugaucgcuacacauuauauacauguaacagauuuucucaugugcuccauaaauaugcacagaaacauuuuaauggaaaaaaccauacaggccaggcgugguggcucacacguguaaucccagcauuuucggaggccaaggcaggaggaucacuugagcccaggaguuugagaccagccugggcaauauagggagaccccaucucuaaaaaaaauuuaaaacauuagcuagaugugguagaggcaggagaaucacuugaaccuggaggcagagguugcagugagccaugaucacgccauuguacuucagccugggcaacagagcaagacucuugucucaaaaauaaaacaaacaaaaaaaaacacacaaguaguuaauaaucauauaaaagacuacucagccuuauuaguaaucaaagaaauacacauuaaugcuacacauuuagauacccuuuauacccacccaauuggcaaaaauuuuaaagucuaaccaagaguuggcaaggauuuggaacaauggucaggaauucauagauacuacuauaggaguguaaauugaugcagccauuuuggaaauuaggccuuaucuuguacaguugacguggguauacucugugacccagcuguuuuagucugugugacugagaggaacuuggaggaaguauguauaagaauuuucauagcagcaaaaaaucaggaaacaaccucaagauucauugauaacagaauagguacauauugagccuaaacauaaaaauggggggaaaaaagaauagguacauaaauugugacuguauuuauagaauggaauguuuauuuguaaugacugaaugaauaaucauuucaacaugaauaaaucuuagaaaaauugaaugaaaaaacaaguugcaacagaauacacaaaguaugauauuuuauaauuuuagaaaauaaaugauagcaguuuuagggucauauacguauauacuacaacuauaaaaauaagaaaugagaugucacguagcaaaaauuauaaagugguaauacugucugucauugggcauauaaggaaaaggguaccucacauacauuacugagggaaguacggaguuuuaugguaucuacuugccccaacauuucuacuuguaugugacaaaagauaccauaaagaaacuuaaaaauaagucuguuaacugggaaaaauauuugcaacuuuuauauaaagagaaagaauuacgagauguauagguuauauaaagauuuauuucuguaaauaagagaccuaacagaaggaaaccggucugugaaagauggccuuguaaacaugaaauuauuccaaacuuugugcauaaugagggaaauguuaaagcagugagguucgcuuuuugucagccgcuagacugacaaccauuuuaaaauguucauaacaggcacucucauguacugccccugggaauguaaaugguacaaauacucuggaggacauucuggcauuuuuucccuuuuuucuuucugguuugacucugggauuuuuuuccuuccuuuuuuccccccuuauuucucuguacuucaaugaauauaaauuggcacuaucucuugacuuuaagugaauauagcuugugauccuucaagaaauacauguguagaaauacacguaaagaauggaggcugaguggguggcucaugcccauaaucccgacaccgugaccaggagugagaccagccuaggcaacauacugagaccucaucucuacaaaaauaaaauuagcugguguggugguguacaccuguagucccagcuacuugagaggcugaaguggggauaucuugaguccaggaggucaagguugcaaugagcugugauugugccacugcacucagccugguugacagagugagacccugucucaaaacaaaagaagaaaaaagaaaaagaauguuuacuggaaaccacuuaaaacaaacaaacaaacagagcuuaaagguaaaaauaaagucuuuuugugaggggaaagauuuuguacaguccuuuuaaagauguguacuaaaaagcaaguugcaaauaguaucuacauauauagcauaaaaaucuuaaaauaguacuguuucuuucuuucuuucuuuuucugagacagagucuugcucuguugcccaggguggagugcaguggcgcgaucuuggcucacugcaaccuccaccucccagcuucaagugauccuccugggucagacucccaaguagcugggauuacaggcaugugccaccacagcuaauuuuuguauuuuuaguagagaugagguuuugccauguuggccaggcuggucucgaacuccugaccucaggugaucugcccgccuuggccucuuaaagugcugggauuacaggcaugagccaccaugccuggccaauacuuccgauuucuauauguauauaaacuuacauaugacuucacagaaauguuuuaagaggacaugcacagaacugaguauuugcucaagcauuguuuguaauuugaacuuaaauaaaagaagucaugugucagaaguuaaccagaggacccauaauuucacucuuugguauuuauucaagagaaaugaaaccuuucuacaaaaagacuggcacaaaaacaugccuaugcagcuaacccuagaaacaucgcaagagacuggauacacaaauggugguuauauucauacagugaacuauguccagcagugugaaggaacaaacccccaugcagcaacauggaugaaccucagaugggcugagugaagggacaccagaguacauaguguaugacacucuuacaugagguucuagaauaggaaaaaaacuaaucucuggugauaaaaaucaaaacgauaguugcuuggaagggggcugaccaggaaggggcaugagggaacuuucugggacagugggaauguucuguugucuugacagagguguggguuauacagguauacacaauugccaaaacugacugaauucuacacuuaagaucuauguauucucuguguguagaugauacuuuaaagagaaaaaaaggugaccacggaaaauuacugaagaacauuuaccauuuaaagaaugugaaguuuuuucuaacauuguuuuuuuaaugcucauauuuagagaagcugcucgagaaugucgcagaa

SEQ ID NO: 187889 - RNA, 133 nt, Homo sapiens
agguggucguacaaaguaaguaugcuuucugucuacagaaagucuccuaacacugucagagacacuuacuaacuaacucauucacucuuguuuaccaucuagcugcaucaggagauaugcaaacauaucagau

SEQ ID NO: 187890 - RNA, 44 nt, Homo sapiens
aggcacagauggaguacagggacuucagacauuaaccaugacaa

SEQ ID NO: 187891 - RNA, 49 nt, Homo sapiens
uucuggaguuucugcugcugucacuucuaugucuguuccaacucccauc

SEQ ID NO: 187892 - RNA, 49 nt, Homo sapiens
uaaaccaugguuugaaacgaagugaaacaucuagacucucaaucccuaa

SEQ ID NO: 187893 - RNA, 68 nt, Homo sapiens
uggggcgagcgcucuagugagcgcggacggaugcuuaggcaguaguccuggcagcggcaguaguggug

SEQ ID NO: 187894 - RNA, 95 nt, Homo sapiens
gcagcagaagagaggaagggggagggccccgagggcuacacacgcucacacuuucaaguucccuuggagggagaggagguggggcugcagaaaga

SEQ ID NO: 187895 - RNA, 46 nt, Homo sapiens
agggcaagagggccgggagaguggggagcggaggcaggagugcggg

SEQ ID NO: 187896 - RNA, 66 nt, Homo sapiens
acugaccugggcaccucuuauuuggacauugccaaaggcgcuguggaguuauucuugaagguaaag

SEQ ID NO: 187897 - RNA, 48 nt, Homo sapiens
uaagcuagauuuuguacauuucuucugggaugcagagcucuuagguag

SEQ ID NO: 187898 - RNA, 37 nt, Homo sapiens
guuugguuauaauuaccuuuuaagugagcuaaaggga

SEQ ID NO: 187899 - RNA, 47 nt, Homo sapiens
accuccaaaaaugagauucuuauuaccuuuuaaauauauacuuuuua

SEQ ID NO: 187900 - RNA, 41 nt, Homo sapiens
ugcuaagccaucuuuacgaaauauguguuaguuucugcacc

SEQ ID NO: 187901 - RNA, 44 nt, Homo sapiens
uuggaggucauaaaauagaucugaaauucaacauucauccuaca

SEQ ID NO: 187902 - RNA, 41 nt, Homo sapiens
auguauuuagauuauuaaaauaauuaaauuuaagugugaaa

SEQ ID NO: 187903 - RNA, 45 nt, Homo sapiens; identical to SEQ ID NO: 120032

SEQ ID NO: 187904 - RNA, 43 nt, Homo sapiens
uguuuaccuaagccuuuaaggcugugucaccaagguauggcca

SEQ ID NO: 187905 - RNA, 65 nt, Homo sapiens
aucugugaauguguguuuagaguuguacugucuuacuugguuuccauauguauucauagggccag

SEQ ID NO: 187906 - RNA, 45 nt, Homo sapiens
auaugaaagaauuuucauuuugcuugaagaagugcaaggaccucu

SEQ ID NO: 187907 - RNA, 46 nt, Homo sapiens
guguauauuuccuuuaauguuuauacaaaaguuuauauggagcagu

SEQ ID NO: 187908 - RNA, 83 nt, Homo sapiens
cagccgcagaauaugcauaucaaugaguuggaggugauuauucucuguaacucccuaaugauuguuuucuaagcauuguggcu

SEQ ID NO: 187909 - RNA, 45 nt, Homo sapiens
caguauuuggaacuaauguuuuuaagguuuuuaggaaaaucaggu

SEQ ID NO: 187910 - RNA, 43 nt, Homo sapiens
aauguuuguguuauuuaguauuaucaaucuuuauacucacaga

SEQ ID NO: 187911 - RNA, 56 nt, Homo sapiens
aagaaaaacaagaaacugaguaauauauaauucaggaccauaguuaacuuugagag

SEQ ID NO: 187912 - RNA, 48 nt, Homo sapiens
aggggcggugugugggcgcacuucuaagggaccaucggaccgaguguc

SEQ ID NO: 187913 - RNA, 39 nt, Homo sapiens
augaaaccaacaccaccagcagauccucuguuaguauga

SEQ ID NO: 187914 - RNA, 59 nt, Homo sapiens
uuuacauucuaugcuacaagacugauauuuugucuguuuguaauuacccaguugugguc

SEQ ID NO: 187915 - RNA, 24 nt, Homo sapiens
cucuguccacuggcugcagggaau

SEQ ID NO: 187916 - RNA, 46 nt, Homo sapiens
agaaaucagaaauggacaaacaggccuuaaucccuauugccaagaa

SEQ ID NO: 187917 - RNA, 26 nt, Homo sapiens
gaaaaaagacaccagaaggaugaagc

SEQ ID NO: 187918 - RNA, 46 nt, Homo sapiens
guauuuggaauauuucagccaauaaagaaacacaacuacuugaaaa

SEQ ID NO: 187919 - RNA, 46 nt, Homo sapiens
aaagauuagcaagagagcgcagagaggagaaaaggagacagcaaga

SEQ ID NO: 187920 - RNA, 45 nt, Homo sapiens
uaggaaacaugagcggcaccaacuuggaugggaacgaugaguuug

SEQ ID NO: 187921 - RNA, 43 nt, Homo sapiens
aauuauggcuucucuaacgauggcgcaucuaguucuaccgcaa

SEQ ID NO: 187922 - RNA, 50 nt, Homo sapiens
uuaauguauauuugaacacacaaaaaugugaaauuucuucaguuccguaa

SEQ ID NO: 187923 - RNA, 46 nt, Homo sapiens
uuuaaggucaaacuuuacaaagauaaucaaggaaaucuuaaaggag

SEQ ID NO: 187924 - RNA, 59 nt, Homo sapiens
gaccaugaaggagacgauagcuuauucuuacugcuuuaaaauauuuuuuugaaugugag

SEQ ID NO: 187925 - RNA, 57 nt, Homo sapiens
gguaaagcaaaaguacaaacaccacagguguguugugaguauacaguauuccaguga

SEQ ID NO: 187926 - RNA, 46 nt, Homo sapiens
aacuugcauuaaaacuuuuggaugaagaugaaauuagaggcuacaa

SEQ ID NO: 187927 - RNA, 49 nt, Homo sapiens
uucaacugaagggagaauaugaugccucaaagaagaagaagaagugcaa

SEQ ID NO: 187928 - RNA, 42 nt, Homo sapiens
agcgaguaguaaaggaagauggagccaagaagcuacuuaagu

SEQ ID NO: 187929 - RNA, 42 nt, Homo sapiens
uucacaaagaaaugcuuggugaugcuauccuuguuugcccac

SEQ ID NO: 187930 - RNA, 34 nt, Homo sapiens
cuaacauuuuuaauguaacuucagagggucuuca

SEQ ID NO: 187931 - RNA, 45 nt, Homo sapiens
uuucgggauccagaggaagcugauuauuguauucagacucucgau

SEQ ID NO: 187932 - RNA, 45 nt, Homo sapiens
ggcagucuccauuuauccacagguggaggaaaccucaagagaaag

SEQ ID NO: 187933 - RNA, 78 nt, Homo sapiens
uucugaaaacaaugcuaaggaaaguagccccgaaaaagaggcugaagaaggcugcccugaaaaagaaucugaagaggg

SEQ ID NO: 187934 - RNA, 76 nt, Homo sapiens
aaaaagagucuaaaaagaagacacucaaaaaugauugugaagagaauggccuugcaaaggaaucugaagaugaccu

SEQ ID NO: 187935 - RNA, 46 nt, Homo sapiens
cagucugaagauggcuccgaaagagaauuugaagaaaauggucucg

SEQ ID NO: 187936 - RNA, 34 nt, Homo sapiens
gagagaguuugacgaagauucagaugaaaaggaa

SEQ ID NO: 187937 - RNA, 67 nt, Homo sapiens
gaaaaaguauuugaugaugagucugaugagaaagaggaugaagaauaugcagaugaaaaggggcuug

SEQ ID NO: 187938 - RNA, 120 nt, Homo sapiens
gaaaagcuguuugaagagucagaugacaaggaagaugaagaugcagauggaaaggaaguugaagaugcugacgaaaaguuguucgaagaugaugauuccaaugagaaguuguuugaugag

SEQ ID NO: 187939 - RNA, 55 nt, Homo sapiens
gaguguugaagaagggccccuauccacuggcagcagcuuuauucucaguagcgau

SEQ ID NO: 187940 - RNA, 55 nt, Homo sapiens
ucuacauuugccugugcuucaggguaauuacuaguaguguuacaugaacaugugc

SEQ ID NO: 187941 - RNA, 45 nt, Homo sapiens
gaaguuugugauauucaucaauaaaaaugaguugauaauaugcag

SEQ ID NO: 187942 - RNA, 46 nt, Homo sapiens
ggauucaaagauucauuuauugaaauaaaucaggaagccuuggcag

SEQ ID NO: 187943 - RNA, 41 nt, Homo sapiens
agaggagaaaaguuuuuccuacacacaggcagaggugaggg

SEQ ID NO: 187944 - RNA, 48 nt, Homo sapiens
uaagcauauuuguucucugaacacaccagcgccccccuacccccccaa

SEQ ID NO: 187945 - RNA, 43 nt, Homo sapiens
ucgccccaauucucucuccacauccagagcucucuccccaggu

SEQ ID NO: 187946 - RNA, 46 nt, Homo sapiens
uggauguggagagagaauuggggcgaguuugaugggagggggugaa

SEQ ID NO: 187947 - RNA, 51 nt, Homo sapiens
cccagcaaacuggcuaagaaagaaggugaaguguuggcugggccaggcaga

SEQ ID NO: 187948 - RNA, 21 nt, Homo sapiens
acucucuucugcauucuuugc

SEQ ID NO: 187949 - RNA, 63 nt, Homo sapiens
aauguugagaauucaaagcugauuagccuagugauuuggaaaccacccugauacugugugugu

SEQ ID NO: 187950 - RNA, 49 nt, Homo sapiens
ucgccgcuugccgcucgccgcgcgagucccagccucuucgccuccagag

SEQ ID NO: 187951 - RNA, 94 nt, Homo sapiens
cuuuccgucacugcaagagucuccugcagagggauaggagggaggaggggaagaaagagcagggaggggguguuggcggggggaggaggaggga

SEQ ID NO: 187952 - RNA, 46 nt, Homo sapiens
cguucugggcacaggcgauccggccgaagugagagaggguaccggc

SEQ ID NO: 187953 - RNA, 44 nt, Homo sapiens
cguucugagaaccucaagauccacaagaggacccacacagguaa

SEQ ID NO: 187954 - RNA, 86 nt, Homo sapiens
uuguuuuauccgaagccaaagagcgaaugaaccacccacccucggguucggcgcggcuacucucgguucccaccgcgggcugaguc

SEQ ID NO: 187955 - RNA, 52 nt, Homo sapiens
cuguaccugcuuucucaagccgaaacgggcuuggugaaaccugggcccggag

SEQ ID NO: 187956 - RNA, 72 nt, Homo sapiens
gaggacaaacacaaacccuguuaauuauagaauggaccaaauacauuuuuaaaagaaaacugagaccaauca

SEQ ID NO: 187957 - RNA, 43 nt, Homo sapiens
agaaacaggacaaguguuaaaaugaauuggaggaguuuaagaa

SEQ ID NO: 187958 - RNA, 46 nt, Homo sapiens
ccauugaugccauauuuaucguuuguaauuuaauuauugcuacaag

SEQ ID NO: 187959 - RNA, 47 nt, Homo sapiens
ugugagcaaauuaaaucuuguuuguugguauuuauaacucacucaga

SEQ ID NO: 187960 - RNA, 75 nt, Homo sapiens
cucuaucucagaugguuguuuaacugcgaguuuaaauguguuuguccuggauuuucggcaugcaaaucaaauauu

SEQ ID NO: 187961 - RNA, 71 nt, Homo sapiens
acugaucaauucaguuaguggccaugacaucucaaucuuguacuucaaagacugagaagcuggauuuaauc

SEQ ID NO: 187962 - RNA, 55 nt, Homo sapiens
cuuacauaaaaaugaaaauugcggcaggaugcaugucugucuguucuaucuagag

SEQ ID NO: 187963 - RNA, 60 nt, Homo sapiens
aucuaugacuuaucuaaucugccuaucaaucuaucuaguagcuaucuauauauuuucaaa

SEQ ID NO: 187964 - RNA, 42 nt, Homo sapiens
uugcaaaauauguauuuuuaaaguucaugauuuguaggcaaa

SEQ ID NO: 187965 - RNA, 45 nt, Homo sapiens
auggaaaagaaauugauugcuauuuuggggggcuggaguggguag

SEQ ID NO: 187966 - RNA, 41 nt, Homo sapiens
uaccuccuuuaaggggcaaugcucuagguuuuugguggcag

SEQ ID NO: 187967 - RNA, 43 nt, Homo sapiens
aaguuagguuagauugagggugggggagggaacucauggagaa

SEQ ID NO: 187968 - RNA, 20 nt, Homo sapiens
ccacuguuaggcaaaaggga

SEQ ID NO: 187969 - RNA, 41 nt, Homo sapiens
ccacccgaaagccgcuugcggcucccggggcucaucagcga

SEQ ID NO: 187970 - RNA, 34 nt, Homo sapiens
gccgggccagggccggagcggggacccgcuggga

SEQ ID NO: 187971 - RNA, 43 nt, Homo sapiens
gaggggguuggggauagaguugaaagccgcuuugcagugccgc

SEQ ID NO: 187972 - RNA, 41 nt, Homo sapiens
caaaggcugcagaacuguugcguaguuuaaacucccuuguu

SEQ ID NO: 187973 - RNA, 39 nt, Homo sapiens
aauguaggucguggcgguugagcgcaaaauuguuaaaaa

SEQ ID NO: 187974 - RNA, 45 nt, Homo sapiens
uuccaagaaaaugccccggcuguuagacaaaugugccauugcgag

SEQ ID NO: 187975 - RNA, 55 nt, Homo sapiens
ggagccucuucaguaguuuggaaacuuguuuugaaauugccaccaagccgauuuu

SEQ ID NO: 187976 - RNA, 73 nt, Homo sapiens
uuuuuuuuuuucugugggugaaguuuccuuccccgguucacucacucccccauuccccacccccucgcuggaa

SEQ ID NO: 187977 - RNA, 123 nt, Homo sapiens
uggcugaugccgacaagaagauggcgugagucgaggccauccccaggggaggaggugagugcagaggagugggacaccgugacucacagcucucuccccucagcgucgcgacucuggccucug

SEQ ID NO: 187978 - RNA, 42 nt, Homo sapiens
ggaucaaccgggcugcccgcugcgugcgcugggcccccaacg

SEQ ID NO: 187979 - RNA, 1291 nt, Homo sapiens
agcacaacgggcaggugacagguaugucaggguggcugggaccaccguccugaaaggaggugguggguuggggggguggugcaaggcagggcauggccacucauuguggagcaucugcccacucaccgugaaacccggauucaaacuggcuucaauuuuaaggggacuguguuggcucauguuaccaaaaacucacaggguugagggcuucaggagaggcuugauccagcagcuccacaugaccaagaacccaucuuuucugccucuuggcuuugcccuccagcauguuugcugauagcauggagggcucugacacucccucauaagcucuaggagugcccccuggugucacucuaaauaagcacuggaucucaguaaaaagugcuugcugggccgggugcaguggcucaugccuguaaucccagcacuucaggaggccaaggcgaguggaucgcuugaggucaggaguucgagaccauccuggccaacaugacuaaauguugaaaaauacagaaauuagccgggugugguggcacgcaccuguagucccagauacucuggaggcugaggcagaagaaucgcuugaacccaggaggcggagguugaagugagcugagauugcaccacugcacuccagccuggauggcagagcgagacugugucgcaauaaaaacaaagaaagaaagaggccgggugcgguggcuugcgccuguacucccagcacuuugggaggcggaggcgggcggaucaccugaggucaggaguucaagaccagccuggucaacauggugaaaccucaucucuacuaaaauacaaaaauuagccaggcaugauggcgggugccuguaaucccagcuacuugggaggcugauaugugagaauugcuugaacccggaagauggugguuccagugagcugagaucgugccagugcacuccagcuugggcggcugagcgagacucugucucaaaaaaaaaaaaaaaaaaaaaagauuggugguacacaccuguagucccggcuacucaggaggcugaggcacgaggauugcuugaaccugggaggcagaggcugcagugagcugagaucaugccacugcacuccagccugggugacagagcgagacucuguuucaaaaaaaaaaaaaagugccugcugggcagauacagcuuccaccuggaugguggccuuucagccucucccauguggccaccauacagccaccucugccugagugucaucagccuccuguguucccuccauccccccacaggcaucgacugggcccccgaga

SEQ ID NO: 187980 - RNA, 43 nt, Homo sapiens
uuucaggguuuucaagcuuuuacucuuaauuccuaaaugagau

SEQ ID NO: 187981 - RNA, 37 nt, Homo sapiens
ccuggccgcgggacagcuucuguccaaucauguugag

SEQ ID NO: 187982 - RNA, 45 nt, Homo sapiens
cagaaggggauuaccauaggcagacgccagggugggccugggaag

SEQ ID NO: 187983 - RNA, 41 nt, Homo sapiens
cccuccugugacuuauucccugagacuuuucaggagagcca

SEQ ID NO: 187984 - RNA, 48 nt, Homo sapiens
cugccuuugauacaggcaauucaguggacuauaauaauaguggagggu

SEQ ID NO: 187985 - RNA, 38 nt, Homo sapiens
auaagcaccaauuuuuaauaucuaagucaauuuuuggg

SEQ ID NO: 187986 - RNA, 45 nt, Homo sapiens
ccugcuccuggaaaauggacuggaggccuuuuagaauggucucac

SEQ ID NO: 187987 - RNA, 32 nt, Homo sapiens
acucggggaggcaaaggagccggcaccgccuc

SEQ ID NO: 187988 - RNA, 14 nt, Homo sapiens
aggugguugggggc

SEQ ID NO: 187989 - RNA, 43 nt, Homo sapiens
uuagccagauaaugagguuuaaacgugcacuucuugccuggag

SEQ ID NO: 187990 - RNA, 46 nt, Homo sapiens
ugggaaagacagugcgagguggggguuacucacacaucaggagaag

SEQ ID NO: 187991 - RNA, 46 nt, Homo sapiens
aaucucucccacaaaaacaguuauggugucuagccaggccuugaga

SEQ ID NO: 187992 - RNA, 82 nt, Homo sapiens
gacauugcagagaacaagaugccaggccugaugcgcauaugggagcgguacuccgccuccaagccacugaacggcgcccgca

SEQ ID NO: 187993 - RNA, 78 nt, Homo sapiens
ccaaagcuggcauuucagccagcacuggcauuccaguguugccguugccaaggcuggcaugccuggaagggcgaaaca

SEQ ID NO: 187994 - RNA, 45 nt, Homo sapiens
ccuucagaaucccauugaccaucaucuuguacagguuguggaccc

SEQ ID NO: 187995 - RNA, 48 nt, Homo sapiens
ucuauggcugugggagccccucauaggugguaucaagcaggccacaga

SEQ ID NO: 187996 - RNA, 45 nt, Homo sapiens
aucacgucuguggccugcuugauaccaccuaugaggggcucccac

SEQ ID NO: 187997 - RNA, 46 nt, Homo sapiens
aaggaugaugucaacacaaccugugguggugacaaagacgucgccc

SEQ ID NO: 187998 - RNA, 45 nt, Homo sapiens
caccacagguuguguugacaucauccuuggccagcacuuugagca

SEQ ID NO: 187999 - RNA, 45 nt, Homo sapiens
ccugggcaugucuuguuacugccccuucaagccagaucacuaccg

SEQ ID NO: 188000 - RNA, 44 nt, Homo sapiens
cugggcgagggcugugaagaaagaguaguaagaagcgguagucg

SEQ ID NO: 188001 - RNA, 67 nt, Homo sapiens
auuuuuaguggcuucucuuuguggauuucggaggagauuuuagauccaaaaguuucaggaagacccu

SEQ ID NO: 188002 - RNA, 115 nt, Homo sapiens
aaaauuguguguguguguuuaaguuuccaaagaccuaaauauaugccaugaaacuucagguaauuaacugagaguauauuauuacuagggcauuuuuuuuuuaacugagcgaaaa

SEQ ID NO: 188003 - RNA, 50 nt, Homo sapiens
caguggacugaauuguugaggcuuuauauaggcauucauggguuuacugu

SEQ ID NO: 188004 - RNA, 52 nt, Homo sapiens
uuucaauaauaucccaccuuacuacaguauuuuggcaauagaaggugcgugu

SEQ ID NO: 188005 - RNA, 57 nt, Homo sapiens
cuauaggaaaauaaacaauugacuuuauucuguguuuaccaauuuuaugaagacauu

SEQ ID NO: 188006 - RNA, 94 nt, Homo sapiens
acuguuccauacuuugagcacaaagauaaagccuuuugcuguaaaaggaggcaaaagguaaccccgcguuuauguucuuaacagucucaugaau

SEQ ID NO: 188007 - RNA, 46 nt, Homo sapiens
uaacaaaaaagcuugaaauuuuuauaugacuuauaauacugcugug

SEQ ID NO: 188008 - RNA, 47 nt, Homo sapiens
uuugauguauuguuguuauucccauucuuuaaaugaugcacagagag

SEQ ID NO: 188009 - RNA, 63 nt, Homo sapiens
aaucugagguccagagaucacuucuuggugagagucucacagcuauuaaguauuagagccaag

SEQ ID NO: 188010 - RNA, 42 nt, Homo sapiens
agaccuuagaauucacaggagguauuuguccuucacgcgagu

SEQ ID NO: 188011 - RNA, 58 nt, Homo sapiens
uuguaugguauugauccuuacgucuuaauucccuugaaugugaagaaagaaaccagag

SEQ ID NO: 188012 - RNA, 47 nt, Homo sapiens
aauugcuaaugugcugauagccccauuuugcuugggaauuagagggc

SEQ ID NO: 188013 - RNA, 50 nt, Homo sapiens
cagccugauaggcagauuccauuucaugaugucagauucccaccuccugu

SEQ ID NO: 188014 - RNA, 52 nt, Homo sapiens
ugauauccagaggauugccaccaugaaguugucauuuuuaguggagaggaag

SEQ ID NO: 188015 - RNA, 45 nt, Homo sapiens; identical to SEQ ID NO: 120170

SEQ ID NO: 188016 - RNA, 46 nt, Homo sapiens
ugggucuagcuauugguacucauggugcuaauauucagcaagcuag

SEQ ID NO: 188017 - RNA, 44 nt, Homo sapiens
uuaauggugucagaucuguucuaugaccagucaaagaguuucua

SEQ ID NO: 188018 - RNA, 73 nt, Homo sapiens
uaauaggaaaaaauggaaagcugauucaggagauuguggacaagucaggaguugugagggugaggauugaggc

SEQ ID NO: 188019 - RNA, 46 nt, Homo sapiens
auuaaaagcaaaggugccauuuuacaaagaggacuauaacggcaag

SEQ ID NO: 188020 - RNA, 75 nt, Homo sapiens
gggguccguacuaaaggccaucauuccauucuugccuuucuucauuuuaauuuacuauucaggucuacucgugaa

SEQ ID NO: 188021 - RNA, 95 nt, Homo sapiens
uuuacuuauaagacuucagcaaaugaacuagcugugugacuuuaggcaagucacuucccuacacuagaugcuucuugaaauuccuuuuggccaaa

SEQ ID NO: 188022 - RNA, 46 nt, Homo sapiens
ugagauguuuaugaguggauuggaaggacagugguuagaaaugagg

SEQ ID NO: 188023 - RNA, 40 nt, Homo sapiens
accauaguauauguucuuuuaaaacaaaagauggcccaaa

SEQ ID NO: 188024 - RNA, 88 nt, Homo sapiens
guagaccaguugcguuuggagagauuacaaauugaugagcaguugcgacagauuggagcuaguucuagaccaccaccaaaucguacag

SEQ ID NO: 188025 - RNA, 45 nt, Homo sapiens
auuuuacucaguaacuuuaucuguuccuagacuuauagcugcuaa

SEQ ID NO: 188026 - RNA, 83 nt, Homo sapiens
cuaagucguuaaccccuucaggcauaaugaauuuauuauaguaauucuuuauuaaugaucaauuauuguaaugggagugggag

SEQ ID NO: 188027 - RNA, 46 nt, Homo sapiens
guugccaugguggccuccuuugccacccucucagaaaugaccaaaa

SEQ ID NO: 188028 - RNA, 66 nt, Homo sapiens
aaucuuuuccuccagagaguauagauguuuaaaggaacacagcuauuuaaugauauggcacaucaa

SEQ ID NO: 188029 - RNA, 75 nt, Homo sapiens
ccuuuuuaaaaaugagaaugaaacauguuuauaaccaaaauuaaccucaaauauugcaaagcccuucauuuugag

SEQ ID NO: 188030 - RNA, 72 nt, Homo sapiens
cgucucuggaagcuucuguuaacccucuuuuuuuuuuuuuuaaagucagacaaugguauauaacuuuuaacu

SEQ ID NO: 188031 - RNA, 51 nt, Homo sapiens; identical to SEQ ID NO: 120186

SEQ ID NO: 188032 - RNA, 46 nt, Homo sapiens
auuuccguaauucuuauuccauauuagaaaacuuuguuaggccaaa

SEQ ID NO: 188033 - RNA, 44 nt, Homo sapiens
cagggcagauuuuaguuuuauuuucuaaaguacugagcagugau

SEQ ID NO: 188034 - RNA, 47 nt, Homo sapiens
uauagaagucuucaugaaaugcuaugucauuucauguccugugucag

SEQ ID NO: 188035 - RNA, 52 nt, Homo sapiens
gucauuuucauuagcaaaaaaaguuguaugaucugugccuuuuuuauaucuu

SEQ ID NO: 188036 - RNA, 46 nt, Homo sapiens
uuuguugcacugaaguuugauaaauaguguuauugagagagaugug

SEQ ID NO: 188037 - RNA, 46 nt, Homo sapiens; identical to SEQ ID NO: 120192

SEQ ID NO: 188038 - RNA, 49 nt, Homo sapiens
caaagucaugauguuuuuaaaaucuuauuaaaguuucaaaaaucugaag

SEQ ID NO: 188039 - RNA, 45 nt, Homo sapiens
uuauaauagagccauauaauggaauucugugacauuauuaaagau

SEQ ID NO: 188040 - RNA, 40 nt, Homo sapiens
auuuggauuuccuagcuuaauacuuaaaugggacucccag

SEQ ID NO: 188041 - RNA, 45 nt, Homo sapiens
ucaguauguaacaguagacuugaauguuucuuguuaaggucugcu

SEQ ID NO: 188042 - RNA, 45 nt, Homo sapiens
cuuauccugguaugucugcccauuuauugccgcucucuuuucugg

SEQ ID NO: 188043 - RNA, 49 nt, Homo sapiens
uaaaccaugaauaacaauaaaguaacauuugcuagaaauugguggcuag

SEQ ID NO: 188044 - RNA, 40 nt, Homo sapiens
ucuacauaguacagacugcuugagaaacaaugugaauaag

SEQ ID NO: 188045 - RNA, 30 nt, Homo sapiens
uccucaagucuccaugcaaagacugugcca

SEQ ID NO: 188046 - RNA, 48 nt, Homo sapiens
caagagcuguggcaagccaugucucggccgcgugauggggcagacaug

SEQ ID NO: 188047 - RNA, 45 nt, Homo sapiens
gaucagcacgaugccugccacggugcccccgacgauggcggcgau

SEQ ID NO: 188048 - RNA, 62 nt, Homo sapiens
aaaauaugucagaugagaaugugagcaaacuggaacucuguucuagcaugagucacuauagg

SEQ ID NO: 188049 - RNA, 46 nt, Homo sapiens
ugcaaaaugaaguguccuuuucucaauucccauuuaauuugaucuu

SEQ ID NO: 188050 - RNA, 77 nt, Homo sapiens
uuguaauuuaguaccagccuugagugccuuuucccauucuaggcaaguggcuucaggagaggagcaaaagggaacua

SEQ ID NO: 188051 - RNA, 41 nt, Homo sapiens
caucuaaagagcgaaggcagguuucagagcugagaggucau

SEQ ID NO: 188052 - RNA, 46 nt, Homo sapiens
accuaguggagcucagugucaacccaguaauacaguuuuaggggag

SEQ ID NO: 188053 - RNA, 75 nt, Homo sapiens
ccauuuccucugugggauauaaaaagugauaagguaagguuccagucugaaggaauuuacaagcuuugaggagag

SEQ ID NO: 188054 - RNA, 56 nt, Homo sapiens
uguaacggguuugaagaaacaaagaaggaagcgaaagaggaagucugaaauguuac

SEQ ID NO: 188055 - RNA, 62 nt, Homo sapiens
uuauuuuugucauguuuacuuucaaacaugaaauaaaauugaguucuguuuucaugcaucaa

SEQ ID NO: 188056 - RNA, 39 nt, Homo sapiens
uauucauguuauauggcuuauucuguaagccauauagua

SEQ ID NO: 188057 - RNA, 45 nt, Homo sapiens
uauuuuuaucuccuuuuuuuacaauaaccaaguuagagcacuccg

SEQ ID NO: 188058 - RNA, 45 nt, Homo sapiens
cucuuucuuucuccaguucuccuuggucuguaacaggaaugcccc

SEQ ID NO: 188059 - RNA, 41 nt, Homo sapiens
ggugaagagagggaugggacaaccuaguaggagggagguag

SEQ ID NO: 188060 - RNA, 49 nt, Homo sapiens
uaaccaaacauaacauuauacacaaagaauacuuucauuauuuguggaa

SEQ ID NO: 188061 - RNA, 48 nt, Homo sapiens
ccaauuauaaauuuuaauaaagacuaaacgaaaagguuuggcuguuac

SEQ ID NO: 188062 - RNA, 48 nt, Homo sapiens
cccucaguggaauucugacaagccgaguuuaaaagauauaaagaucau

SEQ ID NO: 188063 - RNA, 43 nt, Homo sapiens
cugaacaucucccauacucuggguggggaaagagugacagaac

SEQ ID NO: 188064 - RNA, 46 nt, Homo sapiens
ggccaaauacagcaauuuugauguugcuacccauguuccccugaua

SEQ ID NO: 188065 - RNA, 56 nt, Homo sapiens
ucgguguccuuuaagaagaggggagagagacacgggaagaacacaugaagauggag

SEQ ID NO: 188066 - RNA, 73 nt, Homo sapiens
guccagaacaaugugcugaaggauccagaggacuguguggaugugagaggaauucaggggcaucaagcagaca

SEQ ID NO: 188067 - RNA, 54 nt, Homo sapiens
gaagggguaguucuggagucaucugccaaggcucaacugagcccagcaggggaa

SEQ ID NO: 188068 - RNA, 46 nt, Homo sapiens
ccgaggucccugauggccuacccccuguggccuacaaccccuggau

SEQ ID NO: 188069 - RNA, 46 nt, Homo sapiens
acugagcaagccauacaguuguuggaaaagaugaaaacgucagcca

SEQ ID NO: 188070 - RNA, 55 nt, Homo sapiens
uauagcuggucuuuuccaccuuaucauccuuccucugagaaguaugaaaacacua

SEQ ID NO: 188071 - RNA, 46 nt, Homo sapiens
gaugauaagguggaaaagaccagcuauacggagaaucaucgguaug

SEQ ID NO: 188072 - RNA, 32 nt, Homo sapiens
uuuuguagaugaggaaacugagccccaaagaa

SEQ ID NO: 188073 - RNA, 43 nt, Homo sapiens
ggcuuggcagccuucugcaggagcucagcuggccagcccaggu

SEQ ID NO: 188074 - RNA, 52 nt, Homo sapiens
ugagggggcugugcuuagguaggggcugcuauccacucuggaaauuaaguca

SEQ ID NO: 188075 - RNA, 43 nt, Homo sapiens
ucuccccugcaggguaccugucaguaaaccuagggguggggug

SEQ ID NO: 188076 - RNA, 53 nt, Homo sapiens
aaaggguagaaagagcuuugcuuccuuucagaaaccacugagggugugcuguu

SEQ ID NO: 188077 - RNA, 48 nt, Homo sapiens
aaagucuuucacccugguacugcuccauguccagagucuggguucucu

SEQ ID NO: 188078 - RNA, 52 nt, Homo sapiens
acgcuggaaacuucuccaccaucccccaguacuucaaggagaauggcuaugu

SEQ ID NO: 188079 - RNA, 55 nt, Homo sapiens
cagaaugccuuugcgcagguaugucugggaaccucuagcugugggugugugcugc

SEQ ID NO: 188080 - RNA, 44 nt, Homo sapiens
gguuggauggaggaagauaaggaggaaaagaugaauagcugaag

SEQ ID NO: 188081 - RNA, 31 nt, Homo sapiens
augggaaagauggggggaaagaggaagggaa

SEQ ID NO: 188082 - RNA, 36 nt, Homo sapiens
uccagcaaauuguggcuacuaauuugcccccugaag

SEQ ID NO: 188083 - RNA, 45 nt, Homo sapiens
ccaccggccuggaggcuacagcugccuccaccuccacccugccgg

SEQ ID NO: 188084 - RNA, 45 nt, Homo sapiens
gcccgugugagaagugaaugcugggacucagccuucagacagaga

SEQ ID NO: 188085 - RNA, 44 nt, Homo sapiens
gcauauucuguucaaguauuuuuuuacaagcuugugcuguaggc

SEQ ID NO: 188086 - RNA, 60 nt, Homo sapiens
acccagagcccugggaaguaugugcucccaccucccaaauuaaauaucgaaaugccagau

SEQ ID NO: 188087 - RNA, 46 nt, Homo sapiens
ucuacgagaauauggaaacauuuccuaugaucuccaucacgaagau

SEQ ID NO: 188088 - RNA, 46 nt, Homo sapiens
cuccaguuuccacucuggggaaagcagagugggaugucagauuugu

SEQ ID NO: 188089 - RNA, 28 nt, Homo sapiens
gcaggcugagccccauuuccccuugcca

SEQ ID NO: 188090 - RNA, 45 nt, Homo sapiens
aaagucaaagauuggaugccgagaaggaaagcagagccuuugggg

SEQ ID NO: 188091 - RNA, 46 nt, Homo sapiens
aguggaguuacugggcugucuuugcuccaauauggcuguggaaguu

SEQ ID NO: 188092 - RNA, 48 nt, Homo sapiens
gggucaaggccgugacugugucaguaucguagccugcauacuuggaau

SEQ ID NO: 188093 - RNA, 61 nt, Homo sapiens
cucuuuaccaggaauguuucccucucuuuuccucuccuccagaccuagugaacuccuauuu

SEQ ID NO: 188094 - RNA, 41 nt, Homo sapiens
cuggcgcuggcgccaugaacccgcuguaaggcgcaggcugu

SEQ ID NO: 188095 - RNA, 47 nt, Homo sapiens
gaauaaucuaugcuaagugcuuagaaaagugucuugcauguaguaga

SEQ ID NO: 188096 - RNA, 25 nt, Homo sapiens
acagcaaaugagaaaguucuuugaa

SEQ ID NO: 188097 - RNA, 43 nt, Homo sapiens
uagacaaagaaguuauuuacauauguccuuucaauggccccau

SEQ ID NO: 188098 - RNA, 57 nt, Homo sapiens
cauagaagacaugcauuuccaauguaugaaaaaccccauacuagccaaugugugcua

SEQ ID NO: 188099 - RNA, 33 nt, Homo sapiens
cuuuggauaaagggcugugauggaagucaguag

SEQ ID NO: 188100 - RNA, 45 nt, Homo sapiens
aguggcccagagaaguugcugguagaauuggagugguuagcagag

SEQ ID NO: 188101 - RNA, 61 nt, Homo sapiens
auucugccugaucuaauugggaagcaaggccucauuagaggugaugcuugcugagccaagg

SEQ ID NO: 188102 - RNA, 46 nt, Homo sapiens; identical to SEQ ID NO: 120293

SEQ ID NO: 188103 - RNA, 41 nt, Homo sapiens
ugucugcagagguguuuauuaaauaauuucaucauuuccag

SEQ ID NO: 188104 - RNA, 45 nt, Homo sapiens
auaguuguuaguauagggccuugaagaauggauuuaauuuccagu

SEQ ID NO: 188105 - RNA, 82 nt, Homo sapiens
uuuaaaggaagcauaguugguuuaaaaaagaguggcaggcauguugagggaagaaaguuuuuaccuuagaauuugaaaaagg

SEQ ID NO: 188106 - RNA, 49 nt, Homo sapiens
ugcagguguuuguuacagccgccuuugguuuucauagucuuugcugcuu

SEQ ID NO: 188107 - RNA, 49 nt, Homo sapiens
gaugauuacaauacccgaagucuuuguggacuuuucuaccacaggugug

SEQ ID NO: 188108 - RNA, 81 nt, Homo sapiens
aaaaugagguaauuuuacauuacuguacccuuaaaugguagauggaagcuuuuuaaaaagaugagugucuuuaauuucaga

SEQ ID NO: 188109 - RNA, 55 nt, Homo sapiens
gaacacugguguucaaagugauuagucugaugacagaggaaaaugguuggggagg

SEQ ID NO: 188110 - RNA, 32 nt, Homo sapiens
ucugugacacuuacccugcucuuuuggugguu

SEQ ID NO: 188111 - RNA, 45 nt, Homo sapiens
aauuuuuuuaagggaaauaaucacacaggucugaaaauaugaaua

SEQ ID NO: 188112 - RNA, 73 nt, Homo sapiens
auuuuuuuccagggaauauauauuuucuaaauaagaagaaaagcuuuuuuuuaaaagagagagcacagguaca

SEQ ID NO: 188113 - RNA, 37 nt, Homo sapiens
uagccaagauauggacucaaccuguguccaucaacag

SEQ ID NO: 188114 - RNA, 45 nt, Homo sapiens
aauacaaacgaaaacuaccgugacauaccaugucacagcccucaa

SEQ ID NO: 188115 - RNA, 46 nt, Homo sapiens
uagaauacauauuacaagaaaacuacaggguccacacggcaaucag

SEQ ID NO: 188116 - RNA, 42 nt, Homo sapiens
uaagaugaauccaaaugugaaagaugcauguuacugccaaaa

SEQ ID NO: 188117 - RNA, 438 nt, Homo sapiens
acucugagaguauucaagucaaaagaaaaaucucaggccuggcgcaguggugcacacccauaaucccagcacuuugggaggccgaggcgggcggaucacuugaggucaggaguuugagaccagccaggccaacauggugaaaucccgucucuacuaaaaauacaaaaauuagccaggcauggugcuguacaccuguaaucccagcuacuugggaggccagagcaggagaaucacuugagccugggaggcagggguugcagugagccaagcucaugccacugcacuccagccugggugacgagcaagacuccgucucaaaaaauaaauaaauaaaaaagaaaaaagucucagcagacaguuaucuguccauggagguacaggcugccucuaucugucuucuucaccacccagaaccaaccaugcccuggccacccaugu

SEQ ID NO: 188118 - RNA, 42 nt, Homo sapiens
gagaucaugaagacccuaggugagagggaugagggagcagga

SEQ ID NO: 188119 - RNA, 43 nt, Homo sapiens
ugcucugguggucaccaggcuucaugugagggacuuugggagu

SEQ ID NO: 188120 - RNA, 45 nt, Homo sapiens
aaagagaaagccccuugauguggcguuuccacaaauagaugucag

SEQ ID NO: 188121 - RNA, 44 nt, Homo sapiens
uucacgugucuugcauccaguuagucaucaaaccagagcuucug

SEQ ID NO: 188122 - RNA, 64 nt, Homo sapiens
accaucgagcgagagugcauggaggagaucugcagcuacgaggaggucaaggaaguguuugaga

SEQ ID NO: 188123 - RNA, 45 nt, Homo sapiens
cccgggucaugguguaccgggguacugugcauagccaaggggagc

SEQ ID NO: 188124 - RNA, 38 nt, Homo sapiens
cugcauucaccagcaucucuggcaucagggagcucugg

SEQ ID NO: 188125 - RNA, 42 nt, Homo sapiens
aaaaaaaauucaacacugccucuagauuguuauuuuguccaa

SEQ ID NO: 188126 - RNA, 71 nt, Homo sapiens
uagcuaauuauagugauuaguauuaguagaguuccguggcgggggguggggggcugugcuuguuucggaau

SEQ ID NO: 188127 - RNA, 45 nt, Homo sapiens
uugcuuuuugccuuggaaggcugcugguuuguaaaacuagcagaa

SEQ ID NO: 188128 - RNA, 43 nt, Homo sapiens
uuguauucucuaaggaugaguucuuuagcuuugcuuaugaguu

SEQ ID NO: 188129 - RNA, 45 nt, Homo sapiens
gacuuuagacaagcacauguuacaccuguguugccacaagcaguc

SEQ ID NO: 188130 - RNA, 52 nt, Homo sapiens
acaguucuuuguaaaaugaccugcgaauuacccuaauucucaaaagcaaaac

SEQ ID NO: 188131 - RNA, 45 nt, Homo sapiens
auuaagaaaaugauaagugaaauugauaaggaagggacaggaaaa

SEQ ID NO: 188132 - RNA, 54 nt, Homo sapiens
ggagcagcgaggcaccccuggcugggaagaucagggaaggcuuccuggaggcga

SEQ ID NO: 188133 - RNA, 46 nt, Homo sapiens
gggcaguguuagagguaagggugggguugaggggacucugggucua

SEQ ID NO: 188134 - RNA, 45 nt, Homo sapiens
augcguucuuuuuccauauuauauuuuccccucugcaacucaagu

SEQ ID NO: 188135 - RNA, 67 nt, Homo sapiens
cuuuuuuuuuccacuugcugagccuuuuuccugccacccuguuggccuccaggcgagagccccuggg

SEQ ID NO: 188136 - RNA, 50 nt, Homo sapiens
cagcccugcccacggucccuaaaucaccguugaagugccccaucccccug

SEQ ID NO: 188137 - RNA, 39 nt, Homo sapiens
agucagccaagugcgugccuugagaaaggacggggugag

SEQ ID NO: 188138 - RNA, 76 nt, Homo sapiens
gaaauaggcagagcauagcgggcaccugaucaggggcacagggggcuggcaccccucguuucugcuguacugggac

SEQ ID NO: 188139 - RNA, 75 nt, Homo sapiens
uaugcaacgccaggcucagcgugguucccuccuccaaggaacaaguccaaacucuggguccacugaaggcagcug

SEQ ID NO: 188140 - RNA, 41 nt, Homo sapiens
gccuccguuugcucaucugaaagaugggcaugggugauaac

SEQ ID NO: 188141 - RNA, 50 nt, Homo sapiens
cuugggcuuggcucagcucuggucagagcagcacagaguagcagccaaag

SEQ ID NO: 188142 - RNA, 45 nt, Homo sapiens
cucagcguguugacugauuuugaggggaaggauguggccaccaag

SEQ ID NO: 188143 - RNA, 47 nt, Homo sapiens
ucacagacauuaccaaagaggagcuugugaauccaggaaaagcucca

SEQ ID NO: 188144 - RNA, 47 nt, Homo sapiens
acuaaugugcgcaauuauaauaaaugguaagauaucacaugugucag

SEQ ID NO: 188145 - RNA, 42 nt, Homo sapiens
gugacucaguuuccucaacuuggugggguguucccugcuaug

SEQ ID NO: 188146 - RNA, 50 nt, Homo sapiens
ccacaggguccagccugucuuuaggaucaucuacacugcaugaggggagc

SEQ ID NO: 188147 - RNA, 66 nt, Homo sapiens
cugccagaaggagccagggcugcugaggaagagcuguggggcagaagugaagccccgcaggggagg

SEQ ID NO: 188148 - RNA, 42 nt, Homo sapiens
cagcccuggcuccuucuggcagaggcaggccccaggcaggcu

SEQ ID NO: 188149 - RNA, 47 nt, Homo sapiens
ggugccugggcuucagauggggaccccagcgaagcaggggcugaaga

SEQ ID NO: 188150 - RNA, 41 nt, Homo sapiens
ggggaaggggcagcuuacacuaacagggaacuugacugggg

SEQ ID NO: 188151 - RNA, 46 nt, Homo sapiens
ggaaacauaggcucagaagaccgaagcacuccuuccccuggcaggc

SEQ ID NO: 188152 - RNA, 48 nt, Homo sapiens
gcguuucacuaauggggguaagccucccuguauggucugggggcugcu

SEQ ID NO: 188153 - RNA, 53 nt, Homo sapiens
aggcagugaugaagaauaaggagaagccaucagggagaggccggggggccucc

SEQ ID NO: 188154 - RNA, 46 nt, Homo sapiens
aggguguccucccaauuuucuggaguuaaugaagcucauucgagau

SEQ ID NO: 188155 - RNA, 50 nt, Homo sapiens
ucgaaugagcuucauuaacuccagaaaauugggaggacacccucgcugau

SEQ ID NO: 188156 - RNA, 46 nt, Homo sapiens
gcagaaagccgugcacaagagccccuugucagugcgcagcacagac

SEQ ID NO: 188157 - RNA, 46 nt, Homo sapiens
cagaucuuuggggauaaagaggacuuuagagccucucaguuuaggu

SEQ ID NO: 188158 - RNA, 97 nt, Homo sapiens
cugaaaguguuuucgggaacugcuuccccuagcccaggcgaagagaccuuugaagacuggcuagagcaggucacugagauaaugcccauauggcaag

SEQ ID NO: 188159 - RNA, 79 nt, Homo sapiens
cuccugggaaguggugguaaaaccccguaacccagaugaugaguuucucaguagacugaacuacuuccugaaagaugag

SEQ ID NO: 188160 - RNA, 45 nt, Homo sapiens
agaaacucaucaucuggguuacgggguuuuaccaccacuucccag

SEQ ID NO: 188161 - RNA, 47 nt, Homo sapiens
cuccugaacauucucccuaggacccuguaugcgcacaggggcuguaa

SEQ ID NO: 188162 - RNA, 46 nt, Homo sapiens
cuuacagccccugugcgcauacaggguccuagggagaauguucagg

SEQ ID NO: 188163 - RNA, 45 nt, Homo sapiens
cuccauggggaugccuacaaucagcagggccuuucugggguccau

SEQ ID NO: 188164 - RNA, 117 nt, Homo sapiens
ugcaggcugugugaaaccugggaccacuucugccuuccuacguggcaguggcucagaguuauuugagugcugucaaacugagcugauugcugcccuaguauuagaucaguccauaga

SEQ ID NO: 188165 - RNA, 61 nt, Homo sapiens
gauucuacuggagcuggcacaagauaucgacuaugcuuugcucccaagggaaauaccagga

SEQ ID NO: 188166 - RNA, 46 nt, Homo sapiens
cucugggggcagcagugcagccucugcuagaacaaauguuguaccg

SEQ ID NO: 188167 - RNA, 46 nt, Homo sapiens
cccaggugcacuggccuuugaugccuggcuugagcacaccacugag

SEQ ID NO: 188168 - RNA, 56 nt, Homo sapiens
ugccagcaggugccagggcuggugaggaagagcuggggggcagagguaaagcccug

SEQ ID NO: 188169 - RNA, 47 nt, Homo sapiens
caaaacuaguaaccagaaaauugaacauguuuggaaaacacaacaag

SEQ ID NO: 188170 - RNA, 46 nt, Homo sapiens
uucccaucagaagacuuaagcugcagguauuuccuuuucuuauaua

SEQ ID NO: 188171 - RNA, 92 nt, Homo sapiens
ggcagaagcuuaaccaagaauauucucagcaguuucugacuuuguuucagcagugggauuuagauaugcagaaagcugaggaacaagaagaa

SEQ ID NO: 188172 - RNA, 46 nt, Homo sapiens
caagggcacggcaagaauucagcagaggaccuggaguucaggugug

SEQ ID NO: 188173 - RNA, 66 nt, Homo sapiens
cgugaauaugugggagcaaaauaauuuuaaacaaaauuuuaaugaguguuuuccauauagggcacu

SEQ ID NO: 188174 - RNA, 46 nt, Homo sapiens
gaaaaucauucagcaggaaauugaacuugcuuggcauacccgggaa

SEQ ID NO: 188175 - RNA, 32 nt, Homo sapiens
uuuuuuuguacagaauucuuauugucagaaag

SEQ ID NO: 188176 - RNA, 55 nt, Homo sapiens
caugauaaucuacuuacuggugcacaaaaugaauuuaaaaaagaaauggcuaugu

SEQ ID NO: 188177 - RNA, 92 nt, Homo sapiens
cagaagcuuaaccaagaauauucucagcaguuucugacuuuguuucagcagugggauuuagauaugcagaaagcugaggaacaagaagaaaa

SEQ ID NO: 188178 - RNA, 46 nt, Homo sapiens
cccaucagaagacuuaagcugcagguauuuccuuuucuuauauagu

SEQ ID NO: 188179 - RNA, 47 nt, Homo sapiens
aaacuaguaaccagaaaauugaacauguuuggaaaacacaacaagau

SEQ ID NO: 188180 - RNA, 45 nt, Homo sapiens
agaugaaugaacuaauggagaaauagaaagucuucagugauggcc

SEQ ID NO: 188181 - RNA, 38 nt, Homo sapiens
cuucccagccccuguggcucgaaaagcagccccaugca

SEQ ID NO: 188182 - RNA, 45 nt, Homo sapiens
cugccaaguccgaggaggaggagaagcuggcggagcuugccaggc

SEQ ID NO: 188183 - RNA, 46 nt, Homo sapiens
ugggugcuccaguugcucgagguaaagguguggauggcccaggugg

SEQ ID NO: 188184 - RNA, 32 nt, Homo sapiens
gaccaggcagggagcacuugcuaguccaagac

SEQ ID NO: 188185 - RNA, 39 nt, Homo sapiens
uggccuugugaggucuuggagagaguggcagacagugca

SEQ ID NO: 188186 - RNA, 59 nt, Homo sapiens
gguggaacaggcuugccuaggcaugcaguuggcauuuauauggugguucugggguuacu

SEQ ID NO: 188187 - RNA, 66 nt, Homo sapiens
gcagugcaggaggcagcgcuggccagaucuggauuuauagaguuggcuggacucgcugagaggaag

SEQ ID NO: 188188 - RNA, 49 nt, Homo sapiens
ccugcagggcuuggggaaaggguggugcugucuugacauaagauggcag

SEQ ID NO: 188189 - RNA, 51 nt, Homo sapiens
guagaaaccgugcuuaaccugguaaugaauguuggauaaaggugagcaaaa

SEQ ID NO: 188190 - RNA, 45 nt, Homo sapiens
agggcaugggcggggcgcggcucggagcgcgaaacauggcggggc

SEQ ID NO: 188191 - RNA, 52 nt, Homo sapiens
cuguccgguguguccggcggaccgaaagcagcuacucacuccugggcaguuu

SEQ ID NO: 188192 - RNA, 46 nt, Homo sapiens
caagcccuggagcaaggaggcgccugggcagagcgaggcugaggga

SEQ ID NO: 188193 - RNA, 46 nt, Homo sapiens
caucguucaucaugaauggcccaucguccagggugaagucccagaa

SEQ ID NO: 188194 - RNA, 46 nt, Homo sapiens
gggcguccuggacccggacucugucacacccaccuacagcgccaug

SEQ ID NO: 188195 - RNA, 46 nt, Homo sapiens
ccgaaaggacacauggcgcuguaggugggugugacagaguccgggu

SEQ ID NO: 188196 - RNA, 92 nt, Homo sapiens
gugcccaaagagaucuccccugacaccacgcugcuggaccugcagaacaacgacaucuccgagcuccgcaaggaugacuucaagggucucca

SEQ ID NO: 188197 - RNA, 46 nt, Homo sapiens
caacaagaucuccaagauccaugagaaggccuucagcccacugcgg

SEQ ID NO: 188198 - RNA, 67 nt, Homo sapiens
guggaugcggagcuccaccagggagcuggguagguugggcgggaucuccaccaggugguucuuggag

SEQ ID NO: 188199 - RNA, 87 nt, Homo sapiens
aucuccaagaaccaccugguggagaucccgcccaaccuacccagcucccugguggagcuccgcauccacgacaaccgcauccgcaag

SEQ ID NO: 188200 - RNA, 54 nt, Homo sapiens
ugaaccuggagccuucgauggccugaagcucaacuaccugcgcaucucagaggc

SEQ ID NO: 188201 - RNA, 78 nt, Homo sapiens
gcagaccucccugagacccugaaugaacuccaccuagaccacaacaaaauccaggccaucgaacuggaggaccugcuu

SEQ ID NO: 188202 - RNA, 54 nt, Homo sapiens
gauggccuggauuuuguuguggucuagguggaguucauucagggucucagggag

SEQ ID NO: 188203 - RNA, 51 nt, Homo sapiens
ccuaggccacaaccagaucaggaugaucgagaacgggagccugagcuuccu

SEQ ID NO: 188204 - RNA, 42 nt, Homo sapiens
ucaccuggaggagcuugaggucugggagcccugagggcaccc

SEQ ID NO: 188205 - RNA, 35 nt, Homo sapiens
gugauguuguuggagugcagauagaccaccugaag

SEQ ID NO: 188206 - RNA, 54 nt, Homo sapiens
gcuucggggugaagcgggccuacuacaacggcaucagccucuucaacaaccccg

SEQ ID NO: 188207 - RNA, 66 nt, Homo sapiens
cugcagcugccucuacuuuuuguaguugccaaacuggauggccaggcggucagugacgcagcggaa

SEQ ID NO: 188208 - RNA, 192 nt, Homo sapiens
ccaccgcggggccucagugggggucucuggggaacacagccagacauccugauggggaggcagagccaggaagcuaagccagggcccagcugcguccaacccagccccccaccucgggucccugaccccagcucgaugccccaucaccgccucucccuggcucccaagggugcaggugggcgcaaggcccgg

SEQ ID NO: 188209 - RNA, 71 nt, Homo sapiens
gcagcucugaggccaagggaacaugugaugggggccgggccuugcgcccaccugcacccuugggagccagg

SEQ ID NO: 188210 - RNA, 102 nt, Homo sapiens
uucucguucacucccaaacccaaguguccaaggcuccaguccuaggagaacagucccugggucagcagccaggaggcgguccauaagaauggggacaguggg

SEQ ID NO: 188211 - RNA, 121 nt, Homo sapiens
uggagcaggggucugggagggacaggccaugaacuugcaagggggcugaggggagccgcagagucggggaggguugaaaggcuggaaaugcaugaggaggaggaacagaacaugugugucu

SEQ ID NO: 188212 - RNA, 58 nt, Homo sapiens
gcaaguucauggccugucccucccagaccccugcuccacuggcccuucgaccaguccu

SEQ ID NO: 188213 - RNA, 45 nt, Homo sapiens
agagagagagagagagagaggaaggacggggaaagagagaacaga

SEQ ID NO: 188214 - RNA, 40 nt, Homo sapiens
ucucucucucucucucuuucugugugugugugugugugug

SEQ ID NO: 188215 - RNA, 81 nt, Homo sapiens
agaaaggucugaggaagcacaagacacacacacacacacacacacacacacacacacacacacacacagaaagagagagag

SEQ ID NO: 188216 - RNA, 32 nt, Homo sapiens
ucccagcucaaggcagaaggccagagggugug

SEQ ID NO: 188217 - RNA, 75 nt, Homo sapiens
agucuccccagccugcccugcucaggccuugcccccaaaccuguacugucccggaggagguugggagguggaggc

SEQ ID NO: 188218 - RNA, 49 nt, Homo sapiens
cugcuucugaggucgguggcugucuuuccauuaaagaaacaccgugcaa

SEQ ID NO: 188219 - RNA, 46 nt, Homo sapiens
cuggagccgcgucucaggacagcuggggccauggaagugucuagaa

SEQ ID NO: 188220 - RNA, 42 nt, Homo sapiens
accgaugcgcgccgacucguacagcucgcggcugcggcaguc

SEQ ID NO: 188221 - RNA, 46 nt, Homo sapiens
cuccgaauccaggccacagcucauggagucgcggucagccucggau

SEQ ID NO: 188222 - RNA, 42 nt, Homo sapiens
gaaguuugggagguugggggugacauugaggauguagcggau

SEQ ID NO: 188223 - RNA, 46 nt, Homo sapiens
gaugccugccccccacugcccugcuccugcgaguggcgcuccucca

SEQ ID NO: 188224 - RNA, 64 nt, Homo sapiens
ccuccccucccuugccacacgagugggcagggacacccguggguggggguggggcaggggccgg

SEQ ID NO: 188225 - RNA, 35 nt, Homo sapiens
aaacgccucucccccaagcagccacugggauccag

SEQ ID NO: 188226 - RNA, 55 nt, Homo sapiens
cucuggguccccauccccugggaggccccagccccgagaggcccaagcccuuggu

SEQ ID NO: 188227 - RNA, 45 nt, Homo sapiens
uucccaagccuggcucgggcacccaguguuccaggcccgggccag

SEQ ID NO: 188228 - RNA, 42 nt, Homo sapiens
ggcugucccuagugcugcaauucccuguuucaggcagcacag

SEQ ID NO: 188229 - RNA, 55 nt, Homo sapiens
gggguggaagcccugggggccuagggccccucugccacccagggaauagggcucc

SEQ ID NO: 188230 - RNA, 43 nt, Homo sapiens; identical to SEQ ID NO: 120504

SEQ ID NO: 188231 - RNA, 46 nt, Homo sapiens
ccagcagacaaagggucaccucccaguugagggccccuggcaccuc

SEQ ID NO: 188232 - RNA, 46 nt, Homo sapiens
ugcuggucuacuucugugucuggaagggggucaaauccacgggaaa

SEQ ID NO: 188233 - RNA, 45 nt, Homo sapiens
accuggucuggccaucuguuaccuaucuugccuuggggacccaga

SEQ ID NO: 188234 - RNA, 42 nt, Homo sapiens
gcuugagauaguaaaugaugccauccagggcgccaggcagca

SEQ ID NO: 188235 - RNA, 29 nt, Homo sapiens
gcccuaccugacucugccaccuuggagau

SEQ ID NO: 188236 - RNA, 101 nt, Homo sapiens
accccacucacaucagucaccauggagagaucgaugacaaagcagagggcacaacagagggccacagagaucucccuuuggaaacggaaguaguaggaggc

SEQ ID NO: 188237 - RNA, 24 nt, Homo sapiens
gaggaggcagcccaggaggugcag

SEQ ID NO: 188238 - RNA, 43 nt, Homo sapiens
caggggccugaccacccugaccccaguguccgagagcagcaag

SEQ ID NO: 188239 - RNA, 66 nt, Homo sapiens
ggagagugucaugugacaacucagcucacaucaccagcucaccucugguagccauagcagccccug

SEQ ID NO: 188240 - RNA, 47 nt, Homo sapiens
guuguuuuagugagcacucauggugcuuucuccccuccucccccagg

SEQ ID NO: 188241 - RNA, 49 nt, Homo sapiens
gcucacuaaaacaacuuuuuccauuuuuaauaaaacgccaaaaauauca

SEQ ID NO: 188242 - RNA, 41 nt, Homo sapiens
uccuaggccccgccuagugccccacccccacccacagugcu

SEQ ID NO: 188243 - RNA, 44 nt, Homo sapiens
ggggugggcguggcaggggcaggaggagugcagcacugugggug

SEQ ID NO: 188244 - RNA, 51 nt, Homo sapiens
uggcagcuugggaaaugugaggaagggaaggagggagagacgggagggagg

SEQ ID NO: 188245 - RNA, 50 nt, Homo sapiens
ugggcuauaccccucuccccaucccuguuauagaagcuuagagagccagc

SEQ ID NO: 188246 - RNA, 33 nt, Homo sapiens
gcgugcgugaguacggagaguauauauagaucu

SEQ ID NO: 188247 - RNA, 35 nt, Homo sapiens
cuuguauauuucuaaaaagaggaaggagcccaaac

SEQ ID NO: 188248 - RNA, 43 nt, Homo sapiens
gcagggcuggggcugggugaggguggcgggccugcggggacau

SEQ ID NO: 188249 - RNA, 53 nt, Homo sapiens
agugcagguggggagcgguggggggggacagggaggaacagagacucaggcag

SEQ ID NO: 188250 - RNA, 45 nt, Homo sapiens
ggguucaccaggagguucgaggcaccgaauggugcuggggaaggc

SEQ ID NO: 188251 - RNA, 40 nt, Homo sapiens
cuaugugagcgauguggucugugggcagaaagaggagguu

SEQ ID NO: 188252 - RNA, 47 nt, Homo sapiens
ccucguuugccccucguguucaugggagcucguuuucuuuuccucua

SEQ ID NO: 188253 - RNA, 42 nt, Homo sapiens
uguccagccucucccgcugcucagguagcggcccagccgggg

SEQ ID NO: 188254 - RNA, 40 nt, Homo sapiens
auacaugccaacacuuggaccuaugacacggaggcccggg

SEQ ID NO: 188255 - RNA, 94 nt, Homo sapiens
cugacgcugucauuuccacugagaccgucuucauuguggagaucucccugacaugcaagaacaggguccaggugagacagugggguuucagaca

SEQ ID NO: 188256 - RNA, 45 nt, Homo sapiens
ggggugccggagagaucagggcacggugaugccagauccuagcca

SEQ ID NO: 188257 - RNA, 41 nt, Homo sapiens
gagggccauacccaaaaaaggccccauuuccuucuuuggac

SEQ ID NO: 188258 - RNA, 51 nt, Homo sapiens
ugaucaaaagggcugagugauuuccugagucuacaagggaggugcuggggu

SEQ ID NO: 188259 - RNA, 38 nt, Homo sapiens
agggggcagaaggugacccugccuuuguucccucaccc

SEQ ID NO: 188260 - RNA, 98 nt, Homo sapiens
gggugccuggcguguggggguggggaggggaggggaaagacagguaggaacaccggcccaagccccagaaaaggaaaggagagaaaugggcaagagac

SEQ ID NO: 188261 - RNA, 42 nt, Homo sapiens
acugaggugcuggcugcggcgaucggccuugugaucuacuac

SEQ ID NO: 188262 - RNA, 45 nt, Homo sapiens
cugcagucuugcucucucugagucacuggggaaacaggugccccc

SEQ ID NO: 188263 - RNA, 46 nt, Homo sapiens
gcggggccgggagggguccgguucaaguuggaguugccggccaugg

SEQ ID NO: 188264 - RNA, 50 nt, Homo sapiens
acaggaggaucggaaggggcuucaggccugguucauuucccugccaagca

SEQ ID NO: 188265 - RNA, 73 nt, Homo sapiens
gcgcccuuuuccuuccucaccugcugggcagggggugauuucaguuuacgagcacgcagcucccccucauucu

SEQ ID NO: 188266 - RNA, 191 nt, Homo sapiens
ccauauacccuucuugucugcucuggaccccgcacuuggcuuguuucggugaagcucagcaaccugggggcagcgucccagcccccucagccuucagaggccaggaggggaaacgggcccugagagaccccugcccacccgcccuccaucaacuccaggucguuggcacaucugugcccuagucacggcca

SEQ ID NO: 188267 - RNA, 72 nt, Homo sapiens
agagcaaaugugugcucaggagagcauggaguggggcagagggagaggggccaggagguuucagagcagcag

SEQ ID NO: 188268 - RNA, 46 nt, Homo sapiens
uacucauggcugauuggggggcugcccaggagaaggugggggucag

SEQ ID NO: 188269 - RNA, 28 nt, Homo sapiens
aagggcucggagcuguccucaggguuuc

SEQ ID NO: 188270 - RNA, 52 nt, Homo sapiens
gggcuccugaagccuucucgcucucucucucucuccuccucaucggucaugc

SEQ ID NO: 188271 - RNA, 30 nt, Homo sapiens
ugcggcugcgggagcagggcggaccacacu

SEQ ID NO: 188272 - RNA, 42 nt, Homo sapiens
cccgcugaucccggcggcgcccacucacccgagacgccuaag

SEQ ID NO: 188273 - RNA, 53 nt, Homo sapiens
ccguggcugguucccacggagcgccaacacccaacagccccaggaugggaggg

SEQ ID NO: 188274 - RNA, 45 nt, Homo sapiens
ccacgcacauauuacaucccauguugcuggccggcgagaggaggc

SEQ ID NO: 188275 - RNA, 44 nt, Homo sapiens
gcgggccgccuagcgggggaggggggcacgcccccgaggugggg

SEQ ID NO: 188276 - RNA, 42 nt, Homo sapiens
cugcuuccacgugccgcggugccuagccaugugcgaggagau

SEQ ID NO: 188277 - RNA, 46 nt, Homo sapiens
cccaccccccgccccccgcccuuccguacuccaccccucaccaggc

SEQ ID NO: 188278 - RNA, 46 nt, Homo sapiens
uagagggauggacaagcugugcuggagaaugugucagaggguggca

SEQ ID NO: 188279 - RNA, 114 nt, Homo sapiens
gugggaggccuuccacucccccacuccccugggcacccuggggcucgacacaccuggagagacagagauucggggaugucccaccuggggaagguggagggccugagggcugga

SEQ ID NO: 188280 - RNA, 41 nt, Homo sapiens
gugcccaugaugcuacugaaccugguggagcagcucgggga

SEQ ID NO: 188281 - RNA, 42 nt, Homo sapiens
ccuggaaggggcugcacccccagacugggagcagaguggggc

SEQ ID NO: 188282 - RNA, 40 nt, Homo sapiens
ugcaauuggugaaguucacacuuucauuguaauuuuagcg

SEQ ID NO: 188283 - RNA, 64 nt, Homo sapiens
guuuccagucaccuaacuucccuuccucaggcucccccggcccacccugcucagugaccccaca

SEQ ID NO: 188284 - RNA, 25 nt, Homo sapiens
cgcugccgcccacccuggggagaga

SEQ ID NO: 188285 - RNA, 45 nt, Homo sapiens
agcaucaccaccuccccacugaggcccuggccccugccgacaguc

SEQ ID NO: 188286 - RNA, 41 nt, Homo sapiens
caaggaaaggugagggcuggcuugcuucucagcccugcugc

SEQ ID NO: 188287 - RNA, 46 nt, Homo sapiens
ggcgacagcgugaacaucaccagcuccagugccaucacgacaaccg

SEQ ID NO: 188288 - RNA, 37 nt, Homo sapiens
aacaugaguucaaaccaagguaagugaagguggccag

SEQ ID NO: 188289 - RNA, 33 nt, Homo sapiens
cccaagcauuaaggaccuuccugcggggcgcca

SEQ ID NO: 188290 - RNA, 46 nt, Homo sapiens
cagugccaaacccgccagaccagcgcgaccagcaccaccaugacug

SEQ ID NO: 188291 - RNA, 42 nt, Homo sapiens
acuacagccaugucgagcgucggcgccaaccaccagcgagau

SEQ ID NO: 188292 - RNA, 46 nt, Homo sapiens
gcccgugucccagcccacccagguaacucugaucacggcaccuagu

SEQ ID NO: 188293 - RNA, 58 nt, Homo sapiens
ggccccgggacagccaggcaccauccuccgcacugugcccaugggggguguucgccug

SEQ ID NO: 188294 - RNA, 72 nt, Homo sapiens
ccaucaucaccaccaaggugaugacuucaggaacuggagcaccugcgaaaaucaucacugcuguccccaaaa

SEQ ID NO: 188295 - RNA, 115 nt, Homo sapiens
gcccaccauccugggcaucagcagcgucucccccaguaccaccaagcccggcacgaccaccaucaucaaaaccauccccaugucggccaucaucacccaggcgggcgccacgggu

SEQ ID NO: 188296 - RNA, 51 nt, Homo sapiens
agcgggaacaauccugaagcuggugaccucagcagauggcaagcccaccac

SEQ ID NO: 188297 - RNA, 66 nt, Homo sapiens
ggcguccacggguccugugacucagaucauccaggugagcucucagucuuugcacauacgcaagag

SEQ ID NO: 188298 - RNA, 63 nt, Homo sapiens
ucugggcaaagugaugucggugguccagaccaaaccaguucagacuucagcagucacaggcca

SEQ ID NO: 188299 - RNA, 46 nt, Homo sapiens
ccacaguugugggcggggucaccaagaccaucacccuggugaagag

SEQ ID NO: 188300 - RNA, 41 nt, Homo sapiens
cacuggccgcugcggccgcugccacccagaagauccccccu

SEQ ID NO: 188301 - RNA, 46 nt, Homo sapiens
ggggggcaguggcaacagccgacagcuaccuucuccagcuccagaa

SEQ ID NO: 188302 - RNA, 87 nt, Homo sapiens
aacccuggaucgucccuagguuuggggcuguuaucucugcccugugcuggcugagugggcugaauuggucugcgggcuuauaagaga

SEQ ID NO: 188303 - RNA, 37 nt, Homo sapiens
gagguagucccaagccagcgcccccucuugcucugcg

SEQ ID NO: 188304 - RNA, 56 nt, Homo sapiens
aggagggccaagcuggagguggaagccacuuugccuugggcuggcccagcucucgg

SEQ ID NO: 188305 - RNA, 58 nt, Homo sapiens
aggcgagccggugggaguggaagagacucaaagcaaagacgcccaaaaacgggccccc

SEQ ID NO: 188306 - RNA, 39 nt, Homo sapiens
gucugauuucccucuuucuugguggucgccucacccuca

SEQ ID NO: 188307 - RNA, 31 nt, Homo sapiens
ugccaggugugaggggagucaaguuugagga

SEQ ID NO: 188308 - RNA, 59 nt, Homo sapiens
gcacagagucgggguugcaccuggcccccaguuugggguuucuggaaagagugugguga

SEQ ID NO: 188309 - RNA, 46 nt, Homo sapiens
aaggauuggguuacaugacaccccccagaugauucaggggugacug

SEQ ID NO: 188310 - RNA, 69 nt, Homo sapiens
ggggagcuggaguggucuucaucuagugcaggguccuuuccccaccuuccccucccagcugagagccag

SEQ ID NO: 188311 - RNA, 45 nt, Homo sapiens
cagguagaacagagaggaaggcagcucguugaacuugaccggcca

SEQ ID NO: 188312 - RNA, 46 nt, Homo sapiens
auugaccacuuuggcaugaauucauuaccagucugcaaagacaggu

SEQ ID NO: 188313 - RNA, 28 nt, Homo sapiens
agcucaguaagcuaaggcuucuccagug

SEQ ID NO: 188314 - RNA, 31 nt, Homo sapiens
gcggccugcguagucgugugucuccccgcuu

SEQ ID NO: 188315 - RNA, 39 nt, Homo sapiens
ugcccauucuggagaaaugaccauuucuagauuacagau

SEQ ID NO: 188316 - RNA, 46 nt, Homo sapiens
gacuggugagggagaggggcugucgccagcgguggugacuucagac

SEQ ID NO: 188317 - RNA, 62 nt, Homo sapiens
ggccaccgcgccguggccaucaaggagcucaucgugguguuuggcggcggcaacgagggaau

SEQ ID NO: 188318 - RNA, 64 nt, Homo sapiens
gcugugugagaaaccgcuucuccgugagagcugccuuagacgaaagggggugugugaaaggaau

SEQ ID NO: 188319 - RNA, 48 nt, Homo sapiens
ccucccgcccgagcuuguaagcgggagcgcccggacaaguagucgggg

SEQ ID NO: 188320 - RNA, 51 nt, Homo sapiens
ccggcccgccuccauucguuaggugugucgaggcuguuucgggagcggcgg

SEQ ID NO: 188321 - RNA, 46 nt, Homo sapiens
aggcccaagaccuaguuacccagacagugagaagccccuggaaggc

SEQ ID NO: 188322 - RNA, 30 nt, Homo sapiens
gcucugugggcauaggcaggcagaguggaa

SEQ ID NO: 188323 - RNA, 47 nt, Homo sapiens
cugcaucaucgucgucagagccaccgcagauuaucaucaacccugcc

SEQ ID NO: 188324 - RNA, 45 nt, Homo sapiens
gcuaagggagugccaucuccaccccaggacuggcccuuggcagcu

SEQ ID NO: 188325 - RNA, 41 nt, Homo sapiens
uccauggcagccccuggcagcgccaucaggagccagugccc

SEQ ID NO: 188326 - RNA, 44 nt, Homo sapiens
ccugggccagcuggccugcugcugccugcaccgccgggccaaaa

SEQ ID NO: 188327 - RNA, 45 nt, Homo sapiens
aggucuggcugcagaugccugggcugcucccaucgccaugcagau

SEQ ID NO: 188328 - RNA, 46 nt, Homo sapiens
ucugcauggcgaugggagcagcccaggcaucugcagccagaccugc

SEQ ID NO: 188329 - RNA, 45 nt, Homo sapiens
ggcuggucagagggcugugaagacgcacggugccaggaccaagua

SEQ ID NO: 188330 - RNA, 58 nt, Homo sapiens
gggacugaagcucgggcaacucggagagcccacuugaagacaaauuacaaacacacag

SEQ ID NO: 188331 - RNA, 42 nt, Homo sapiens
cgggcagguaggccagggugccccgcacugucuguguccggg

SEQ ID NO: 188332 - RNA, 30 nt, Homo sapiens
ggccagagggggagccacaccaggucccgu

SEQ ID NO: 188333 - RNA, 46 nt, Homo sapiens
gcguguaccgggcggugaugaggaacacgguguaugcugugaagag

SEQ ID NO: 188334 - RNA, 81 nt, Homo sapiens
aaggcugaauuccuuccuccuugucucgaaucuucccuggggggcaggggacaccuaccuugguagaagaaggggcuggag

SEQ ID NO: 188335 - RNA, 45 nt, Homo sapiens
ccgagcucaggcccugaaugggucugggagccuggaaaagcuuca

SEQ ID NO: 188336 - RNA, 26 nt, Homo sapiens
ugguggagguaauuuuggccgugaug

SEQ ID NO: 188337 - RNA, 44 nt, Homo sapiens
aaaagacccuuucuaaacaagagaugcagucugcuggaucacgg

SEQ ID NO: 188338 - RNA, 45 nt, Homo sapiens
guggaugcagcaaugugugcucgaccacacaagguugaugggcgu

SEQ ID NO: 188339 - RNA, 42 nt, Homo sapiens
gaaaacuuucugugagacaucacgcagucaaaucccgccggu

SEQ ID NO: 188340 - RNA, 44 nt, Homo sapiens
ugcugggcugucgacuucccucaugaugugggucaugccagcuu

SEQ ID NO: 188341 - RNA, 51 nt, Homo sapiens
agaagagaacuagugggugguuguguacaggacccccaucccucaccccuc

SEQ ID NO: 188342 - RNA, 55 nt, Homo sapiens
cuucuuugguucugggaggggugagggauggggguccuguacacaaccacccacu

SEQ ID NO: 188343 - RNA, 36 nt, Homo sapiens
ccccaagccugccccgcuacccaagcagccccgccc

SEQ ID NO: 188344 - RNA, 24 nt, Homo sapiens
cggggcaggcuugggggcugccgg

SEQ ID NO: 188345 - RNA, 45 nt, Homo sapiens
gccuuccagaccugcuccguaagcagacaccaagccugggucccc

SEQ ID NO: 188346 - RNA, 44 nt, Homo sapiens
caaugacuaccaacguuggccacugaaggagcccgacgccugcg

SEQ ID NO: 188347 - RNA, 42 nt, Homo sapiens
ccuugggcuggaggccccggccaaccgcccggcaggcacucg

SEQ ID NO: 188348 - RNA, 30 nt, Homo sapiens
cgaaggugaaagcgugaggagagagaugga

SEQ ID NO: 188349 - RNA, 41 nt, Homo sapiens
auggagauggaguagugcaggaucaggguccagaugaggcc

SEQ ID NO: 188350 - RNA, 52 nt, Homo sapiens
uguuccaggguggguggggugaggcaggggaagugggggaguugggcaaacg

SEQ ID NO: 188351 - RNA, 85 nt, Homo sapiens
cugguugugcuugcggugcaucuucuucuggcugagcaccuccaacagcgcgauaagccgcagcccgucgcucagguccgucugc

SEQ ID NO: 188352 - RNA, 46 nt, Homo sapiens
aggcaccuaggcgcgcgggaggcgaggcagggagcagagguugcgc

SEQ ID NO: 188353 - RNA, 46 nt, Homo sapiens
ugguucuuacgcgcgcagacagaccgccuauauaagccaugcgcag

SEQ ID NO: 188354 - RNA, 45 nt, Homo sapiens
aaggcaaaaguggaugaguuuccgcuuuguggccacaugguguca

SEQ ID NO: 188355 - RNA, 41 nt, Homo sapiens
aaguuguggcaaagauggcuuccauauccgggugcggcucc

SEQ ID NO: 188356 - RNA, 43 nt, Homo sapiens
cgcagccuguugguuguauggguugcucuaagggaccuuggag

SEQ ID NO: 188357 - RNA, 45 nt, Homo sapiens
aggguucacauuggccaaguuaucauguccauccgcaccaagcug

SEQ ID NO: 188358 - RNA, 47 nt, Homo sapiens
uagauccacaucucaaagaaguggggcuucaccaaguucaaugcuga

SEQ ID NO: 188359 - RNA, 43 nt, Homo sapiens
gugcugccccccucuuaauacucaccaauaaauucuacuuccu

SEQ ID NO: 188360 - RNA, 58 nt, Homo sapiens
agaagggaaaccagagacgagagggaaagugagacagagacggacagagccucagaga

SEQ ID NO: 188361 - RNA, 40 nt, Homo sapiens
gcccacauacccauguauaucccagaauaggcaccagggu

SEQ ID NO: 188362 - RNA, 28 nt, Homo sapiens
uacgagcucaucgagaagcgaggcccgg

SEQ ID NO: 188363 - RNA, 79 nt, Homo sapiens
uggagggaccuauggggguaggcaucccgggagccaacaugaggcccagcuccaucacaugccagcagaggggacagag

SEQ ID NO: 188364 - RNA, 45 nt, Homo sapiens
cugcuuggaaaaauucugcuccugcagaggaaggagcaaucugga

SEQ ID NO: 188365 - RNA, 48 nt, Homo sapiens
uuccuggcaccgagacauuaaaaugagagcagaggaagucaggcuggg

SEQ ID NO: 188366 - RNA, 44 nt, Homo sapiens
agggggcccaccagagcuguggagaggggacccuaagacuccuc

SEQ ID NO: 188367 - RNA, 42 nt, Homo sapiens
ugauggcggccauggcgacggcucgagugcggauggggccgc

SEQ ID NO: 188368 - RNA, 43 nt, Homo sapiens
uacaauguuucacuacaguugauagauaccacuuugguuccag

SEQ ID NO: 188369 - RNA, 78 nt, Homo sapiens
aagagcugguguggcuggagcacagugagugagagaaagggguaggagauguaggagaugguuugcagguggcuaggc

SEQ ID NO: 188370 - RNA, 27 nt, Homo sapiens
gggcgaguguguauaccaaacagguua

SEQ ID NO: 188371 - RNA, 119 nt, Homo sapiens
cuguagggugggcaaggcggcugacuccuacuccugaguuaccacaagucagcugccugcagaucuccccaccccaugacugccuuccaugucuucucacccugcccugagagugcugg

SEQ ID NO: 188372 - RNA, 34 nt, Homo sapiens
ccagccucccugcucugcugcucauucgccugcc

SEQ ID NO: 188373 - RNA, 49 nt, Homo sapiens
agugugcaggcuuggugcguggggcuaguggggaggagaagcugggguc

SEQ ID NO: 188374 - RNA, 62 nt, Homo sapiens
uggcagacuuggacacuaagucuaaaugacccuaaguuugagggacuaggaaugucaucagg

SEQ ID NO: 188375 - RNA, 105 nt, Homo sapiens
gucauuguaacucacaggaggauggaucacaggugauacuggcuguuuuuguagcagcuggcgaccuagcccuccggccaccacggcuacaucacgggccaccug

SEQ ID NO: 188376 - RNA, 46 nt, Homo sapiens
caccugugauccauccuccugugaguuacaaugacaccgcuccccg

SEQ ID NO: 188377 - RNA, 45 nt, Homo sapiens
cuguggacuucgaggcgcuccaugguaaaccagugccgggcagac

SEQ ID NO: 188378 - RNA, 45 nt, Homo sapiens
caggucacagggcccagcaucuacuccuuccacugcgaguauguc

SEQ ID NO: 188379 - RNA, 71 nt, Homo sapiens
cccccauuacguugaaagccuggaucuggcagacacacagacacgggucagaaaggaccguugggaggccc

SEQ ID NO: 188380 - RNA, 41 nt, Homo sapiens
uccuacgccagcgacugugccagcuucuucucccccggcau

SEQ ID NO: 188381 - RNA, 86 nt, Homo sapiens
gaagagcaugaacagggaggugagcagccccauccagaugccgggggagaagaagcuggcacagucgcuggcguaggagaacugcu

SEQ ID NO: 188382 - RNA, 48 nt, Homo sapiens
ucagccucaagaccauggaucgcuuugaugaccacaagggccccacua

SEQ ID NO: 188383 - RNA, 43 nt, Homo sapiens
ugcaagcuccccucagcccaucuugcucccucuucagcccgcu

SEQ ID NO: 188384 - RNA, 80 nt, Homo sapiens
gaugggggcagcccaagaaagcuccucagcgggcugaagagggagcaagaugggcugaggggagcuugcaguucaugcug

SEQ ID NO: 188385 - RNA, 35 nt, Homo sapiens
uagggucuccuuucuccuuauuuauucuuguggcu

SEQ ID NO: 188386 - RNA, 57 nt, Homo sapiens
acuacuuaacugucuguccugcuuggcugucguuaucguuuucuggugauguugugc

SEQ ID NO: 188387 - RNA, 44 nt, Homo sapiens
ucgccggcuguuuggcauguucccaccgggagugccgggcagga

SEQ ID NO: 188388 - RNA, 43 nt, Homo sapiens
acauuccagucucggccucggcccaucgacucagggggccccu

SEQ ID NO: 188389 - RNA, 45 nt, Homo sapiens
gaugucauccacagguuuguucagcauauauguccccccauagau

SEQ ID NO: 188390 - RNA, 40 nt, Homo sapiens
aggguuaaggauuuggucaguggaucaaugagguggguga

SEQ ID NO: 188391 - RNA, 27 nt, Homo sapiens
acacgcgagaguuggugggggggaggu

SEQ ID NO: 188392 - RNA, 32 nt, Homo sapiens
ugggucaaaguuaauaaauuagaauaaauuag

SEQ ID NO: 188393 - RNA, 46 nt, Homo sapiens
agaagcgggagaagcagcgcgagcagauggagcagaugaagcagcg

SEQ ID NO: 188394 - RNA, 46 nt, Homo sapiens
ggaagcuggagaagcuucgagagaaggagcguaagaaggaagccaa

SEQ ID NO: 188395 - RNA, 62 nt, Homo sapiens
cuucacccuggaggaggaagaagagggaggcgaggaggaagaggaggcggccauguaugagg

SEQ ID NO: 188396 - RNA, 41 nt, Homo sapiens
gacguugacacaagcuucuugccugaucgagaccgugaggu

SEQ ID NO: 188397 - RNA, 44 nt, Homo sapiens
ccuucagcuacugggauggcucugggcaccggcggacagucaag

SEQ ID NO: 188398 - RNA, 46 nt, Homo sapiens
ugcugaggagcugguacgagaagaacaagcacaucuuucccgccag

SEQ ID NO: 188399 - RNA, 24 nt, Homo sapiens
aucacagguacagcugggccagca

SEQ ID NO: 188400 - RNA, 59 nt, Homo sapiens
gggugcuccaggaaauugguggcugcggagggagacagaggagggacagcagggagcga

SEQ ID NO: 188401 - RNA, 44 nt, Homo sapiens
cugggcucaguguuugggccgcuucucccuccacacccacuugu

SEQ ID NO: 188402 - RNA, 43 nt, Homo sapiens
ggaaaaaacauuccaugaacaaagaaaaacucaugcaacuaaa

SEQ ID NO: 188403 - RNA, 74 nt, Homo sapiens
acaauaaaggcaauuuguuuaaucaguuaacggaaauuucuuggcuuaugaaagugaaaaguccagugguauug

SEQ ID NO: 188404 - RNA, 50 nt, Homo sapiens
gguaacccugggcauccucuucaggcccaguugcucccagccccuaccuc

SEQ ID NO: 188405 - RNA, 41 nt, Homo sapiens
gaggcuggccgacuccccacccccgcaggucuggcagcuga

SEQ ID NO: 188406 - RNA, 42 nt, Homo sapiens
agaugggaaacgacucucggauuauagcaucgggcccaacuc

SEQ ID NO: 188407 - RNA, 31 nt, Homo sapiens
gccgcaugccucacagccggaugccgcagcg

SEQ ID NO: 188408 - RNA, 45 nt, Homo sapiens
gugauggccccacagaagaaaugccuucagaugcuguugucagug

SEQ ID NO: 188409 - RNA, 45 nt, Homo sapiens
aguacgaaggcuggcccgaggcgcuggagauggaaggcuguaucc

SEQ ID NO: 188410 - RNA, 58 nt, Homo sapiens
ucaucaguggccuuggcaacaagcugauuuggugaggugguggaagccaggccagacu

SEQ ID NO: 188411 - RNA, 89 nt, Homo sapiens
agagauugggucaggagagugugcuguccggaaagccagcagagaaguuagugcuucugucagguggacaugggcagcccacugagagg

SEQ ID NO: 188412 - RNA, 62 nt, Homo sapiens
aaggacagguuugggugggggucaggggcaagccugugcgggaccccugcugggggcgggcg

SEQ ID NO: 188413 - RNA, 41 nt, Homo sapiens
cacaggagccuccggggcugggacgaagaugugguucuccu

SEQ ID NO: 188414 - RNA, 63 nt, Homo sapiens
cucgggccguuccuccgggccugggggcuggcgaugcgggccgggccggagauuucucuggcc

SEQ ID NO: 188415 - RNA, 95 nt, Homo sapiens
ugggcucggucagggagguucccugucaggcccgccgacccgcuccgcccccggagaggacgcaaggccgcugcgcaggguggccaggcaggccc

SEQ ID NO: 188416 - RNA, 55 nt, Homo sapiens
aggcagccucucugcuauaagaaaagcagacgcagcagcugggaccccucccaac

SEQ ID NO: 188417 - RNA, 46 nt, Homo sapiens
uggccuugcccgccagccucagugccacuugacauuccuugucacc

SEQ ID NO: 188418 - RNA, 29 nt, Homo sapiens
cugggucucacuccugaguggggccaggg

SEQ ID NO: 188419 - RNA, 86 nt, Homo sapiens
agcucugggacagacgaaugggcgcccuccuccuuccuucuguugggcuggagugaguggaggaggugacucagcuccugggcuca

SEQ ID NO: 188420 - RNA, 24 nt, Homo sapiens
ccuucccgccgcccgaccccgagu

SEQ ID NO: 188421 - RNA, 32 nt, Homo sapiens
uccucccgacucggggucgggcggcgggaagg

SEQ ID NO: 188422 - RNA, 42 nt, Homo sapiens
caccccacugcugcaccagauugagcuggagaagcccaagcc

SEQ ID NO: 188423 - RNA, 51 nt, Homo sapiens
gcucaaucuggugcagcaguggggugaaaauacgccaggccucacggagcu

SEQ ID NO: 188424 - RNA, 41 nt, Homo sapiens
augaugaccaagaagccgggcauguucuucaaccccgagga

SEQ ID NO: 188425 - RNA, 46 nt, Homo sapiens
aggccaacaaugugguccugggccaguacguggggaaccccgaugg

SEQ ID NO: 188426 - RNA, 45 nt, Homo sapiens
ggaaccgcaucaucguggagaagcccuucgggagggaccugcaga

SEQ ID NO: 188427 - RNA, 45 nt, Homo sapiens
ggucacaggccaaccgccucuucuaccuggccuugcccccgaccg

SEQ ID NO: 188428 - RNA, 45 nt, Homo sapiens
augaagguguuuucgggcagaaggccaucccggaacagccaccug

SEQ ID NO: 188429 - RNA, 48 nt, Homo sapiens
uguuccaggaaagcagcccauucuccguucauugagcagacagcgauu

SEQ ID NO: 188430 - RNA, 47 nt, Homo sapiens
cugcugggggggagaugggagguggcgugcucaggcagcaccuggaa

SEQ ID NO: 188431 - RNA, 1008 nt, Homo sapiens
ggguuuaacggucagaguccuggcuguuaagguuuguggcugaugcagguauggcucuuuuuauuuuuauuuuuuugagauggagucucacucacuccgucacccaggauggagugcaauggugccaucucagcucacugcaaccuccaccuccuggguucaagcgauuuuccugccucagccucccaaguagcugggauuacagaugggugccacuacaccuaacuaauuuuuguuauuuuuuuuuuuuuuuugagauggagucucacucugucacccaggcuggaaugcaguguugcgauuucugcucacugcaagcuccgccucccgaguucacgccuuucuccugccucagccuccugaguagcuggacuacaggugcccacaccaggccuggcuaauuuuuuauuuaguagagacgggauuucaccauguuagccaggauggucucaaucuccugaccucaugauccacccgcuucagccucccaaagugcugggauuacagacgugagccacugcgcccggccuuuuuguuuuguuuuguuuugagacagagucucgcucugucgccaggcuggagugcaguggcgcgaucucagcucacugcaaccucugacucccugauucaagcgauucuacugccucagccuacugaguagcugggacuacaggcacgcaccaccacgcccagcuaauuuuuguauuuuuaguagagaugggguuucaccauguuggccaggauggucucgaucucuugaccuugugaucugcccaccuuggccccccaaagugcugggauuacagaugugagccacugcgcccagccaauuuuuguauuuuaaguagagacuggguuucgccauguuggccaggcuggugucaaacuccugaccucaggcgauccaccugccucggccucccaaagugcugggaauacaggcgugagccaccgugcccggccagguauggcucuucugaggggaccaggcuggggcuggggcugagg

SEQ ID NO: 188432 - RNA, 35 nt, Homo sapiens
auggccccuccuuacucugccacuggcagagcccu

SEQ ID NO: 188433 - RNA, 41 nt, Homo sapiens
aggugugcgggauccugcgggaagagcuuuuccagggcgau

SEQ ID NO: 188434 - RNA, 68 nt, Homo sapiens
cugcuccgcgcuucuggagcacuggccaaggcgggccgauucaggacccagguuacuugggcggcgag

SEQ ID NO: 188435 - RNA, 44 nt, Homo sapiens
gaguuccucaugugcaaguuccaggaggccaggaaacuggugga

SEQ ID NO: 188436 - RNA, 119 nt, Homo sapiens
auuuccugugugggaaguggaugaguuuucuacagcugccgugaccaagcaccacagacugcggggccgaagccacagaaacgcguggccucccgcuucuggaggccuggaggcugagc

SEQ ID NO: 188437 - RNA, 56 nt, Homo sapiens
ugcuucugcccuccagacagauggaucagcugccaggggggccccagccaucccag

SEQ ID NO: 188438 - RNA, 45 nt, Homo sapiens
aaaauacuagcuuuuaggaaaacgauauuaacugccuggugacca

SEQ ID NO: 188439 - RNA, 69 nt, Homo sapiens
aacagcagcuccagcaggccgaggaggcccugguggccaaacaggaggugaucgauaagcugaaggagg

SEQ ID NO: 188440 - RNA, 45 nt, Homo sapiens
agcacaagauugugauggagaccguuccggugcugaaggcccagg

SEQ ID NO: 188441 - RNA, 40 nt, Homo sapiens
uuuucccagccuaccucuccucuccccuggcccugcccag

SEQ ID NO: 188442 - RNA, 84 nt, Homo sapiens
gcagccagaccgauguguauuuaaccagucacuauugauggacauuuggguuguuucccaucuuuuuguuaccauaaauaaugg

SEQ ID NO: 188443 - RNA, 43 nt, Homo sapiens
gaauccacccugaggcuuccucacagggcuuccugcuauuuga

SEQ ID NO: 188444 - RNA, 46 nt, Homo sapiens
caaucucuggcacuaggggaucaucuggguuuggaucacauagcag

SEQ ID NO: 188445 - RNA, 75 nt, Homo sapiens
uaccccuucaaaccaucuaagguugcauuuacaacaagaauuuaucacccaaauauuaacaguaauggcagcauu

SEQ ID NO: 188446 - RNA, 70 nt, Homo sapiens
gggugauaaauucuuguuguaaaugcaaccuuagaugguuugaagggguagucuguaggaaaacgaauug

SEQ ID NO: 188447 - RNA, 45 nt, Homo sapiens; identical to SEQ ID NO: 120778

SEQ ID NO: 188448 - RNA, 64 nt, Homo sapiens
gacgacaagcacacacuauggcgcugaaacggauuaauaaggaacuuagugauuuggcccguga

SEQ ID NO: 188449 - RNA, 69 nt, Homo sapiens
gccccgccgccaggauaaucaagaguuuuggccggaccuuugagcauacacugagagagugaggagcca

SEQ ID NO: 188450 - RNA, 22 nt, Homo sapiens
gcggaccaugcagcgcuuuggg

SEQ ID NO: 188451 - RNA, 108 nt, Homo sapiens
aggcggcccauggagacaugggggacauccaaggaugagcccuaaggagcgccaggugcgcugggccggucucugccugaggggcuguguaauggcagggcucccaag

SEQ ID NO: 188452 - RNA, 67 nt, Homo sapiens
ccggccuugucucucggcccuggcuccguggcaagggcgcgagagugggagccccucgcggugacuu

SEQ ID NO: 188453 - RNA, 79 nt, Homo sapiens
cagugucugugcugcugccagcccggacgccgccguuacagcuccaugcgacuaggggagcaaggguaguggaaacggg

SEQ ID NO: 188454 - RNA, 45 nt, Homo sapiens
agagcuccgaguugcaagaaaguucuagaggccacaagcccgcgg

SEQ ID NO: 188455 - RNA, 1202 nt, Homo sapiens
ugggacccauacauuuggccuuacacaccuuguuuucucgcuuaccuacggauauacguucuaagaaaugggucguuaggcgauuucaucauugugugaacaucagagggcucuuacacaaaccuagguggcauaggcuacuacacaccuaggcuguauaugguguagcguauggcuccuaggcuucaaaccuggacagcaugguauugugcggaaugcuguaggcaguugggacacagcgucgagaguuuguguacuuaaacaugucuaagcagaaaaaggacaguaaaaauauagcacagggccgggcgcgguggcucaggccugugaucccagcccaggcuggcggaucaccugcggucaggaguucaagaccagccuggccaacauggugaaaccccgucucuacuaaaaauacaaaaaauuuaggugggcguggugguauacgccuguaaucccagcuacucgggaggcugaggcaggagaauugcuugaaccuggagaaggagguugcagugagccgaguuucugccacugcacuccagccuggggaaagagugugaccgucucaaaaaaaaaaaauuauauauauauauaaauauguguguguauauauguauauuauauauguauguauuauauguauguauauuauauauauauaguacacaagguuauaaguggugcacccguagaggagggcacuuaccaugaauggagcuugcugagcuggaaguugcccugguugagucggugacugaaugugaaggccucagacauuacacuacuggagacuuuauaaucuguacaccuaggcuacacuaaauuuauaaaaauauauuuuucuucagaauaaaucaaccuuagcuuacuguaacuuuauaaacuuuuuacuucgacuguuguaauaauacuuagcuuaaaacaaacacauuauuuagcuguacguaaauauuuucucugcuuaucuccuuauuuauaaguuuucuauuuuaaaauuuuuuaauuuuuuucuuaaaaaauuuuuuuuuguuaacuaagacacaaacacagcacacacaguagccuugaccuacacagggucaggaucaucaagacaucacuaggagauaggaauuuuucagcucuguuauaaucuuaugggggccaccaucacauacgcagucuguacuugcaaaacauuauguggcaugugacuguaa

SEQ ID NO: 188456 - RNA, 48 nt, Homo sapiens
acgagccacucgcuuggugaagucacaacagagugcagguauguggga

SEQ ID NO: 188457 - RNA, 69 nt, Homo sapiens
cacuuauugcugcaguaaagaggcagcuccgagugaggaccaucuacgagagcaaaaugauugaauacg

SEQ ID NO: 188458 - RNA, 44 nt, Homo sapiens
uucuggagucaugagugaaaagguauguguuacggggcuagaag

SEQ ID NO: 188459 - RNA, 45 nt, Homo sapiens
ugaugugcuugaugcucaguggcuguaugauaaccacaaggauga

SEQ ID NO: 188460 - RNA, 47 nt, Homo sapiens
cggcauugaggucaaucaggagauugugguuaucaccaccaaaggag

SEQ ID NO: 188461 - RNA, 47 nt, Homo sapiens
aggccuccuucucauaauggaguauuuccuccauaugcacauccuga

SEQ ID NO: 188462 - RNA, 72 nt, Homo sapiens
ugaccacagcggucaucucuaccugcgaccaugguauaguagccaagaucaagagagugaucauggagagag

SEQ ID NO: 188463 - RNA, 56 nt, Homo sapiens
ggagucuggucaagggauugucuguuaagccacaccggugugaagaguggguuagg

SEQ ID NO: 188464 - RNA, 38 nt, Homo sapiens
gugaggaacaggugagcauggagguuguagagcccagg

SEQ ID NO: 188465 - RNA, 46 nt, Homo sapiens
agucagucugcaacaguaaguggugaguucuucuguccagcgucag

SEQ ID NO: 188466 - RNA, 46 nt, Homo sapiens
agugguaaaagccccgcagguaguugccgaagcagcaaaaacugcg

SEQ ID NO: 188467 - RNA, 55 nt, Homo sapiens
gaaucagaugggccucgacuccuaccucagcuauggcagcaacacagugauggaa

SEQ ID NO: 188468 - RNA, 58 nt, Homo sapiens
ugaaagugacgagacuccuccagcagcuccucaguugaucaagaaggaaaagaagaag

SEQ ID NO: 188469 - RNA, 49 nt, Homo sapiens
gacagugauaccaccaagaagaagaagaagaagaagaaagcaaaagagg

SEQ ID NO: 188470 - RNA, 65 nt, Homo sapiens
ggaggagaaacuaaagccuuauugagaaaacauguuauagauccuuuuguugcugagagagugga

SEQ ID NO: 188471 - RNA, 70 nt, Homo sapiens
aguuugcauuuuuuaaauccccucuguuuaaaagguuuguaaaacaaaaacaaaaaacuaagucugcuca

SEQ ID NO: 188472 - RNA, 47 nt, Homo sapiens
ccuguuggguuuucuuguugaucucaugcuagcagagcaaaaauugu

SEQ ID NO: 188473 - RNA, 48 nt, Homo sapiens
gcguuuuuaacugcaacuuucuauaaugccaaaaugacacaucugugc

SEQ ID NO: 188474 - RNA, 42 nt, Homo sapiens
ggucaauaacucagcagaaaaaugagcuaaggguaugaccag

SEQ ID NO: 188475 - RNA, 45 nt, Homo sapiens
uuggcaccaaauuugaaacagugcaccagauccauaagcagaaca

SEQ ID NO: 188476 - RNA, 93 nt, Homo sapiens
uuuggguucuuguacacagauacaacacggccgccaaggaagagugaggaagaugggaaggaguaccacuuuaucucaacggaggagaugacg

SEQ ID NO: 188477 - RNA, 49 nt, Homo sapiens
gaagagcugaugcuagaaagugaugcacaccaggaaaucccuccaucug

SEQ ID NO: 188478 - RNA, 45 nt, Homo sapiens
cggauucuggcugagcagggcauucuuaauguggcugcgacccac

SEQ ID NO: 188479 - RNA, 45 nt, Homo sapiens
aagggacaggaggugcggaaagugcgacucauacaguuugagaag

SEQ ID NO: 188480 - RNA, 24 nt, Homo sapiens
augauguaagccucuacuccagac

SEQ ID NO: 188481 - RNA, 31 nt, Homo sapiens
aagucuuuaaggaacacaucaaggaguaggu

SEQ ID NO: 188482 - RNA, 42 nt, Homo sapiens
ucacuggauuuaacaguaucccuuuuacuauucagcgacuau

SEQ ID NO: 188483 - RNA, 96 nt, Homo sapiens
uaaucgaccaaagguuucuuugucagcccccaugacaacaaaugggucgccugacagcacagacagcaaagagguaaauuugcagcaaaaugaaga

SEQ ID NO: 188484 - RNA, 115 nt, Homo sapiens
ugagguaaaaagacucauguuugacaaaaaaggcgaagucagagaaacagccauucaagcgacuugcagcgaaauuucuucgguuaugguagaagaaacagaagcaucaccuuca

SEQ ID NO: 188485 - RNA, 280 nt, Homo sapiens
agguauugagagaccaucuguaaaagggaggaguaagaagauccucaaauucuuguauucauugcuuucgugaaagaauuguacauaauagaacuccuuguaaugccgacauugggcuuuucucccaccuguauguaguuguugcugaauuucagggaaugugauuugaauuauagaacaucagaauucaugaaacuuaacuguggagguauucugaaaauaaaauuuaaguacaacaacauuugcuuauuuuuagagucuuuuaugacaucaagagaaa

SEQ ID NO: 188486 - RNA, 33 nt, Homo sapiens
aaucauccauggaaaaugaugacgaagccacag

SEQ ID NO: 188487 - RNA, 51 nt, Homo sapiens
gaaaagcagguuguaaaacaauaaaguacuuuauggauaauuccuggaaga

SEQ ID NO: 188488 - RNA, 36 nt, Homo sapiens
uuuuaauuuaggauuaaaguuuuuaaacuggaaggu

SEQ ID NO: 188489 - RNA, 86 nt, Homo sapiens
ucuuaagucuguugaaauaccagguuaaacacauuccaagagaucuguucaaacucaaauucuuuuguauacuucugaggugccug

SEQ ID NO: 188490 - RNA, 46 nt, Homo sapiens
aaaguugacuggcaacgaguggagaaggacaugaagaaagccaaag

SEQ ID NO: 188491 - RNA, 54 nt, Homo sapiens
guggugaggagcucucgacucagcauggaugcuggagacacaguacaaugaaua

SEQ ID NO: 188492 - RNA, 42 nt, Homo sapiens
uguauuugauuguuaguuucauauuuacuacuagggaugcau

SEQ ID NO: 188493 - RNA, 46 nt, Homo sapiens
uuugacucuuuggucacugauauuugaucugugcuguggaauccag

SEQ ID NO: 188494 - RNA, 49 nt, Homo sapiens
gaaaugguuauggagagguuauacucgaccauugucuauguaguuaguu

SEQ ID NO: 188495 - RNA, 47 nt, Homo sapiens
auucauuucuuuuaccacuacacuuagccugcaugaugguacuguuu

SEQ ID NO: 188496 - RNA, 57 nt, Homo sapiens
aaaguguucaucuccuuuugauuguggaagggacaaagggacagaguccaagugguu

SEQ ID NO: 188497 - RNA, 45 nt, Homo sapiens
cccugcuucucuuccaguuagugcuuuaucucucuuaaauauaau

SEQ ID NO: 188498 - RNA, 47 nt, Homo sapiens
aaacgcuucuucccauaagaguuuaauaauucuagaaagaucccucu

SEQ ID NO: 188499 - RNA, 46 nt, Homo sapiens
aagaccuugacuuucuucgagaucaauuuacuaccacagaagucag

SEQ ID NO: 188500 - RNA, 43 nt, Homo sapiens
uaaguuuguagauagauuagugauuuugaaaugugauguggaa

SEQ ID NO: 188501 - RNA, 44 nt, Homo sapiens
aaaagagcacauccuguaaauaugggaaagucauuccaguuagg

SEQ ID NO: 188502 - RNA, 55 nt, Homo sapiens
auaaacaacugccacaugcugcacacuggaaaagaagagaaagugcagcuccuac

SEQ ID NO: 188503 - RNA, 73 nt, Homo sapiens
ugugcagacaagugagggagcuaggguggacagucucuguuacauugacauucuacuggagucuaagcuccac

SEQ ID NO: 188504 - RNA, 37 nt, Homo sapiens
uuacagguugacauaacuuugaauguuuuaacagcaa

SEQ ID NO: 188505 - RNA, 48 nt, Homo sapiens
ugguauuuuaaucauuauuuuugccugucauaagaaaacucuuagcug

SEQ ID NO: 188506 - RNA, 46 nt, Homo sapiens
ugcacuuaucugagguuagaaaaaauguagucuuaauagcccucuu

SEQ ID NO: 188507 - RNA, 43 nt, Homo sapiens
cuaaggugauuuuguaguucuuaacaguucuccagagcaucuu

SEQ ID NO: 188508 - RNA, 45 nt, Homo sapiens
aagaguugugagcuuuuuuauucaugauaaaaccuuauaggaaua

SEQ ID NO: 188509 - RNA, 49 nt, Homo sapiens
cauggcuaugacaauuuggugccaaugugggaugggguugccucugaag

SEQ ID NO: 188510 - RNA, 49 nt, Homo sapiens
gaauguaucaugggagugggaacaaggacuagggaggcuaguuaggaag

SEQ ID NO: 188511 - RNA, 63 nt, Homo sapiens
uuuaucaggcuccuucuggcugcucuguggagaauaaacugcaagcauggcagggguggggaa

SEQ ID NO: 188512 - RNA, 45 nt, Homo sapiens
aaugugguucacucuucagaagagguugucaaaucagagaggaga

SEQ ID NO: 188513 - RNA, 53 nt, Homo sapiens; identical to SEQ ID NO: 120910

SEQ ID NO: 188514 - RNA, 49 nt, Homo sapiens; identical to SEQ ID NO: 120911

SEQ ID NO: 188515 - RNA, 45 nt, Homo sapiens
cgguugguaaugucaaauaagagaagaccaccuacugaguuccug

SEQ ID NO: 188516 - RNA, 41 nt, Homo sapiens
acagaaaacuuugcagagaacaauuugaacuaaaguagagc

SEQ ID NO: 188517 - RNA, 43 nt, Homo sapiens
aauacauguguauuauguuuuauuuccacaucugugugugugc

SEQ ID NO: 188518 - RNA, 85 nt, Homo sapiens
ggucaauaacacauauugcuugcaccacaacuccaccaaccugcccuuugguggcuaauaaacuagcuggaauugaucucuguau

SEQ ID NO: 188519 - RNA, 41 nt, Homo sapiens
gagagaggacuuccugguucuaggugcgguccaggagggca

SEQ ID NO: 188520 - RNA, 39 nt, Homo sapiens
gagguucaggugggagcgcaguccgggcccgcaagcagu

SEQ ID NO: 188521 - RNA, 45 nt, Homo sapiens
ucuuuagaaauaguuauguauuacagcauuuaaauuaaauuugaa

SEQ ID NO: 188522 - RNA, 27 nt, Homo sapiens
uauacugccaaaauucuucauugugcu

SEQ ID NO: 188523 - RNA, 41 nt, Homo sapiens
cagguguuuaaaaaaauaguuauauccaagacccaccucag

SEQ ID NO: 188524 - RNA, 182 nt, Homo sapiens
ccaucaaggagggcccaaguggaccaccagugauagcucucuggucaggaucucuuuuguuccaaauguagaaaccugcuuuggcuuuacugagaaaggagaugugcacuuguuuagguaugagucacccuccagagcaaacugaguaccuacccugugggaagacacccacugggcuacau

SEQ ID NO: 188525 - RNA, 47 nt, Homo sapiens
acaaugacagaaauacagaaauagcacucaaagacugaauggcaauu

SEQ ID NO: 188526 - RNA, 54 nt, Homo sapiens
caaguugcgcugcucgcgacgaggugagugcgcagggcucggcgggccgggcgc

SEQ ID NO: 188527 - RNA, 42 nt, Homo sapiens
cauacccgggacgcgggccggcccucccggacccggguggaa

SEQ ID NO: 188528 - RNA, 46 nt, Homo sapiens
ucaguuucugacgcgcagaaacugucaaggaagucgggagccccag

SEQ ID NO: 188529 - RNA, 39 nt, Homo sapiens
cggaguggaguauggggagugcgccuucgggagucggcg

SEQ ID NO: 188530 - RNA, 43 nt, Homo sapiens
cgccugcgcugggauagggccuggacuucacgugcgucgccug

SEQ ID NO: 188531 - RNA, 68 nt, Homo sapiens
cauguauguauguuuguguguguauguguuuguauauguagauguaucaacagagucacagaaagucu

SEQ ID NO: 188532 - RNA, 54 nt, Homo sapiens
ggucuuuguauuuuuuauggcaaugaaugagaaauuuuauuugucagugaggau

SEQ ID NO: 188533 - RNA, 41 nt, Homo sapiens
ucaauacaguaagaguuucagaugcucacaggagaaagcga

SEQ ID NO: 188534 - RNA, 48 nt, Homo sapiens
aguugugcuuccaagaaugaguaucucugugcuuggucgaacuucccg

SEQ ID NO: 188535 - RNA, 41 nt, Homo sapiens
gaaguauucauuuacaaaugaacaaugaaaugacuguguag

SEQ ID NO: 188536 - RNA, 45 nt, Homo sapiens
cugggcauggcuuccuuccagcaaggggcagauaccaagaauaac

SEQ ID NO: 188537 - RNA, 40 nt, Homo sapiens
gacacaggcugcuccucccuccaauuacauuuaaaaugga

SEQ ID NO: 188538 - RNA, 50 nt, Homo sapiens
caccugcagguuugugaaccucaucaugccuuguuuuuagcacaacaaaa

SEQ ID NO: 188539 - RNA, 62 nt, Homo sapiens
gaagaaaaucauaccauaucagaugccucgcagagcaccaggcccaccgugaaagguacagc

SEQ ID NO: 188540 - RNA, 53 nt, Homo sapiens
uccuccccuccgcccuccgcgccuucugccauagccuauagccuccucuggga

SEQ ID NO: 188541 - RNA, 48 nt, Homo sapiens
aaauguggccagucuagauugagaugccuuguagaaguauaaaauaca

SEQ ID NO: 188542 - RNA, 37 nt, Homo sapiens
ccaggcaggagcauaacccagccccaaggggagauaa

SEQ ID NO: 188543 - RNA, 81 nt, Homo sapiens
uuccagaauaaguagcacagaucuuugaccgccccccgccccccaccgagggacuguggucuaguuggaagacacaaggca

SEQ ID NO: 188544 - RNA, 41 nt, Homo sapiens
gcagugcaucugcggcuggcugaagauggaauaaaugggau

SEQ ID NO: 188545 - RNA, 50 nt, Homo sapiens
gagaaguuuuugcugagauuuacaugauagagauuugcuuuuuaaaaaga

SEQ ID NO: 188546 - RNA, 53 nt, Homo sapiens
aaauugcauagucuccugaguguuguuuugccuuugacuuuguacuguuuaag

SEQ ID NO: 188547 - RNA, 34 nt, Homo sapiens
uauuuugcagagaaaauaauuuuuucccaaagag

SEQ ID NO: 188548 - RNA, 62 nt, Homo sapiens
ugccugaaaggcuugagugcugaagcaucuagcgcuauucuuguguccgggaacguuccugc

SEQ ID NO: 188549 - RNA, 51 nt, Homo sapiens
cucauugacuuugcuauaaaaucaaaacagugaauucugauaagacuagac

SEQ ID NO: 188550 - RNA, 55 nt, Homo sapiens
uaccgaagggugagggggagguuccagcucuguuuucuguaucaguuuccugggu

SEQ ID NO: 188551 - RNA, 82 nt, Homo sapiens
guccuugccagcaaaagcugcugggaacguggcacucagauaacaggacgguugagaagcggugaguuaggguuacucugau

SEQ ID NO: 188552 - RNA, 51 nt, Homo sapiens
aaucagaagaaugaaguugaccguauguacucuauaaggugguugugugag

SEQ ID NO: 188553 - RNA, 35 nt, Homo sapiens
caggagccugguuauugcagcgguuguggccagag

SEQ ID NO: 188554 - RNA, 77 nt, Homo sapiens
ucauuuccagagucccuguauuucugaucuuggcugcuuuaaaaaggaggugugggccugggaucccagaaguauuc

SEQ ID NO: 188555 - RNA, 67 nt, Homo sapiens
ggggguggggagaaagaggaagacagaugaaagcagggaaauccuucuuggagucauaguuaaaagg

SEQ ID NO: 188556 - RNA, 52 nt, Homo sapiens
ggaguucccucccuugauuucaggcuuuugguguaaagcucccgaaagaaag

SEQ ID NO: 188557 - RNA, 42 nt, Homo sapiens
uguaugaaaaaauguacuaaauaagcucaagaaaauaccauc

SEQ ID NO: 188558 - RNA, 351 nt, Homo sapiens
uuaaaacuacacacauuuacuaucuuaacaguucugggcuggguaugguagcucaugccugucaucugaacacuuugggaggcugaggugcaagaauugcuucagcucaggaguucgagaccagccugggcaacauggcaagacccugucucucucuaaaaaaaaaaaagccaggcauggugguccacaccuguagucccagcuacuuggaggcugaggugggaggaucacuugaguccaggaggucaagacugcagugagccaugcgagugcuccagccuggaugacagaacaaaaucuugucucuauaaaaagaaacuggaaaaaaaaaaaaguaguucuagaggucau

SEQ ID NO: 188559 - RNA, 50 nt, Homo sapiens
gcugcccauauuccuuagcucauggccccuuccuccaucuuuaaagccag

SEQ ID NO: 188560 - RNA, 35 nt, Homo sapiens
uuccaccuguagccuucauuccucccugccaugca

SEQ ID NO: 188561 - RNA, 45 nt, Homo sapiens
ggcugcuuuggggcugaggcgacuggacuggcgucugauugaugg

SEQ ID NO: 188562 - RNA, 56 nt, Homo sapiens
gcacagaaguguucucaucacuuuugcgcuugcuuauuuaacccaugauuguuaga

SEQ ID NO: 188563 - RNA, 52 nt, Homo sapiens
gggcggggggggggguacacaaauguccggaccauagaauaggacauuacag

SEQ ID NO: 188564 - RNA, 90 nt, Homo sapiens
cuucucccaauuccccugguauacuccaggguggcucuguggccacacaugacccaggcccacuggccauuagacacuuuggcagggugg

SEQ ID NO: 188565 - RNA, 67 nt, Homo sapiens
gugaacguccguaaguuccgccuauucuggguaugaugucacacucauaaacaagcuaagcacacaa

SEQ ID NO: 188566 - RNA, 50 nt, Homo sapiens
uggaagguaaauuauuaacccaguagacuaagauuuuacuaaaaacagac

SEQ ID NO: 188567 - RNA, 45 nt, Homo sapiens
caauuugggcuuguucagugguuuucacaugauuggacuggggug

SEQ ID NO: 188568 - RNA, 43 nt, Homo sapiens
uuaccauauugcuuuccugagaggcugugcggguugcguggca

SEQ ID NO: 188569 - RNA, 38 nt, Homo sapiens
ugaguacaguguaguugagaugugcaaacaagauguag

SEQ ID NO: 188570 - RNA, 45 nt, Homo sapiens
uuuucauaguuuggugaguagaaagagaaaugaggaugcuggccc

SEQ ID NO: 188571 - RNA, 30 nt, Homo sapiens
guucagccacgcaguagcauaguauucagc

SEQ ID NO: 188572 - RNA, 46 nt, Homo sapiens
guuuuaauuaggaagaagaaaaaaccuaaaggaacgggaugguuga

SEQ ID NO: 188573 - RNA, 38 nt, Homo sapiens
cuaggcuggucccugcagacggcuucccauuuuuauga

SEQ ID NO: 188574 - RNA, 46 nt, Homo sapiens
agugacgaggugaacuuucugguguaucgguaucuccaggagucag

SEQ ID NO: 188575 - RNA, 46 nt, Homo sapiens
acaucagccaguccaacaucaaugggacgcuagugccaccggccgc

SEQ ID NO: 188576 - RNA, 42 nt, Homo sapiens
cauuccgagagaagcucgcucagcagcaagccagugcggcgg

SEQ ID NO: 188577 - RNA, 46 nt, Homo sapiens
agccaccacgaccucagccggcguuucccaccaaaauccaucgaag

SEQ ID NO: 188578 - RNA, 48 nt, Homo sapiens
ugagauuccauccagcaaagccacaguccuucggggccaugagucuga

SEQ ID NO: 188579 - RNA, 103 nt, Homo sapiens
aacgggggcuccacccagcucguguugaggcacuguauacgagaggggggccaugacgucccgaguaacaaagacgucaccucacuggacuggaauguaagca

SEQ ID NO: 188580 - RNA, 48 nt, Homo sapiens
acacucuuggcuacggguucauaugacgguuuugcaagaauauggacg

SEQ ID NO: 188581 - RNA, 89 nt, Homo sapiens
gguaaccuggccagcaccuuaggccaacauaaaggccccaucuuugccuugaaauggaaccgaaaggggaauuacauuuugagugcugg

SEQ ID NO: 188582 - RNA, 43 nt, Homo sapiens
ccagauugcugaguuuaaaacaugcuguacuuuaaugaugugg

SEQ ID NO: 188583 - RNA, 63 nt, Homo sapiens
ugaucuucaggcucacaauaaagagaucuacaccaucaaguggagccccacugggcccgccac

SEQ ID NO: 188584 - RNA, 45 nt, Homo sapiens
ugucuauagcguagcuuucagcccugaugggaaguacuuggccag

SEQ ID NO: 188585 - RNA, 32 nt, Homo sapiens
uaucaccgaagugcugcucucuagauacugag

SEQ ID NO: 188586 - RNA, 46 nt, Homo sapiens
ugcagaguggaaaucuuguccacagcuaccgaggcacuggcggcau

SEQ ID NO: 188587 - RNA, 51 nt, Homo sapiens
uuuggaucugcggaaguaaccacaaaauauuaucgaaaaaagaaaagaauu

SEQ ID NO: 188588 - RNA, 45 nt, Homo sapiens
uccaaaacuguaggaacuugacuugcguuagaguguacucugaaa

SEQ ID NO: 188589 - RNA, 47 nt, Homo sapiens
gcguguggauugguuuccacccggaacaggcucugugauggcugaau

SEQ ID NO: 188590 - RNA, 65 nt, Homo sapiens
uuuuuuuguuuucccuaacaauuuggacacuacaauugcucucacaaaggagguucaaagaccag

SEQ ID NO: 188591 - RNA, 42 nt, Homo sapiens
acaggagaaaaaaaaaugacuuauaagagaaagagccuggag

SEQ ID NO: 188592 - RNA, 45 nt, Homo sapiens
uuggcuacaucuuucccacaaccguauaacgaccgauggucauuu

SEQ ID NO: 188593 - RNA, 28 nt, Homo sapiens
uucgggagagccuuuaacauguuugcac

SEQ ID NO: 188594 - RNA, 351 nt, Homo sapiens
ucuggaggggguggaggcaaaauuucaucaacuaccggcccacccuauugaaaaacgagaagggagaaggugagaaaguaaaacuuucaaguguacagagaaaccagacaguaaaaacaucaacuacaacacaagccggccguguguggccgcucuccuuccaccaagccucacuccguccucggaaagccgaggccugcuuccacucgggacgacagaagcagccgaaagggggcacugagccugugcuaaggcacagugacuugucuuaagcuugagauucagacacagcucaguuggcugaugugcuaacaaugaaagaagaggcaucacgcacccaaggguuggcgg

SEQ ID NO: 188595 - RNA, 10609 nt, Homo sapiens
aguucccuauggaaacaaaagugagaucagaaaggguccacaagagccuaauugcacaagggcagcugcugggguggggggugggagggggcagaggccauguuuacccaggccugauggcgagccacacaguagugggaacugaacggggaggugggcgggaugagccuggagaggcugagccagacagcugcaccugcccaggcacggcaguuccccagaggcugccaggcaccucggucagagugaccacaaagucacuuuguggagaguucacgcguaucaacugucugaguauuaauuuuccccuuaaaccagaaaagccccagagcuuugcuuccagcccuggcccaggcucaucuagguacaacuggauguuaauuguauuugugccgaaacagacaucaaugagaagcauuaacaaugaucagaagccugcaggugugcucaggguccccuuggccaccucuguacgucugcauuucucucacagagaaaacucucacagggcauuucaagauauuucuggaacugaaacgggcuuuuacacuuugcucauaaauaacaaucacaaaccuucaucuucaacagaauauccggguuaguaaaggagaccucgacuuucaaguguagaauauaagacaucuaagugucuaacucaauuacugagugaaucacuuuuuuaaaauguacuuuuuugggaauagauaauguguacacauuguuuaaaaccaaauauggcauauaguaucuaagcgguuuaaaaauuuuuuucaauggguuaacaugcaguuagauuuuaaaucauuuaaaauuuuaaccuuaaacaucaggaacacuuaagccugcauuaaaaccaacucaauacaacauaauaacaauaucgauccaaauuaaacacgaaagaaaacuuaaaacugcuucucuggaaaugcaaaaaugacaaguaauuuuuaaaauuucuaaaagcauuucagagaucacacauaagucaaacgaaguugggaggccaggcgugguggcucacgacgucaagagaucaagaccauccuggcuaacauggugaaaccccgucucuacuaaaaaauacaaaaaauuagccggacgugguggcaggugccuguagucccagcuacuugggaggcugaagcaggagaauggcgugaacccaggagguggagcuugcagugagccgagaucgugccacugcacuccagccugggcaacagagcgagucucucucaaaaacaacaacaaaaaacaaaagagguugggaaauguuauucuauaggggguucaaaaauccagagccucagagagauuuaaagaaaaacugacuaugcagucauccaucugagacucaacacacuacagagcucuucaugguuugccucugaaaauacucaugcaguauucaaaaucacguguguaacuaaacaaguaacaaaagcucauuguaaaaaauguccaaguacagaaaagugcugacaauagaaaccacagcuuuucuguacuccuuuuccuuuuuuuuucagauggagucucacucugacugagugagacagucccaggcuggagugcaaugaugcaaucucggcucacugcaaccuccaccuccugggugucagugauucuccugccucagccuccugaguagcugggauuacaggcggguaccaccaugccaggcuaauuuuuguauuuuuaguagagacgggacuucaccaacuuggucaggcuggucucgaacuccugaccuugugaucugccagccucggccucccaaagugcugggauuacaggcgugaaccaccacacucggccucuguacuucuuuuucaucuaaaauauguaucugggugguggcuaaauguuaucguucuuuucuguauuuaugaaaauuuuuaggacaucaccuacgaaccuacuaucaaaaaagauccuuucucacugauauuggcauggggagaaaagaggaacaaggcagaagagaacaaaccagugagcgccaaagagcaagcugagaaggcgagcguggggcugccacuagagaccagacacuagugggugacaguguucagcucucgggagccaccugcccgggggugcugagcgcuguccugccccuggccagaguaaaggggaagauggcucuggaaagcagcacaguuggucugcacgucuagcugggacacacuuccagcagacgucaggcagaaagaacaccauugucccaucuaucuuuuuaaaaugugaacuuuuaucuguguaggaacacacccaacugucgggaaugugggaaggggcuuuagauuuuauuuucuugccuucugccagcccauauuacuuucuuuccuuuuuuuaauuuuuuuuuuuuugagauggagucucgcucuguugcccaggcuggagugcaguggagcgaccuaggcucauugcaaccucugccucacaguucaagcaacucuccugccucagccucccgaguagcugggauuacaggugugcaccaccaagcccggcuaauuuuuguauuuuuaguagugacaggguuucgccauguuagccaggcuggucucaaacuccugaagucaggugauccgcccaccucggccucccaaagagcugggauuacaggugucagcuaccguccccagccuuacuuucauaauuuaaaaagcaauuuguuaaaaaaaaaaaaaaaaaaaagaaagaaagaaauuauccagaaaauagaagcaacaauaaagaucuucugguuuacaaaugggacuucaaacccaaaauuuauguggauugugauucuaacaguauaaagauaguucugcggauacuguguacacagacauggccucaggccagaagaggacaaggagggacagaggccgcuggagcggggcggaggcggccccuccacugcugaaaugucuaaguacuauuucuggcuucaagacaggaugauggucuuuuucuuaacuggaaugucggcacagcagcaacugguuuuucuuuuguuuuguuuuuguuuuuuugagauggaguuuuguucuuguugcccaggcuggagugcaauggcacaaucucagcucacugcaaccuccgccucccagguucaagugauucuccugccucagccucccgaguagcuggaauuacaggcaugcaccaccacgccuggcuaauuuuguauuuuuaguagaaacgagguuucuccauguuggucaggcuagucuugagcuugcgaccucaggugauccgcccgccucggccucccaaagugcugggauuacaggcaugaaccaccacgcccagccaacuguuuuauucucuuauuaaucuuuacgcuuguguaaacacuguauuauuuuauauauaugaaauauuucauaaucaaaugaaauacuuguaaauaaaaaauacccacccacucuaaaagguacacugugaaguugaccaccuaucccaugccuccagggccauucccagaggcaguuaucaauauacuggggcuccauccaucaaucauugcccccuuuuaccugagcauauauauuaugcucugugcugaaccuugcuuuuuuucacuaaacaauguaacuacagaaagggaaccugcaugcucaguagcaaccaacccaaacuggaucagggaaacagacaggaaacagauaggaaacauggaaaauccggaaacuaaacacagagguggcaggaacugaggcucagcucaugcuccagcacagcccacacaugaaguaucuuuaaaugucucuucugauuuugaauacaguaaauaucaauucccuguguuuacuugguuuauaugugucauuucuauugauacguacgauauuagaaauuaagagacacuuaaagauaucucauuauuuaacaauaacaagauauccaauauauaguaacaaauauuuaugaaacuguuuuuaaaauauuuggugagaggaauagcauucuuugccuuuuugcgaaucucuugaaugcugacccuggaaaaccccuggccucccaucugcaugcgaucgaccaugaagggccgcuguggcucaagcaggagaggacauuacagccccaggaagagaugcagcuagagagggaggggcaucuaaaagccuuuucagugugcucagagcuucucccugacaccgcacucagcaagggaaggcuccuuacagcgagcugcaauugaacccuaucaccacacuuuuccaacuugguucuucugaaauccauuggucuaucuugaacuuugaaugggucuuuuacccaggcaugauucugugacauccugcaauggucaccugagaaaguccugacacacugagaagcuggugagcacacaaaaguccaauuuucaacugaaagcuccaauuuuaauacugcuaacacuguccguuguucuccuugaagccacaggcucacuuuguuccugccaggacccggaucugcauucccuggcaugucugccagucuuucucaucaaugugugcuccacggagagcgcacagggucagccgcagcuccagccuugcacgugcugccccuugaggccgcuggacuugggugccggcaggggcucuacccacgcugccacuccaccacgcugaguacugagacacacacagaagcucugcuuucuggcuuuccacaguuucaguuaccugcgucugaaaauacuaaaucgaaaauuccaaaaauaauuccuaaguuuuaaaugauguucugugcugagcagcgugaugaaaucuugugccgaccuccucugccccaccugggacacgaaucaucccuuuguccagcagaugcaagcuguccacgacgcuaacugcccacuagucacuuagcagcccucuuggccaacaaccguuggggguacggcggugcugugcucacuguggcucagugacccaggaucacugggggcaggugaccuuccuucugacgcauuggcaggaggucaaggggggcccaaugcuaaguggcagggccuccgugucaucaugcgagcauauuucaucccacgucaucagauggcugaguggcugagugcaguaaagugagcucuuuugagagaucacauucacauuuuuauuacaauugcucuauuuuaugauuggcuauuguuguuaaucucuuacugugcguaacuuauaaauuaaacuuuaucauagggauaugcuuauauaaucauggaacuguacacuuaaaaugggucaauuucauggcacauaaauauuacuuuaauaaaguuuuuuaaaaagaacuuacgaauaauaaaaauaaauaauacaucuguacacaaguguaagauuuaauuaaauuacaguucuuacuacuacagcacagacaugaaguaaaguggcauucgaaaugccagugcauggugaaugccuggcucagccuuacuguuauuauaaauauaguuucgauuugggaggccaaggcggucggaucauuugaggucaggaguucgagaccagccugaccaacugaaacacaaaauuuagccacuacuaaaauacaaaaauuagccaggcaugguggcaugcgccuguaaucucagcuacucgggaggcugaggcaggagaaucguuugaacccgggagguggagguugcaagugagcugagaucacgccauugcacuccagccugggcaacagagggagacuguaucucacaaaaguaaaauaaaaugaaagaaaaagaaaaauaaauaaauauaguuuugaccucaggguccccugaaagggucucaaggacucccagggguucacagaugacacucagaccugcugcuuuaaacacaguuuugcaaggauucaaaacugagcaaaagacauuucuccaagaagauacacaaaugaccuauuaagcacaugaaaaaagacaccccaccacccaucuucaggaaaggcagaucaaaacccaguaagauauuaccuccuacccacugaaauggcuacuaucaaaaaaaaacagagaacagaguaauggugaggacguggagaaacuggaagcccccacaccacuggugggaaaguaaaauggcacagccacuguggaagacagcuuggcggcuccucaaaacaugaaacauacaaccaccaggucaucagcaacuccacugccagcggcuccgcaaaagaugaaacacacaaccaccaggucaucagcaacuccgcugccagcgguuccucaaaagaugaaacauacaaccaccaggucaucagaaacuccgcugccagcgguuccucaaaagaugaaacacacaaccaccaggucaucagcaacuccacugccagcgguuccucaaaagaugaaacacacaaccaccacgucaucagaaacuccgcugccagcaguuccacaaaagaugaaacacacaaccaccaggucaucagcaacuccacugccaggcacaugcgaaagagcugaaagcagggucugaagagauuuuuacgcccacguucacagcagcucuauucacaauugccuagagguggaaaccacccaaguguccacccacagaugagggaaacacccaaugcagcugcuccacacuaacaaauauuggucaaucuuuuuuuuuuuuuuuggagacggagucucguucuguugcccaggcuggagugcaguggugugaucuuggcucacugcaaccuccaccuacuggguucaagcgauucuccugcuuuggccucccaaauagcuggaauuagaggugugcucuaccacccccagcuaauuuuguauuuuuaguagagacaggguuucaccauguugagcagucuggucucgaacuccuaaccuugagugauccacccaccucggccucccaaagugcuaugauuacaggcaucagccaccgcaccuauuauucagucuuaaaaagacagaaggccaggugcagugacucacgccuguaaucccagcacuuugggaggccgaggagggcagaucacgaggucaggagaucgggaccauccuggcuaacacagugaaacuccgucucuaccaaaaacuacaaaaauuaccugggcgugguggcgggcgccuguaguuccaacuacucaggaggcugaggcaggagaauggcgugaacccaggaggcagagcuugcagugagccgagauggugccacugcacuccagccugggugacagagcaagacuccaucucaaaaaaaaaaaaaaaaaguauuccaccacaauuuuaaaaaauuagggggagcacagccaaggagaucagacccaaaaaauggacugggaugcuuguucacugagggauaaaucagaagcccaaaguaggggccgggugugguggcucacaccuguaaucccagcacucugggaggcugaggugagcggaucaccugaggucagggguucgagaccagccuggccaacaugaugaaaccccaugucugcuaaaaauacaaaaaugaguugggggugguggcagaugccuguaaucgcagcuacucgggagucugagacagaagaauagcuugaacccagguggagguuccaacgagccgagaucucaccauugcacuccagcccgggugacagagcgagacacugucucaaaaaaaaaaaaaaaagaaauaaagaaacccaaagugggacacaguuuaaagaagaugcuacuuacuccucuguggacagaacuuuguguccugaugauccaacacaggcccacgagagauaaaaacaucccaugaagaaguacagcuccaguuguaguguaugugcuguggagccgggcaggcguacacaaagcacugaucucuaaaaugugagcaagguguguucccagugcauuuugcugucauuuggucacaaaucucaauguguccacuaagcgauuaaaugauuaaucucuauaucacaacgugucggagauaaagcuaagagaggccugagcaguggcucaugccugucauccccauacucugggaggcugagguggaaggauugcuugagccuaguauuugagaccagccugagcaauauagugagaucccaucucuacaaguaauuuaaaaaagaaagaugagcucuugcaauguugcccaggcuggucucuaacuccugggcucaagugauccuccccauucagcuucccaaagugcuaggauuccagguaugagcuaccaugcccagccaccgacuuuuuucuaagaaaagaauuuucuaauugugacacaauucacauaacauaaaauacucccauuuaauguguacaauucacugguuugcaguauauucacaaaguuguguaagcaucaccacuagcuaguucuagaacauuccaucaccccaaagaggaaauccuguacucacuagcuaucacucuccacccccaguccaggcaacgaggaaucaaucuacuuuccgucucuguggaucuguggccuucugugcucccuucugucacucagcacgucuuuaaggcucguccacauuguggcaugagucacaaucuacuuucugucucuguggaucuguggccuuccgugcucccuucugucacucagcacgucuucaaggcucguccacguugcggcgugagucacaaucugcuuucugucucuguggaccuguggccuucugugcucccuucugucacucagcacgucuucaaaguuuguccacauuguggcaugagccagugcuucauucccuuuauggccaaguagcauuccacugcauggacaggccacacuuguuuauccauuccucacuuuuuggguaccuggguuguuucucuuugguuacuggaaauuaugcugcugugaacauuaaugcacaagcuuucacauaaaugcacacguccguuucucuuggcugcauaccugcaguggaacugcugggucauacaguggguacccgggagcuucugaggaacuguuuccuaaagcagcugcaccguuuuacccucucacgagcagugaaugagggcuccaacaucuccauauccuugccaacacaacaaacuucauuuuguuuuuaaaauaacuuguuguuauuggagagaucauaaacugaagaauuucaauuucauauaaacugcagguaggcagaaacauuuaaguccaaauuucucauaacaaagcagcagcagaagacaugaucuagaaaacgguaagaaucagccacuuccucuguaccguaucaccucacucuacagaauaaaaacacuucugaaaugaguuauugauaacaccugauuaagccgcaaaaaugcugccuuaucuagcuucugacuuuuuuuuuuucaagagacugagucucacugucgcccaggcuggaguacaguggcacgaucauggcacaacugcagccucaacuucccaggcucaagugaucugccccugucagcccccaccccccacguagcugggacuacacaugcgugccaccaaacccugcuaaguuuucauuuuuuguagagacaaggucucacuauguugcccaggcuggucucaaacuccuuucuugacuguagaaacccuuccacauggucucacuugcugaaacccaaacucaguacuuagucuaacuuugggggcaccaccuuccaauucugaccaacccacgugaugugcaaggagacaggauccugucuguguucauccaggcaucucccaaugaagggaaugaagaguuccaguaaccaucucucugucuguuuugugcuucuguuguuaaauucuggaauuagcucagcagugagcccugggcuccugguccagagucucccugcccugguggaugcugcagccuccugcaguuggaaccaucaggccaacgccgacuggccggucaagcuucccagucacacugccacccagagaccagagcacugcacugugaugggugcugauucaaaaugacugcaaauguguacacguacauguguacagauuguucuccaucacuuucauacagaaauuugagacacugauguuguuaauucccacacuauuauggaaaagaggucuucugcuuaaauuccaauuucuuuaaauacugacacugugaauaccaaagcuuuuccaaaacguaccgcacauuucucugcauucuuaggugugucugugacaaucuacggcucuaagucugcugcccucacaggcucuccccaguaggggccccucacaugcacgugugacuugggcacgucaacuguuuuugcuuggcaaaaccaagcaagcacacacccacaggagcgagccuaacccgggguucccaugagccccacaucaucaggucaucucuugcacaggggcguucccggcugcucuaagagcacagccugccucugaaugaugggacuccgccacaccccaaggguguguccugccuguccccgaugcucgacuggcucacgugccucuaaggaggagguuccgaacagcucucugccccucaaagacccccuuuccuucuggcuucacagcuguguucuggauccaggagaaggaagucuggccucuggaguagggggacuuuaagguacugaagagagugaauauagcguauuuuguaccuuuaaccuggccucugaaugguauggaauuggauauug

SEQ ID NO: 188596 - RNA, 42 nt, Homo sapiens
uuucuccaucaucguccucuuucuuuuucuccuuggcagccu

SEQ ID NO: 188597 - RNA, 47 nt, Homo sapiens
agcccccgcuuucucagccucguccuccuggacggcgggagcuggcu

SEQ ID NO: 188598 - RNA, 46 nt, Homo sapiens
cuggcugcacuuuccucauccuccagaucagaagcccucacccccg

SEQ ID NO: 188599 - RNA, 46 nt, Homo sapiens
ucuuggugucaucauauuuggcagguuuuuccagacggcaggucag

SEQ ID NO: 188600 - RNA, 49 nt, Homo sapiens
uuucagccaggcaucuacauacaguucuuuucaaaucucuuugcaagug

SEQ ID NO: 188601 - RNA, 56 nt, Homo sapiens
ggaauaaaauauguuauauuucguccugggauuggaauguguuuaauacaguuggc

SEQ ID NO: 188602 - RNA, 47 nt, Homo sapiens
guccaagaugcagcuaaggcaagaacagccugcacagcaauguacaa

SEQ ID NO: 188603 - RNA, 55 nt, Homo sapiens
uuuaagaugacuugcucuauaaaacuuuuugucagguccaacuucaacuauacca

SEQ ID NO: 188604 - RNA, 83 nt, Homo sapiens
acuuuucaucacccuccuuugagauugaucacccacuuuuggugacuccuuaguagcaauacaggaaaggaugaucaacugug

SEQ ID NO: 188605 - RNA, 55 nt, Homo sapiens
cugcuccaugcugcuaggggacagagauugguggugggagacaggggcuaucuga

SEQ ID NO: 188606 - RNA, 40 nt, Homo sapiens
cucauggcugcaagggcuccgcggucgaguguggguacga

SEQ ID NO: 188607 - RNA, 84 nt, Homo sapiens
ggggccguugaggguguugagagaugugaagguuaguagcaguauaguaagaauuguuggagaggagguuuccagaugacuguu

SEQ ID NO: 188608 - RNA, 51 nt, Homo sapiens
uaguuuacuaccgugugccagcucauaaagugcguaaaagcaggauuugaa

SEQ ID NO: 188609 - RNA, 60 nt, Homo sapiens
guuugucaaucaggcagucauuuuggcauacaguauauuuacuucugguuucuaaaagaa

SEQ ID NO: 188610 - RNA, 46 nt, Homo sapiens
uaucucuggcugaaaguucuagaaaaguuuugaaauuugggguuug

SEQ ID NO: 188611 - RNA, 41 nt, Homo sapiens
cuguauaguauagugguuaagcgcauggacuguccacucag

SEQ ID NO: 188612 - RNA, 36 nt, Homo sapiens
cacugaacuuuauagguugaaauaaaaggagagagu

SEQ ID NO: 188613 - RNA, 62 nt, Homo sapiens
uaguccuuucucaucccuacacauacagucccuuucucucuuuuuagacaugucucaauuuu

SEQ ID NO: 188614 - RNA, 31 nt, Homo sapiens
cgucuuugcuuuccaguucauuuaccgucuu

SEQ ID NO: 188615 - RNA, 45 nt, Homo sapiens
cauuuuaaucgugaucuaguacauacgcacauaccugaaacaagu

SEQ ID NO: 188616 - RNA, 55 nt, Homo sapiens
ugggaaagagccaaccugcccugaaaguguggucuagcauccugucugcuguuac

SEQ ID NO: 188617 - RNA, 40 nt, Homo sapiens
cugaagucuauauucagauuuccuuaacuuuuacugaaca

SEQ ID NO: 188618 - RNA, 38 nt, Homo sapiens
ucucagcugaaauuuccguguauauagucuauauauuu

SEQ ID NO: 188619 - RNA, 46 nt, Homo sapiens
cccaccauugagaaccacagauuggagaagaaaauaaaagcaugua

SEQ ID NO: 188620 - RNA, 58 nt, Homo sapiens
ucagaaaacuugggguugagucacaguguucauuaguagguacuuuacauuucuguag

SEQ ID NO: 188621 - RNA, 46 nt, Homo sapiens
gaauaacaacaaucuugaagccuguugccgagcccuuucccaggag

SEQ ID NO: 188622 - RNA, 42 nt, Homo sapiens
cgccaccuccuucauacaugcacauaccucgguauaguacaa

SEQ ID NO: 188623 - RNA, 46 nt, Homo sapiens
ccaacagaacuaucagccuucucaguauucucccaaacagcagcag

SEQ ID NO: 188624 - RNA, 47 nt, Homo sapiens
acgaucccaaacaacugagaauuuugaagcauguuuaaaaucuugug

SEQ ID NO: 188625 - RNA, 82 nt, Homo sapiens
ggacauaacccauaugggaauccacccguaguaguuggguacuuuggaaaccuuuagguaccuguagagcauaaacaaauuu

SEQ ID NO: 188626 - RNA, 54 nt, Homo sapiens
gagaauugagcaaucuagucagguacccuuaaagucauuuucagaagccuaguc

SEQ ID NO: 188627 - RNA, 56 nt, Homo sapiens
gcaucuucuauaaauaaguauggcuacaguuaacuguaaucguuuagaacaagcag

SEQ ID NO: 188628 - RNA, 41 nt, Homo sapiens
acacaaacaaaauguuuuaaaaugugauuuguagcagucag

SEQ ID NO: 188629 - RNA, 30 nt, Homo sapiens
aauuacaguuggccaacgacaaaguugcac

SEQ ID NO: 188630 - RNA, 56 nt, Homo sapiens
cggugagaaagcagaugggcuuaaaagcaugguccccaaaacaacguucuucaaag

SEQ ID NO: 188631 - RNA, 46 nt, Homo sapiens
aagaaaugcauuguaaaaauguaguuuuagagcaaauuaauaauga

SEQ ID NO: 188632 - RNA, 45 nt, Homo sapiens
ccuggggaaugccagcagcaggagagcuugaagcagcacccccag

SEQ ID NO: 188633 - RNA, 25 nt, Homo sapiens
caacuucaagaaagcauucgggcag

SEQ ID NO: 188634 - RNA, 42 nt, Homo sapiens
uacagaggguggugcagcagaaauuaauugcaauggagugau

SEQ ID NO: 188635 - RNA, 46 nt, Homo sapiens
gcgccaggcagaauuacuagagaagcgaaugcaggaaauugaggaa

SEQ ID NO: 188636 - RNA, 39 nt, Homo sapiens
aaugagauaaaagaggccucaggcaggaucuggcauaga

SEQ ID NO: 188637 - RNA, 35 nt, Homo sapiens
ccaaggcccugggugggcuucuggaaugagcaugc

SEQ ID NO: 188638 - RNA, 43 nt, Homo sapiens
aggagcacgguuuccuggaucccaccaacauacaaagcagcca

SEQ ID NO: 188639 - RNA, 42 nt, Homo sapiens
caaggggccugcugcccaucuacaccucacgguacuucaacc

SEQ ID NO: 188640 - RNA, 2532 nt, Homo sapiens
gagagcuggggcgcccacgagaggaucccucacccggugagugguuggccauccuugccgcaaaggaugugcaaaaggaagacggcauccgcuucugggaugggcucuguccuccuggacaugccgagagccugccugauccuggguccugcugcuggaggcggccacuucgccugguccccgagcguccgcaacaaaauuugucagaaagaaaaucuugaggcacauuucccuggggggaagucagggcuccucucuggaggguccaguccuuaagggugggcugggugguagggacuucaguucagaggagcgggaggaaucagauggaacuccucuuggauucggguauacggcagucacuggggggcgaaccccggauuuccuguauuagaagccgccucuagaaucgcguuaauagugggagauauggcggcgaugccuucugcgugccccaugaauuagggggggaagcacccgaauagaagggucucccgggcauauuugccucgccagcuguuggccagguuuuugguggaucgugggcgggaggaguggagguuccucuucgcgagguuuuccgaauccaaauacacagguuuagugcaguguggaccccaggcaaaauguggaguaaaauuucuacccgauaucaucugguucugcccugaucagccacuuucacaguggagagagauggcgcccaagugcaaaccugccaguagcccccuaggaucaguccuugccgaaggggggucgugggauugggggcacugggagaauagaugcaggggguggguuggggaggagagaaggccguguccuugggucugggaagagggaggagagaaaugcagaaaaggggguguguugcuggggucuggacgcugggagcuggggauggggugccgcgggggucuucagagcguugcgugguggucgcucgaaaauccugacauguugcagucuuggacuuuuggucaaaucgccuuuugccauuuccuuugucagagucaagcccccccaggccgcccccucccacccugggccggcgggccuggugggggcgcaggcggguggcuacguggcagguuucuggaagguuuccuggcuggccgcgagagggcgcuggcggcacugcggaauuuuggggggcgggguggggaggggagguggccuuuguucuccugauggagggggucgggcgcgggaucuacuggaggauccuggauucguuuacccaagagggaacaguuuugagaccccccggauucacugcggaguggccgcagaggccggggucggccuuugcgccguggcuucggguguuguggaggcgcacagaggcacguuaguugauuuccagugguuuuugguuucgggggucuuaggaagguguggcucauuugagcaggauggagagagaggcugugacaaggucagugaggggccaucgugcgggggcuagaaauuguuguuguggcgaaggagggaggcacgacuuuggaggcgugauguugaugccugggggcgaaggcggggagcggcgugguggcccccuuugcguuacuuuccagcgaugucacagguucugucucucguuccgagaccacccacaugcgugacagcggugccuggaggacugggucuuucugacuuuagugaacguguguuuaauuggauugacgaaggugggagucgggauuucugcuuuucccuguagcaggcggagcggcgcuccagaggggccuggcgcagguccgcuggguggcccaccuuccucuggggcuggggcccgguggcugggggcgcaggaggcgccuggugcgggcgggaggcgcugcgccgcagccacaggugggcucuggcuggugguggcuggagaggcguccagggggcguagcgaccuggcgcgguggccuggggugggcuguggagcccuuccuagccugagaccuguugggcacccccuguccauccaggcccgccgggcgcgggccggggcgccgcagguggcugcugcacuccuggguuacgggugcgggccgcgcgcccccuagcggugugugccagccccgcuaccuuggguuuugaguugcgcacacgcacacagcuaacacuugugaccugucagucaaaucauccuuacccccucccacuccucuccuccaccucccauuucuccucucccuccacccuuucucauuuccucgucccuccucccccuccuauuuuucuucucccuccucccucuuuccucuucccuccucccucuuccccccucauuuuccucaucucucuuuuccccuccccuucucuccuccccucucccugccccccuccuuccucccuccauaccccucccucuucccucccagccccucccuacugccuuccucaguccuccccuuugccacuccucccugccuuucccucugccugcccccuuuugcucucugcuguuccggugcuggccguuagaggucacgaagaugguuucuaaccugccccccucccaugccauagggucuc

SEQ ID NO: 188641 - RNA, 30 nt, Homo sapiens
caacaaacuguauuacaugauccaugauug

SEQ ID NO: 188642 - RNA, 61 nt, Homo sapiens
auuaauaacauaauugcugguagcugaauauguuuuggaggaguguuuuccaucuuaggga

SEQ ID NO: 188643 - RNA, 60 nt, Homo sapiens
cuccagccauccaggaguggcuguccuuuucagucuugucuuuuauauagguagcugagg

SEQ ID NO: 188644 - RNA, 47 nt, Homo sapiens
caaaugcgaauguauagccaagaaacaaaaaucuggagucugaguuu

SEQ ID NO: 188645 - RNA, 47 nt, Homo sapiens
guugucauucuaacucugcuguguggcagcguaaauaguccccuuuc

SEQ ID NO: 188646 - RNA, 52 nt, Homo sapiens
agagaaaaaccaggaaggggugacuccuuccccccaccagccccugucccug

SEQ ID NO: 188647 - RNA, 42 nt, Homo sapiens
uacacagagacaauuaugacugacuguauaacaccugacaga

SEQ ID NO: 188648 - RNA, 46 nt, Homo sapiens
aacuguauggugggaagccaugcaauuaaaaaacugacugaaauua

SEQ ID NO: 188649 - RNA, 35 nt, Homo sapiens
ccucaaugauggcgcuuuuuaaacauuaggguagu

SEQ ID NO: 188650 - RNA, 52 nt, Homo sapiens
ugcaugucaccacauaggauuaaacagccugaauuuuuuuaugugcccaucu

SEQ ID NO: 188651 - RNA, 45 nt, Homo sapiens
gcuuuucacuuguagacuagaguaaggcaaguuguguguggagau

SEQ ID NO: 188652 - RNA, 46 nt, Homo sapiens
gagaaggcuguguucucuugcaugauauuuagcagcaagagcaagg

SEQ ID NO: 188653 - RNA, 357 nt, Homo sapiens
ucuuuggguggcuacuuuguuuguuuguuugagaugaagucucgcucugucacccaggcuggagugcagugacaugaucucggcucacugcaacuucugccucccagguucaagcaauucuucugccucagccucccaaguagcuggaacuacaggugugcgccaccacgccuggcuaauuuuuguguuuuuaguagagauggguuuucaccauauuggccaggcuggucuugaacuccugaccucgugauccauccgccuuggccucccaaagugcugggauuacaggcgugggccaccgcacccggcccuuggguggcuacuuucauagaaaggcagcuaugcuauauugauaug

SEQ ID NO: 188654 - RNA, 45 nt, Homo sapiens
uguuucuugugugcucugcuaagcagcugcuagaguccuaaagac

SEQ ID NO: 188655 - RNA, 52 nt, Homo sapiens
uagaaaucauaccauuuuuauuucuguccauuuguauuuguaaucuccuagu

SEQ ID NO: 188656 - RNA, 26 nt, Homo sapiens
uccuaguucagauaaagggcauaauu

SEQ ID NO: 188657 - RNA, 58 nt, Homo sapiens
caugcaggcacacguauuaauggcaauguagguuuguaaacaauacuacuaauaggcu

SEQ ID NO: 188658 - RNA, 77 nt, Homo sapiens
auaaaggaagcauuuauggugcuguauacgcuaauguagcaucaaagauaaagugaagaaaaauaggcuagggaaaa

SEQ ID NO: 188659 - RNA, 66 nt, Homo sapiens
ggacagugccuggcacauaguaagcaugcaguaaaugucaguugguuuuauuacuucugagaauac

SEQ ID NO: 188660 - RNA, 69 nt, Homo sapiens
uacuuaaagcauggcugauuuuuuguuguguuuuguuuuuucacuaacaccauggugaaaguuuaaaca

SEQ ID NO: 188661 - RNA, 46 nt, Homo sapiens
gcuaugaugccuuuaccauucaaaacgacauaaaaauugcacagug

SEQ ID NO: 188662 - RNA, 32 nt, Homo sapiens
cuuccacuuuguuucuucguaacuagaaggaa

SEQ ID NO: 188663 - RNA, 46 nt, Homo sapiens
aaauggucccauuuggcugccucaucccguggugccuuggccugag

SEQ ID NO: 188664 - RNA, 42 nt, Homo sapiens
uuucugugggacuuuggcauuauuauuguaacugcuccagaa

SEQ ID NO: 188665 - RNA, 49 nt, Homo sapiens
ugaugcggagugugcacuggagaaacuuacuaccgaucaugagaaaggu

SEQ ID NO: 188666 - RNA, 45 nt, Homo sapiens
cugagccucaguuuuuccauuuguaaaacugagaaagccucuuga

SEQ ID NO: 188667 - RNA, 49 nt, Homo sapiens
uuuuuaaaugaauggaaaaauagaaaaucucaacaaagaaauggaacau

SEQ ID NO: 188668 - RNA, 44 nt, Homo sapiens
acugcaaaaguuuugacagcugaacugacauuggcgacacagaa

SEQ ID NO: 188669 - RNA, 45 nt, Homo sapiens
gaagugguuagauucuugaugcauuuuaaagcuaaaacugauagg

SEQ ID NO: 188670 - RNA, 46 nt, Homo sapiens; identical to SEQ ID NO: 121245

SEQ ID NO: 188671 - RNA, 42 nt, Homo sapiens
uauccccacucaucacuggacuccccaagggccaggugugca

SEQ ID NO: 188672 - RNA, 45 nt, Homo sapiens
ucaugauguguucccaggagacugcacacgcuucugaagccauca

SEQ ID NO: 188673 - RNA, 45 nt, Homo sapiens
ugaaaauaauuguggucucuuaaggcaguaagcaugaguccgugu

SEQ ID NO: 188674 - RNA, 46 nt, Homo sapiens
ucaaaauggcuauggcugaacaaauuguugauuugaugaguagguu

SEQ ID NO: 188675 - RNA, 54 nt, Homo sapiens
auaacagaacacauaauguguaccauuguaggacuucuguccuuaaagggagag

SEQ ID NO: 188676 - RNA, 42 nt, Homo sapiens
ucuugaaggucacuuauaaggaaagcagugaaaugacuucua

SEQ ID NO: 188677 - RNA, 45 nt, Homo sapiens
ucagcguuagguggaauaaggaagaaaucccuguggaucgggaaa

SEQ ID NO: 188678 - RNA, 28 nt, Homo sapiens
uguuaaaacuuccccuggagaucuuagg

SEQ ID NO: 188679 - RNA, 42 nt, Homo sapiens
auuauagccuaggaauguagcuugcuuuugaguuggaugaau

SEQ ID NO: 188680 - RNA, 80 nt, Homo sapiens
uuaaauuauggccauucagaaaauauauaauccuacauucauguaaaaccaaaaguuucccauguugcagccaaagguua

SEQ ID NO: 188681 - RNA, 42 nt, Homo sapiens
agaagccucacaggcagugagucuuggagcaggccagaagag

SEQ ID NO: 188682 - RNA, 44 nt, Homo sapiens
auauacaagguaaaauguuauaagugaagaaauuccagguagau

SEQ ID NO: 188683 - RNA, 42 nt, Homo sapiens
gggcagcauaaugggcagaugucaggauuaacaacuaaugau

SEQ ID NO: 188684 - RNA, 51 nt, Homo sapiens
caguggcuccacagcauucggauaaaaauguuuuaaacauuccugaaagaa

SEQ ID NO: 188685 - RNA, 42 nt, Homo sapiens
aaaaugcguuuuuaggaaauuacuuuucuaaggcaaacaaua

SEQ ID NO: 188686 - RNA, 24 nt, Homo sapiens
uaguaguacaugaaagguugacag

SEQ ID NO: 188687 - RNA, 50 nt, Homo sapiens
uaggaagaggucuggucaggucuuguugauaauuuguuuucuagaaacgu

SEQ ID NO: 188688 - RNA, 68 nt, Homo sapiens
accuuguaaaagacaaccaaccaaacagauaacaaaccaaaaagaaaucaccuaagucacacacugga

SEQ ID NO: 188689 - RNA, 45 nt, Homo sapiens
ccaaaaguauuuaaagugccuucaaaaagugauuuuaaaagagga

SEQ ID NO: 188690 - RNA, 24 nt, Homo sapiens
ucuugauagugucuuucacagaga

SEQ ID NO: 188691 - RNA, 48 nt, Homo sapiens
uggggaaauuaugaguucaggugcuauaaacauucacguacagguauu

SEQ ID NO: 188692 - RNA, 45 nt, Homo sapiens
ucaaccugcacugagaaaggaagguaucuucaugagaaagggacu

SEQ ID NO: 188693 - RNA, 44 nt, Homo sapiens
aggaaaucaaauaucuuuuaaauuuaaaugcaguuuuucuggca

SEQ ID NO: 188694 - RNA, 32 nt, Homo sapiens
caucuaccaacauagcuggaagagaaguaggc

SEQ ID NO: 188695 - RNA, 46 nt, Homo sapiens
uccucuaccccaaauaaaaaauuaggguggcuauucaguaggggcu

SEQ ID NO: 188696 - RNA, 93 nt, Homo sapiens
gcauagauguauaagcauggggggcuucauguuuuucuugcucccucuauuucucacuguacucccccccgcucuccacugaaaaccucugag

SEQ ID NO: 188697 - RNA, 39 nt, Homo sapiens
acuaucuuggucuuggcacauagguaguaaguagccggc

SEQ ID NO: 188698 - RNA, 42 nt, Homo sapiens
uacucuggaaguggaagcucauuuuuaacauuugccuaagca

SEQ ID NO: 188699 - RNA, 53 nt, Homo sapiens
uauauaauuucacagcuuuuauuuuuauagaguaaaagagaaaacccuugaaa

SEQ ID NO: 188700 - RNA, 43 nt, Homo sapiens
uauaacuuacuaguuugaauauuaaauucuguuucagaugaga

SEQ ID NO: 188701 - RNA, 54 nt, Homo sapiens
cugaauaaaacuuuuuuaaagaaauuaaguuuuauccuaauuguuauugcauug

SEQ ID NO: 188702 - RNA, 44 nt, Homo sapiens
gagagaagagcaguuuuuugacuuucgaagcccuuaacuauuuu

SEQ ID NO: 188703 - RNA, 59 nt, Homo sapiens
guugggguugcaucugguuauguuaguuauugaacaaaggagagaggagucuugaagau

SEQ ID NO: 188704 - RNA, 50 nt, Homo sapiens
auucaucagucccaacugaucaguuaacucagugagauaauugcacacau

SEQ ID NO: 188705 - RNA, 70 nt, Homo sapiens
acuuacuuucuguuacaaauucauucuaccucuguagagguugauugacagcaugaguaaauccagugau

SEQ ID NO: 188706 - RNA, 53 nt, Homo sapiens
uaauuugcacuugaaagcuugaauuuuaucauugacaauauauacugucagau

SEQ ID NO: 188707 - RNA, 12 nt, Homo sapiens
uguuggucucug

SEQ ID NO: 188708 - RNA, 56 nt, Homo sapiens
uggaguauaggaagaaauccaguuuaacccaaacauguaguuagaaaaaggagaag

SEQ ID NO: 188709 - RNA, 45 nt, Homo sapiens
uuuugcacaucucuuuaaugucuagcucaguagacgacaucuggg

SEQ ID NO: 188710 - RNA, 46 nt, Homo sapiens
aaugacagguuaaauuaggguggagacaugcaugaagugaugggau

SEQ ID NO: 188711 - RNA, 67 nt, Homo sapiens
ugauacaguuuacauuccagagguccuauggagugauaucacuguaucacuccauaggacuggagaa

SEQ ID NO: 188712 - RNA, 93 nt, Homo sapiens
cugcuugaaauagacauugaugggguuuucaagucucugcuacugcugaaaaaaaagaaguacgcugcucugguuguugagccaacgucggau

SEQ ID NO: 188713 - RNA, 85 nt, Homo sapiens
auuuauggagauacagauucaauuaugauaaacaccaauagcaccaaucuggaagaaguauuuaaguugggaaacaaggugagau

SEQ ID NO: 188714 - RNA, 50 nt, Homo sapiens
aguuuuuauuucuauccacguuguaaccuaaauaucucugaucuguagcu

SEQ ID NO: 188715 - RNA, 45 nt, Homo sapiens
accccuuggagaucuaggggaaugaaaugagaaaaugcacaaggu

SEQ ID NO: 188716 - RNA, 47 nt, Homo sapiens
ugaacaaaacugggagauaguaauaaaggggagagggcaauaaaaaa

SEQ ID NO: 188717 - RNA, 50 nt, Homo sapiens
uucaaguacuaguaaaauaauucaaacacagaugagaggagagagacagg

SEQ ID NO: 188718 - RNA, 46 nt, Homo sapiens
aucugcaucauacaccaaaguggguuucuuguuaauaaguaauacu

SEQ ID NO: 188719 - RNA, 48 nt, Homo sapiens
uucucuuuccuagccuucaaaaccauuuauauuuuacuaccccuguua

SEQ ID NO: 188720 - RNA, 42 nt, Homo sapiens
gauucuagauuuuuagaccugugaggaaucucaaccucuuca

SEQ ID NO: 188721 - RNA, 34 nt, Homo sapiens
auuuuaaaaaaauaccuuuacagugacaucuaga

SEQ ID NO: 188722 - RNA, 86 nt, Homo sapiens
gagaugcacuuacugaucgauaaugguuugcucuucuuaagcuggaccacuaggaguuuuccuccuuuuacuagagccuaaaaaau

SEQ ID NO: 188723 - RNA, 55 nt, Homo sapiens
uggaauagaaauucuuuucucuugagugaauauuuguuuauauaacaugcauugu

SEQ ID NO: 188724 - RNA, 50 nt, Homo sapiens
aauccacaggaugaauaaauagucaugcuggggacaagaaauuauaagac

SEQ ID NO: 188725 - RNA, 41 nt, Homo sapiens
uuuaacuggggauguaauauuuaggauuguauaggcucaua

SEQ ID NO: 188726 - RNA, 45 nt, Homo sapiens
aucauagcuagcucauagaaucuguuuguugaacuuacaguagaa

SEQ ID NO: 188727 - RNA, 44 nt, Homo sapiens
uaaauacuguugguguuugaaugaaugaguuccuucuugagguu

SEQ ID NO: 188728 - RNA, 42 nt, Homo sapiens
ugucuccagugucacugcaauuaugcuguucaggccucauua

SEQ ID NO: 188729 - RNA, 48 nt, Homo sapiens
cuguugagcccaucaacauggccucaaggaggggagcuauugcaaagg

SEQ ID NO: 188730 - RNA, 35 nt, Homo sapiens
uaaagagauuguucacaaaaaugugggcaauuaua

SEQ ID NO: 188731 - RNA, 59 nt, Homo sapiens
acugcagcuucaucuuucucuaauuauccccaacaggauugaaucauaguuuugugcaa

SEQ ID NO: 188732 - RNA, 42 nt, Homo sapiens
uaguaauaagggauccauuuucuuuuucauuuacuaucccuu

SEQ ID NO: 188733 - RNA, 46 nt, Homo sapiens
gagguuccugaaaacugugguuggauguagaaauuaacucugagaa

SEQ ID NO: 188734 - RNA, 44 nt, Homo sapiens
ugcaacagaaaagauaggugcagguacacuguucugcacuaaac

SEQ ID NO: 188735 - RNA, 55 nt, Homo sapiens
uuccacaggagaggcuaaucugucuuaauaagguaaaaugaauuuauuugaaaau

SEQ ID NO: 188736 - RNA, 41 nt, Homo sapiens
cgugaagccggacaaaggccucugucacagcugcugagagu

SEQ ID NO: 188737 - RNA, 132 nt, Homo sapiens
cgcuaucuggggugacagaaggccuuguggucuuggccuuggccccuuccugccacucccagcccaggauccuggugccccuggcuccuaccugagccuuggaccuuauaggcaaaggacacgaggaccccg

SEQ ID NO: 188738 - RNA, 49 nt, Homo sapiens
uugcaaaguggcaccaccaugggguuguccucaaugccacggaacaguc

SEQ ID NO: 188739 - RNA, 117 nt, Homo sapiens
cugacugagggcagaccagggugugaaggggagccaacacccacccuccaguccccugucccgccaagccccggccccaggaacacaccugguugggccagcccaaaauggauaagg

SEQ ID NO: 188740 - RNA, 43 nt, Homo sapiens
cugagauuguauuguuuugggaagaacuuaaguagcauucuau

SEQ ID NO: 188741 - RNA, 45 nt, Homo sapiens
guguguuuuuucagcaauguuugacugaaucccaagcuuucucaa

SEQ ID NO: 188742 - RNA, 46 nt, Homo sapiens
aaaagucaucuggaagacucaugcugauaauguaaugcauggugaa

SEQ ID NO: 188743 - RNA, 41 nt, Homo sapiens
ucaggguugauguaaaaccuagaggucuuccuucccaagcc

SEQ ID NO: 188744 - RNA, 46 nt, Homo sapiens
gugguuuguccuuaguuuugccaucugguaaugaaugguugaagug

SEQ ID NO: 188745 - RNA, 56 nt, Homo sapiens
guagcuucaaaauaaaguuagaaagcugaauugggagcccaaccaauugcuuuuuc

SEQ ID NO: 188746 - RNA, 57 nt, Homo sapiens
ucugcuugucugguuucuugccuaaguucagcaucaauauucuaauccccugggaag

SEQ ID NO: 188747 - RNA, 46 nt, Homo sapiens
gugauaagauacuuucuaccaauuagcucuacucaauaguggaguu

SEQ ID NO: 188748 - RNA, 63 nt, Homo sapiens
accuucccuuccuagaacagauuucuaggaaaagucuucaggucuuuuugaucacaauacgau

SEQ ID NO: 188749 - RNA, 57 nt, Homo sapiens
cugccucacauuccauaacaguaacacaaauuauggauaaaucauuaaguauaaauc

SEQ ID NO: 188750 - RNA, 57 nt, Homo sapiens
ugaaaucuucugugauuaauuuguauugauuuuuggggggcaggaacuggaaggggg

SEQ ID NO: 188751 - RNA, 55 nt, Homo sapiens
caucucugaccaagaaggguggcagggaagggggguucuaauuccaacucagcua

SEQ ID NO: 188752 - RNA, 62 nt, Homo sapiens
ugaugaaguuggggagggaaggggacuugaaggggauaaaugaacuccucauuagauucaga

SEQ ID NO: 188753 - RNA, 49 nt, Homo sapiens
aaggugccaaaguuacaagccucuggcauuggugguucauggcaggauu

SEQ ID NO: 188754 - RNA, 37 nt, Homo sapiens
uaguuucggggguuugaaauaugugcuggcacggggu

SEQ ID NO: 188755 - RNA, 42 nt, Homo sapiens
uuccaguuuuucaacuaauuuuguauuguagauuucaccgaa

SEQ ID NO: 188756 - RNA, 37 nt, Homo sapiens
acagaaaguauaaguaacuugcucaagaucacagagc

SEQ ID NO: 188757 - RNA, 29 nt, Homo sapiens
ugagaaauuguaaucuucaauuucuaguu

SEQ ID NO: 188758 - RNA, 56 nt, Homo sapiens
uaaacaaaccaaaaucucaaaauuuggagaugaugguuggcaaggaacuaugugua

SEQ ID NO: 188759 - RNA, 50 nt, Homo sapiens
gcuauuugcccaguuauuuuucaaguuuguguuuuuacuuugccauuucu

SEQ ID NO: 188760 - RNA, 72 nt, Homo sapiens
gagcagccagagaaugagaagaggugggaaaacaugguguugugaaaccagugaagagcauuucagggaagu

SEQ ID NO: 188761 - RNA, 57 nt, Homo sapiens
uguaggacucagucuuaaggaaccccagcauuuaaugacuugguagaggaggacagg

SEQ ID NO: 188762 - RNA, 66 nt, Homo sapiens
ucaauuacugguucuugccucauagccaggaauucuucaagugauauuugcugaguguguacaugg

SEQ ID NO: 188763 - RNA, 47 nt, Homo sapiens
uuuaaugauguccugauagggcagaaaaaaauaauuugucuucagaa

SEQ ID NO: 188764 - RNA, 52 nt, Homo sapiens
uuuucagcccugugcaggaggguggugugccuucugcaggcagggaggagga

SEQ ID NO: 188765 - RNA, 100 nt, Homo sapiens
cauuugacaaaagauuugcuguuuugaggcuagugaugagauugauuuauuuauuuuuuuauuuauuuugccuuaggacuaagaguugagcggagauggg

SEQ ID NO: 188766 - RNA, 52 nt, Homo sapiens
ugaugguguacaggauguuaccacacugucuccuuauguuagccaugcugag

SEQ ID NO: 188767 - RNA, 46 nt, Homo sapiens
gcgauaaaaagaaaagugugaaguuauuaaccacuauucaccagug

SEQ ID NO: 188768 - RNA, 353 nt, Homo sapiens
uuuuuguuuuuuguuuuuuuguuuuuuuguuuuugagacggagucucgcacugucucgcuggagugcagcaucgugaucuuggcucacugcaagcuccgccucccggguucacaccauucuucugccucagccucccgaguagcugggacuacaggcacccgccaccgugcccggcuaauuuuuuuguauuuuuaguagagaugaaguuucacuauguuagccaggauggucucgaucuccuuggccucccaaagugcugggauuacaggcaugagccacugugccuggccugcauuugcugaaguuuuugaguggucaccacaucuuaguuuuaccugugcuuuaaggaauc

SEQ ID NO: 188769 - RNA, 45 nt, Homo sapiens
agguuuaggaggacacaagccaguugauguaagagacagcuggga

SEQ ID NO: 188770 - RNA, 49 nt, Homo sapiens
acucuauaugcuugaaaauacugaguauuucuuucaaaauggcuaagau

SEQ ID NO: 188771 - RNA, 41 nt, Homo sapiens
aaagaaauugggcaagccuauggcacugaguggacauauau

SEQ ID NO: 188772 - RNA, 40 nt, Homo sapiens
caagauacgagugggcagaauaauauaguaaccugcagau

SEQ ID NO: 188773 - RNA, 46 nt, Homo sapiens
guugauaaugauaagccccaaauuuguccaaugaucucccccacuc

SEQ ID NO: 188774 - RNA, 76 nt, Homo sapiens
ccaucuuauuuuuguauuagaaaaugcacucacuaugccccaacugggugauaauacauggguugacuauugagau

SEQ ID NO: 188775 - RNA, 73 nt, Homo sapiens
aaacaggauggugggcuagagaauguuuggauggcugguuuagauuggucagggaaggcuucuuugaggaggu

SEQ ID NO: 188776 - RNA, 65 nt, Homo sapiens
ggcguaauaacauucacaucucuagauaugagaguauuuuuaacuauacauguuauaguguggga

SEQ ID NO: 188777 - RNA, 42 nt, Homo sapiens
uuguuuuacaacaguacaaagaguugcuucagaggcacagaa

SEQ ID NO: 188778 - RNA, 49 nt, Homo sapiens
guugaaggacgugcagacaauaaccaccaaauuuaacuuuaauaggaga

SEQ ID NO: 188779 - RNA, 33 nt, Homo sapiens
gauuuucagaaagccucagcaaaaacugguggg

SEQ ID NO: 188780 - RNA, 47 nt, Homo sapiens
uaaaaaauaaauuccauuuaauaguccaggacgcugauggguggacg

SEQ ID NO: 188781 - RNA, 46 nt, Homo sapiens; identical to SEQ ID NO: 121396

SEQ ID NO: 188782 - RNA, 46 nt, Homo sapiens
acuucuuuucaacugcauuggacccauccuauccaagcugcuaucc

SEQ ID NO: 188783 - RNA, 60 nt, Homo sapiens
cuagaauaaugucagauacauaguaaauguucaaaaauauuugauugauguauggaagaa

SEQ ID NO: 188784 - RNA, 52 nt, Homo sapiens
ucccugauucuagguauuauaauuuguaagugagacuuccucaaggccuuug

SEQ ID NO: 188785 - RNA, 54 nt, Homo sapiens
aaccuggccuggcuucagguguuagagccaagucuaugcgugagaaaucuagau

SEQ ID NO: 188786 - RNA, 96 nt, Homo sapiens
uauagcuagcauccugaguuccuguggauaggaagcgauaucucugcacccacuucccuuaugauauuucaagaccuaucuuuaaaguuccaaaaa

SEQ ID NO: 188787 - RNA, 57 nt, Homo sapiens
auaaaugccuauauuuuggaugugauauggguaauuuggguacauuaaagucuugca

SEQ ID NO: 188788 - RNA, 42 nt, Homo sapiens
aauaaucuuuucagaguaaaaugauccuguggacugguggga

SEQ ID NO: 188789 - RNA, 46 nt, Homo sapiens
uuuaaugacauugaauaauuaaagaaucauuguugguugucuugua

SEQ ID NO: 188790 - RNA, 65 nt, Homo sapiens
agaaaauagcaacaaaauauaaaauuaugaaguucaagucuaagguuuguauuuggcgaugauuu

SEQ ID NO: 188791 - RNA, 31 nt, Homo sapiens
cuuucuugcugcuugccuggugaccacugau

SEQ ID NO: 188792 - RNA, 44 nt, Homo sapiens
agggcauuucagcuuaacgagccaaguacuagcaaaggccuaga

SEQ ID NO: 188793 - RNA, 45 nt, Homo sapiens
aguucaaguggauuccagucaccucccauugguaaaaggggcaga

SEQ ID NO: 188794 - RNA, 46 nt, Homo sapiens
ccauggaaguugaagagguggaccuggagccuauggcugccaaggc

SEQ ID NO: 188795 - RNA, 53 nt, Homo sapiens
gaagauuugaauucauaaaaauuucaguaaaaguuaaaaacacccaauuugga

SEQ ID NO: 188796 - RNA, 42 nt, Homo sapiens
aguguguuuaauuuuagugaguagcaggaagaucauggauua

SEQ ID NO: 188797 - RNA, 44 nt, Homo sapiens
aaccgaacaacauuaagucaauguucauugcuugugcuggaaag

SEQ ID NO: 188798 - RNA, 60 nt, Homo sapiens
ccaccauucacccacaaguccccacuguuuuaguguccauuacuaggagcccaguaaggu

SEQ ID NO: 188799 - RNA, 89 nt, Homo sapiens
agaaaggacucauguccugguaaucucagugcuaaucacaguaguggacucaaaguaaauauguaguuuuguugaauaaaggagccauc

SEQ ID NO: 188800 - RNA, 58 nt, Homo sapiens
ucuugaacuaaucccauuaccuaucuggacuugaguuuuugucagcuguaaauuagga

SEQ ID NO: 188801 - RNA, 63 nt, Homo sapiens
uugucccugcagaugguauuggcuauguggaagauggccgagagauuuuugaugaugaccuug

SEQ ID NO: 188802 - RNA, 36 nt, Homo sapiens
ucgaggacuucacagguguuuaugaagaaguugaug

SEQ ID NO: 188803 - RNA, 47 nt, Homo sapiens
ugagauauccgaggcacagaaaguuuagugagguuacaauggcagau

SEQ ID NO: 188804 - RNA, 45 nt, Homo sapiens
gccaagaagcccuagaaagacugaaaaaggcuaaagcuggugaga

SEQ ID NO: 188805 - RNA, 70 nt, Homo sapiens
uaauuguuuuaacaggaucuuggaggaacuuucuggcgagucauguauauuuggauauguauguuuggcc

SEQ ID NO: 188806 - RNA, 66 nt, Homo sapiens
gugauaaauuagcuaacagcugaucucccuuguuuagugucuccgcaggauaucaguugaauuggg

SEQ ID NO: 188807 - RNA, 43 nt, Homo sapiens
aagcagacaugauuauccccauuucacagauguggacccugag

SEQ ID NO: 188808 - RNA, 46 nt, Homo sapiens
uuagcaggcagggcaccuugauaauggcagugaaaaguugaaaggu

SEQ ID NO: 188809 - RNA, 50 nt, Homo sapiens
aggaacuuccaggaaaauuuuauacauuguaacuaagcaggaaagaaagc

SEQ ID NO: 188810 - RNA, 37 nt, Homo sapiens
cgcgcgcggggcuccggguugggacaguggcaugauu

SEQ ID NO: 188811 - RNA, 23 nt, Homo sapiens
auagaaccuggcuuugaucacac

SEQ ID NO: 188812 - RNA, 48 nt, Homo sapiens
ugaacucuuguccaagagccuaggccauuccuuuagacucccaauauc

SEQ ID NO: 188813 - RNA, 38 nt, Homo sapiens
ucacaaaauucuaaaauaaugcagcugggauuugaagg

SEQ ID NO: 188814 - RNA, 46 nt, Homo sapiens
ugcgccacccagauaacauaaaaccgcuuccugaggggccuaggac

SEQ ID NO: 188815 - RNA, 45 nt, Homo sapiens
cugucuucccuaggggaaguaaagagguuaccccccgccccucuc

SEQ ID NO: 188816 - RNA, 43 nt, Homo sapiens
uggguuggccuucucaucugcgagcccuaauuuugcagguuca

SEQ ID NO: 188817 - RNA, 42 nt, Homo sapiens
auuuucucugcccaucucccucaggcagaagcaaucaagaag

SEQ ID NO: 188818 - RNA, 37 nt, Homo sapiens
cuacaaaaauggcuuuaagcucccaguagucacagca

SEQ ID NO: 188819 - RNA, 46 nt, Homo sapiens
uagacucuuaaaucaggcagcuggugcaaagucaucaccaauaaau

SEQ ID NO: 188820 - RNA, 40 nt, Homo sapiens
uuuuuagucagccucuuaaaaugaaaaccucacucucucc

SEQ ID NO: 188821 - RNA, 34 nt, Homo sapiens
agaaaugaaagggggaucugcagauugaaagaga

SEQ ID NO: 188822 - RNA, 24 nt, Homo sapiens
agagaaacaggcagauagagagaa

SEQ ID NO: 188823 - RNA, 35 nt, Homo sapiens
ugaagcauauuauaaauaacuugagucaagagcuc

SEQ ID NO: 188824 - RNA, 48 nt, Homo sapiens
ucaauuaggauuucucaagcucaguacuagugacauucgggacuggag

SEQ ID NO: 188825 - RNA, 46 nt, Homo sapiens
ggauaauuauagcugcauguaauuuuaaguaucuagcuuugaagau

SEQ ID NO: 188826 - RNA, 45 nt, Homo sapiens
acuuuucauguuuauucacauuuuacuuguaccuuuguuuaagga

SEQ ID NO: 188827 - RNA, 46 nt, Homo sapiens
ugcucggggaaggccccacugagaaaacgcuucuugagugaagaac

SEQ ID NO: 188828 - RNA, 45 nt, Homo sapiens
gaagggggugagguuuugaguggaagccaugagaaggugggcgau

SEQ ID NO: 188829 - RNA, 68 nt, Homo sapiens
cagggucucucugcugagcugcagcuccugugacuauuacccuucaaacaccacccaggcaacccugu

SEQ ID NO: 188830 - RNA, 46 nt, Homo sapiens
guuuguguagguuguccagcuagaagucucugcaccucgcccaacu

SEQ ID NO: 188831 - RNA, 42 nt, Homo sapiens
ccauuccauaauagcauccuuuaaggagaagcuucaggagac

SEQ ID NO: 188832 - RNA, 45 nt, Homo sapiens
agauguuucuugagaccaaggauuucagaggaguauuauggugga

SEQ ID NO: 188833 - RNA, 45 nt, Homo sapiens
aaaggccuucccaagagagucucaccuguaaagugagguccugaa

SEQ ID NO: 188834 - RNA, 45 nt, Homo sapiens
gcaauggugacauuaucugaugagucacguaaguggcaccuguca

SEQ ID NO: 188835 - RNA, 45 nt, Homo sapiens
auuacaguugaccugcuggcccuaacaaagugcaacccggucucu

SEQ ID NO: 188836 - RNA, 43 nt, Homo sapiens
agucuuaaguauguaugcucuacuuauggcuuugucccuggac

SEQ ID NO: 188837 - RNA, 43 nt, Homo sapiens
ucagugguguccgccauugagccgugcuaaaugucgugucaca

SEQ ID NO: 188838 - RNA, 53 nt, Homo sapiens
cuaggagauaagcauagaucccuuuuaucaugcuucucugagauuuucacaga

SEQ ID NO: 188839 - RNA, 120 nt, Homo sapiens
gcuuugcaauaaguguucauuuaaaagaaagacauuuacaaagguaaaacauaagaguuuagacuauagcgauaaaucuuuuuauuuuaguaauuucuuuaaagggaaaaguaaagagau

SEQ ID NO: 188840 - RNA, 74 nt, Homo sapiens
cagcugcuugucagaagagacccuauuuaacacuucuaaacuuguuucagagguggaggaaaggauaaucuggg

SEQ ID NO: 188841 - RNA, 47 nt, Homo sapiens
gugggcugcuguuuccuuguaacaaaaccccauaaugauggcaguuu

SEQ ID NO: 188842 - RNA, 24 nt, Homo sapiens
gcaggggucaaagcagacagaaau

SEQ ID NO: 188843 - RNA, 36 nt, Homo sapiens
guugauuccauuuucagucuguauguaagucaaaua

SEQ ID NO: 188844 - RNA, 27 nt, Homo sapiens
acuuucagaugcuuaccaaaggggcag

SEQ ID NO: 188845 - RNA, 48 nt, Homo sapiens
gaauuucuuuuuaaccaauauuucuucuacuuuuuucagccaaaugau

SEQ ID NO: 188846 - RNA, 49 nt, Homo sapiens
ccugagagauccugcaacucuuuuauaaaauauuugaaucaauucagaa

SEQ ID NO: 188847 - RNA, 79 nt, Homo sapiens
ucuuauccuucagucugaacccagaggcagccacucuuuacuacuucugcuguagucuuuggguugguaauauuuacau

SEQ ID NO: 188848 - RNA, 44 nt, Homo sapiens
ucaccaacacuugauuuucuacuuucuugaaagaaccuauaggc

SEQ ID NO: 188849 - RNA, 48 nt, Homo sapiens
cucuggacuggucaagacuuuucaacuuggcuugaggaugagcaggua

SEQ ID NO: 188850 - RNA, 381 nt, Homo sapiens
gcugcuuuucuuuggauuccuuuaucgucauuuuauuuuuauuucuuuuuuuccccucuuuuuuuuuuuugagauggagucuugcucugucgcccaggcuggagugcaguggcgcaauuucagcucacugcaaccuccgccucccagguucaagcaauuaucuugccucagccucccuaguagcugggacuaaagaaacaugccaucaugcccagcuaauuuuuguauuuuuaguagacacaggguuucaccauguuggccaggcuggucucgaacuccugaccucaagugauccgcccaccucggccucccaaagugcugggauuacaggugugagccauugcgccuggcuccuuuauugucauuuuaauggggcucgag

SEQ ID NO: 188851 - RNA, 41 nt, Homo sapiens
aaagugcagguaauugagcaagccuuuagauggcuccuaga

SEQ ID NO: 188852 - RNA, 47 nt, Homo sapiens
agaucucggauucagguauggcucuaugagcaagugaauaugcugau

SEQ ID NO: 188853 - RNA, 31 nt, Homo sapiens
uuaggcauccuucuuuuguuagucgcaauuu

SEQ ID NO: 188854 - RNA, 78 nt, Homo sapiens
guuugauccuuucauuagcacuaacauccaauauuuucuggaucgguuuuauaccaaccgcaucucuuuccgcaugcu

SEQ ID NO: 188855 - RNA, 46 nt, Homo sapiens
agucagaaauagacacaaugaugugguuccuacaauggcacaagga

SEQ ID NO: 188856 - RNA, 45 nt, Homo sapiens
uaaguaugguaccacuuagcugaaaguaaaaauaucuagguaaga

SEQ ID NO: 188857 - RNA, 46 nt, Homo sapiens
gaguuuucuugaacuuuuagaauaugaaaauaagagcccugaggau

SEQ ID NO: 188858 - RNA, 49 nt, Homo sapiens
ucccccauguggcuuaagugcaucagggaagccagugccuccaaagauc

SEQ ID NO: 188859 - RNA, 48 nt, Homo sapiens
ucaucuuuuauuguaacuuuuuugagaauggagaagggggucagggau

SEQ ID NO: 188860 - RNA, 42 nt, Homo sapiens
guugaaggcaggccagcaugauaagauaucgaggguaggggg

SEQ ID NO: 188861 - RNA, 48 nt, Homo sapiens
ugagauaaagagcaauacauggaaaaauuacccgcaaggcaccaaaaa

SEQ ID NO: 188862 - RNA, 46 nt, Homo sapiens
ccauuauuuuacuuccaugguaaucugauuuuagaguugggcaaau

SEQ ID NO: 188863 - RNA, 254 nt, Homo sapiens
uucuguucucacucauaagugggaguugaacaaugagaacacauggacacggcaaggggaacaucacacaccagggccugucgggaggugggggggcuaggggagagauagcauuaggagaaauaccuaauguagaugacaaguugaugggugcagcaaaccaccauggcacguguauaccuauguaacaaaccugcacguucugcacauguaccccagaacuuaaaguauaauaaaaaaaauuaaaugcuuuc

SEQ ID NO: 188864 - RNA, 51 nt, Homo sapiens
ccugcagaacuuuguuuuucuuuuuuauggcuucugagaauuugguuauau

SEQ ID NO: 188865 - RNA, 47 nt, Homo sapiens
ugcaaaaagugauguccauacuuuuuuuuuuuuaaaagcuaggauag

SEQ ID NO: 188866 - RNA, 54 nt, Homo sapiens
gccacccacaucucguucugaaguuuuaagggcugugagguuugugucaagcag

SEQ ID NO: 188867 - RNA, 32 nt, Homo sapiens
aauauccggggggcucuccuggggcucggauu

SEQ ID NO: 188868 - RNA, 43 nt, Homo sapiens
caccgaaguccaggaauuguuugauggagagcggcgacggcga

SEQ ID NO: 188869 - RNA, 45 nt, Homo sapiens
uuaaugucuucauugguaguaucaauccaugcuccucguauggau

SEQ ID NO: 188870 - RNA, 44 nt, Homo sapiens
gcaggaaaaggcugacuugaacuguuccccacaggggccgcugg

SEQ ID NO: 188871 - RNA, 41 nt, Homo sapiens
cuguuggaaggcuugcugggacccuucgugaucuaacaugu

SEQ ID NO: 188872 - RNA, 27 nt, Homo sapiens
cccagcucccaucaaggugagccagua

SEQ ID NO: 188873 - RNA, 40 nt, Homo sapiens
ggcaccuggcccaggacucagaaaagcugaaggaggauau

SEQ ID NO: 188874 - RNA, 45 nt, Homo sapiens
ucuguaaagccacagcaggagcagucugacuguccaccuccuccu

SEQ ID NO: 188875 - RNA, 46 nt, Homo sapiens
ccauucagcuugucucaggccugggucagagacugaugcugggagg

SEQ ID NO: 188876 - RNA, 48 nt, Homo sapiens
cacauguaaauagccugcacuuccuaaaucucguguggccucccaugg

SEQ ID NO: 188877 - RNA, 47 nt, Homo sapiens
auuuugugugguagauaagaaagaaauuaucacaaaaaaucagaaau

SEQ ID NO: 188878 - RNA, 46 nt, Homo sapiens; identical to SEQ ID NO: 121558

SEQ ID NO: 188879 - RNA, 44 nt, Homo sapiens
cacgaaagacuauccucaccggugugaguacugcaagaaaggcu

SEQ ID NO: 188880 - RNA, 46 nt, Homo sapiens
ggagaagccguaccaaugccaguacugcgaauauaggucugcagac

SEQ ID NO: 188881 - RNA, 45 nt, Homo sapiens
caaguguaaauucugugaauacgagacagcugaacaaggguuauu

SEQ ID NO: 188882 - RNA, 46 nt, Homo sapiens
gaccagcaaggcagagaaggccauugaaugcgaugagugugggaag

SEQ ID NO: 188883 - RNA, 42 nt, Homo sapiens
gaaaaggcacaugaaaaaccaucccgaacaccuugccaagaa

SEQ ID NO: 188884 - RNA, 47 nt, Homo sapiens
ucauacuccuuucuuuuccuuuuuuagcaauaauuauuggcccugau

SEQ ID NO: 188885 - RNA, 42 nt, Homo sapiens
aaauaccaguauccuguaaggauuauuugaauugaauuagag

SEQ ID NO: 188886 - RNA, 45 nt, Homo sapiens
cuggcaaaauagaacacgaugguucuucuggaaugaccauggaca

SEQ ID NO: 188887 - RNA, 46 nt, Homo sapiens
uacuccaaguuacagguaaaaccaugacauuuugcaagcucuaaaa

SEQ ID NO: 188888 - RNA, 34 nt, Homo sapiens
cuauauugauuucagaaguuaaggauuaacaaag

SEQ ID NO: 188889 - RNA, 725 nt, Homo sapiens
aaaaugcuauuuuaaaaugcagguugagcauccuuaauccaaaaauccaauaucugaaaugcuccagaauccagaacuuucuaaguacagacaugacaccacaaguggaaaauuccacaccugacacuugcuuucugaggguucaauguauauaaacuuuauuucaggcacaaaauuguuuuaaaaaauuguauaaaauuaccuucaggcuauguguauaagguguauaugaaacacagauaauuuuuuuuuuuuuuuuuaauuugagacagucuuguucugucucccaggcuggagugcaguggcuccaccucggcucacugcaaccuccaccccggcucacugcaaccuccacccccuggguucaagugauucuccugccucagccucccgaguagcugcgauuauaggcacgugccaccaugcccagcuaauuuuuuuguauuuuuaguagagacgggguuuugccauguuggccaggcugaucucgaucgaacuccugaccucaagugauccaucugccucagccucccaaaaugcugggauuacaggcgugagccaccaugccuggcugaaacacagauaaauuucauguuuagacuugggucccaucccuaagauaucucauuguguauaugcaaauauugcaaaauccacaaaagucugaaacacuucugguccaaguauuuuggauaaggguuacucaacccuuacgacugccagau

SEQ ID NO: 188890 - RNA, 52 nt, Homo sapiens
uauagacuuaagggaaaaaaaaaaucacuggacagagagaaccugaagauaa

SEQ ID NO: 188891 - RNA, 51 nt, Homo sapiens
guaucuaaauuagaguagguucaguaaggcaugggcuauuggagaggagau

SEQ ID NO: 188892 - RNA, 24 nt, Homo sapiens
auaugacuuuggugcuuuugagag

SEQ ID NO: 188893 - RNA, 32 nt, Homo sapiens
uugcuuguugguggauguuucuucuaggcagu

SEQ ID NO: 188894 - RNA, 51 nt, Homo sapiens
ccuugggagauuggaugccuagucaugccauuaccugaaaggaggaguagg

SEQ ID NO: 188895 - RNA, 26 nt, Homo sapiens
aaguacguuaauaauaguaaagggga

SEQ ID NO: 188896 - RNA, 49 nt, Homo sapiens
gauacagauaugugcuaaauaaauacauacauaagaccauuaucccugg

SEQ ID NO: 188897 - RNA, 47 nt, Homo sapiens
aacggucaucauuccugagcaagugcuggacucagauguaacugaag

SEQ ID NO: 188898 - RNA, 79 nt, Homo sapiens
aagggagaaaggaaaaaaaauagaaguaaaagaaacacaugggagagauggaaagaagaacaaauaugaguugaggaga

SEQ ID NO: 188899 - RNA, 53 nt, Homo sapiens
uaaauuucuauagccauagauggagcauauuggugguauauugcaccagaaca

SEQ ID NO: 188900 - RNA, 56 nt, Homo sapiens
gguaguuuggggccagaacuuagaagaugacagguguuugaauuuuauuuagaggg

SEQ ID NO: 188901 - RNA, 56 nt, Homo sapiens
guguuuguguacaugcugacagugguagagggaagugcuugaaggaaaguuagggg

SEQ ID NO: 188902 - RNA, 77 nt, Homo sapiens
guaauuuaguaucuguaaguaagacauauauaaauaaucauaauaugacaaaccaguacaauaagagaagaauagag

SEQ ID NO: 188903 - RNA, 74 nt, Homo sapiens
gaauuaaaaaaaaaaaaaaaagauucuugagaaguugagaauugacaagaucuggcaaucugacugugagcaga

SEQ ID NO: 188904 - RNA, 58 nt, Homo sapiens
ccccauguaggccagaauaucuauuaggaaaugcacgugauguaaaaggaugggaaga

SEQ ID NO: 188905 - RNA, 49 nt, Homo sapiens
aaaacaaauaaauuauaucugugaucccuaauuuaagauagauaaaaug

SEQ ID NO: 188906 - RNA, 123 nt, Homo sapiens
auuguuauagacacauuugccuuuguuugccuuuccugcagcuuaagcauuccuucuaccauguauaauaaaauuuaguucucugagugugacuuagugagaagaauuagaguugagucauag

SEQ ID NO: 188907 - RNA, 45 nt, Homo sapiens
aucuggagaaaugauggcuaacauugaacaacaugggggaaaaau

SEQ ID NO: 188908 - RNA, 43 nt, Homo sapiens
gacuauuugagcaaagccuacaaaaguuccagaugggacaggg

SEQ ID NO: 188909 - RNA, 64 nt, Homo sapiens
ugucuucauccuuugauuacaucaaguguuucucacacugcucgaacuaagucugcaacuaaag

SEQ ID NO: 188910 - RNA, 42 nt, Homo sapiens
ggucaugaaauuaaugguugcugauacucaaccuggagcaug

SEQ ID NO: 188911 - RNA, 39 nt, Homo sapiens
uauuuuauugucuucccaacccccuggaaaaagcuuggu

SEQ ID NO: 188912 - RNA, 269 nt, Homo sapiens
uuauaaaacccagguaucuuguaauuguauuuuacucaaaggaaguauacucuaaggaaauuguguggccuugagguacacagccauuaggcauuuaaaaaauauauuuaaaaaguuuuauggaauauuuuuaaauuacugaaaaucagaaucacccagauuuaagagaucuuaauauuuugcuacauauuugauucauaucuuuuuguuguuuaaagaaauaaaaucucacagauucaaagggucccuccccauccccuuccugucuu

SEQ ID NO: 188913 - RNA, 96 nt, Homo sapiens
ccaggucaaggaguaaccccucccaccaccccuuaucugauuggaauauggccagccuauucuuauuccugccaaguuauuuuuccagacaacauu

SEQ ID NO: 188914 - RNA, 45 nt, Homo sapiens
gaccauuaucucucaaagcaauaauuucgguuacuggguacagag

SEQ ID NO: 188915 - RNA, 74 nt, Homo sapiens
uguguguuuauauuuuuuccuucuacacugugaauauagagacaaguucugauuuaucuuugucuccaagcagu

SEQ ID NO: 188916 - RNA, 36 nt, Homo sapiens
ucaagauuaagauuagagucaaguugugugauuaag

SEQ ID NO: 188917 - RNA, 28 nt, Homo sapiens
aggaaaucaguuugagagguauguuuag

SEQ ID NO: 188918 - RNA, 40 nt, Homo sapiens
uuuggaacgaugcgucucuauuaagacagcugcuccuuuu

SEQ ID NO: 188919 - RNA, 57 nt, Homo sapiens
cugugcuuuacgguacuuaguaguuccauuggacuaggaaaaguuucaaaguugaaa

SEQ ID NO: 188920 - RNA, 76 nt, Homo sapiens
aaguauuaauagguggcauuuugagaagguuaccgagggauggguaggacuuuguuagguagagguggagguggag

SEQ ID NO: 188921 - RNA, 43 nt, Homo sapiens
augcagacgguggcugcaagaagucucauguuuagagguaggu

SEQ ID NO: 188922 - RNA, 43 nt, Homo sapiens
aucuguuggugguauuuuuuuaaaucgaggaauaagggcagac

SEQ ID NO: 188923 - RNA, 42 nt, Homo sapiens
gcggcggcucggcgccugcugcaggggacgauagaggggguu

SEQ ID NO: 188924 - RNA, 23 nt, Homo sapiens
gccccgaggaggccgcaguuagg

SEQ ID NO: 188925 - RNA, 84 nt, Homo sapiens
ggaagcauauuaauguuauaaacuucgcugacuuugaagguuguguuguagcaugaggaacacaaauaaaacaauucuaaauca

SEQ ID NO: 188926 - RNA, 50 nt, Homo sapiens
gcaaugagugaguccuuuugauuuuuaacuuauuccccaugucccuauac

SEQ ID NO: 188927 - RNA, 41 nt, Homo sapiens
auuguccuuuagagcaugauuacuuguucccauggacaaau

SEQ ID NO: 188928 - RNA, 51 nt, Homo sapiens
ggccccauauuuuauguugcuuuaucuuugaaauuuugcaugaaaaggaaa

SEQ ID NO: 188929 - RNA, 31 nt, Homo sapiens
aaaaaaagagaauaaccuuaccguuaccuac

SEQ ID NO: 188930 - RNA, 46 nt, Homo sapiens
gaauuccucuuaacaaccaagggguuuauuuucaaagcaauauugg

SEQ ID NO: 188931 - RNA, 81 nt, Homo sapiens
ucuuuuauuuucauuuugcaguuuaauugguuggggucagauaagaagaggagugacaaucaagccaacaguagaugauga

SEQ ID NO: 188932 - RNA, 51 nt, Homo sapiens
uuuugaccaauccagugugcacagagguaggagaaaaaauugcccuuagcc

SEQ ID NO: 188933 - RNA, 42 nt, Homo sapiens
aucggccuugacagcacuaacucucccuccuguugacaggga

SEQ ID NO: 188934 - RNA, 46 nt, Homo sapiens
cuaagaaugaagugcucauggugaacauaggaucccugucaacagg

SEQ ID NO: 188935 - RNA, 41 nt, Homo sapiens
auuuaccuuugcugcuuucuugucuccuucagugcguacac

SEQ ID NO: 188936 - RNA, 58 nt, Homo sapiens
uggggcaaguacuuggugcagucggagcuuuaccugagauauucacagaauuggaaau

SEQ ID NO: 188937 - RNA, 45 nt, Homo sapiens
guaaagcuccgacugcaccaaguacuugccccaccauucugucag

SEQ ID NO: 188938 - RNA, 51 nt, Homo sapiens
uaggaguuggaacaaaaauugaccccacuuugugccgggcugacagaaugg

SEQ ID NO: 188939 - RNA, 49 nt, Homo sapiens
agggagguguagcuggugguaguauccuaaaaggaguauuaaagguaaa

SEQ ID NO: 188940 - RNA, 46 nt, Homo sapiens; identical to SEQ ID NO: 144566

SEQ ID NO: 188941 - RNA, 97 nt, Homo sapiens
caauuucagcucagcugaaauacaauauugaaguuguuugugaguacauaguaaagaaaauuccaguacccccaagagacuuuacuucagagccccg

SEQ ID NO: 188942 - RNA, 45 nt, Homo sapiens
gaaucaaaauaugcuucaguuucaugaucucuauagcagccaggu

SEQ ID NO: 188943 - RNA, 63 nt, Homo sapiens
gcugauuuuaagcuucuugcuuaggaccaggauugggagccacacaauugggagguuccagug

SEQ ID NO: 188944 - RNA, 29 nt, Homo sapiens
uuuuggcagucucuuaaauuuugcacuug

SEQ ID NO: 188945 - RNA, 42 nt, Homo sapiens
agcuugaugacccaaguugcccucggccagaauguuauagau

SEQ ID NO: 188946 - RNA, 45 nt, Homo sapiens
aauccacagucgucaaagcuauuucuggaguucauacugucaggu

SEQ ID NO: 188947 - RNA, 45 nt, Homo sapiens
auguuaccaaguugacgccacuuucacacgaaguuaucagcagac

SEQ ID NO: 188948 - RNA, 31 nt, Homo sapiens
cguccacuagaggcuggacaggaccccccga

SEQ ID NO: 188949 - RNA, 57 nt, Homo sapiens
accgagccuugguuucuuaucuaugaaauauagucgguacuaccaacaucgcagggu

SEQ ID NO: 188950 - RNA, 35 nt, Homo sapiens
uggauuacuuuauuagcaucuauuuucucugaauu

SEQ ID NO: 188951 - RNA, 50 nt, Homo sapiens
auggagccaugggugaggcauuguagaacaguguuuaauaggggaggcua

SEQ ID NO: 188952 - RNA, 47 nt, Homo sapiens
caggagcugucuuuacauaugucuuuggggucuucugacucacaguu

SEQ ID NO: 188953 - RNA, 42 nt, Homo sapiens
uugagaagauagagaaugcugaaaaagcugaugugggggcag

SEQ ID NO: 188954 - RNA, 47 nt, Homo sapiens
gagcacccagaauugucuccuaggcaguugauuacacauauauaugg

SEQ ID NO: 188955 - RNA, 169 nt, Homo sapiens
gcuaagagaaagaagacuuggaaaguagggcuguaagcucuaaaaguuuuuuuuuuguuuuguuuuuuuuuuuucuaacacgcgugggaguagagcuagagguuggaggcaggaggccuggaagcugugacuuuuaggaaaacuaugucucauuuaaaucaggucgagg

SEQ ID NO: 188956 - RNA, 46 nt, Homo sapiens
ugagcauguaggggauuuuguuuacauugaaguaagguuccacagg

SEQ ID NO: 188957 - RNA, 53 nt, Homo sapiens
gccgggagcuguguaaggaugagaauuaagaagauagauggucuggggugggg

SEQ ID NO: 188958 - RNA, 58 nt, Homo sapiens
aaaaaacauagccuaggaaauuuaauggcacugaaaaauacauauaaagugugggaaa

SEQ ID NO: 188959 - RNA, 46 nt, Homo sapiens
uguuugaccccagcaaagaagggaccauagaacaacggaccaggag

SEQ ID NO: 188960 - RNA, 45 nt, Homo sapiens
acaaaaauagcugaucuucauuaauuacaucuuaauuagaaccau

SEQ ID NO: 188961 - RNA, 47 nt, Homo sapiens
aaaaugcaacauagauaauaguguaaaucagauauaauugagggcua

SEQ ID NO: 188962 - RNA, 47 nt, Homo sapiens
aucauaagcaaagguuguguucuggggugaggaucaugagagagaua

SEQ ID NO: 188963 - RNA, 44 nt, Homo sapiens; identical to SEQ ID NO: 121701

SEQ ID NO: 188964 - RNA, 52 nt, Homo sapiens
guuccucuggggccuccguuccuaccaugagacuagcaagaugaaagugcug

SEQ ID NO: 188965 - RNA, 45 nt, Homo sapiens
gagaucuaaggaaacuucucaccuaugaguuuguaaagcagaagu

SEQ ID NO: 188966 - RNA, 42 nt, Homo sapiens
uagaaauuugggauucaacugaaagaaauugacaaagaagaa

SEQ ID NO: 188967 - RNA, 46 nt, Homo sapiens
gauguuuauccagaaaucauugaacgugcaugcuuuguccuagaga

SEQ ID NO: 188968 - RNA, 82 nt, Homo sapiens
cucuuuccugaagaagggccacaucucggggcugugcagcaccuggguucugugaggcacgcgaguugggagaagggcgcag

SEQ ID NO: 188969 - RNA, 45 nt, Homo sapiens
aacucgcgugccucacagaacccaggugcugcacagccccgagau

SEQ ID NO: 188970 - RNA, 47 nt, Homo sapiens
cgcagguucugccagucagguggaauuggccaaucagcggggaucca

SEQ ID NO: 188971 - RNA, 43 nt, Homo sapiens
ccuggaggucugcaccaguuccagugaccacucagaacccacc

SEQ ID NO: 188972 - RNA, 39 nt, Homo sapiens
ggguucugaguggucacuggaacuggugcagaccuccag

SEQ ID NO: 188973 - RNA, 59 nt, Homo sapiens
gaugaaacuccugccuggaagacagugaaagacaaacccaggacucagggugaccaaug

SEQ ID NO: 188974 - RNA, 47 nt, Homo sapiens
gaaucuggagucccggacaauaauucggggcaagaggacccgcaagg

SEQ ID NO: 188975 - RNA, 45 nt, Homo sapiens
gaaccaucugcugaugucugugcaguugcaccgucagguucagag

SEQ ID NO: 188976 - RNA, 102 nt, Homo sapiens
cagacccagaauguaaaucaggccaaaauggccacuucccaggcugacauagagaccgacccagguaucucugaaccugacggugcaacugcacagacauca

SEQ ID NO: 188977 - RNA, 57 nt, Homo sapiens
cagccugggaaguggccauuuuggccugauuuacauucugggucuggguaucagcug

SEQ ID NO: 188978 - RNA, 47 nt, Homo sapiens
gcaggccuaagaccccuuucaaggcuuggaaugauaccacuaaggcc

SEQ ID NO: 188979 - RNA, 43 nt, Homo sapiens
gcauugagagacugagagaaauuguagguggcauuugggccca

SEQ ID NO: 188980 - RNA, 51 nt, Homo sapiens
uggugucuaugauuucucucaggcucauaaugccaaggaugugcccaacac

SEQ ID NO: 188981 - RNA, 30 nt, Homo sapiens
gcuaguccccagaguucacagcccccaacu

SEQ ID NO: 188982 - RNA, 51 nt, Homo sapiens
gggggucgcacagaguggggaaugcagaaagagggaggguggaggcaggag

SEQ ID NO: 188983 - RNA, 48 nt, Homo sapiens
cauggagguuuugagucaggaggaaucaucuaacaguacagaucgagg

SEQ ID NO: 188984 - RNA, 43 nt, Homo sapiens
uugggguuggggccugaggcaaggugagaauuagcccccagac

SEQ ID NO: 188985 - RNA, 46 nt, Homo sapiens
cccaaccccaacccccucgcugccucccuucuucacgacucagagg

SEQ ID NO: 188986 - RNA, 44 nt, Homo sapiens
ggagauucagggcccccagaagaaaguggccaggaaaugaugga

SEQ ID NO: 188987 - RNA, 42 nt, Homo sapiens
guugacaaaagaacacuggagaaauaugaaagagaagcuaag

SEQ ID NO: 188988 - RNA, 46 nt, Homo sapiens
aaacauuuaauagugcuuauuaauaagauggaugaucccacaguaa

SEQ ID NO: 188989 - RNA, 46 nt, Homo sapiens
gauuaccauuuauuccguauuuggauaacuugccaaacuucaacag

SEQ ID NO: 188990 - RNA, 24 nt, Homo sapiens
ggccaaaaccacaagccaggacag

SEQ ID NO: 188991 - RNA, 46 nt, Homo sapiens
acauaaauauauuuuguguaaucgccauucuucuccuagagcacaa

SEQ ID NO: 188992 - RNA, 45 nt, Homo sapiens
caacauauacuucuuugcugaaugcuaauaaacuucuggguucaa

SEQ ID NO: 188993 - RNA, 44 nt, Homo sapiens
aaguggagaggucagaacccgggugauucugugaugucucaggg

SEQ ID NO: 188994 - RNA, 43 nt, Homo sapiens
auguauauuuaggucauguuaaauaaaauggcuggaggaagga

SEQ ID NO: 188995 - RNA, 42 nt, Homo sapiens
caaaagcauuauuccaggaccuugcaauggagacauguuguu

SEQ ID NO: 188996 - RNA, 62 nt, Homo sapiens
ugaauuucuagagcuaagcaguuuguggcugaaacccaauggcagccuaggggaggaaggaa

SEQ ID NO: 188997 - RNA, 42 nt, Homo sapiens
caggaauaggauccuuaccaccugaaguggggcagccaggau

SEQ ID NO: 188998 - RNA, 39 nt, Homo sapiens
accccuggaagcaccacaugaauuugcauggcacuaaca

SEQ ID NO: 188999 - RNA, 48 nt, Homo sapiens
gaaacaguuugcccacaaagucaccuugacuuagggggcaaacagcau

SEQ ID NO: 189000 - RNA, 29 nt, Homo sapiens
auucauuccauaaagggcugcaacugcca

SEQ ID NO: 189001 - RNA, 52 nt, Homo sapiens
ucacaagaagaaaccucgaaagcaaaaacuggagugcaguagcagcagcagc

SEQ ID NO: 189002 - RNA, 47 nt, Homo sapiens
guugggcagaaggguggggggguggggguuguuguuuaacuugaaaa

SEQ ID NO: 189003 - RNA, 42 nt, Homo sapiens
cagcuacuccuccacugccaugaauggaaaccuagccaagua

SEQ ID NO: 189004 - RNA, 47 nt, Homo sapiens
gggaaggcaagugugaagagaauccugaguuccacaaugaugaagau

SEQ ID NO: 189005 - RNA, 42 nt, Homo sapiens
ugggaggcagcucagggagguuuugagugaaagaugagucag

SEQ ID NO: 189006 - RNA, 72 nt, Homo sapiens
gggaaugccacugugaguuucucacaggcccugguagaguucaccagcaaugggaaccucuuuuccagcaug

SEQ ID NO: 189007 - RNA, 47 nt, Homo sapiens
agggccuacccuacuuauucacccccugaagauccagaggaagagga

SEQ ID NO: 189008 - RNA, 47 nt, Homo sapiens
uuaccucagcuuuccccaccacugcaagcagcgagccagacuggagg

SEQ ID NO: 189009 - RNA, 48 nt, Homo sapiens
ugaggcccuuaggcccaucagugaugggccuggcagcagggguaucag

SEQ ID NO: 189010 - RNA, 56 nt, Homo sapiens
gccuaugccagggaggcccacacuugggaagcucauggcagggaggccagaacccg

SEQ ID NO: 189011 - RNA, 61 nt, Homo sapiens
aaacuuugagcccuuuuuguccucccggccaccuggggcaauggagacagaggaagaacgg

SEQ ID NO: 189012 - RNA, 47 nt, Homo sapiens
gacagcuacaguggagaugcccuauaugaguucuaugagccagauga

SEQ ID NO: 189013 - RNA, 41 nt, Homo sapiens
gaggaggaagaagaggaagaagagguggaauuagaggagga

SEQ ID NO: 189014 - RNA, 31 nt, Homo sapiens
ggaggagauggccuugccagaugaugaugac

SEQ ID NO: 189015 - RNA, 44 nt, Homo sapiens
ggcaaggccaucuccuccccaccuccuugguaggucaccaggca

SEQ ID NO: 189016 - RNA, 46 nt, Homo sapiens
aguuucuccaacaccagaaccuucuccaccagcuacugagaaaaug

SEQ ID NO: 189017 - RNA, 62 nt, Homo sapiens
gaaagcuguggcugagaaguuucccucuaugcccaagccaaagaaaggccuaaaaggcuuuu

SEQ ID NO: 189018 - RNA, 46 nt, Homo sapiens
cagagugcccauggggcuuuggagacaggcuccagauguaagacau

SEQ ID NO: 189019 - RNA, 44 nt, Homo sapiens
caagaaggguaucuguacucugccuaguuucuuuggagggggac

SEQ ID NO: 189020 - RNA, 64 nt, Homo sapiens
gagcugcagccucugggaguacccgugaacaaacagcagaaaaaggagccaagaacaaggcagc

SEQ ID NO: 189021 - RNA, 43 nt, Homo sapiens
ugauaauguuauaacagugccuggaagccugaggcugcauuuc

SEQ ID NO: 189022 - RNA, 24 nt, Homo sapiens
gggacauggcucugggagagagaa

SEQ ID NO: 189023 - RNA, 48 nt, Homo sapiens
aaaccucuacuugcagcugggcaucucuagcccagggcuggaccugcc

SEQ ID NO: 189024 - RNA, 34 nt, Homo sapiens
gugacuggagccgcggcgacggcggcagcagcug

SEQ ID NO: 189025 - RNA, 44 nt, Homo sapiens
cagcuuuacauucuaucuccuaucuucugaucuucguauacccc

SEQ ID NO: 189026 - RNA, 45 nt, Homo sapiens
uguaagcuccucccaauacagaaaauauuuuuuaaggcagcauau

SEQ ID NO: 189027 - RNA, 50 nt, Homo sapiens
guugcugggccuuugcuucagacccgaagcuggagcuggcuggcuugacg

SEQ ID NO: 189028 - RNA, 58 nt, Homo sapiens
aaaugaacagaucccucucuucucuggccuagcugagcaaccugucuugagcuccaag

SEQ ID NO: 189029 - RNA, 47 nt, Homo sapiens
gugcagugaguagcccagcuagagggcacggccugugcugaggagcc

SEQ ID NO: 189030 - RNA, 23 nt, Homo sapiens
ccucauccugagacuggcgagaa

SEQ ID NO: 189031 - RNA, 66 nt, Homo sapiens
ugugugcgcgcgcaugagccaagccccccaccaacaacagaguugccaccgcagaacaaaggaaag

SEQ ID NO: 189032 - RNA, 53 nt, Homo sapiens
ucuggacugagcugagcacuuuguuuuggaaacaaaggcucacagccauacuu

SEQ ID NO: 189033 - RNA, 70 nt, Homo sapiens
cggaauauuuaccugauuacaggggagggugugaguacagaaauuggaaaauaauuauuaaagcuggaag

SEQ ID NO: 189034 - RNA, 42 nt, Homo sapiens
cauagagcagucuaaguucaucagugcccaagccaccaguua

SEQ ID NO: 189035 - RNA, 44 nt, Homo sapiens
guuaggcuuccugcuaacgggccacgacuucacaaaccccaccc

SEQ ID NO: 189036 - RNA, 49 nt, Homo sapiens
aaaaggggaaaccccaggccccaacgaagccguccugacuguugcaucu

SEQ ID NO: 189037 - RNA, 25 nt, Homo sapiens
gaaaacagcuggagccacccgguga

SEQ ID NO: 189038 - RNA, 48 nt, Homo sapiens
ugaagaaggcauucccuguacuaaaggagaacagaggacuaguugagg

SEQ ID NO: 189039 - RNA, 24 nt, Homo sapiens
uuuucucaggaguggaugggagga

SEQ ID NO: 189040 - RNA, 43 nt, Homo sapiens
ggugccagcucauagauuugggggagaugggccacaaucagag

SEQ ID NO: 189041 - RNA, 42 nt, Homo sapiens
cuaaggagccauuuguggggagggaaacaacuggggcccuga

SEQ ID NO: 189042 - RNA, 42 nt, Homo sapiens
gccaaaccauacccccagggcaaauacucuccagccccaacu

SEQ ID NO: 189043 - RNA, 42 nt, Homo sapiens
aaacuccagcucugcauccaugguggucacacgcacacugau

SEQ ID NO: 189044 - RNA, 39 nt, Homo sapiens
auagaauauacaccauuuucuuuucucccuuauucagga

SEQ ID NO: 189045 - RNA, 61 nt, Homo sapiens
agagaagcaaacugcaggacaguauggagacuucuaaggacaaggccagccaguuugagga

SEQ ID NO: 189046 - RNA, 50 nt, Homo sapiens
aucaauuccucggacacauccucaggguagaacuuggcacggaacuuaaa

SEQ ID NO: 189047 - RNA, 46 nt, Homo sapiens
gggcaguaaauaucaucauugagaaugcccucuuucacuugcagaa

SEQ ID NO: 189048 - RNA, 46 nt, Homo sapiens
ugcgggagcaacuugucuccggccagguagccagacuuaugcacuu

SEQ ID NO: 189049 - RNA, 34 nt, Homo sapiens
aguguuaaaauauuaaggugcuaagcuuccaggu

SEQ ID NO: 189050 - RNA, 46 nt, Homo sapiens
ccagccacagcucugagccuuucuuguucuugaugcugaaguaguu

SEQ ID NO: 189051 - RNA, 45 nt, Homo sapiens
ucaaugggcuugaugacaaauuucuuaucauugaaagagauguuc

SEQ ID NO: 189052 - RNA, 71 nt, Homo sapiens
ggcgcauguauaguucaugguuccccaugcacaaggccaagauccgcuuguuaauccgcagccggggagca

SEQ ID NO: 189053 - RNA, 51 nt, Homo sapiens
gcuccaucugcuucuggugcuucuccucccgggccugugccuucaucugcu

SEQ ID NO: 189054 - RNA, 47 nt, Homo sapiens
uccuucucccguucaaucuucucuuucuccuucucugccauuucacg

SEQ ID NO: 189055 - RNA, 41 nt, Homo sapiens
aauagcuucguuccuggaaaugauccaccccaagacaaagc

SEQ ID NO: 189056 - RNA, 46 nt, Homo sapiens
ucugggcacgcuuccguuccugcucaaguuccagagcccuacgggu

SEQ ID NO: 189057 - RNA, 42 nt, Homo sapiens
ccugagucuuuuucuggucccgggaggccugcagcaaggccu

SEQ ID NO: 189058 - RNA, 41 nt, Homo sapiens
ucacucuccuucuucugucgggccaucuccagcugggagau

SEQ ID NO: 189059 - RNA, 44 nt, Homo sapiens
cagcacgggucuucuccaagucuuccuguaccaucugggccugu

SEQ ID NO: 189060 - RNA, 46 nt, Homo sapiens
gguacguuccuccucacugcgguccuuggccauagcaucagcccgu

SEQ ID NO: 189061 - RNA, 46 nt, Homo sapiens
cuccagcacaguaugaguuaggugaguuagguguaggagugugggg

SEQ ID NO: 189062 - RNA, 46 nt, Homo sapiens
cccuggggagaaauugagucccuaaagucaacgacaaggcuuauug

SEQ ID NO: 189063 - RNA, 108 nt, Homo sapiens
guccugauggggcuggcugagcuuuuggguacucaucccuacuguuauagcuggagaggauuuggguauugaagcagggaggggcagaucccacgaagugacugcaga

SEQ ID NO: 189064 - RNA, 44 nt, Homo sapiens
gggguggggguguggaagggacuaggccagaauccccagcagcu

SEQ ID NO: 189065 - RNA, 46 nt, Homo sapiens
uaagcuaggggcacugcauggugggacaggauggccccuugaggac

SEQ ID NO: 189066 - RNA, 53 nt, Homo sapiens
ugucucuaaaugaacuagcaaaaaaaaaaaauguaguuuuuguuuguaaggaa

SEQ ID NO: 189067 - RNA, 33 nt, Homo sapiens
aacuuuuugagguucagcaauuggagguggcaa

SEQ ID NO: 189068 - RNA, 48 nt, Homo sapiens
aaagucacagggcaaauuagugggcuagaacugugcaagaacccaggu

SEQ ID NO: 189069 - RNA, 28 nt, Homo sapiens
caagcagcauagcacaguagaaaaagau

SEQ ID NO: 189070 - RNA, 109 nt, Homo sapiens
gauaucacacuucugggucuacaauugucagggaacuggcaagguugucaugauaccagucucuccauucuggucuuucguaagcucucucagggccccacuaucuaau

SEQ ID NO: 189071 - RNA, 40 nt, Homo sapiens
uaggaguggaggaacagcagcaagcuaggaacacuuuggg

SEQ ID NO: 189072 - RNA, 43 nt, Homo sapiens
aaaaagggugagucaugauaaucauuuuucuucauaccuugug

SEQ ID NO: 189073 - RNA, 48 nt, Homo sapiens
ucuguaaaauguugcuaacaauaauucuuaauaugauugucuugagaa

SEQ ID NO: 189074 - RNA, 56 nt, Homo sapiens
gggaaagaauggcccaguugaugaugaaaaaaaggugcacuuauggaaugccauuu

SEQ ID NO: 189075 - RNA, 80 nt, Homo sapiens
auauuaaguggcaaauucaggauuugaaaauagucuggcucuggaaacuggauuuuauguagcaagcaaaggagucacua

SEQ ID NO: 189076 - RNA, 45 nt, Homo sapiens
cacgucuaauacaguacaaaacuaguuuuuucauuuucuggaaga

SEQ ID NO: 189077 - RNA, 39 nt, Homo sapiens
cagggagaugggugggaagagcagccacaugacagacag

SEQ ID NO: 189078 - RNA, 45 nt, Homo sapiens
cagcagccuggguaccucacauccagcagaaacuuggccaacauc

SEQ ID NO: 189079 - RNA, 42 nt, Homo sapiens
gcaucuggaaaugauggcacuguacaguuuagaagcuugauu

SEQ ID NO: 189080 - RNA, 43 nt, Homo sapiens
uaagauuuaugauaugucauaaggucauaugugcuauggaaaa

SEQ ID NO: 189081 - RNA, 47 nt, Homo sapiens
gacaacagcuuuuaguaaggauuuuuuuuucuuuuucuuccccagcu

SEQ ID NO: 189082 - RNA, 134 nt, Homo sapiens
uucccaacuaggaucgguauuuccacaagacauuuagaaguaugugggguguguguguguguguguguguguguguuuuacacacagucugagguacuacugcauuuaaugccaaacagaugcaacaaauaauu

SEQ ID NO: 189083 - RNA, 51 nt, Homo sapiens
uaaacuaggggcagagagggaacaaggcccuggaacugaggucguggcugu

SEQ ID NO: 189084 - RNA, 27 nt, Homo sapiens
gagcuggauuuuagaguacgauuagcg

SEQ ID NO: 189085 - RNA, 20 nt, Homo sapiens
agaaaaagguuuuuuuuuau

SEQ ID NO: 189086 - RNA, 83 nt, Homo sapiens
gaacaugccuggacguguccaacaaccuugagcaucuaggguugggagauaaagaagagaaggaggcuggguguuagugaagg

SEQ ID NO: 189087 - RNA, 37 nt, Homo sapiens
cgagccauuuccuguaggcucuuacuggaccugcauu

SEQ ID NO: 189088 - RNA, 64 nt, Homo sapiens
cccccugguguggcaaggcggcugggaccugcggcaucuaggugcagaaguacagaaucagguc

SEQ ID NO: 189089 - RNA, 65 nt, Homo sapiens
guaccggagucccauuugggagcaagagccaucuacucguccguuaccgggugagugugggaaca

SEQ ID NO: 189090 - RNA, 45 nt, Homo sapiens
ugagucaagcggaacuuugauuacaaggaauuucauauacuguga

SEQ ID NO: 189091 - RNA, 45 nt, Homo sapiens
ugcuuccuccgagucuuuagcagcuuuuaaaaacuucaccgaaga

SEQ ID NO: 189092 - RNA, 64 nt, Homo sapiens
accugccucaaaacaguuuuuagaaagaucaaauggcauaauuuauguaacgugucuaauacua

SEQ ID NO: 189093 - RNA, 13 nt, Homo sapiens
gugaguuguguua

SEQ ID NO: 189094 - RNA, 23 nt, Homo sapiens
acuuuuuuuccccugacucuucu

SEQ ID NO: 189095 - RNA, 42 nt, Homo sapiens
guuugacagcuccacauuaaaugaaucuguucgcaauaccau

SEQ ID NO: 189096 - RNA, 51 nt, Homo sapiens
cgugaucuaaaagcuguugggaaaaaauucaugcauguuuuguacccaagg

SEQ ID NO: 189097 - RNA, 48 nt, Homo sapiens
ucuaggagggagagagguagauauuagaauaaagacagaaaauauuac

SEQ ID NO: 189098 - RNA, 24 nt, Homo sapiens
accucucuaauuuuuuaaauuuaa

SEQ ID NO: 189099 - RNA, 42 nt, Homo sapiens
ccgagcauauauauuuuuuuuacuuuugaaaguuuaaccuua

SEQ ID NO: 189100 - RNA, 51 nt, Homo sapiens
aauucuuacgcuguuuccuuuucucagaaugcugcaaagagacucugcaga

SEQ ID NO: 189101 - RNA, 41 nt, Homo sapiens
ugcaguuaccaucacccucaacucaaaacuucuuggaggga

SEQ ID NO: 189102 - RNA, 49 nt, Homo sapiens
guuuuacuuugucaucaguuggaugauucucaccuuuacuccucaguaa

SEQ ID NO: 189103 - RNA, 24 nt, Homo sapiens
uuuucucauuagauguguuuuuuu

SEQ ID NO: 189104 - RNA, 53 nt, Homo sapiens
cuauaaauugcacauugaggaacucuaauagacaaagauuaggugucaggcag

SEQ ID NO: 189105 - RNA, 84 nt, Homo sapiens
ugcugcuccuacuucugagaccaagacucuuuugucauauucuuuagcaauaggacggguaaagacuggauuuaauugcuguuc

SEQ ID NO: 189106 - RNA, 42 nt, Homo sapiens
acuacuaacaguauuuggacugccuguucauuccuggagaca

SEQ ID NO: 189107 - RNA, 51 nt, Homo sapiens
uagagagcaguagugugagaauagaaugccuuucuauuuggguuaaacuau

SEQ ID NO: 189108 - RNA, 52 nt, Homo sapiens
uuaagacaaaauuuggauaucauauuauuaugguugaaggaagaaaauaaaa

SEQ ID NO: 189109 - RNA, 45 nt, Homo sapiens
gauucaaugaaguggccacacaauauagugaagauaaagccaggc

SEQ ID NO: 189110 - RNA, 41 nt, Homo sapiens
guccgggggcgcguagcccggagucccaguguggcccggag

SEQ ID NO: 189111 - RNA, 48 nt, Homo sapiens
ggggcgcagagcccccgucgcgccucgugcggcagcggagagcccagg

SEQ ID NO: 189112 - RNA, 50 nt, Homo sapiens
ccuccuggccggccgggcggagaagagcgacaccgaagccggcgggaggg

SEQ ID NO: 189113 - RNA, 46 nt, Homo sapiens
uggcucggccugggcagcguuggcucggcaaguggcuuguggcgau

SEQ ID NO: 189114 - RNA, 42 nt, Homo sapiens
ucauuuugucuccggcuuuuucgaguguuuuccugcgggcgg

SEQ ID NO: 189115 - RNA, 42 nt, Homo sapiens
uugucucauccgcucaggugaauggggaugcgugggcccugg

SEQ ID NO: 189116 - RNA, 46 nt, Homo sapiens
gagccuuagccagguggggcagagggaagggcauaguucaguguag

SEQ ID NO: 189117 - RNA, 53 nt, Homo sapiens
ugccaucuggauggaaccguugugagcacuggaaagggaaaaaaugccuggag

SEQ ID NO: 189118 - RNA, 42 nt, Homo sapiens
gaaaaccgggagggcggugugugccgcacacgcaccaugaag

SEQ ID NO: 189119 - RNA, 42 nt, Homo sapiens
cccugcccccugggcuucggaggggggugcuugugccccuaa

SEQ ID NO: 189120 - RNA, 61 nt, Homo sapiens
cuguucucuccuuaccuuuggcauccuuuggccugguggggaaacagaggcccagggugga

SEQ ID NO: 189121 - RNA, 51 nt, Homo sapiens
aguguaugguuguccaacuacugcaggggaaaaggucaaauagaugaagaa

SEQ ID NO: 189122 - RNA, 50 nt, Homo sapiens
ggagucucucgcaguggauguagagguggccaauccaccagcaagcaagg

SEQ ID NO: 189123 - RNA, 45 nt, Homo sapiens
aagccauuuccuauguggacccucaguuccucaccuacauggcac

SEQ ID NO: 189124 - RNA, 44 nt, Homo sapiens
ugaugauuacuacaaauacugcgacgaagacucugacagugaca

SEQ ID NO: 189125 - RNA, 42 nt, Homo sapiens
aggaaccuguggucaggcccaaaaucagaaaccuggcaaguc

SEQ ID NO: 189126 - RNA, 42 nt, Homo sapiens
cuucugaaggcaagcuggcuacaaaaggugacagcucggaga

SEQ ID NO: 189127 - RNA, 62 nt, Homo sapiens
gaaaggggcaaggucuuuggcugggccaccuccacauuucucuaguuuuagccgugauguga

SEQ ID NO: 189128 - RNA, 56 nt, Homo sapiens
guggccgggcacgggggcgaggauuuugggggguuccugggaacugcuuuucaggu

SEQ ID NO: 189129 - RNA, 78 nt, Homo sapiens
augacgaguucgaccucgugcugcauaaauacuuacaggcggaagaguacucaauccgguccugcacgaaaggcugua

SEQ ID NO: 189130 - RNA, 41 nt, Homo sapiens
aaucuggaccccuacaagcaccauucuccgaugcuggccug

SEQ ID NO: 189131 - RNA, 46 nt, Homo sapiens
ucaguaacgccugaauuuuugauacuguuagccagauaggugcuua

SEQ ID NO: 189132 - RNA, 48 nt, Homo sapiens
ugugcaccagaagaugaggccaacuggcugcaaagacgaaagggcuaa

SEQ ID NO: 189133 - RNA, 41 nt, Homo sapiens
cguagacugauuuuagagucacgccucccauccagacauac

SEQ ID NO: 189134 - RNA, 45 nt, Homo sapiens
gcuuaauaucuaauugauguugacaacacuggggugggauacuua

SEQ ID NO: 189135 - RNA, 46 nt, Homo sapiens
caaaugguuacuucuuucucaugauacgugucugaaacaggucauc

SEQ ID NO: 189136 - RNA, 42 nt, Homo sapiens
uggccaagggccccaaggguacauuaggaagacaagcagccc

SEQ ID NO: 189137 - RNA, 48 nt, Homo sapiens
auggaugcaggguugggagggggccgauugcacacauuuuggggugag

SEQ ID NO: 189138 - RNA, 75 nt, Homo sapiens
cagacccggugccccuuuauacuccccgacaaugaggaaaugguguacggagggcucccuggcuuuaucuguaca

SEQ ID NO: 189139 - RNA, 82 nt, Homo sapiens
gguaaaggcagggcacuggggaagagggaggaggccgggggcccagggcaggcaucaggucagaggaguugggagcagggau

SEQ ID NO: 189140 - RNA, 46 nt, Homo sapiens
ccaccagcagcaauuccaccacuccuauuuccaccacuaccaccaa

SEQ ID NO: 189141 - RNA, 42 nt, Homo sapiens
cccagccacugucgcgcaggaacgggucccugcagcccccag

SEQ ID NO: 189142 - RNA, 45 nt, Homo sapiens
cccggagguggagcgcagggaacuccugccugcagcagcgccgcg

SEQ ID NO: 189143 - RNA, 23 nt, Homo sapiens
cauuguaggagacagaaagauaa

SEQ ID NO: 189144 - RNA, 55 nt, Homo sapiens
gaaaaguggaaaaaauaacaagcuguguaauucauagggugguuaugagaauaaa

SEQ ID NO: 189145 - RNA, 7485 nt, Homo sapiens
uguuauuuuuacugccagaaauaauaguaguaguaguuggaggaggaggaggaagaggaggaggaggaggauuauaggugugucacagacugaaaaugaguggggaggcaauguccuauagugcaaaauuuuagcuuuagaggcugaaaggccuggguuugauuacugcuuuuauuauuuaucagcugugugacuuaaaacuuaaccuaguuguucuuucaugaguaaagugaauaaaauaauauacgaaugauuacauuucaguauuauugugaagaccacauugaagucacauauauaaaaauacuugauaagcugaaauacuauacguuauauguguauauugcuauuugccaacucucuuaaaaagaaccaaaaagaguuggcaaauagcaacauacacacauagcguauuuauauguuuuauucuuauaaagaaccaaggagaauugaaaaugacuuauaaaaaugacaaaacauuuauauugucaaaauugguauaauaugaagauaaacccagaguagaaagcuuugaauuauuauuauaucauuuauuauuuucuuugugcuaugauauacacuguaaaaaucuugccucauuuacuccuuucaacaccucuuuaggucuaaggcaggaacuugauuuaauucaaguuuugaaauauuacuauagcuucaauguaaauaccucacagaaaacaaaacaaaacaaagcaaaacugaaguucagagagguuaacuugccuguguucacaaagccaguaagccaguaagcuacauagccaggacuggaaucuagcccugauuucaaagccucuuaacugaacuugaaagauggcagugggaggugaaaagauuuugagaaaauacuauaagggaugaguggaagcuagacauuauugaagauacucuaaauaaauguuguuucuucuccuauuuucgaccuuaguaaaaauguucuuaaggaaaaucuaaaccuagucaauaaccugagggagccaaggaauguaauauaagcccaaugagagcaaagacuauuucuucuuuaccacuguauucccugugacuagaacagugccuagcauauagcaggcccucaacaaauaauuauuacuuuuauguauaaaauacaucaaaacauauaugguaaaaaaaaaagaccuagucauauuuuuagauucuuuuuacuuagaguucuuuuuuuuucuucucuucaacuuuuauuuuaaauuuagggggacaugugcaggaugugcagauuuguuacauggguaaacaugugccacggugguuugcugcacagaucaucccaucaccuagguauuaagcccagcauccauuagcuauucuuccugaugcucugacaacucuaguaagaguuguuuguuuguuuauuuuuuucuuguaaauuuguuuaauuuccuuguagacucuggauauuagaccuuugucagauggauagcuugccaacauuuuuaucccauucuguagguugucuguucacucuguugauccuuucuuuugccaugccgaagcucuucaguuuaauuagaucccauuugucaauuuuugcuuuuguugcaauugcuuuuggcauuuuagucaugaaaucuuugcccauuucuauguccugaaugauauugcccagauuuucuuuuaggguuuuuauaguuuuggguuuuacauuuaagucuuuaauccauccugaguuauuuuuuguauaugguguauggaagguguccaauuucaauuuucugcauauggcuagccaguucucccagcaccauuuauuaaauagggaaucguuuccccauugcuuguuuuugucagguuuguugaaaaucagaugguuguaggugugcagucuuauuucugaguucucuauucuguuccauuggucuaugugucuguucuuguacugguaccaugcuguuacuguaaucuuguaguauaguuugaaguuggauagcaugaggccuccagcuuuguucuuuuugcuuaggauugucuuggcuauuugggcucuuuuuugguucuauauaaauuuuaaaauaguuuuuuuuuucuaauuuugugaagaaugucaaugguaguuuaaugagaguaguguugaaucuauaaauuacuuugugcaguauggccauuuucaagauauugauucuuccuauccaugagcauggaauguuucuccauuucuuuguguccucucugauuuccuugagcaguggucuguaguucuucuugaagaggucccucacuucccuuguuagcuguauuccuaggugucuuauucauuuuguagcaauugugaaugggaauuaauucaugauuuggcucucugcuugccuguuguugguguauagcaaugcuagcaauuuuugcacauugauucuauaucuugagacuuugcugaaguuguuuaucagcuuaagagcuuaaggagcuuuugggccgagaugaugggguuuucuagauauaggaucaugucaucugcaaacaaagauaauuugacuuccucucuuccuauuugaauaccuuuauuuccuucucuugccugauugcccuggacagagcuuccaauacuauguugaauaggagugguaagaggggguauccuugucuugugccaguuuucaaggggaaugcuucuagcuuuugcccauucaguauacuauuggcuguggguuugucauaaauggcuguuauuauuuugagguauguuucuucaauaucugguuuauugagagauuuuaacgugaagggauguugaauuuuauugaaggccuuuucugcaucuauugagauaaucuugugguuuuugucuuuaguucuguauaugugaugagucacguuuauugauuuguguacguugaaccaacguuguaaccuggggaugaagcugacuugaucaugguggaugaacuuuuugaugugcuacuguauuuuauugaggauuuuugcauugauguucaccaaggauauuggccuaacguuuucuuuuuuuuguuguaucucugccaggauuugguaucaggaugaugcugaccucauaaaaugaguucaggaggagucccuccuuuucaauuguuuggaauaguuucaguagaaacaguaccaacucuucuuuguaccucugguagaauucagcugugaaccugugugguccugggcuuuuugguugguaggcucuuugucaaagucuuaauuucagaacucauuauuggucuauucaaggauucaauuucuuccugguucagucuugggaggguguaugugaccagaaauuuaucgaauuuuuucuggauuuucuaguuuauguucauagagguguuuauaguauucuuugaugguuguuuguauuucuguggggucaguggugauaucccucuuauuucugauuguguuuagaguguuucaagguuuuuucaugucucuaucuccuucacuucagcucugaucuuuguuauuucuuguccucugcuagcuuuggaauuugguugcucuuaguucucuaguucuuuuauauauauguguguguguauauauauauauguguguguauauauauauauguauaaaauacuugaaguucuaggguacaugugcacaaugugcacguuuguuacauauguauacaugugccauguuggugugccucacccauuaacucgaaccugauguaaaugacgaguucucuaguucuuuuaguugagauguuagguugcuaacuuuagaucuuucuagauuucugaugugggcauuuagugguauaaauuucccucuuaacacugcuugagcugcaucgcagagauucugguacguugucucuuuguucucauuaguuucaaagaacuucuugauuucugccuuaauuucacuauuuacucaacagucauucaggagcauauuguucaauuuacacgcaguuuugugguuuugagugaauuucuuaaucuugaguacuaauuugauugugcuguggucugaaagacuguuaugauuucaguucuuuugcauuuguugagggguauuuuacugccaauuauaugaucaauuuuagaguaacugccaugugaugaugagaagaauguauuauguuguuuugagguggagaguucuauagauaucagguccacuugaucuagagcugaguucagguaguaaauaucuuuguuaauuuucuaucuugaugaucugucuaauauugccagugggguguuaaaguuucccacuauuauuguuugagagucuaagucucuuuguaggucucuaagaauuugccuuaugaaucugggugcuucuguauuaguuguauguauauuuaggauaguuagcuccucuuguugaauugaacccuuuaccauuguguaaugcccuuuuuugucuuuuuugaucuuuguugauuuaaagucuguuuugucagaaaauaggauugcaaccccugcuuuuuucuguuuuccauuugcuuguaaauuuuccuucaucccuuuauuuugagccuaugugugucuuugcacaugagaugggucacuugaagacagcaauaccaaugggucuuggcucuuuauccaguuugccauucugugugucuuuuaauugagucauuuagcccauuuacauuuaagauuagcaugugugaguuuguuaguuauaugugaguuugauccugucaucuugaugauagcugguuauuuuguagacuuguuuaugugguugcuucauagugucacugguuuguguacuucaguguguuuuguaguggccaguaacaguuuuuccuuuccauauuuagugcuuccuucaggagcuuuugaaaggcaggucuggugguaaugaauuccagcuuuuucuugucugaagaggaucuuauuucuccuucacuuacgaagcuuaguuuggccagauauaauuuucuggguuggaauuucuuuucuuuaaguacguugaauauugucccccagucucuucuggcuuguaggguuucugcugagaggucugcuauuagucugaugguuuucacuuugucagugaccugaccuuucucucugguugcccuuaacauuuuuucuuuuauuucaaccuugcagaaucugaugauuaugugucuugggguugaucuucucauggaguaucuuacugggguucucugcauuuccugaauuugaauguuggccugucuugcuauuuugggaacauucuccuggaugauuuccugaacuauguuuuccagcuugguuccauucucccugucucuuuuagguuccccagucguagguucaguuucuuuacauaaucccauauuucauggagguuuuguucauuccuuucauuuuuuuucucuauucuugucugccugucuuauuucagaaagauagucuugaagcacugagauuuuuuccuccucuugguauauucuguuauugcuacuugugauugcauugugaaguucucguguuguguuuuucagcuccaucagguuggcuguguuccucucuaaacuggcucuucuggcuaucagcuccuguauuguuuuaucaugauucuucgcuucuuugcacuggguuacaacaugcuccuuuagcucagcaaaguuuauuauuauccaccuucugaagcccacuuccaucuauucagccaucucagccucagcccaguucugugccuuugcuggagagguguugcagucauuuggagaagaggcacucugacuuuuugaguuuucagcauuuuuacguugauucuuucuuaucuuugugggcuucucuuccuuugaucuuugagguuacugaccuuugaauuagauuuuugugggguuuuuuguugauguuguuauuguuguuguuuucuguuuguuuuccuuuuaacagucaggccacuguaccguaggacugcugugguuugcuggugguccacuccagacuccaguugccucgguuucuccaguaccuugaguuaucaccagugaaggccaugaaacagcaaacaugacagccagcuccuuccucuggaagcucugucccagggggguacugaccuguugccagcccacaugugccuguaggaaggagcuagagacccccauugugaggucuuagucaggaagaaugggaucagaagcccaccgaaagaagcagucuggcugcuuuuugguagagcagguguguuguauuucggggggacccuuccuuguccaaaccaccuguauucuuaacagccagcaggcuggaguggcugagucaaccaaaccucagagauggaggccacccuuucccccaggagauccgucccagggagagaucagagcucuauccguagaacccuggcugcaguggcugaagccgccacugggagauccugcccagugaggaggaauggaucagggucccacuuaaagaaguagucuggcacugaucuggcaaggcagcugugcugcgcuguggggaacccuuccccauccaggccaucuguauucuccaaaguuggcagguuggaauggcugagucuacggaucagcagagaugguggccgccccuccccacaggaguucaguccugucucaggcagacuccagccuguugccuuuggcuggcuugaauuccaagccagugcaucuuaaugugugaggugcuguggaaguggggcccacagaacugcuuggcucccuggaaucaccccccuuccuagggacauguauggauggacuugccagugauccugggucuggaguaugcauuauaaaacucuuggguuucugugugugccugaguggcugcucugcugagacuccacacagcucuguguauuggacccaagguccuggugguguggggucacaaggugaucuccugauccauggguugcauagaucugugggagaaacgugguuuccuggggcagggucacacaaucacucacagcuucccuuggcuggggguggaggguuccuuuggcugcaugucacucccgggugggccgucaucccucucuacuuuucuucauucucuguaggucaaguuguuugccuagucagucccaaugggagaaccuggauauuucaguugaaggugcugaauucacucaccccuuucauuccucuccauuagugcugcagacugaagcugcuucuaaucgaccaucuuggccccucccauauuuuuagauucuuaugaaauagaguguuagcuaaugcauauuagguaguuccugaaaugguuucagugaauuaugugugcauauaaaugugaagcaucuaaaugauagguuggucuauuuaguccaguugccggugucaauaggagaaugguaacucuauuaauuuguguaaacagugcaauuguggugacuaucuggggauuagauacugggaaccuauugacugacaaauguauaagguagggcuauuauuucuuuacuuuuuuuggcuuauagcaagcuucccaguagaauaauauuaaaugcuauaaaauaagcaaagugaauacucaa

SEQ ID NO: 189146 - RNA, 358 nt, Homo sapiens
augugaaauacagucuuuuuuuuuuuuuuugagacagggucucacucugucacccaggcuggagugcaguggcgugaucucagcucacugcaaccuccgccugccagguucaagcgauucuccugucucagccuccagaguagcugggauugcaggcaugccccaccaaggcuggccacuuuuuauauuuuuaguggagaugggguuucaccauguuggccaggcuggucuugaacuccugaccucaggugaucugccuaccucggccucccaaagugcugggauuacaggcaugagccaccacacccagccaauacagucuuuuuugaggguaaggaaagagguaguacuuaucuca

SEQ ID NO: 189147 - RNA, 46 nt, Homo sapiens
uugcugagguaguauaguacaagaacauuggauuuggaguaagaag

SEQ ID NO: 189148 - RNA, 244 nt, Homo sapiens
ucaaaauaucacauguacuccaaaaauauaauauguacaacuauuauguauccauuaaauuaaaaaagaaaccaaagggcuaugaagagugcugugagagaauaauaggggagggucugcuuuaauuagaaugaacagagaagguuuugcugaguagguagcauuguuacugagacauaggaugagaggggcguugggaggggggcacauaccaggugauggaaaagccuaugugaaagucuug

SEQ ID NO: 189149 - RNA, 75 nt, Homo sapiens
aagcaaggaagagcgugggauguuggaggaacuagaaaaagagcacugugacuggaaaguaguuaguaaggggga

SEQ ID NO: 189150 - RNA, 51 nt, Homo sapiens
cuguucuaagugaaaaguccuaaaacaggaaagaguuuggcauguucaagg

SEQ ID NO: 189151 - RNA, 58 nt, Homo sapiens
ucaagguauaucuugaacauacagcugagagaacaagcuuucugguauugguauccag

SEQ ID NO: 189152 - RNA, 30 nt, Homo sapiens
acugaauuuauccagggucaaggacuugcc

SEQ ID NO: 189153 - RNA, 47 nt, Homo sapiens
auuuucaccacagugguauuccugggaacuguuauaaaacagaucau

SEQ ID NO: 189154 - RNA, 45 nt, Homo sapiens
acagugaauaauagcacuucugccaauugguaagaugggcauaaa

SEQ ID NO: 189155 - RNA, 34 nt, Homo sapiens
gaauguaaguuuuagaguugugggggggacuuag

SEQ ID NO: 189156 - RNA, 48 nt, Homo sapiens
augggagaggauaagggagcauuccaggcagaagaaguagcaaaugua

SEQ ID NO: 189157 - RNA, 67 nt, Homo sapiens
uagaggugaggucagagagguaagaggagaggaacagaucauguagggcuuuguaggucauuguaaa

SEQ ID NO: 189158 - RNA, 104 nt, Homo sapiens
acagauucaacuggaaaaguuggcaggaagauggguaauaaugaagcauuuuaagcaggagaguguacaaacuauguauuggcagauaauugacagugauggga

SEQ ID NO: 189159 - RNA, 46 nt, Homo sapiens
guuuugcuugcuauaaagggcagucuaggaaagaugcuugagauuu

SEQ ID NO: 189160 - RNA, 48 nt, Homo sapiens
cugcuuucuuuuuucucagugaaaaagaaacauggagcuaaaagugaa

SEQ ID NO: 189161 - RNA, 40 nt, Homo sapiens
gcauguuuuguaauuuuuuguugaaaacugggaauuuuug

SEQ ID NO: 189162 - RNA, 28 nt, Homo sapiens
caaucuggauaauauuuaccaccaacac

SEQ ID NO: 189163 - RNA, 47 nt, Homo sapiens
aacuagccacacaaagagccaggagagaaacaguauucagauagaga

SEQ ID NO: 189164 - RNA, 49 nt, Homo sapiens
gaaauauuggcagaggccagauugugcagauugggauuuauaagccaug

SEQ ID NO: 189165 - RNA, 46 nt, Homo sapiens
auugugcuuuaacaugauuacugucugcagaguggacaguggauug

SEQ ID NO: 189166 - RNA, 51 nt, Homo sapiens
gaaggugaagggaaguggaaggauuuugguuauaauuugaagauagaguca

SEQ ID NO: 189167 - RNA, 24 nt, Homo sapiens
ggaugagaaauaagaugauuugca

SEQ ID NO: 189168 - RNA, 35 nt, Homo sapiens
uugcaucacguaaacaaaauuaggauaugugcugc

SEQ ID NO: 189169 - RNA, 50 nt, Homo sapiens
caguacccaugucaguguuuguuaaauaagauaaaaugaauaagcauuug

SEQ ID NO: 189170 - RNA, 46 nt, Homo sapiens
ccugaaagcagaaagugcuaauuuuuuacuuuaaaaaaaaaucugg

SEQ ID NO: 189171 - RNA, 46 nt, Homo sapiens
ugacucaguggauaauuccagugaaacccaggaagaaccgcauuag

SEQ ID NO: 189172 - RNA, 49 nt, Homo sapiens
ucuaaagauacaagcuggugcgguacaauauggaaugagaacaauaagu

SEQ ID NO: 189173 - RNA, 39 nt, Homo sapiens
auaaacaaucaguggcuugauaaauuauguuuggaccua

SEQ ID NO: 189174 - RNA, 44 nt, Homo sapiens
aaaguuauaaaauuuaaaugagauuaauuuaaugaacgccaaaa

SEQ ID NO: 189175 - RNA, 41 nt, Homo sapiens
gucugagaccaacgacaccaaaguucugagacauuaagcca

SEQ ID NO: 189176 - RNA, 45 nt, Homo sapiens
uuguuuuccacuaacggagccaaauacaaacugggguggcuacag

SEQ ID NO: 189177 - RNA, 30 nt, Homo sapiens
ucuguaugauucuauaaaucauuaaaaaca

SEQ ID NO: 189178 - RNA, 46 nt, Homo sapiens
cugaaacuuauuaauuagguagauuaaaucuauaacagagucuugg

SEQ ID NO: 189179 - RNA, 73 nt, Homo sapiens
aaaauaccacaaacuguguggcuuaaacaacagagauuuauuuucuugcagcucuaaaagcuggaagucugag

SEQ ID NO: 189180 - RNA, 39 nt, Homo sapiens
gaaaucaaagaacccucagcuuuuugucaccuuuuuggg

SEQ ID NO: 189181 - RNA, 57 nt, Homo sapiens
uaauuuugagguaacugggcaagaaauagcagaagaaagaacauuuaaagggguaau

SEQ ID NO: 189182 - RNA, 25 nt, Homo sapiens
aaaguagaaugcaacguuuauauga

SEQ ID NO: 189183 - RNA, 42 nt, Homo sapiens
guauaagccuagaaucuagccuacuaucuggaacauuguugg

SEQ ID NO: 189184 - RNA, 46 nt, Homo sapiens
aaugaaaauuuuaaacugacauuuguugaugugaguaagggccacu

SEQ ID NO: 189185 - RNA, 45 nt, Homo sapiens
gacuucaggaacuaaacagguagaauugccauuucugagaugagg

SEQ ID NO: 189186 - RNA, 48 nt, Homo sapiens
gagaagggaagaguagagaaaaaggguggaccaauuagaaggaugcag

SEQ ID NO: 189187 - RNA, 42 nt, Homo sapiens
uugaaaaacagccaaccagcuccaggcccagccuagccuggg

SEQ ID NO: 189188 - RNA, 42 nt, Homo sapiens
ccuccaugucugacuuaguagccucagaaguguaaauaggaa

SEQ ID NO: 189189 - RNA, 37 nt, Homo sapiens
uucuccagauagacagugggcugagugguuuccuccc

SEQ ID NO: 189190 - RNA, 37 nt, Homo sapiens
auagggcagcaugcccacucucauccuccaccggcaa

SEQ ID NO: 189191 - RNA, 46 nt, Homo sapiens
cuccuuggagauaaaggaagaugagccaugagguugggauuuuugu

SEQ ID NO: 189192 - RNA, 48 nt, Homo sapiens
ucaagaauggaagucaguuuguguccacggcacuguguacacaccugc

SEQ ID NO: 189193 - RNA, 47 nt, Homo sapiens
auccuagauuccccccauuuugccucuguccgugccccuucccuggg

SEQ ID NO: 189194 - RNA, 45 nt, Homo sapiens
ucagaaaauucccuggggucaccuucuaguugcccccauucccag

SEQ ID NO: 189195 - RNA, 46 nt, Homo sapiens
aaggguuggacgggaugaccuccagaagucccuucaauuucuagua

SEQ ID NO: 189196 - RNA, 42 nt, Homo sapiens
ucuucagcaaccccgagaccagcgacuccuucggcuacgacg

SEQ ID NO: 189197 - RNA, 44 nt, Homo sapiens
cucuucacuucaaagucaaucccacagggcuguaaagggacaag

SEQ ID NO: 189198 - RNA, 45 nt, Homo sapiens
ccaucagguugacucugacuuuguaggacaccaggauccccagca

SEQ ID NO: 189199 - RNA, 49 nt, Homo sapiens
gggagaaaggguggggaaugguuugauugggucaaucuaacugggagaa

SEQ ID NO: 189200 - RNA, 45 nt, Homo sapiens
ggaugagggggaaggaugauuccaacaagagcagaagguggaggg

SEQ ID NO: 189201 - RNA, 36 nt, Homo sapiens
aggagggaagguaucaaagaaugaaagacgaaagaa

SEQ ID NO: 189202 - RNA, 48 nt, Homo sapiens
aacuccucgaugacuauguccucagagcuugcagaagcagcagaagag

SEQ ID NO: 189203 - RNA, 51 nt, Homo sapiens
agacuccagugagacgcuguuuucaccccuuccuccuccuagccucucucc

SEQ ID NO: 189204 - RNA, 44 nt, Homo sapiens
agucccuuacauaugucauauuuuaauuauagaaaucaguagca

SEQ ID NO: 189205 - RNA, 40 nt, Homo sapiens
ggacucugucaugacaugcuaacuagacuucaggggagcc

SEQ ID NO: 189206 - RNA, 42 nt, Homo sapiens
cccggacuacaacaaugaguugacccaguuucugccccgaac

SEQ ID NO: 189207 - RNA, 42 nt, Homo sapiens
uggaaacuguaccaugcuauuuccucuagugaaaaugagguu

SEQ ID NO: 189208 - RNA, 45 nt, Homo sapiens
accucgcuggaucagaaagacagaagaaaaccaaggcugaagggg

SEQ ID NO: 189209 - RNA, 42 nt, Homo sapiens
ccugggcccgauuuggggucuggaugcugauugguagguauc

SEQ ID NO: 189210 - RNA, 46 nt, Homo sapiens
ugcucauuauugggaucauuguggucaucuggagacagccacagag

SEQ ID NO: 189211 - RNA, 45 nt, Homo sapiens
ggcauuccucuucaaacucacugaucuuguggaccucaugucaau

SEQ ID NO: 189212 - RNA, 54 nt, Homo sapiens
cauuccauucuguuuggggcuugggcacagugugugcccaggcuguaugcagac

SEQ ID NO: 189213 - RNA, 59 nt, Homo sapiens
acaccuauagguuagauggucacucuuaggagcugcagagcugggaaaaugaaggggaa

SEQ ID NO: 189214 - RNA, 94 nt, Homo sapiens
cagccaguguggcccgggccuggagcucugcuuuugacaaccugauugggaaccacaucucuaagacucugcagggguccauugcacugcacgu

SEQ ID NO: 189215 - RNA, 31 nt, Homo sapiens
uaggugaaaaaggcagggacuugugugagcc

SEQ ID NO: 189216 - RNA, 56 nt, Homo sapiens
agaaauugcucauucuauccaucuccguccugguuuccuuaauuaagugaaugguu

SEQ ID NO: 189217 - RNA, 48 nt, Homo sapiens
ugggccuucaccacuggcuggaaccucauccucuccuaugucauuggu

SEQ ID NO: 189218 - RNA, 59 nt, Homo sapiens
cacauugggugcaggcguguauguccuagcuggcgagguggccaaagauaaagcagggc

SEQ ID NO: 189219 - RNA, 64 nt, Homo sapiens
caucuucuucaauuccugcuaggaugccguggcaagcauuucgcagauuuggucaaaagcuggu

SEQ ID NO: 189220 - RNA, 42 nt, Homo sapiens
cuccuuugcuugguggagggggucuuguaauucgcuuucaga

SEQ ID NO: 189221 - RNA, 90 nt, Homo sapiens
gcuugggaggaaguaggggaacauuugcuuacuccccugggcgacagcugcgcuaguugagcagugugggcuuggugaggagggauggaa

SEQ ID NO: 189222 - RNA, 57 nt, Homo sapiens
aaaaucugggaccugagucggggggcaucggguggaacccuuccucucugcugagag

SEQ ID NO: 189223 - RNA, 71 nt, Homo sapiens
gagacccccgccccgggaguuagggcucccgucuccaccccagcuccaaaccauuucuagaugggggcagg

SEQ ID NO: 189224 - RNA, 43 nt, Homo sapiens
ccaacccaacucggcuuaacuccgccucaccgagcccagucca

SEQ ID NO: 189225 - RNA, 27 nt, Homo sapiens
uuuugcaaagccaagaagugugugugu

SEQ ID NO: 189226 - RNA, 66 nt, Homo sapiens
ccucccucccucuuucccucccuuccucuuuccaucuacccuccgauuguuccugaaccgaugaga

SEQ ID NO: 189227 - RNA, 28 nt, Homo sapiens
ccuucauuuggcauuccccacuugagaa

SEQ ID NO: 189228 - RNA, 41 nt, Homo sapiens
uguagcccuaagugguacuaacuuuccuucauucaacccac

SEQ ID NO: 189229 - RNA, 48 nt, Homo sapiens
caccucuaccaaacauuuguuguucagcuccaggacccacgggaaccc

SEQ ID NO: 189230 - RNA, 41 nt, Homo sapiens
caccacagcuggugggaaaucugggacuggagggggcuggu

SEQ ID NO: 189231 - RNA, 45 nt, Homo sapiens
ugggugagggacccagguuccugacacagacagacuacacccagg

SEQ ID NO: 189232 - RNA, 27 nt, Homo sapiens
cugguaucuccucggaguaacggcgac

SEQ ID NO: 189233 - RNA, 41 nt, Homo sapiens
uaccucaacuucgauugcagacagcaaagugccucccaguu

SEQ ID NO: 189234 - RNA, 25 nt, Homo sapiens
auucuucaggucaauagucaagccu

SEQ ID NO: 189235 - RNA, 45 nt, Homo sapiens
aagcgcacacgcagcugcuuuccacggaguggcauauuguccagc

SEQ ID NO: 189236 - RNA, 45 nt, Homo sapiens
cccucucuaccuggccaaacacagaaaaggcuucuuccagcaguu

SEQ ID NO: 189237 - RNA, 46 nt, Homo sapiens
agcagcuggcuucccugagaacucaacaaugccuuuuccugagggc

SEQ ID NO: 189238 - RNA, 83 nt, Homo sapiens
caucuaacugguccaugggcuccacagucacaggacgaggaaaucuggaagaaagaacaaaguucaguguuaaucaaaucaua

SEQ ID NO: 189239 - RNA, 43 nt, Homo sapiens
auauucauacucaaaggagccaggcugugcaaaucuggguggc

SEQ ID NO: 189240 - RNA, 44 nt, Homo sapiens
cccugucucauuagcaugaccuggugcucauggcgugcagcuuc

SEQ ID NO: 189241 - RNA, 54 nt, Homo sapiens
agagcuacuaggacguaagccagagccuccuauuagcaacagagaggugaaagg

SEQ ID NO: 189242 - RNA, 46 nt, Homo sapiens
aguuccauccggcaucauaguggcagguccuggaggagcuggggua

SEQ ID NO: 189243 - RNA, 45 nt, Homo sapiens
ccacacagaauugacuuguuuaauaccaccccucccuugcccucu

SEQ ID NO: 189244 - RNA, 41 nt, Homo sapiens
cuaacuggauccacuuugccaugguuuccccaggcccucaa

SEQ ID NO: 189245 - RNA, 49 nt, Homo sapiens
uugggggauguuugguuuuugugguguauguggcaguuucucuggggcu

SEQ ID NO: 189246 - RNA, 27 nt, Homo sapiens
cugcacuugggccgcggagucuugcuu

SEQ ID NO: 189247 - RNA, 23 nt, Homo sapiens
gugcuggcccugugggaugcagu

SEQ ID NO: 189248 - RNA, 42 nt, Homo sapiens
ccgagucuggagccgcagucugcagcuggcgaguuggccaaa

SEQ ID NO: 189249 - RNA, 48 nt, Homo sapiens
gaagaggaggaggccaggaccaucagagugacaccugucaggggccga

SEQ ID NO: 189250 - RNA, 45 nt, Homo sapiens
uccugcccugccggcaucugugccugugccaggccugcacugaaa

SEQ ID NO: 189251 - RNA, 45 nt, Homo sapiens
ucuuuagcggguuuccuuuucggcaacaucaauggagccgggcag

SEQ ID NO: 189252 - RNA, 42 nt, Homo sapiens
aagcacuuggcaggcuugggggcuuuggggcugggcagccug

SEQ ID NO: 189253 - RNA, 45 nt, Homo sapiens
ccuccaccuccacccccgggaccaaugaagaaggauaaggaccag

SEQ ID NO: 189254 - RNA, 45 nt, Homo sapiens
gcuugggccuauaucuccuggcauugagccauguguauagccuaa

SEQ ID NO: 189255 - RNA, 45 nt, Homo sapiens; identical to SEQ ID NO: 122142

SEQ ID NO: 189256 - RNA, 46 nt, Homo sapiens
cagugacauauuauuggcuacauaagagcucuucacacuguauuag

SEQ ID NO: 189257 - RNA, 48 nt, Homo sapiens
gugcucggagaaagaggaagaagaagcaccgugagcugauacaggaag

SEQ ID NO: 189258 - RNA, 46 nt, Homo sapiens
acgaugauggcuccuguggaguccaaauuuucccaaucaacuggag

SEQ ID NO: 189259 - RNA, 46 nt, Homo sapiens
gaauuuaggaaacuugaggaaaacaauggcacugaucuucuggcug

SEQ ID NO: 189260 - RNA, 45 nt, Homo sapiens
ucucugaagaagagucgaauucucuuagggaaaacaggagucauc

SEQ ID NO: 189261 - RNA, 44 nt, Homo sapiens
agaaaacagcuauaaaggauauugggguauaaauuaagggaaug

SEQ ID NO: 189262 - RNA, 49 nt, Homo sapiens
acccuuaaugaugcagguuggcauggcaaccaagauaaagaacuauuau

SEQ ID NO: 189263 - RNA, 90 nt, Homo sapiens
aucuccuuuccuggguucucuccauccuggccaauugcugcaagugaggaauucuuuccuguuuuuacuguuaacuaaggaaauugauaa

SEQ ID NO: 189264 - RNA, 44 nt, Homo sapiens; identical to SEQ ID NO: 122160

SEQ ID NO: 189265 - RNA, 47 nt, Homo sapiens
gguuacuauauucgggaauuaguggauauuuuugugguuggccagca

SEQ ID NO: 189266 - RNA, 46 nt, Homo sapiens
aauggaagauauaaaaaaagccuuuccuucccauucagaaagcagc

SEQ ID NO: 189267 - RNA, 25 nt, Homo sapiens
uaagucugauuuucguuuaccaacg

SEQ ID NO: 189268 - RNA, 41 nt, Homo sapiens
uuugcuccagaagaagaaaaugaggaagauuuccagaugaa

SEQ ID NO: 189269 - RNA, 46 nt, Homo sapiens
ugaaggauucuccuaugugaagauuccaaacaaaccaacacagcag

SEQ ID NO: 189270 - RNA, 34 nt, Homo sapiens
gcaacuucuacguaaauuuggugugccugaggaa

SEQ ID NO: 189271 - RNA, 55 nt, Homo sapiens
caucaacugaagucuuaucaacugacacagacagcagcucagcugaagauaguga

SEQ ID NO: 189272 - RNA, 49 nt, Homo sapiens
acauguugcagaacaagaaaaccagcucucagcuuucacgugaacggga

SEQ ID NO: 189273 - RNA, 31 nt, Homo sapiens
uguucagaggaaucugcuucucuaucuccua

SEQ ID NO: 189274 - RNA, 45 nt, Homo sapiens
uggacgcugucucaagauuuaucgcacguuucgagaugaagaggg

SEQ ID NO: 189275 - RNA, 56 nt, Homo sapiens
gucgaaaauuugcccuuuuugaugaacaacaucgggaagagaugcgaaaagaacgg

SEQ ID NO: 189276 - RNA, 46 nt, Homo sapiens
caaacaaaugcgccaccuuccaacccuguugccaugacagaagaac

SEQ ID NO: 189277 - RNA, 46 nt, Homo sapiens
cauucauaaugauaaugaagaacuuaucaagguugaagggaccaaa

SEQ ID NO: 189278 - RNA, 45 nt, Homo sapiens
ugacgcugucguccaucuuggagucuaucaucaaugacaugagag

SEQ ID NO: 189279 - RNA, 35 nt, Homo sapiens
aguguuuaaauagcuuaaaaaaauuuauuuuuuuu

SEQ ID NO: 189280 - RNA, 627 nt, Homo sapiens
uuguguguggacauuugggguuuuuuuuguuuuggagacagagucuugcucuguugcccaggccggagugcaguggcacgaucuccgcucacugcaaccuccaccuccuggguucaggcgauucuccugccucagccugccaaguagcuagggcuauaggcgcgugccacccacgccuggcuaauuuuuuguauuuuaaguagagacgguuucacuguguuagccagguuggucuugaucuccuggccuugugauccacccgcuugggcuucccaaaguuccgcgauuacaggcaugaaccacgcauuugcuuuuuuuaauuuuaauuuuuuuuauuugucaggcaaguaagacaguuaagggacacuuguuuuuauuucucuuggguauauaaagaucgagcaucccaaauccaaaaacuugacaugcucaaaucuuaaacuuuuugaaugccugcuugaugcucuaaggaaauccucauuggagcauuuggauuucuaauuuucggauuagggauguucacauauuugcagauauuccaaaauauuucagauucuuaaaaaaccugaaaucugaaacacuugcggucccaagcauuucagauaagggauacucagucuguaccua

SEQ ID NO: 189281 - RNA, 61 nt, Homo sapiens
cauagaaauccuuaaaggaaucuaugaaccccuuacauuauaaacagaaguuuuguaugau

SEQ ID NO: 189282 - RNA, 46 nt, Homo sapiens; identical to SEQ ID NO: 122180

SEQ ID NO: 189283 - RNA, 385 nt, Homo sapiens
aguaauucacaauccaguuggcagaaagagacaauuaaaaugcagcuuggaaccaggcaugguggcucauaccuguaaucucaacacuuugguaggcugaggugggaggauugcuugaggccaggaguuugagaccagccugggcacacauagcaagaccuuccuugucuguauaaaaaacuuauaaacaaaagcuuagcuaggugugguggugagugccugaagucuuaagauauuugggaggcuaaggcaagaggaucacuugaacucaggauuucaagacugcagugagcuaugaucacgccccugcacuacauccugggcaacagcaagacccugucucuauaaauaaauaaaauaaauaaguaaagugcagcuugacaag

SEQ ID NO: 189284 - RNA, 30 nt, Homo sapiens
augaaacgccuaguauguuaacaccaaacc

SEQ ID NO: 189285 - RNA, 56 nt, Homo sapiens
uucccagccccccuacaguagcuucagcaacuuuacuauuccuguagaggcucuau

SEQ ID NO: 189286 - RNA, 41 nt, Homo sapiens
uuugacucaacuugagaaggauauuuguacugcuaaagaag

SEQ ID NO: 189287 - RNA, 73 nt, Homo sapiens
auccauguuuuauaguugaguuaaucaaggcuuagagauguuaaguaauuuguuacucacuagcaaguguugg

SEQ ID NO: 189288 - RNA, 44 nt, Homo sapiens
cagcuauucucagucaggguuccacuggaaaguguaaaacccag

SEQ ID NO: 189289 - RNA, 47 nt, Homo sapiens
uaugucugaaggagaagaugaugaggaagaugcugggagugaugaag

SEQ ID NO: 189290 - RNA, 45 nt, Homo sapiens
ccagcugagugaaaguggaagugacucugaugugggaucuggugg

SEQ ID NO: 189291 - RNA, 46 nt, Homo sapiens
aggguuuuucuaggacuuggguagagguggggagggaggagagcug

SEQ ID NO: 189292 - RNA, 97 nt, Homo sapiens
accagugaacgugcauuacuugugugauuuuuuuuucaaguaaaauuaagaauaaacaaacaaacaaaaaaauaaagagcacucuggcagaagugug

SEQ ID NO: 189293 - RNA, 58 nt, Homo sapiens
caguagugcaggccagagauaacaaaggacuaagccaagguaggcagaguagggaugg

SEQ ID NO: 189294 - RNA, 68 nt, Homo sapiens
cuuguguauaugacguuggcaaguugauguuuuugaacagggucauuuuucucucagggacauguaga

SEQ ID NO: 189295 - RNA, 55 nt, Homo sapiens
cgaacacccaagacacaagcuucagcagcaucgguggguaugagguaucagagga

SEQ ID NO: 189296 - RNA, 96 nt, Homo sapiens
uguguguuuauauguguuuauauauauacuuguguaugcaaagguaaaagucugaaaggauauaugcuaacuguucacaaugauaaccccccagga

SEQ ID NO: 189297 - RNA, 45 nt, Homo sapiens
aggaaggcccggucgaaguucaggcugaaguccugugggcagggc

SEQ ID NO: 189298 - RNA, 373 nt, Homo sapiens
ugaggguagcuauuauuauuuugcucauuuuacugaggaagaaacagccuuaaagacugugaucuguccaugaucauacaggaagugacagauacaggcaugcaguccagauaucgugucuuuuguugauccagcugagugaaagcaggacuuacugccugcgccaccccucugguguugaagucaucucuaaguccagucccuuagccugagguaacugagaccagaagaaagugaucugggagaaugaggagccgagccccagggccugaaaccaaguccuuggagagaaucacugagaaucuuacaagacggugggaauauagaccuaccagggauagccuguaucuucaaagaauucuuuaaguggagg

SEQ ID NO: 189299 - RNA, 46 nt, Homo sapiens
gaacaguacaucuauaaaaggaaaagugauggcaucuauaucauaa

SEQ ID NO: 189300 - RNA, 47 nt, Homo sapiens
gggaggucaugccugaucucuacuucuacagagauccugaagagauu

SEQ ID NO: 189301 - RNA, 48 nt, Homo sapiens
acugcuacuaagccugagguugcagacuggucugaagguguacaggug

SEQ ID NO: 189302 - RNA, 56 nt, Homo sapiens
ugagggagcccuggcuggggcagggauggacagcagugucuuucugcaggugccgg

SEQ ID NO: 189303 - RNA, 46 nt, Homo sapiens
gcgacuccaacaucagagcuccccaaguucuggggacuucagagcc

SEQ ID NO: 189304 - RNA, 42 nt, Homo sapiens
ggagagagacucucagccacucccccagggccggccaccucc

SEQ ID NO: 189305 - RNA, 42 nt, Homo sapiens
guccguuuggagggcugguuucgaccugggggguggcgagca

SEQ ID NO: 189306 - RNA, 50 nt, Homo sapiens
cccgggagccccacggggugacggccacggccgagaccucaauuuugggg

SEQ ID NO: 189307 - RNA, 45 nt, Homo sapiens
gagguggagagggccggcagaggccugcugccauucuccagggcu

SEQ ID NO: 189308 - RNA, 30 nt, Homo sapiens
uaugauggagcacuggcuggggcagggaug

SEQ ID NO: 189309 - RNA, 48 nt, Homo sapiens
ugcuacuaagccugagguugcagacuggucugaagguguacaggugcc

SEQ ID NO: 189310 - RNA, 47 nt, Homo sapiens
gaggucaugccugaucucuacuucuacagagauccugaagagauuga

SEQ ID NO: 189311 - RNA, 46 nt, Homo sapiens
acaguacaucuauaaaaggaaaagugauggcaucuauaucauaaau

SEQ ID NO: 189312 - RNA, 40 nt, Homo sapiens
aagaaagugaagaugaagaguacuacagugaagaugaaga

SEQ ID NO: 189313 - RNA, 46 nt, Homo sapiens
guacccucggcagcuaugcagaugcuuuucaguuccuggcccaauu

SEQ ID NO: 189314 - RNA, 46 nt, Homo sapiens
ucggccuccuccggccgcccguaguuccaguuccccuuuccccacc

SEQ ID NO: 189315 - RNA, 48 nt, Homo sapiens
ucuguccugaaacuuaaugccuuuuucaguuugauugucuacauggag

SEQ ID NO: 189316 - RNA, 46 nt, Homo sapiens
auggucaaccuccuggaggaugcaguaagguuccagagacaagcag

SEQ ID NO: 189317 - RNA, 43 nt, Homo sapiens
aggcucaguugcuuuugaaaguacuagaacuacuuggugugaa

SEQ ID NO: 189318 - RNA, 42 nt, Homo sapiens
uggaauagagaagagauuugagugaaaugaaguuggcccuag

SEQ ID NO: 189319 - RNA, 49 nt, Homo sapiens
agauaaaggcuuagugaucauaaagcacuguacuaaauguaguguugag

SEQ ID NO: 189320 - RNA, 43 nt, Homo sapiens
uggcuuguucaucuuuguacucccagugccuggaacucaguag

SEQ ID NO: 189321 - RNA, 59 nt, Homo sapiens
uagcaguauguaggcugccauugacacagaaguuaccauaguaguaaaaugacauacua

SEQ ID NO: 189322 - RNA, 76 nt, Homo sapiens
guaaaauguaagaugcugcuaaugguucuaggaagacaucaauaggcaauguaguagacucuagaaauuuggacau

SEQ ID NO: 189323 - RNA, 40 nt, Homo sapiens
acucuuacaagaacuuaggagucugcccucagaaggcagg

SEQ ID NO: 189324 - RNA, 44 nt, Homo sapiens
ugacaagaaggcucaaggucccaaaggugguggcaaugcaguaa

SEQ ID NO: 189325 - RNA, 53 nt, Homo sapiens
guucugcccacucuucuauucaaugaaccuaugccccacagagagagagagag

SEQ ID NO: 189326 - RNA, 50 nt, Homo sapiens
ugggaugagauucaaugaaguggccgcacaguauagugaagauaaagcca

SEQ ID NO: 189327 - RNA, 99 nt, Homo sapiens
ccuugccuguaagugggauggauaagccuguguuuacagacccaccgguuaagacaaaauuuggauaucauauuauuauggucgaaggaagaaaauaaa

SEQ ID NO: 189328 - RNA, 101 nt, Homo sapiens
ucucuggcuucuaggaggucucuuauuaauaugguuuuagaccacguggaggacauggaggaaagacuugacgacagcagugaagcaaaggguccugaaga

SEQ ID NO: 189329 - RNA, 46 nt, Homo sapiens
aucugugaaacaauuugaugcuucaacucccaaaaaugacaucagu

SEQ ID NO: 189330 - RNA, 40 nt, Homo sapiens
ucagauggcgaagaugaagaugauucuuuuaaagauaccu

SEQ ID NO: 189331 - RNA, 36 nt, Homo sapiens
aaguuggaagaggaaccuucagcaucuucaccacag

SEQ ID NO: 189332 - RNA, 57 nt, Homo sapiens
ggaugaugagauuuuacgucauugcaauccuuggcccauuauuuccauaacaaauga

SEQ ID NO: 189333 - RNA, 49 nt, Homo sapiens
ggcacugcaagaggauccucuggaaaguuuuaauuauguacuuagcaaa

SEQ ID NO: 189334 - RNA, 45 nt, Homo sapiens
ucuauagcuacuuuaccaaagggguuuggaaguguagaagaacuu

SEQ ID NO: 189335 - RNA, 50 nt, Homo sapiens
aaaauggcaaguguagucauugaugaucugcccaaagagggugagaaaca

SEQ ID NO: 189336 - RNA, 52 nt, Homo sapiens
caacaaagaagaaaugcccuaaauugaauaaaccacagccucagccuucacc

SEQ ID NO: 189337 - RNA, 50 nt, Homo sapiens
auagcuggaaucucagaccaugauuugauguacacaugugaucugucugu

SEQ ID NO: 189338 - RNA, 51 nt, Homo sapiens
agcugcagcuucagucuuugcaugcugcucagaggaaaucugauauaaaac

SEQ ID NO: 189339 - RNA, 45 nt, Homo sapiens
aacuuaauggcaaucauaaaacccuauuuucucaggaggacuaaa

SEQ ID NO: 189340 - RNA, 42 nt, Homo sapiens
augucauccucgaugaagcacauaaaauaaaaaccucaucua

SEQ ID NO: 189341 - RNA, 46 nt, Homo sapiens
ggaccagaaaccucaaucggauucagcaaaggaaugguguuauuau

SEQ ID NO: 189342 - RNA, 46 nt, Homo sapiens
gauggaagaaaaggugguauauuggcugaugauaugggauuaggga

SEQ ID NO: 189343 - RNA, 36 nt, Homo sapiens
auaugugaaagaggccaaagaagcaacuaagaaugg

SEQ ID NO: 189344 - RNA, 92 nt, Homo sapiens
aaaagagggaauggccaacuacaaggguggucagcuaagggauggcguggcaagaggagacauuugagcuaggcguugaaaaaugaguaaac

SEQ ID NO: 189345 - RNA, 46 nt, Homo sapiens
gaagccgaggccuugagcccagagcaggcugcucauuaccuaaggu

SEQ ID NO: 189346 - RNA, 44 nt, Homo sapiens
gucaaacgcuggaccauucugagugccuguagacagcaucccug

SEQ ID NO: 189347 - RNA, 40 nt, Homo sapiens
cuacaggcacucagaaugguccagcguuugacauacauug

SEQ ID NO: 189348 - RNA, 65 nt, Homo sapiens
ugucccgaaccaaaacuaggcugucccgaaccccugguaauagaauuguuuaucuuuauaccaag

SEQ ID NO: 189349 - RNA, 41 nt, Homo sapiens
gggcacaugccacaugcagauuuuggugcuuucccaaacuu

SEQ ID NO: 189350 - RNA, 44 nt, Homo sapiens
gaauaacccagaaauggagcccggagcccaauuccagagaggaa

SEQ ID NO: 189351 - RNA, 42 nt, Homo sapiens
uuaguucugggaauggugagaacucucccagaauccaaguuu

SEQ ID NO: 189352 - RNA, 47 nt, Homo sapiens
aacagccucugucuggcguguaucaaaacucuggacucccagaaaga

SEQ ID NO: 189353 - RNA, 44 nt, Homo sapiens
ugaacaaaauggauguggucuuugcccucgugaagcuuacaauu

SEQ ID NO: 189354 - RNA, 31 nt, Homo sapiens
ccuauggcauuuauauuuaugcaagaauaag

SEQ ID NO: 189355 - RNA, 43 nt, Homo sapiens
aauucaguaacuauuuuagguggaauucacuuuugauguaagu

SEQ ID NO: 189356 - RNA, 71 nt, Homo sapiens
ucucccaucucuguucccccagauacccuguuccccuucucaugggcagucaguguugugugugugugugu

SEQ ID NO: 189357 - RNA, 45 nt, Homo sapiens
uccuaauuaccuaauauuucccauaaaugucauauuuuugcagau

SEQ ID NO: 189358 - RNA, 39 nt, Homo sapiens
uuagggauuuuggucacaucucaaaagugcuucaauauc

SEQ ID NO: 189359 - RNA, 45 nt, Homo sapiens
uccugaccauugagugcccaacuauuaucauugacuucuucaguu

SEQ ID NO: 189360 - RNA, 34 nt, Homo sapiens
caauaagagcaagaagcuaaaccauauacuagcu

SEQ ID NO: 189361 - RNA, 46 nt, Homo sapiens
uucccaaaggaauugacuuuauuuaacagaguguggaaaaguuaaa

SEQ ID NO: 189362 - RNA, 44 nt, Homo sapiens
aacagguauuuuuuauuauuuauuaauucucagauaucaugaga

SEQ ID NO: 189363 - RNA, 50 nt, Homo sapiens
ucacauucaguuaccucuuacuaagcuguucucacucaagcacucugaau

SEQ ID NO: 189364 - RNA, 60 nt, Homo sapiens
auagccagugugaagaaugacuaguuauggcaaaauaugaacauagauuaaauccaauaa

SEQ ID NO: 189365 - RNA, 67 nt, Homo sapiens
gaaagcagagugacaaguggacccucgggagcccuggggauuucuggcuuggccugagguucucuug

SEQ ID NO: 189366 - RNA, 42 nt, Homo sapiens
gucuauggugaagugacgguaagcaaggagaauaaugacugc

SEQ ID NO: 189367 - RNA, 51 nt, Homo sapiens
gggagauggaggaggaagagggggaggaggaggaggaggugguggaggggg

SEQ ID NO: 189368 - RNA, 32 nt, Homo sapiens
ggagaggaggaggaggagaagaaggaggaggg

SEQ ID NO: 189369 - RNA, 92 nt, Homo sapiens
ggaaggagagagcugggggacagggcaaucgaagagcuccauggugagaugagaccugcgacuggagguggggugaaguggggugggguugg

SEQ ID NO: 189370 - RNA, 99 nt, Homo sapiens
gggaaagacucaccaaagcuguuccuggucuuucacagcugggaaggagaacaacaugcugcagcccgagacccacaucuucacagcccccgaggaggu

SEQ ID NO: 189371 - RNA, 95 nt, Homo sapiens
gccuaaccuuguccuugaugccgugggagauggaggaggaagagggggaggaggaggaggaggugguggagggggaggaggagcaggaggaggag

SEQ ID NO: 189372 - RNA, 69 nt, Homo sapiens
ugacccucuucuacugcagccacagguccugggaaaguagugggguccagaacccugggaggggcggag

SEQ ID NO: 189373 - RNA, 88 nt, Homo sapiens
uagauguggagccuggaugcccuugcaagcuguguuuuguggccaaauuuuaacgaugugcccagagaggaggggcuggaggagcucc

SEQ ID NO: 189374 - RNA, 41 nt, Homo sapiens
gcaacaguccaggugacaaaucuuugguugggcgggacgca

SEQ ID NO: 189375 - RNA, 44 nt, Homo sapiens
ucugucucauaaagacaggauugugcaaucuaaguugaucaguc

SEQ ID NO: 189376 - RNA, 46 nt, Homo sapiens
gcugaaaggugggguccgugcuggcgagggccacagaggcccaggg

SEQ ID NO: 189377 - RNA, 63 nt, Homo sapiens
gcccugggaggaaagagcugguaggaauaagcgucccugucaggaaaaagagguauggaaaag

SEQ ID NO: 189378 - RNA, 43 nt, Homo sapiens
gcagccacagguccugggaaaguagugggguccagaacccugg

SEQ ID NO: 189379 - RNA, 66 nt, Homo sapiens
guaugggauccauuccaagaguuucuugggagggggcuaugugugaguggggcuucugggaaggag

SEQ ID NO: 189380 - RNA, 46 nt, Homo sapiens
ucugucucauaaagacaggauugugcaaucuaaguugaucagucuc

SEQ ID NO: 189381 - RNA, 41 nt, Homo sapiens
aacaguccaggugacaaaucuuugguugggugggacgcaua

SEQ ID NO: 189382 - RNA, 80 nt, Homo sapiens
uggagccuggaugcccuugcaagcuguguuuuguggccaaauuuuaacgaugugcccagagaggaggggcuggaggagcu

SEQ ID NO: 189383 - RNA, 69 nt, Homo sapiens
acccucuucuacugcagccacagguccugggaaaguagugggguccagaacccugggaggggcggaguu

SEQ ID NO: 189384 - RNA, 97 nt, Homo sapiens
gccuaaccuuguccuugaugccgugggagauggaggaggaagagggggaggaggaggaggaggugguggagggggaggaggagcaggaggaggagga

SEQ ID NO: 189385 - RNA, 68 nt, Homo sapiens
cacagcugggaaggagaacaacaugcugcagcccgagacccacaucuucacagcccccgaggagguaa

SEQ ID NO: 189386 - RNA, 123 nt, Homo sapiens
aaggagagagcugggggacagggcaaucgaagagcuccauggugagaugagaccugcgacuggagguggggugaaguggggugggguugggggaaagacucaccaaagcuguuccuggucuuu

SEQ ID NO: 189387 - RNA, 78 nt, Homo sapiens
uugggagggggcuaugugugaguggggcuucugggaaggaggcaacaucagcaaggggguugcagugaagguuggcga

SEQ ID NO: 189388 - RNA, 45 nt, Homo sapiens
gggagugcaugugcaugccugaaaguggggucuauggugaaguga

SEQ ID NO: 189389 - RNA, 41 nt, Homo sapiens
auacaagagggaaaucagcucaaagggggagcaagggaaua

SEQ ID NO: 189390 - RNA, 44 nt, Homo sapiens
ugacacuucauaggaggcucaacagguaccugcugaaugaagaa

SEQ ID NO: 189391 - RNA, 57 nt, Homo sapiens
gccucaccauuuccagguugguguccaagagggaccugagaaggcagaggccaaggg

SEQ ID NO: 189392 - RNA, 26 nt, Homo sapiens
gaagccuucccagcugcccggacgac

SEQ ID NO: 189393 - RNA, 41 nt, Homo sapiens; identical to SEQ ID NO: 122364

SEQ ID NO: 189394 - RNA, 49 nt, Homo sapiens
cuggcuggcuagcuccugggaugucuucaucgcaagguggccuccucgu

SEQ ID NO: 189395 - RNA, 46 nt, Homo sapiens
ccgcauuguuggacauucagguggugccuaguucuuucccuguguu

SEQ ID NO: 189396 - RNA, 47 nt, Homo sapiens
augauuacuuauacauuccugaaacauuuucaucuguaucugcccug

SEQ ID NO: 189397 - RNA, 46 nt, Homo sapiens
auuuuucuuggucuuuauauccacuaguuuauauccacuacagugg

SEQ ID NO: 189398 - RNA, 41 nt, Homo sapiens
aagcuuauggccacagaaguugcugcugacacucuggguga

SEQ ID NO: 189399 - RNA, 42 nt, Homo sapiens
cucaaacaaaggagguaagaaaccuaggaccaaagcacccaa

SEQ ID NO: 189400 - RNA, 49 nt, Homo sapiens
ugcuggcuggcuagcuccugggaugucuucaucgcaagguggccuccuc

SEQ ID NO: 189401 - RNA, 41 nt, Homo sapiens; identical to SEQ ID NO: 122378

SEQ ID NO: 189402 - RNA, 26 nt, Homo sapiens
agccuucccagcugcccggacgacag

SEQ ID NO: 189403 - RNA, 45 nt, Homo sapiens
guaagauuuggugguggguccaaggaaaauaagguuuacucuaga

SEQ ID NO: 189404 - RNA, 52 nt, Homo sapiens
cuugacgucugugaaauuauugacucuccgcaguccccugucacacacagag

SEQ ID NO: 189405 - RNA, 39 nt, Homo sapiens
gugguugcaauaguugacaggauauggggaaacagacaa

SEQ ID NO: 189406 - RNA, 45 nt, Homo sapiens
ucugaagucuuuuugucauguagcuauuaaucuguggcuaugaaa

SEQ ID NO: 189407 - RNA, 54 nt, Homo sapiens
auaauuccaagaucaguauuauuuuucucaggugaugcacuggaaucucagcag

SEQ ID NO: 189408 - RNA, 42 nt, Homo sapiens
auuuuuucucuccucauggaaucaccucaaauggaagggaug

SEQ ID NO: 189409 - RNA, 42 nt, Homo sapiens
ccccuuuaauuaggucagaauggcaggcaagggguggggaag

SEQ ID NO: 189410 - RNA, 46 nt, Homo sapiens
aauuuguccaacuggcuauuuuuaagcuuguccuaaaagccaauaa

SEQ ID NO: 189411 - RNA, 50 nt, Homo sapiens
agauggagaagugccuugucuuuuuagaacaaagauaacacauuacgugu

SEQ ID NO: 189412 - RNA, 42 nt, Homo sapiens
cacagauugcuuaccuagucucuaaauaaugaaaugugugug

SEQ ID NO: 189413 - RNA, 47 nt, Homo sapiens
agcuuuaccagaaaagaauaauagcggauauguucauccaaacuaag

SEQ ID NO: 189414 - RNA, 48 nt, Homo sapiens
auauuaugaucuauaaguuuauuuuaaaagcuaauauaagaacucaaa

SEQ ID NO: 189415 - RNA, 53 nt, Homo sapiens
auaaacucugaaauuuucaacaaaaaaugcacagaaugacaagagcagcaaua

SEQ ID NO: 189416 - RNA, 45 nt, Homo sapiens
uauaauuaaugaggagaucuggaaaaauaauucuaauugguaagg

SEQ ID NO: 189417 - RNA, 134 nt, Homo sapiens
aaaaaagcacuuggauuaucugugaauucuauaugaauaauauagaauauauuaacauauauuaauaugaauguaauauauauaauuauauauagaauauauauaauucuauagcaucugugaaugcuauagcu

SEQ ID NO: 189418 - RNA, 59 nt, Homo sapiens
uucuuuugaagcuugggcccauuacuacauuagcacuauuacuggugacuuuagguuca

SEQ ID NO: 189419 - RNA, 53 nt, Homo sapiens
ggaaggacauuugaagacacagugagaaagcggccauuggcaagcaaggaaga

SEQ ID NO: 189420 - RNA, 48 nt, Homo sapiens
gaggagcaggcaaggaacgcuuccaggcugcgguggccagggacgccu

SEQ ID NO: 189421 - RNA, 42 nt, Homo sapiens
aaauacaaaguuuucaaaacaguauauuuuauuuuacaauag

SEQ ID NO: 189422 - RNA, 27 nt, Homo sapiens
uauuuuucaaucuuccaaacagcaaag

SEQ ID NO: 189423 - RNA, 47 nt, Homo sapiens
auuccccauccccagcugaagaaagggguguuacugaguccagcuga

SEQ ID NO: 189424 - RNA, 63 nt, Homo sapiens
acauccauaaguggagaaggaaauagauaaaugucaaaguaugauugguggagggagcaaggu

SEQ ID NO: 189425 - RNA, 115 nt, Homo sapiens
uaaagcaaacuagugaggacaaaggauuuuguccucaucucaacaaugaucagcuauuggaacugcaugaaacugaacaauuuaaaccuggagcugguaauguucuuaagaccaa

SEQ ID NO: 189426 - RNA, 46 nt, Homo sapiens
uuuuccguuuuuaaaucacucacagagggugggacaggaggaagag

SEQ ID NO: 189427 - RNA, 50 nt, Homo sapiens
aaguuuuaagaauaaaauaaaaauuggaaauaauuggccaaaauugaaag

SEQ ID NO: 189428 - RNA, 37 nt, Homo sapiens
ucagcauguaaaaaguaaagaacugaaaauagacaaa

SEQ ID NO: 189429 - RNA, 41 nt, Homo sapiens
aguguaggugguuccccaaggcugguaccaaugagacuggg

SEQ ID NO: 189430 - RNA, 50 nt, Homo sapiens
uuccuaguccaucccucaugaaaaaugacugaccacugcugggcagcagg

SEQ ID NO: 189431 - RNA, 37 nt, Homo sapiens
uagggacuaagccaugccccuaacaagaaaacaagcc

SEQ ID NO: 189432 - RNA, 50 nt, Homo sapiens
guacuugguauaagguuuuuggccccagagacaugggaaaaaaaugcaug

SEQ ID NO: 189433 - RNA, 44 nt, Homo sapiens
aauaaaaagcccucucuuauucccacucuacaacgcaugucaaa

SEQ ID NO: 189434 - RNA, 48 nt, Homo sapiens
gauauguucgauacuaaggaaaaacuaaacagaucaccuuugacaugc

SEQ ID NO: 189435 - RNA, 53 nt, Homo sapiens
uuccuuaguaucgaacauaucacagcuacucaaugaaguuucuucucaacuaa

SEQ ID NO: 189436 - RNA, 44 nt, Homo sapiens
accuuguuuuuugcaaaaauuuuccaucuccucaaucaggccag

SEQ ID NO: 189437 - RNA, 42 nt, Homo sapiens
uauugucucuacaaaauucucauuguauaguuaaaccacagu

SEQ ID NO: 189438 - RNA, 38 nt, Homo sapiens
caaauuggccucaaauauacauauaauuuauucauuua

SEQ ID NO: 189439 - RNA, 40 nt, Homo sapiens
ugcuaggcacuaaaaaugcaaugauuauugauaucuaggu

SEQ ID NO: 189440 - RNA, 131 nt, Homo sapiens
uggccacuacuaugagcagggaguucaggcuguccccuugggaccucgcuuugucccaggcacagucacccuuuccauaaccaucacuagaaaucccaaaccccagaauccugcucaccuaagcucaaaga

SEQ ID NO: 189441 - RNA, 46 nt, Homo sapiens
uuuuuuuuccccaacaaccugaccauuuuaucuucucagucuaggg

SEQ ID NO: 189442 - RNA, 45 nt, Homo sapiens
agauuagauacugacuggauuuuggugucucucucaaguggagaa

SEQ ID NO: 189443 - RNA, 36 nt, Homo sapiens
ucuuuugagauguacuuuuugauguugccgguuacc

SEQ ID NO: 189444 - RNA, 59 nt, Homo sapiens
aacgucggcuaucagagcaagcauuguggagcgguuccuuaugccaggcugccauguga

SEQ ID NO: 189445 - RNA, 36 nt, Homo sapiens
augugggcaaguguacgugugugugugucaugugug

SEQ ID NO: 189446 - RNA, 90 nt, Homo sapiens
augcaaagaaauauuuaaggagagauuacaugaaaucaaagagagggagauagauucaugaagaggcugaaauacucaaaggugaguaga

SEQ ID NO: 189447 - RNA, 71 nt, Homo sapiens
aagcagagaacaaauacaagccaacagagauuaauacugaaauagaaaaucacaaacagcaagagaugcug

SEQ ID NO: 189448 - RNA, 173 nt, Homo sapiens
ggagagagagaauagcccaagagaggcagaaaggaaaugcagaaaugagaaaugugagauaaaaaguagaaacagcagaaaggaggccagacucagaaaaaaggugaaauuuaaaacgaacgagaaggggaagggguaacaaauaaucacaguucacaaagagaaaagagagg

SEQ ID NO: 189449 - RNA, 90 nt, Homo sapiens
cacacagcaugugacccaaaaaggagacaugaaauaaagcgugaaagaagagccacaucuaggagagcaaagagaaauagcaacaaaaug

SEQ ID NO: 189450 - RNA, 97 nt, Homo sapiens
auggguaagacacacuuuagauagagaacaaagagcaaagacaagaaagaaagagacaaagaaauacacacuugagugcaagagauaagcaaaggca

SEQ ID NO: 189451 - RNA, 52 nt, Homo sapiens
guauuucuuugucucuuucuuucuugucuuugcucuuuguucucuaucuaaa

SEQ ID NO: 189452 - RNA, 49 nt, Homo sapiens
uuuuuuuuaucuuucugugaugcuuuucaugccucuugugccccucacu

SEQ ID NO: 189453 - RNA, 88 nt, Homo sapiens
gacauucagaggaaguaaguaguagaagaggcaagauacagugaggggcacaagaggcaugaaaagcaucacagaaagauaaaaaaaa

SEQ ID NO: 189454 - RNA, 95 nt, Homo sapiens
gcagugccuggcacaugucaaguaaaagguaacccaagaagacucauaaguucauuucccacaauauaagugaccacuagcacuaucagguagca

SEQ ID NO: 189455 - RNA, 64 nt, Homo sapiens
agucucuagacuucucuguuugugaggguuaaaugaaaucauguauguaaagugcucaccuauu

SEQ ID NO: 189456 - RNA, 155 nt, Homo sapiens
uaaaacaccauuucugcuuucugcugaaaggguaacccuuucucaucuccguuugugagagacucugucgucaguuaagauuaguguaaaaagaaaacuaaacucugaaguagccauuauaaaagugugagaaugaagucaguuuucuaaagagu

SEQ ID NO: 189457 - RNA, 40 nt, Homo sapiens
agugccaggcauguugaucuucaggugggaaggcugacuu

SEQ ID NO: 189458 - RNA, 41 nt, Homo sapiens
uccugccugaugacagauaacuuugugccauuuuuagucag

SEQ ID NO: 189459 - RNA, 47 nt, Homo sapiens
gcugauugauggaagccgcauaaauacaaauggaaaccugacuaaaa

SEQ ID NO: 189460 - RNA, 46 nt, Homo sapiens
uugacguguggugguuguuuuugagacuuuaucuuccuaucuggga

SEQ ID NO: 189461 - RNA, 48 nt, Homo sapiens
caacccuaggucaggagguucugucaagauacuuuccuggucccagau

SEQ ID NO: 189462 - RNA, 53 nt, Homo sapiens
gcuuguuguuuuacaguguuagugauccauucccuuugacgaucccuaggugg

SEQ ID NO: 189463 - RNA, 66 nt, Homo sapiens
gaucacuaacacuguaaaacaacaagccuauucuucugaggaagaucugaaaagagauaaaagaaa

SEQ ID NO: 189464 - RNA, 55 nt, Homo sapiens
aaguauugaaaugcaguacacugggaaagucuguucuaaugggcaacuagugguu

SEQ ID NO: 189465 - RNA, 23 nt, Homo sapiens
uauucauuccagcucuauucugu

SEQ ID NO: 189466 - RNA, 364 nt, Homo sapiens
agcuggccaggcgugguggcucacgccuguaaucccagcaguuugggaggucgaggcgggugaaucaccugaggucaggaguuugagaccagccugaccaacauggagaaaccccgucucuacuaaaaauacaaaauuagccuggcguggucgcgcaugccuguaaucucagcuacucgagaggcugaggcaggagaauaacuugaacccaggagacagagguugcagugagcugagauugcgccauugcacuccagccugggcaacaagagcgaaacugcgaaaaaaaaaaaauacacgccacaaaaacaguuaagcaaaucuaugcagaaggaaaaacaagguacagaaaaccagggauuca

SEQ ID NO: 189467 - RNA, 45 nt, Homo sapiens
ugauucuguaccuuaagucaagaggaaggauggcuugauuuuagg

SEQ ID NO: 189468 - RNA, 51 nt, Homo sapiens
gcugaggacaggcuggcgccuccacccacccuccugccucaccccugcgga

SEQ ID NO: 189469 - RNA, 42 nt, Homo sapiens
ggaagggcggggcguggacagggacggugggcaggucaccag

SEQ ID NO: 189470 - RNA, 41 nt, Homo sapiens
gggcugguucagccccaggguuuuacacaacuagcaggcaa

SEQ ID NO: 189471 - RNA, 54 nt, Homo sapiens
uccaucccguaaccgcuguuggggcgcccgggggacccuggccaagaggagaug

SEQ ID NO: 189472 - RNA, 48 nt, Homo sapiens
cagaugaccgacugcaccgaguaaugugugcccugcaaccgcuccgga

SEQ ID NO: 189473 - RNA, 37 nt, Homo sapiens
cgggccgggagcguucggcgccuacgcgagcccgggg

SEQ ID NO: 189474 - RNA, 45 nt, Homo sapiens
gauagagcauagccauuguguuuggcuauuugcgaagguuggcaa

SEQ ID NO: 189475 - RNA, 43 nt, Homo sapiens
agcuacgaaguaguacuuacaguauucuaaagagccagagacu

SEQ ID NO: 189476 - RNA, 47 nt, Homo sapiens
uuuuuaagaaagacaucuggauuguaggguggacucgauaaccuggu

SEQ ID NO: 189477 - RNA, 41 nt, Homo sapiens
ccuggggagacaauuuuauaguguacacuggaaacacaaaa

SEQ ID NO: 189478 - RNA, 42 nt, Homo sapiens
aggugggcaagaaugguucuuguccccagaaucugacaauaa

SEQ ID NO: 189479 - RNA, 49 nt, Homo sapiens
guguguuggugcaguguugacuaugaaaagcaggccugaacuaggugga

SEQ ID NO: 189480 - RNA, 26 nt, Homo sapiens
accaaggaaagugcaacugagaauug

SEQ ID NO: 189481 - RNA, 49 nt, Homo sapiens
gccuugucuggucaacauuacccagcaaagaggcaaaaggggcagggca

SEQ ID NO: 189482 - RNA, 60 nt, Homo sapiens
uggccccuuuuuacagacuauugcucacaaucucagguguccauauuugcagcuauuagg

SEQ ID NO: 189483 - RNA, 41 nt, Homo sapiens
uagucuguaaaaaggggccaagggcacacaaggggcagaga

SEQ ID NO: 189484 - RNA, 42 nt, Homo sapiens
aaaaccauugauaacugccauugugccuauuaacagucccag

SEQ ID NO: 189485 - RNA, 40 nt, Homo sapiens
ugagauuaugaguaguuaacacuucucagcagcaauccaa

SEQ ID NO: 189486 - RNA, 54 nt, Homo sapiens
ggaccuguguaggagaaaaagacccuauguuccucccauuacccuuuggauugc

SEQ ID NO: 189487 - RNA, 23 nt, Homo sapiens
uuucuuuugucuuugucaguaga

SEQ ID NO: 189488 - RNA, 46 nt, Homo sapiens
aggggcauuagguaaccagcacccucuugauguaaagcaaagauga

SEQ ID NO: 189489 - RNA, 49 nt, Homo sapiens
uaacugaaaauggucaaggagucaguacugaagaucagcaaugccaagg

SEQ ID NO: 189490 - RNA, 34 nt, Homo sapiens
aaucaaugaaaauuagagugacuuucgagagaag

SEQ ID NO: 189491 - RNA, 38 nt, Homo sapiens
gcucccagcaaaccccuagucuagccccagcccuacuc

SEQ ID NO: 189492 - RNA, 65 nt, Homo sapiens
uuucugugcuacagacucuucaaaggaaaauaguuaagucaauuucaaagaaaaugaccagcaca

SEQ ID NO: 189493 - RNA, 62 nt, Homo sapiens
ccuugccacggcucaccaccauguccacaccaagcaggccuggagcacugcccauggcaaca

SEQ ID NO: 189494 - RNA, 34 nt, Homo sapiens
uaccgcccacugggagacauacacguggccccuc

SEQ ID NO: 189495 - RNA, 28 nt, Homo sapiens
uggcuaaagacagcugcgaagugccaug

SEQ ID NO: 189496 - RNA, 24 nt, Homo sapiens
ucacagccaauuagagcagaagau

SEQ ID NO: 189497 - RNA, 50 nt, Homo sapiens
uuccaucuucugcucuaauuggcugugaucaauuccacccccauuucuaa

SEQ ID NO: 189498 - RNA, 75 nt, Homo sapiens
cugcguggcacuaggcggcaaaacccgccaucuuuaacaaugcggcaagcccgccaugauguccacgugacaaaa

SEQ ID NO: 189499 - RNA, 72 nt, Homo sapiens
uggcgggcuugccgcauuguuaaagauggcggguuuugccgccuagugccacgcagagcgggagaaaaggug

SEQ ID NO: 189500 - RNA, 79 nt, Homo sapiens
aaagcacacagcaaagacaaagaggcccgccauguuuuacacugcggcaagaccuucagccgccaucuuuuccugugug

SEQ ID NO: 189501 - RNA, 42 nt, Homo sapiens
ugguggacaugugcggucacacaggaaaagauggcggcugaa

SEQ ID NO: 189502 - RNA, 103 nt, Homo sapiens
accgcacauguccaccaccaugcuaaccacuuaacaaagccucgcccaucaugauguggccuucccgccacuugaacacugcgacagaacuggauccgccauu

SEQ ID NO: 189503 - RNA, 38 nt, Homo sapiens
caaugccgcaaugucaaaaucgccauuuuaagcccugc

SEQ ID NO: 189504 - RNA, 75 nt, Homo sapiens
uuuuaucaguacaagggacuaguuaaaaauggaagguuaggaaagacuaaggugcagggcuuaaaauggcgauuu

SEQ ID NO: 189505 - RNA, 55 nt, Homo sapiens
augauucuuacugccucccgauacaacaaucacgcaaagcuccuaacaagcccca

SEQ ID NO: 189506 - RNA, 37 nt, Homo sapiens
uguuaggagcuuugcgugauuguuguaucgggaggca

SEQ ID NO: 189507 - RNA, 43 nt, Homo sapiens
aauggcggccacuuuuccuccacaaucugaacacgcccuuagc

SEQ ID NO: 189508 - RNA, 49 nt, Homo sapiens
cgcuuuggcagagaaugacucugcaguuaagcuaagggcguguucagau

SEQ ID NO: 189509 - RNA, 32 nt, Homo sapiens
ucuggaauaucuacacuuuuuuuugcugcuga

SEQ ID NO: 189510 - RNA, 55 nt, Homo sapiens
ucaccccgaugggccagaguguuggggguucagaggggaagggaaucagcaggua

SEQ ID NO: 189511 - RNA, 66 nt, Homo sapiens
ggaaaaaaaaauaaaaagcagguauccgcggccccgaugggcgaauaaaaaagaauuaaaaggcag

SEQ ID NO: 189512 - RNA, 52 nt, Homo sapiens
uguggaucaguuuuuuacucuuccacucucuuuucuauauuuugcccaucgg

SEQ ID NO: 189513 - RNA, 52 nt, Homo sapiens
aagaguaaaaaacugauccacaaaaaacagagaugucaaccaaaaaugauuc

SEQ ID NO: 189514 - RNA, 49 nt, Homo sapiens
gagagaguaagaaauauggcugcagcagcgaauugcagcgcuuuaagaa

SEQ ID NO: 189515 - RNA, 42 nt, Homo sapiens
ccuuugcaaauggaacacaagauauauggggucagcucagag

SEQ ID NO: 189516 - RNA, 44 nt, Homo sapiens
acucaaaaaguggacauaaaagcaagugauuccuguuugcccau

SEQ ID NO: 189517 - RNA, 46 nt, Homo sapiens
auuuaagaggaaaaacugagccaggcuaaggaagggcaaagagcca

SEQ ID NO: 189518 - RNA, 87 nt, Homo sapiens
uaggacuggaacuggaacuugaacuggaacuggaacucgaacuggaacuggaacucgaacuggaaccagaacuacuaccaccaccag

SEQ ID NO: 189519 - RNA, 46 nt, Homo sapiens
cuucuuacuugaagaucaaggacuaugguuggaggucucuguccug

SEQ ID NO: 189520 - RNA, 48 nt, Homo sapiens
auaacauuugagguuguuuuaaaauacaggacuauuuauuguagccau

SEQ ID NO: 189521 - RNA, 95 nt, Homo sapiens
caugggggcuguguugugcauuauggcaugucaggauguuuggcagcauuccugcccucuacacaaaugucuccagacguugcuaaugucccaca

SEQ ID NO: 189522 - RNA, 44 nt, Homo sapiens
uuacuaagugcaaacaaacauuuuaaaguuuaggcaugccaaaa

SEQ ID NO: 189523 - RNA, 43 nt, Homo sapiens
cauugcauuuccuaucuaauuagacagcaaucaaacccagaag

SEQ ID NO: 189524 - RNA, 48 nt, Homo sapiens
aggcuuuuuuuuuuuuuuuuaaugggggagggauugaguuguuggugg

SEQ ID NO: 189525 - RNA, 41 nt, Homo sapiens
ucaggauccgacucgguugguucggccgccgccgccgaggc

SEQ ID NO: 189526 - RNA, 42 nt, Homo sapiens
acccgccucuagcccagcgccugcucggagacguugcucagg

SEQ ID NO: 189527 - RNA, 47 nt, Homo sapiens
auguaaaagacagagguuuagaacaaaguuuauggugugaaugaggc

SEQ ID NO: 189528 - RNA, 42 nt, Homo sapiens
gcuuuugugacaacuuucaccuucucugaacuuuuuccuugc

SEQ ID NO: 189529 - RNA, 48 nt, Homo sapiens
cagaaauauauauuauccuuggucugaaauuccugauuaccgcucccu

SEQ ID NO: 189530 - RNA, 42 nt, Homo sapiens
agaggaguggagugcuuucuauguaaugaaaagguggcaauu

SEQ ID NO: 189531 - RNA, 44 nt, Homo sapiens
uugcagugagcccuggaaaauuacuuaguggaaaggcaccagau

SEQ ID NO: 189532 - RNA, 47 nt, Homo sapiens
ugaaaugugccaaauuuucuuaccucaucucacagauucacccacag

SEQ ID NO: 189533 - RNA, 48 nt, Homo sapiens
cagcuccaaggcccugagagaugagaaauguaagggaaagcacaugga

SEQ ID NO: 189534 - RNA, 91 nt, Homo sapiens
cuuucuggagauugggccuuggggaaggagagcagcccaggcuggagugauaugagcaugggcaccaacaccaacagccuucuggaugaug

SEQ ID NO: 189535 - RNA, 45 nt, Homo sapiens
caacaaggggauugaaaaaccaccuggcaaaaacucccgccaggu

SEQ ID NO: 189536 - RNA, 42 nt, Homo sapiens
acaaagugucaaaaucaagaaagaaaaguucacccagcaaga

SEQ ID NO: 189537 - RNA, 63 nt, Homo sapiens
ccguaaggagcccccuguuauuaucaaauauaucaucauuaaucgcuuuaaaggugagaagaa

SEQ ID NO: 189538 - RNA, 61 nt, Homo sapiens
caguugguuccaaagaggaagaugaugaugaauggugucccaaaaagagaagaaaaguaac

SEQ ID NO: 189539 - RNA, 45 nt, Homo sapiens
cuaauucuggcagcuccuccucccaacagaacuaugggcugcgag

SEQ ID NO: 189540 - RNA, 48 nt, Homo sapiens
gaagaaaggcaaagaggaaggacaggaagacaaagguguagagaagaa

SEQ ID NO: 189541 - RNA, 41 nt, Homo sapiens
ggcuucccccugcauaagucaagggcaggagacagacgaga

SEQ ID NO: 189542 - RNA, 51 nt, Homo sapiens
ugaaacugucucucaaacuuuucuacucuucagauaucuuucucuaauauc

SEQ ID NO: 189543 - RNA, 46 nt, Homo sapiens
gguucugccucucuuaugaccuuggacaagcauuuaaggucucuga

SEQ ID NO: 189544 - RNA, 46 nt, Homo sapiens
uguuacucuuagacuugugcuuuuuuucacuacagcagguuuucca

SEQ ID NO: 189545 - RNA, 44 nt, Homo sapiens
gaauuuugugccuguuauuaugauuucuguuugacagagaagaa

SEQ ID NO: 189546 - RNA, 24 nt, Homo sapiens
uaaaucaugucaauuuaaaucacu

SEQ ID NO: 189547 - RNA, 78 nt, Homo sapiens
auucucauaugucaggauuucuagacaggauacacuugaaacagguaauaauacuaaauaauauaugauaagggagaa

SEQ ID NO: 189548 - RNA, 68 nt, Homo sapiens
gugugugugugugugugcauguguauguguguguguguguuggaauuuauccauuuaaguaaauguag

SEQ ID NO: 189549 - RNA, 46 nt, Homo sapiens
acaugcugauuggagccaggcugugggaauguuuuuggucuaaggc

SEQ ID NO: 189550 - RNA, 41 nt, Homo sapiens
ggaaagccaggucaugacuccagguccaaauggcccugucu

SEQ ID NO: 189551 - RNA, 60 nt, Homo sapiens
auggagaguugacagaagaaccuaggaagcaugacuaagugguugaaucugcuauggaaa

SEQ ID NO: 189552 - RNA, 25 nt, Homo sapiens
uggagaguggugguugcugaggaga

SEQ ID NO: 189553 - RNA, 47 nt, Homo sapiens
guugaaaagaaacagucagauaucuguggcauuaccuacuggccaga

SEQ ID NO: 189554 - RNA, 86 nt, Homo sapiens
ucuuaaaaccaguucgugcaaaccagaaauuguaguauguacagaauauuucaagucacaacuuucugggaugaaugguuuccaua

SEQ ID NO: 189555 - RNA, 46 nt, Homo sapiens
cuccagugcccagucucugcucuucuauuuuggagguugcagagac

SEQ ID NO: 189556 - RNA, 57 nt, Homo sapiens
ugcaaacacuuaagaaauguuucuagaaaucaaaaucauuuuuguaugcuaguagau

SEQ ID NO: 189557 - RNA, 45 nt, Homo sapiens
guaauagugcaaaagugcauuuaacuaugaaggcuugcugggaga

SEQ ID NO: 189558 - RNA, 44 nt, Homo sapiens
aagacagugacagucauuaaaacuucuucagcacuuacuaugag

SEQ ID NO: 189559 - RNA, 49 nt, Homo sapiens
caaucauuagguauggugauggagucagagagggagauggugucuagac

SEQ ID NO: 189560 - RNA, 290 nt, Homo sapiens
agccaucaaugaggacaacagugugguguccuugucccagguaagcuguggccacagacuagucuuuccuuacugcacuuacuugagggauuuucccagguuucuuuucucauuuuucuugcagugacugcagauagagugggguuuacugggaaucccaaucuccagggcugcugcuuacuccccgucagcccaaugacccaaaggccuuaacuuucuuuccucagcccaagauggaugaauugcaguuguuccgaggugacacaguguugcugaaaggaaagaagaga

SEQ ID NO: 189561 - RNA, 42 nt, Homo sapiens
gacgguucuucuguuugagaauggcuguugauaggucaucac

SEQ ID NO: 189562 - RNA, 45 nt, Homo sapiens
gccaaguacuguuaaugccaucaauccucuaggaaggaauuggug

SEQ ID NO: 189563 - RNA, 68 nt, Homo sapiens
guuaaugcuucuaaauuauugcuuauguuagggcuucaguauuucauuugaggugacuuuccaaaaca

SEQ ID NO: 189564 - RNA, 43 nt, Homo sapiens
aagucugaguguaauucacaaugguuccuauuucugugaacug

SEQ ID NO: 189565 - RNA, 55 nt, Homo sapiens
uaguaaaugcaggggcauuaccaggaggucaguagaguagcauagagguauagac

SEQ ID NO: 189566 - RNA, 53 nt, Homo sapiens
aauauuccugaauggcaaccaagccaaggaggcugagauuugggaaaugcucu

SEQ ID NO: 189567 - RNA, 46 nt, Homo sapiens
aggaggcuuuccauuuuugggaacccaaagagacuucugucugugg

SEQ ID NO: 189568 - RNA, 46 nt, Homo sapiens
augaguuuuucuggggcccaagaucccaccuagaaaccaccaagau

SEQ ID NO: 189569 - RNA, 45 nt, Homo sapiens
guacuugaucccaggaaucacuccuauacucuguacaaccgaagg

SEQ ID NO: 189570 - RNA, 26 nt, Homo sapiens
gccucaguucucauguauuggggggu

SEQ ID NO: 189571 - RNA, 45 nt, Homo sapiens
ugcuccuggaaaauggacuggaggccuuuuagaauggucucacca

SEQ ID NO: 189572 - RNA, 55 nt, Homo sapiens
acaauggcaggaaaaucaucacuuuuuaaaguaauucuccuuggagaugguggag

SEQ ID NO: 189573 - RNA, 46 nt, Homo sapiens
uuccauacaauagguguggaauuuuuaaauaaagauuuggaagugg

SEQ ID NO: 189574 - RNA, 25 nt, Homo sapiens
uuccagaacuuaaguaacuggaaga

SEQ ID NO: 189575 - RNA, 42 nt, Homo sapiens
auaaaauuaaacuaauguugcugcuucauuaguuggugggag

SEQ ID NO: 189576 - RNA, 40 nt, Homo sapiens
acuugacuauucuagaaguuauacuuggauuuuuuccugg

SEQ ID NO: 189577 - RNA, 44 nt, Homo sapiens
cgaccaaaccccuucucuuugccccacugauuccgccaccccaa

SEQ ID NO: 189578 - RNA, 39 nt, Homo sapiens
uuccccacuuucugggcaaauuucgaggaguaauuaggc

SEQ ID NO: 189579 - RNA, 37 nt, Homo sapiens
auauccugaaggauauccuuggguuuauuucuaggcg

SEQ ID NO: 189580 - RNA, 40 nt, Homo sapiens
gacaagccuuuuuuugauuggguuguggugcaguuccagg

SEQ ID NO: 189581 - RNA, 32 nt, Homo sapiens
agucggaggcggucuuugguaucccggucauu

SEQ ID NO: 189582 - RNA, 42 nt, Homo sapiens
gguggguuaggccuguguguugcuuagccgaaagaggcaucg

SEQ ID NO: 189583 - RNA, 46 nt, Homo sapiens
cuccagugcauuucuaucguaaccgggcgcgggggagcgcagaucg

SEQ ID NO: 189584 - RNA, 45 nt, Homo sapiens
cugcggcaauacagcugcugcuuuggugccaauucgcuucaggua

SEQ ID NO: 189585 - RNA, 64 nt, Homo sapiens
uguauugccgcaguucuagcuucaccuucacgauguuucccuuggucaaaagcgcacuaaaucg

SEQ ID NO: 189586 - RNA, 43 nt, Homo sapiens
acagacagcauucaagauuagaaggccgagauguucguaaaag

SEQ ID NO: 189587 - RNA, 49 nt, Homo sapiens
ucaccugguuuaauugcagggaaacaacccaaaugguaucgaugcagcu

SEQ ID NO: 189588 - RNA, 44 nt, Homo sapiens
aaugaaggugacccguaauuacuauuuaguuuguuuagccaucu

SEQ ID NO: 189589 - RNA, 36 nt, Homo sapiens
gcaacuuugaaaauaaccacaaaauauuagcuggac

SEQ ID NO: 189590 - RNA, 56 nt, Homo sapiens
ugauuuagccucucucaaccucaguuuccuucuuuguaaaauaaguaauuuguaaa

SEQ ID NO: 189591 - RNA, 65 nt, Homo sapiens
uaauacagcauuaccguauuugucaugaaaaucagguguacguuucugguggcucugccuugcca

SEQ ID NO: 189592 - RNA, 48 nt, Homo sapiens
auagaauggaaccuguccccuguuggcagaguuaccccaaaggaaugg

SEQ ID NO: 189593 - RNA, 67 nt, Homo sapiens
gaauuguuuaaaaaacagcucauaauugaugccaaauuaaagcacuguguacccauuaagauauggc

SEQ ID NO: 189594 - RNA, 38 nt, Homo sapiens
cagggcccacacuaccgccccacaccccgccucccgca

SEQ ID NO: 189595 - RNA, 44 nt, Homo sapiens
gaaagcgacauuuuggaaauacagcuggggagagaggucgguga

SEQ ID NO: 189596 - RNA, 42 nt, Homo sapiens
ugagguaauucugcacguuugcccgcgugcucucugugcucu

SEQ ID NO: 189597 - RNA, 53 nt, Homo sapiens
gggaccuugaaaggucauuuuacuuucccuucccccacgcuccuagaccgucg

SEQ ID NO: 189598 - RNA, 63 nt, Homo sapiens
cagccaaaugagaaacggcccacaucucacagguuccugcacaaaaggauauuuuuccaagag

SEQ ID NO: 189599 - RNA, 43 nt, Homo sapiens
uuuauccuuuuugucacgugugauauauuugugcauaccagga

SEQ ID NO: 189600 - RNA, 60 nt, Homo sapiens
agucuugggcuuuauuuccucucucucuagggaaacuggcuugaggaagcuagcuggggg

SEQ ID NO: 189601 - RNA, 46 nt, Homo sapiens
uucugcuuauuuuugugguaauuuccuuucuuucucucauagguug

SEQ ID NO: 189602 - RNA, 39 nt, Homo sapiens
ugugaguguaggagauaaggggagguaauccagagggca

SEQ ID NO: 189603 - RNA, 38 nt, Homo sapiens
guucuucagugagguagauuggaguucaggccuagugg

SEQ ID NO: 189604 - RNA, 28 nt, Homo sapiens
cacuuuuauggcauuuacugugugucag

SEQ ID NO: 189605 - RNA, 44 nt, Homo sapiens
cuucaauguuccuaugaagaacaaccagauaacaaacaaccaga

SEQ ID NO: 189606 - RNA, 58 nt, Homo sapiens
auggagccaagucgguaguccuuaugagccaccuaggccggccugauggugugcccau

SEQ ID NO: 189607 - RNA, 58 nt, Homo sapiens
gccugacaaguacuccuuagagccaguugcuguagaacucaaaucucugcugggcaag

SEQ ID NO: 189608 - RNA, 49 nt, Homo sapiens
gcugcugggucugucauccugcuggagaaccuccgcuuucauguggagg

SEQ ID NO: 189609 - RNA, 50 nt, Homo sapiens
gccagccaaaauagaagcuuuccgagcuucacuuuccaagcuaggggaug

SEQ ID NO: 189610 - RNA, 49 nt, Homo sapiens
gauaaggagcuggccucuaggacuaggaggaaugauagggauugacuag

SEQ ID NO: 189611 - RNA, 67 nt, Homo sapiens
agucaaucugccacagaaggcugguggguuuuugaugaagaaggagcugaacuacuuugcaaaggcc

SEQ ID NO: 189612 - RNA, 79 nt, Homo sapiens
guaguaggccauaacuugggugguuuauugucauauagcucagucacacuggguaacugaggagaauuuaauaaaggaa

SEQ ID NO: 189613 - RNA, 32 nt, Homo sapiens
ggguuggagaaacauagggcaaaguuaggcag

SEQ ID NO: 189614 - RNA, 54 nt, Homo sapiens
agcuaaaguugcagacaagauccagcucaucaauaauaugcuggacaaagucaa

SEQ ID NO: 189615 - RNA, 61 nt, Homo sapiens
gauuggcacuucucuguuugaugaagagggagccaagauugucaaagaccuaauguccaaa

SEQ ID NO: 189616 - RNA, 46 nt, Homo sapiens
ggcaagguaaucuucacaccauucuucucagcuuuggacauuaggu

SEQ ID NO: 189617 - RNA, 68 nt, Homo sapiens
gcugagaagaauggugugaagauuaccuugccuguugacuuugucacugcugacaaguuugaugagaa

SEQ ID NO: 189618 - RNA, 42 nt, Homo sapiens
cauuuuuaguuuuaucuguuuuuucuucaucuguuuaaugug

SEQ ID NO: 189619 - RNA, 72 nt, Homo sapiens
gaggcugucacucgggcuaagcagauuguguggaaugguccuguggggguauuugaaugggaagcuuuugcc

SEQ ID NO: 189620 - RNA, 46 nt, Homo sapiens
uggagacacugccacuugcugugccaaauggaacacggaggauaaa

SEQ ID NO: 189621 - RNA, 60 nt, Homo sapiens
agucaacuuagcauuuucugcaucuccacuuggcauuagcuaaaaccuuccaugucaaga

SEQ ID NO: 189622 - RNA, 100 nt, Homo sapiens
acugcacccuggauuugcauacauucuucaagaucccauuugaauuuuuuagugacuaaaccauugugcauucuagagugcauauauuuauauuuugccu

SEQ ID NO: 189623 - RNA, 56 nt, Homo sapiens
guuucacuacucagcauggaaacaagaugaaauuccauuuguagguagugagacaa

SEQ ID NO: 189624 - RNA, 1227 nt, Homo sapiens
gauuacugacaaaugagaagaaaaccuuaguaagugaaauuuauaaggagaaauaugauuauguguucacuaaaaucaauggccuuuuaaauucaguaggaagaaaaccagccaaucuuauauaugaacucuuuaguuucuuucuacauaaauuagaaaaaaaaaauacugggcucaucucucaggauuguuuuaagggccaaacaacagaaugcucuaaauaccuuauaaauaauuugugauguguuaaaaaaaauguuuuguauuauuaaaaauaaguuuaacacaaguuuuauuuugcuacuacaaaauagcuucuaaaauaacucugaaguucaaaaaaauuauauaaacauuucaagaauaaacugggaaauaaacucaggcaaguuuaaugggaaaaaaccugauagcgaauuuaagaauucuagucuuugucacuaagagaauuucagaguagucguuuccaaggaagaugaucaaauagcaugauuaagaccuggucauuucagauguaggagcaggucaggaguauguagucugcaggauggcuguuacauuccuuaaugauauggucaguggaagacucaaacccauuucuuaugugaaccugaacuuaaacaaguauggagaauauaccuguuggccuauugcuacaauaguggcagugguuguagcccuugaauuuauucauaaccuaaaaauaauaauagcgacagagcuuagaucugacugauauuuggggggaacuuggacuuagaaaacagacacuaaacaacauucccuuaggcuggguuugguggcucaugccuguaaucccagcacuuugggaggcugaggugggaggaucucuugaggccaagaguuugcgaccugccugugcaaaacaguuaagaccuugucgcuaccaaaaaaauuuaaaaacaaagaaauaaauaauuaaagugccucaucuguugaaucuaauuucauaaagaauaacucaaaauuagaccuuauuauaagggcaauguuaacugugauaugguuucuuaauaugauuuauaaagacagcacuauuauaaaccuauacaacugaggacugugcagagaucaugugguuaaaccuuaaaagacugauguuaggcaagaaaaaccaggaagcacuguggaggagaaggaaauaaggucacagucugcuuuccuaccuuucaaucaggucacacagauaauugaaagucugaacag

SEQ ID NO: 189625 - RNA, 44 nt, Homo sapiens
gucuuuaacaaaagcugcaucacaucugaugcauccugcaugaa

SEQ ID NO: 189626 - RNA, 2964 nt, Homo sapiens
ugcuaaacacauaaacagaauuauguacucaauauaucugaaacacaaaagaaauaguauacucuacagacauacuucuaaccauauuauuauuaaacuaagacugagaaagaauucaagcugucuuuaaauguggaauugaaauuagggguuaaaaacucugcagcuuagaaaagaaaaaagaguaaauguuuuuaucaugauccaccauaguuuagaaagucaugccugauucuuauuuuucuuuuuuuuuuuugagacagagucucgcucugucacccaggcuggagcgcaguggcacgaucucggcucacugcaagcuccgccucccagcuucaugcuauucuccuaccucagccucccgaguagcugggacuacaggugcccgccaccacgccuggcuaauuuuuuuguaguuuuaguagagacgggguuucaccauguuagccaggauugucuugaucuccugacuuugugaugcgcccgccugggccucccaaaaugcuaagauuacaggcgugagccacugugcccagccugaaucuuauuuuucaagaccacccccacccgcuacuggcuaaaaacuguucucagaaauagcuucugacacuuucaacacuccaguaaaagcaguauugaaagagccucauguauuucauuuccuagaaauacagucuucaaaccuaucaaugaacagaacauagaaaacugaaaagggugcagagaauguauaaucuuccccacugugaguuuauucacccuuaaaggggugcaaacugcacugccaaaaacuaugcauagcuaugugaaacucaauucuauugucuucucugaaagccaaaggaaugugggcauaaaagcauuuggacuuauccuggcuuagaacuggaggaucaguaguguauuucaugugcauuaucuuuacuauguaaagacaauacuauaaaaaugaaacuauaaauuaucuucagaacagguuuuuagacuuaaaaaaaucucacccugaaaauauauuuaugcuguuucacaaaugagaaaaucuuauucaucuaguuuagaaaacaaaguuucuuaaacuguauaaauuuaagugccauuugcagggcaaaugaaaggacagguagcagcacauuacaguaacugaaccaaaaaggaaauucgaccuagcccuggucuucucuucagccguuaucaggugauuuccagugaaagauuacuuucauauacuucaagacaguauuaaagccagaaaucagucauuuuuaacaaugggauuaagucucaaaaaugcauauauauucuaaagccaaaaaucuuuaauuuuuacuuuuauuaaccuaguaguuuauacugacuccaagucuuucaggagaauaauuucagcuuuuuauuuuuuuugagauggagucuugcucuguugcccaggcuguagcgcaaugacgugaucucagcucacugcaaccuccaccucccagguucaagagauucuccucgcuuagcuucccgaguagcuggcauuauaggugucugccaccaggcccggcuaauuuuuguauuuuuaauagagacgggguuucaacauguuggucaggcuggucucgaacuccugaccucaggugaucugccugccucugcccaccaaagugcugggauuacaggugugagccacugcacccagccaauuucagcuuuuuuaaagaaaaggugguaguauaaugcacugggaagaaugaaaacaaugguaauuaaccccaguccauuaacuggcuacauaaccucagacaaaucacucaaucuucaaucucccuuucugcaacuguaauauaauacaccucugggacugcuaauaaaguugauuaaaguaacagagcucagaggugcuauguuucacauacauguaaggggccaucauuacuacugcacagugaauacagauuuugguugacuuuuccuguauucaugggacuuccuaagcugaaauaaauaaguacaauaguaauacucuacccaguugacucucaucuuuucaccacuggaugcugccuauccuaaaguuaaacugcuuuuuacuaggaaaauaugauguguauugcagggaauuuuguugaaacaauuauucuaagggaagucucugccuguaaaagcauuuaucacaaaaaagcugcuuuauacacguuuuaaaagauauucaaacuaaaaacaaaaacaaaaacaacaaaaaacuuggaaauaauuuagaguacgacaguuaaaaacauagauacuuggccaggugcgguggcucacgccuguaaucccagcacuuugggaggccgaggcgggcggaucaugaugucaggagaucgagacuauccuggcuaacauggugaaaucccgucucuacuaaaaauacaaaaaauuagcuggacgugguggcaggugccuguagucccagcuacucgggaggcugaggcaggagaauggcgugaaccccggaggcggagcuugcggugagccgagaucgcgccacugcacuccagccugggcgacacagcgagacuccgucucaaaaccaaacaaaaaacauagcuacuuuauuugcuguuuucaugucauacuuuuuuuuaaaaaagaaaaacuuccuuguuuguuguuguagguaucuuucaguuccugauuauaaaauacaacuuuauguauuaacuauuaaaauauuuuuaugaacuuccaagaaacauaaauuuuauuaauauaaauuauacaugaaaacuaaagaaaauacuacuuauaacaugugacacagcaauaaauacaacagcaaggcaaagugccccauauuccaggcuuaaaaguuuaccuucagguuacagggugcaauagugaagagauggaccguggagcccuagggcuuucacugccacccuggacacaauguuugauuaccugucaaaaucaucaucuucuaguucaucugcauuugcccag

SEQ ID NO: 189627 - RNA, 42 nt, Homo sapiens
uucuuugaauuuauaggguuuagauuucugaaagcagcauga

SEQ ID NO: 189628 - RNA, 47 nt, Homo sapiens
caagauauuuacucaugcauuuacucuauugcuuaugcuuuaaaaaa

SEQ ID NO: 189629 - RNA, 68 nt, Homo sapiens
uuucaacaaacgugccauugauaaaugcuggaagauuagacacuuccccaacgaauuuauuguugaga

SEQ ID NO: 189630 - RNA, 98 nt, Homo sapiens
gaagaagaggagcuagaggaggaagaagaggaggaggaggaggaggacaugagucacuucucguugaggcuggagggaggccggcaagacucggagga

SEQ ID NO: 189631 - RNA, 39 nt, Homo sapiens
gcccuaaguacugagacaaggaggagugcacuucuguaa

SEQ ID NO: 189632 - RNA, 61 nt, Homo sapiens
agguuguuguguguuuuuauuuuuuggcuuguuuauuuacaccugagaggauguggaaugg

SEQ ID NO: 189633 - RNA, 64 nt, Homo sapiens
uaaaaauaauccuuugaauuaagcacuaugauuaucucuguuuuucagagaaggaaauacagua

SEQ ID NO: 189634 - RNA, 47 nt, Homo sapiens
uccaaaaaugagucaagacaaauaaaauuucaccuuucaaacaccag

SEQ ID NO: 189635 - RNA, 59 nt, Homo sapiens
ugaaaauuauucacuuacagagauugaauugacuuuuuuucauuucauaaugugguuga

SEQ ID NO: 189636 - RNA, 59 nt, Homo sapiens
aggaacagcaggaaacacguggauucauuaggaaagaucagaguagcaucuuguaauag

SEQ ID NO: 189637 - RNA, 43 nt, Homo sapiens
gcuucucacuggccaaucuccucuucaugggcaccagccacug

SEQ ID NO: 189638 - RNA, 54 nt, Homo sapiens
gcugucauucuugaugacgaccucuaauccguggugccgcaacugagcucgaag

SEQ ID NO: 189639 - RNA, 47 nt, Homo sapiens
cugagcccugcguuucucaucccgagucguccggggagcuucugacu

SEQ ID NO: 189640 - RNA, 43 nt, Homo sapiens
gcaauaggucagaccccugaauaauuuucuguuuugcuccccu

SEQ ID NO: 189641 - RNA, 56 nt, Homo sapiens
gcugaguucuccucuaaaagacuacaaucaaggugucagcaaggacugacuucuca

SEQ ID NO: 189642 - RNA, 45 nt, Homo sapiens
ggugcagaacucuggcagacacuacuauaaccaguuauucaaggu

SEQ ID NO: 189643 - RNA, 48 nt, Homo sapiens
cauaacacaaacuugaccugagggacauucuacgaaauacuuaaccag

SEQ ID NO: 189644 - RNA, 46 nt, Homo sapiens
gccaacaaaauaggauuugaagaaaaagauauugcagccaaugaag

SEQ ID NO: 189645 - RNA, 35 nt, Homo sapiens
guaucugcagcucuacauuaaaaaggagaaagaga

SEQ ID NO: 189646 - RNA, 48 nt, Homo sapiens
auguaaaauacauauuucuuuucuuuugaagaauuccaacaaaacuga

SEQ ID NO: 189647 - RNA, 42 nt, Homo sapiens
auucuugaccauugaauaucugaggugguagagccuuaaggg

SEQ ID NO: 189648 - RNA, 57 nt, Homo sapiens
augcccuaauagcucguuuuuuaugaucacacaauacuucguuuauuuucacccucu

SEQ ID NO: 189649 - RNA, 45 nt, Homo sapiens
agggcacuguaaauuggucuguugaugacauugucaaaggcacaa

SEQ ID NO: 189650 - RNA, 72 nt, Homo sapiens
ggaugccauuucgaacaucuuucaggcugcugagaaacuaggugaaacugagaaacuuaguauaaugauuga

SEQ ID NO: 189651 - RNA, 50 nt, Homo sapiens
aggcuuuguuaagcuuaauugagaagaauuucuugguagaggaagaggaa

SEQ ID NO: 189652 - RNA, 46 nt, Homo sapiens
guccaucacuacaguggcaauaauauugaacugggcgcagcaugag

SEQ ID NO: 189653 - RNA, 44 nt, Homo sapiens
cuccugguugggggccaucccacaccuaaggcagaaagauggug

SEQ ID NO: 189654 - RNA, 69 nt, Homo sapiens
ccaccaucuuucugccuuaggugugggauggcccccaaccaggagcugcugcuaagauggcccgggagc

SEQ ID NO: 189655 - RNA, 41 nt, Homo sapiens
agguggggcucccuaggccccuccccucuucaaggggucua

SEQ ID NO: 189656 - RNA, 75 nt, Homo sapiens
ugagagcagagauuaaccaaaaguugacagaaaccggaguaagagaacgccugaaagagcugcugagcuaaauua

SEQ ID NO: 189657 - RNA, 40 nt, Homo sapiens
ggggcucccuaggccccuccccucuucaaggggucuacau

SEQ ID NO: 189658 - RNA, 101 nt, Homo sapiens
uuuauguuuucaaagaacuaaacacaauacugagaaguccaacuuuuagccagaauacauaaauuccugaaaauguauagauuugaaaaauaaaaauaaaa

SEQ ID NO: 189659 - RNA, 48 nt, Homo sapiens
augugcuggcuuccaaccugaugcaauguguaauauugaaaaaaauga

SEQ ID NO: 189660 - RNA, 46 nt, Homo sapiens
uuaaauccuagaaaauguggaguccccaugacucugugcucaccaa

SEQ ID NO: 189661 - RNA, 44 nt, Homo sapiens
cguccuucacucaucaguaaaauguaauaauugccuugugccau

SEQ ID NO: 189662 - RNA, 45 nt, Homo sapiens
cgaaauccaaaugcucagcagacaaaagcuguacuugacuuagaa

SEQ ID NO: 189663 - RNA, 1815 nt, Homo sapiens
gacuuagguaaguacuuucagacagugauuaauauuaguuacaaauaacuguuaguagcuugaaccaguuggcacuuucuuuacuauuuuaacuugacucuuaacuuuuccuucuaaaaaguguuuauggcucaguaccuuugucuuucagaaccuagugaugcuuguuuggaaagacaaagauuucuaauugucgauaacuacccuuccccuguuguggcuaaacugaaaggaaagacauaacuguuuuuuguguguugcuaagccccaaagccccaaaaccagcauuaacagauuuagcaggaaacaucguauauccuuugaggaucuaauaugcauuaaguuuucauaucuuauauagcuuuauuuauuuauuuauguauuuauuuauuugagauggagucuugcucugucguccaugcuggagggcaguggcgcgaucuuggcucacugcaaccuccgccuccuggguucaagcgauucuccugucucagccucccaaguagcugagauuacaggucugcgccagcaugccccgcuaauuuuuguauuuuuaguagagaugggguuucgccauguuggccaggcuagucucaaacuucugaccucagguuauccucuugccucgaccucccaaagugcugggauuacaggcaugagcuaccacaccuggccuuacauagcuuuauauagugaaugaugugagguaccaugaccuuagcaaaaguuguauaggaaaguuuuaugugguuguuucugguggagauagauaaaaguugagaacauaaauuaaaacucagugauagccauuuugcaagauguaaugugguucaacuuuuuggcuaaagcaccgguuuauagacugaagauuugagagcuauuagugggauauaaaaucauuauaaaggugguagccagcauuuaaaaagacaaugaaauagagaagagauuaguaaauaucggagugcaugauacauaguaaguauuauuuugugaaauauuuguuucuuuuguauguguuuguauauuuuugcuggauagaauguguuucuuacugugaguuauagugagaaagcuucaagagccacuaaccuaguuggcaguacuauccacuugauuccucaaaaccaacuauuuaaacuccaggaaauuguauuuauauuucaauguugggaaaaaacaagaauugauacaucucuuuuuuuccaguacugagaaagaaauguaaagauuguggaaccuguaaagcauuuuucuguguucugaauuaccauauuaucuuuuuauuuugggggcacucauuacuuuauacaauuacuuauuuauauacuuuugauuuuaauauuacagaauguaguaucuuacccauauuuguauucuuacaacauuuaauucagugccuggcacuuaauagauacuuagaauuugaguguugacuauucggugauggaguugacaggacaguugagaaguaaaagaguuagugauuggaacaaaaauggggaacagaacuuacgaaaauaaggacaggauauaaaaagauuaaacuauguuagguauugaggggaaauuuccauacauuuguuuuaauaauuuuauuuuuguagaauacuucugugauuaucagauugguuaaaaucccaaauaagggauuuuaaaaacacuuuuacagaagcuauaaaacaguaacaaauuaaaauguucuguuucguucuucuuggaucaauuuauguagaaauuaaaaguuacauaauuauuuguuuuauucugauuaggcguuuacagucccuaauuaaaaauauuacacuuagaaga

SEQ ID NO: 189664 - RNA, 24 nt, Homo sapiens
uucuuggggaugggaaauugaaga

SEQ ID NO: 189665 - RNA, 44 nt, Homo sapiens
gaaaaagcagauucuaaagacuguauggaggcaaccccugaagu

SEQ ID NO: 189666 - RNA, 19 nt, Homo sapiens
cccuaaagaaaacccagag

SEQ ID NO: 189667 - RNA, 46 nt, Homo sapiens
uacuacacaacuguaaccaaccacuuuaugggguuuccccucucug

SEQ ID NO: 189668 - RNA, 44 nt, Homo sapiens
uuucccucuuguuugaaaguuucuaauuauuaaauggugucgga

SEQ ID NO: 189669 - RNA, 59 nt, Homo sapiens
cccauucauguuagaucguugaaacccuguaucccucugaaacacuggaagagcuagua

SEQ ID NO: 189670 - RNA, 46 nt, Homo sapiens
ugucaccgauuauagagauuggacagauacuaauuauuacucagaa

SEQ ID NO: 189671 - RNA, 45 nt, Homo sapiens
acaaaacugucaugcauggugcuaaucagggacccagugcucauc

SEQ ID NO: 189672 - RNA, 38 nt, Homo sapiens
uauguuauagaauuccuuuguuggaacuggccauggcc

SEQ ID NO: 189673 - RNA, 34 nt, Homo sapiens
acgacuuuaccucaaaguguuugaagguguaugu

SEQ ID NO: 189674 - RNA, 39 nt, Homo sapiens
guucuaggaauguuaaaguagaagguuuuuuccaauuga

SEQ ID NO: 189675 - RNA, 64 nt, Homo sapiens
ugagaggagcagagaggaaggagaaagaggaggagagagaaaaagggcacaaaauaccauaaaa

SEQ ID NO: 189676 - RNA, 50 nt, Homo sapiens
auguucccagcaacuucucagcccacagcagagggaugggaugguugacu

SEQ ID NO: 189677 - RNA, 46 nt, Homo sapiens
auggcauuucauugaaagcccgugagugaaugggugcuugcugaaa

SEQ ID NO: 189678 - RNA, 45 nt, Homo sapiens
gaaagucacuuuccuuugcccugguacuucaggccauauacaucu

SEQ ID NO: 189679 - RNA, 91 nt, Homo sapiens
ucuugacucucgcugugacuacagcuguuccaguggcuaccaccuggaaggugaucgcagccgaaucugcauggaagaugggagauggagu

SEQ ID NO: 189680 - RNA, 72 nt, Homo sapiens
gacauagauccccccaagauccgcuguccccacucacgugagaagauggcagagccagagaaauugacugcu

SEQ ID NO: 189681 - RNA, 45 nt, Homo sapiens
ugacagugagacgcugcccaacucugaaaccuccgcagcacggcu

SEQ ID NO: 189682 - RNA, 42 nt, Homo sapiens
agagacagcacuuagugccaugcggaaccugaaugggcgcga

SEQ ID NO: 189683 - RNA, 42 nt, Homo sapiens
aaauucaucaagccauuaguaguacuaacuguggcauuaguc

SEQ ID NO: 189684 - RNA, 46 nt, Homo sapiens
gccuuggcacuggugccccugucauugagucaccuuauggagagac

SEQ ID NO: 189685 - RNA, 30 nt, Homo sapiens
agaguuauacuuguauuuaaauuaucuuuc

SEQ ID NO: 189686 - RNA, 44 nt, Homo sapiens
uuuucuugucugcccuuuaucuucuaggaggaaugcaggcucag

SEQ ID NO: 189687 - RNA, 53 nt, Homo sapiens
uugugaguuagguggcagcaccucaguuuuacaggcaaagaguuggaagcuca

SEQ ID NO: 189688 - RNA, 44 nt, Homo sapiens
cguuaaacagcuaaaaccugauggauugagggcuggccccauga

SEQ ID NO: 189689 - RNA, 38 nt, Homo sapiens
cuuggcuuuuuaacuuauauauguaaaucucaaucucc

SEQ ID NO: 189690 - RNA, 46 nt, Homo sapiens
ugggcaucuguccgaggcuguacucccucccuacuggugucaggag

SEQ ID NO: 189691 - RNA, 47 nt, Homo sapiens
ggguucuugcagagccauggcaguguucacauaugccaagacucuac

SEQ ID NO: 189692 - RNA, 51 nt, Homo sapiens
auuggaaauuuuaguauacauacuugaacagggaaauuuauaguaguggaa

SEQ ID NO: 189693 - RNA, 25 nt, Homo sapiens
auauaaugaauauucguugauuccu

SEQ ID NO: 189694 - RNA, 46 nt, Homo sapiens
cuaauggcagaaccaagaggacccaugcuagaucagagggguccac

SEQ ID NO: 189695 - RNA, 52 nt, Homo sapiens
gucaguguuacacauaccugucuggaucccugggggacaaccgcccccaugu

SEQ ID NO: 189696 - RNA, 32 nt, Homo sapiens
uguuugugggccuugauuuuuauuguacucuc

SEQ ID NO: 189697 - RNA, 50 nt, Homo sapiens
acuuaaaauggccguuauugagugguuagaucacaauuacaguaccucag

SEQ ID NO: 189698 - RNA, 42 nt, Homo sapiens
ugcagaccagauugccauguugccuccugagcaaaggcagag

SEQ ID NO: 189699 - RNA, 46 nt, Homo sapiens
acaauaaaaugaagugauuuuguucugagagaaggugaugggaguc

SEQ ID NO: 189700 - RNA, 39 nt, Homo sapiens
ucuaagcaugugauauuuucuccuagaagacuccgaagu

SEQ ID NO: 189701 - RNA, 44 nt, Homo sapiens
agaaaauaucacaugcuuagagcuauaaaauggucagaaggcua

SEQ ID NO: 189702 - RNA, 64 nt, Homo sapiens
acauuucauccuaucuuccaggcagucccuaaccugcagcccuacccuguaacuacguuuauuc

SEQ ID NO: 189703 - RNA, 44 nt, Homo sapiens
gcauuaaggaggaacaugguuucucucuaucaggccaaccucaa

SEQ ID NO: 189704 - RNA, 52 nt, Homo sapiens
ucuugagguuggccugauagagagaaaccauguuccuccuuaaugccacuac

SEQ ID NO: 189705 - RNA, 62 nt, Homo sapiens
uggaacuacuuuugagccaauuuauauucuuggaauucuauccccuggguuaggauuauggu

SEQ ID NO: 189706 - RNA, 41 nt, Homo sapiens
cucuaagccuaugccaggcuuuuaauucaccugaccauaau

SEQ ID NO: 189707 - RNA, 105 nt, Homo sapiens
uuuguugauuaagguauuucauauuacaacuuugcaagaaaaacuugcucaaagcaggugaggagcuuucuguguauccugcucauccccaguucaacuuggaug

SEQ ID NO: 189708 - RNA, 52 nt, Homo sapiens
uuuggcagccaucauaucuugaagugagugugucaauauauuuagacaugga

SEQ ID NO: 189709 - RNA, 45 nt, Homo sapiens
cguuguaaguuucaagauuccaaaucaaggucauugaagaugaag

SEQ ID NO: 189710 - RNA, 39 nt, Homo sapiens
uuuuuuuuugucacuagucugagcacaauaaagguaggu

SEQ ID NO: 189711 - RNA, 61 nt, Homo sapiens
cuggauaagaccauaucaaaagugacaguaaacauguacacuguugguguuauauggggau

SEQ ID NO: 189712 - RNA, 68 nt, Homo sapiens
cuagccagugaacauaauucuuauuacuagacugccacaaggaagaaauuaacuuacccuguauauca

SEQ ID NO: 189713 - RNA, 44 nt, Homo sapiens
uaugaugauuugcuuaaauauccauauuaaguaagucucaaggu

SEQ ID NO: 189714 - RNA, 66 nt, Homo sapiens
ccagcauugacaaucaaacacuagauaaggauaccaaauuauucuuccccuacuucugcccuuucu

SEQ ID NO: 189715 - RNA, 49 nt, Homo sapiens
aaaaaucucucauuuguguggagucauuucugauuucaggggagauccu

SEQ ID NO: 189716 - RNA, 46 nt, Homo sapiens
uugcuuguauuuuuuaaugcuaaucuugugaaaauaauugacaggc

SEQ ID NO: 189717 - RNA, 51 nt, Homo sapiens
gacauccugucaucugagaaugaacaaagaccaauuuuuugugugugaagc

SEQ ID NO: 189718 - RNA, 49 nt, Homo sapiens
agcucuucauuucuugaacuaccuuccuuuuccaaagagguaaugcuga

SEQ ID NO: 189719 - RNA, 51 nt, Homo sapiens
ccuuucugacugaucucagcauuaccucuuuggaaaaggaagguaguucaa

SEQ ID NO: 189720 - RNA, 51 nt, Homo sapiens
uagaaucucaagucauauuuuuuuucuucuuugguagguuuuaggguaccu

SEQ ID NO: 189721 - RNA, 44 nt, Homo sapiens
aggggacuuuggcaaaaggguggaagguauuugcagcuugccaa

SEQ ID NO: 189722 - RNA, 44 nt, Homo sapiens
guaaucucuuccaacguacauacuuauuugcuuucuuguuggau

SEQ ID NO: 189723 - RNA, 65 nt, Homo sapiens
guccucuacaccaacaaagccgagguccggaaugacaguccccagagaagcggagucacccuucu

SEQ ID NO: 189724 - RNA, 41 nt, Homo sapiens
cucuaccucgaugaaaugcugcaacugcggguccacugcac

SEQ ID NO: 189725 - RNA, 46 nt, Homo sapiens; identical to SEQ ID NO: 153581

SEQ ID NO: 189726 - RNA, 56 nt, Homo sapiens
gaauggacuucaagguuaagaagucacauaaaucccacaggcacuguuuugcuuca

SEQ ID NO: 189727 - RNA, 45 nt, Homo sapiens
uguguacuccugugaguggccucuuuauauguggcccuuucaaaa

SEQ ID NO: 189728 - RNA, 64 nt, Homo sapiens
cuucccugggaguuuuggauacuacgacauugaugcccagaccuuugcugacuggggaguagau

SEQ ID NO: 189729 - RNA, 45 nt, Homo sapiens
gguaccuaaguguucauuuaaugaauuguaaugauuauuggaauu

SEQ ID NO: 189730 - RNA, 37 nt, Homo sapiens
uaauacucuuuucaauuucaucauauauuucucauuc

SEQ ID NO: 189731 - RNA, 40 nt, Homo sapiens
augcaugaucauugcaaaaaauguagauaaagaagagcaa

SEQ ID NO: 189732 - RNA, 45 nt, Homo sapiens
ggucgcugagaucucucccaccucgcccaugagcguggcaucagg

SEQ ID NO: 189733 - RNA, 41 nt, Homo sapiens
ccucugccgggugcuaaccguuagaacaucuagggugggua

SEQ ID NO: 189734 - RNA, 42 nt, Homo sapiens
gcugcacugggagcgcuucaugugcaaccuugacugccagga

SEQ ID NO: 189735 - RNA, 36 nt, Homo sapiens
ucaugaguagcaaauucaacaucugccucaccggua

SEQ ID NO: 189736 - RNA, 50 nt, Homo sapiens
caaggggucagugaaacuacagagaucuguaguucacgguacaguuggua

SEQ ID NO: 189737 - RNA, 48 nt, Homo sapiens
ugcuagggaccuguguuacuagcaagcagcuuugaggucaggguagga

SEQ ID NO: 189738 - RNA, 107 nt, Homo sapiens
ugucccgaaccaaaacuaggcugucccgaaccccugguaauagaauuguuuaucuuuauaccaagaaguuugggaaagcaccaaaaucugcauguggcaugugccca

SEQ ID NO: 189739 - RNA, 52 nt, Homo sapiens
guucgugacaggaucaagcaugcuuuccuuacugaggagcagaaaaucguug

SEQ ID NO: 189740 - RNA, 47 nt, Homo sapiens
ggugucuaagaccuucuucagagaagacuucuagaggauauauuuaa

SEQ ID NO: 189741 - RNA, 42 nt, Homo sapiens
acagacauccccguucucuggucugugcucggugccccagug

SEQ ID NO: 189742 - RNA, 42 nt, Homo sapiens
gggcccgaugccagcccgccgagcgcagggcagcggggagcu

SEQ ID NO: 189743 - RNA, 39 nt, Homo sapiens
uagaccaccgcccccucaagccccguaaccgcugccggg

SEQ ID NO: 189744 - RNA, 46 nt, Homo sapiens
uguaaugauccgaggcaguucccuccucuccucuugcuucucuugg

SEQ ID NO: 189745 - RNA, 57 nt, Homo sapiens
guaaauuuguaaauguaguagcaggugccagcccagaucaccaguccugcagucacc

SEQ ID NO: 189746 - RNA, 55 nt, Homo sapiens
caccacuuuggacucagauugagucucuggcucugccccaaccauugccuuggcc

SEQ ID NO: 189747 - RNA, 46 nt, Homo sapiens
gcuucuuucauggccacuucccuggcuuuggccuugaccucaguca

SEQ ID NO: 189748 - RNA, 46 nt, Homo sapiens
gggauuuccccuagcaucaacuguggcaccaggccuggccucagac

SEQ ID NO: 189749 - RNA, 45 nt, Homo sapiens
ucgugggaccuuuaacauccagggccuugaaucagggagggcgga

SEQ ID NO: 189750 - RNA, 90 nt, Homo sapiens
uuccauauccccccucgccccgccccgcuuccagugguuugaaaggggugugguuuugcugggaaaauggccgaccgcuggggcugcggg

SEQ ID NO: 189751 - RNA, 48 nt, Homo sapiens
cgcagccccagcggucggccauuuucccagcaaaaccacaccccuuuc

SEQ ID NO: 189752 - RNA, 49 nt, Homo sapiens
gguaggggaacacuaccaagcgacagggcuggugucagcggaguccaga

SEQ ID NO: 189753 - RNA, 57 nt, Homo sapiens
gauauugggacuccccgaagugcuuuucuguccgcugagccuucaguuucugccuug

SEQ ID NO: 189754 - RNA, 54 nt, Homo sapiens
caacuuugcguuucuuccugcuccaaggguuggacuggccuccggccccaagau

SEQ ID NO: 189755 - RNA, 61 nt, Homo sapiens
acacgggguggggggggggggcggcgguguccugguacauuugagauggaggaguuggcgg

SEQ ID NO: 189756 - RNA, 50 nt, Homo sapiens
cuggcuuggggaagagacgagaacgagaaaaucugggacgaagacgagga

SEQ ID NO: 189757 - RNA, 44 nt, Homo sapiens
ugagacugugaaaggagcuaaaacuaacgcuggggcagggucug

SEQ ID NO: 189758 - RNA, 46 nt, Homo sapiens
accaucucugggaacaggacccuugcaccgaguuuacccugcccag

SEQ ID NO: 189759 - RNA, 46 nt, Homo sapiens
ucuuuuguuuuuaucaguuuugcaauaauugggacaccacccaauu

SEQ ID NO: 189760 - RNA, 46 nt, Homo sapiens
gacuuacaaugcccuuaauaacuugagugugaacgcagaaaaucag

SEQ ID NO: 189761 - RNA, 48 nt, Homo sapiens
aaguaccaucagaauugauuucccucuuuaauaaagaaugggauagag

SEQ ID NO: 189762 - RNA, 46 nt, Homo sapiens
gaauucagcagaaguucacuuuuuuucuuauucaaagagucuggag

SEQ ID NO: 189763 - RNA, 45 nt, Homo sapiens
auuugcaguugguacgaugugauuuguaaauucuuuguuuuucau

SEQ ID NO: 189764 - RNA, 50 nt, Homo sapiens
auuuguacacagaaagaauuuauugauuugaucuuauuaccuagauugag

SEQ ID NO: 189765 - RNA, 42 nt, Homo sapiens
cuuugauaucagagggaaguggaugugcuaagguucagguuu

SEQ ID NO: 189766 - RNA, 47 nt, Homo sapiens
ugccaacauugccugcagacugcacaaccaagaaguuacucaaagcu

SEQ ID NO: 189767 - RNA, 44 nt, Homo sapiens
ccuguccaagcgggaccgcuuugcagagaccagaggcauaucgc

SEQ ID NO: 189768 - RNA, 37 nt, Homo sapiens
caucuguguguaucaucaauaaaguugugugcuuuga

SEQ ID NO: 189769 - RNA, 40 nt, Homo sapiens
gcaucuguguguaucaucaauaaaguugugugcuuugauu

SEQ ID NO: 189770 - RNA, 44 nt, Homo sapiens
uguccaagcgggaccgcuuugcagagaccagaggcauaucgcgg

SEQ ID NO: 189771 - RNA, 42 nt, Homo sapiens
uugauaucagagggaaguggaugugcuaagguucagguuuug

SEQ ID NO: 189772 - RNA, 47 nt, Homo sapiens
uuguuugccgagcccaaggaugcgggcuuuccauuuagccaggauau

SEQ ID NO: 189773 - RNA, 81 nt, Homo sapiens
gauuggacugaaccuggggccccagguggcacugaggacaggcccucagggggaggcaaggccaaccgagcacacccaaua

SEQ ID NO: 189774 - RNA, 46 nt, Homo sapiens
ccugauauuugguuugauuuugaaacuauggcucggcccuggacug

SEQ ID NO: 189775 - RNA, 73 nt, Homo sapiens
acagacuugagcaugggccgggcucgggaaguggguuggauggcggcaggacugaugauuggggcuggugccu

SEQ ID NO: 189776 - RNA, 45 nt, Homo sapiens
uucccuguggacccaggaagagaaaugggggcuccugaggucgau

SEQ ID NO: 189777 - RNA, 46 nt, Homo sapiens
ggggagcugguacucagacgggaacaacgaccaggacaagaaggac

SEQ ID NO: 189778 - RNA, 46 nt, Homo sapiens
ucuauaauucuuacguggaaucagaaauccuuauuaaugcccuuac

SEQ ID NO: 189779 - RNA, 45 nt, Homo sapiens
uuuuccguuugcuaucucagggagguggaaaaaucaagguugaga

SEQ ID NO: 189780 - RNA, 46 nt, Homo sapiens
ccguugccaugcagaagcgccccuuuccuuaugaaauugaugagau

SEQ ID NO: 189781 - RNA, 46 nt, Homo sapiens
guggaggcaaggguguaaccaggucccggaaugggggcaagggcaa

SEQ ID NO: 189782 - RNA, 41 nt, Homo sapiens
uagcaccaccucccggggugacagaggcccuuggggcugca

SEQ ID NO: 189783 - RNA, 46 nt, Homo sapiens
gacagggcccaggaugaagccucugcucuggacacaguuggagcug

SEQ ID NO: 189784 - RNA, 32 nt, Homo sapiens
ggcacccucccaucccccagccgacccucugu

SEQ ID NO: 189785 - RNA, 39 nt, Homo sapiens
aaaauaaugccuacugauuucucuggaggcuaauuagga

SEQ ID NO: 189786 - RNA, 2946 nt, Homo sapiens
gguucagagccuauauuaaaaugaaaauuaauuagauaacucaucagaaauaccaucuuaucacuucaaauuaaaaguauuaguaagcaaauaguuugacauguuaaugaauucaacuugaggagcuugcugaaaucuuaaugcauacaaaugauagcaaagagagagauacaaaaaaggggcaaacuuuucucagagagaagaaugacaauucccugaaggaguucauuccuucugcuaacucaacuguauuacuuagugccuucauaacuuaaugcaagguuuuugaucuauaagaucuccaaaaagugaggccuuuggaggaacagaugaauuaaaucccuagaagggaaguauucuuuuaaaucacuuuucccuauaaaauuucuaagacccuccagcucagcauggauccuaaauggugccaggaaaacagacaagagccaaucccuguuccaucacacugcuaauacagguuacugcugauuaauuaugucaugaaaauuuauaagaaaucuucuccaagauuucuuuacaaaagcuuuaagaaaucacuaaagaaaugaagccuuuuaaagaucuuuuuucccuuuaauuaagaaaauacaugcauuguugucucaucaaggcaaaauucuagaggucagacaauucuuuuaagcuacucuuucaacauauuacaaauaaguuccauuuagaaaauuaaaaguaugaaauggaaauaaaaaaaauuuguggccacuacuaaaucccaaggaauuugcucuuauuaaguuagcaucuauucgcuuuuaaggccaauuacucaguauaugaugacuacauuaacuaaaaagaaauguagagcaguuauuucuuccuuuuuuuuuuggagauagagucuugcucugucaaccaggguggaguacaauggcacaaucucagcucacugcaaccuccaccucccagguucaugcgauucuccugccucagccucccaaguagcuaggauuacaggcgcgcaccacuacgccuggcuaauuuuuuguauuuuuagcagagaugggguuucaccauguuggccaggcuggucuggaacuccugaccucaggugguccaccugccucagccucccaaagugcugggauuacaggugugagccacugugcccggccugaacuaguuuuuuaaaucacaaauuauaauucauaauaaguuuuauaauuaaaagcuauuaaaccauuauaucaaaaccuauuaaaacuauuaguuuaugauugaaaguuauuagcaugguggugggugccuguaaucccagcuacuuggggggcugaggcaggggaaucacuugaacccaggauguggagguugcagugagccgagaucauacuacuguacuccagccuggacaacaagaguaaaacuccguguuaaaaauaaauaaauaaaaacaacaacaacaacaaaaaaccaguucaaguacucagauacucagauuaaugaaucccaugcaacccuaaaacaaaggcaaauuguucucaauagguaaggauauuaauuaauuguagcuauauggcuuaauguagacuaccaaaaacaccuugcaccauguucuuuuuuuuuuuuuuuuuaaagaaagguaucugguacuaagauggauuuuaaaauaaucucagaagguuugaaaauuauuaacaaucuuuacagcuuuugauuauauauagucauaaugagaauuauaaucacaggucucaaauuuuguugauucaaguaggucaccaugcagcucucuaauugcagcuguggagagagaauauuuuagcuuaaagaguaaacaacggccgggcgcgguggcuuaugccuguaauccuagcacuuugggaggacgaggcaugcggaugaccugagguuaggaguucgagaccagccuagccaacauggugaaaccgucucuacuaaaaauacaaaaauuagcugggaaugguggcaggcgccuguaaucccagcuacucaggaggcugaggcaggagaacugcuugaaucuaggaggcaaagcuugcagugagcugagauugacggcgcuacuguacuccagcccgggcuacaagcacgagacucugucuuaaaaaaaaaaaaaaaaguaaaaaaaaaaaggaaacagcugagugguggcaauacuaccggcuacccacuccauuuccuaguugauaguucagcaauaucuuucugaucuuacuauuguuaauuaauaucauugacagugucucagccaaguuaucagaucuaucuagguugucuuuguguuuuuuuaauccuucagugugacacagcagcucagaagaggaauacaaguaugagcuccaccauuuuccuacuguuuacauaugcauggauuauuagcauuaucuucaaucugugauuucuuugcagaaaucuuuuuaagccacuuuuccauuuugaaaggauuggcuaaaauuuuauaauauaauccacuuauguauugcauauacugcaauauuuuacaacaugcugaaagcaaaugaauaaauacuagguagcauggugaacuucuugaccuacagaauuccuccuuuccuccagaauaucugcauauuguagaaggcaugugcccaucuaucugacuuaagggcugaauaugaacauuaacgucuguucauauagcaagucuccauucuggagaccccaaugcuagagagcuaaauagaacaaacagaaaacaaacaaacaaacaacaacaacaacaaaaaggcucccaaaagaucaaauguuuucauaacacagcuaccuccacuggcuugugauguuuugcuagguaacucaggucagauauuuuaaauauauaaaaauguguauucuuucguaaagaguaagacuuuaaauagcuauuaaaauacuucuaauuagauauacuuacauuauuuuuuguugaauauucugcugauaaau

SEQ ID NO: 189787 - RNA, 42 nt, Homo sapiens
cugucuuggaacgucguaccaaaugcuggaauucuaccucuu

SEQ ID NO: 189788 - RNA, 46 nt, Homo sapiens
agauacguguccugauccugucacaagagguagaauuccagcauuu

SEQ ID NO: 189789 - RNA, 57 nt, Homo sapiens
ugaaguauucccuguauuuccauuauucuuuauggaauauaaaguaagcaugaaagg

SEQ ID NO: 189790 - RNA, 48 nt, Homo sapiens
uagcguugccauugaaaguuaaaauguuugcaugguuuacccucugag

SEQ ID NO: 189791 - RNA, 42 nt, Homo sapiens
uugcauucacgcaaauucacauuggaugugauuuaaaaguag

SEQ ID NO: 189792 - RNA, 123 nt, Homo sapiens
uguuagaagucugguuuauaaaaaagccaaaagugauggaauuuauuccauuugucuuaggaaggcccauaauacuuguuuuucuuacaugugacuagcaacuuucuccacuuaaagacuaaa

SEQ ID NO: 189793 - RNA, 49 nt, Homo sapiens
gggccggaugccagcccgccgagcgcagggcagcggggagcugguagcg

SEQ ID NO: 189794 - RNA, 41 nt, Homo sapiens
uuaccucuggaucucuuagccagaggaauaaacuggcaauu

SEQ ID NO: 189795 - RNA, 50 nt, Homo sapiens
uauguacuuuuuaaugaacacgugucucacacacaaaaagaauuaaggau

SEQ ID NO: 189796 - RNA, 55 nt, Homo sapiens
cuuuuaaucaucugaugaaauuuuguuuuagguaauuuccuugguaccagcaucu

SEQ ID NO: 189797 - RNA, 128 nt, Homo sapiens
gaagaaggcguaagccaggaagcagaaggaaaccccagaggagggccgaaucagccuggccagggauuuaaagaggacacacccguuaggcauuuggacccugaagaaaugauaagaggaguagauga

SEQ ID NO: 189798 - RNA, 142 nt, Homo sapiens
uucaaaaaggaaauaaaaaauacucaauaugcaaaagucuugugaagaaaaugagggaaaaccacagaacaugccaaaggccgaggaagaucgcccuuuggaggauguaccacaggaggcagaaggaaauccucaaccuucc

SEQ ID NO: 189799 - RNA, 43 nt, Homo sapiens
agcagggccugcugggaagauggugggcaggagcaggaggaga

SEQ ID NO: 189800 - RNA, 78 nt, Homo sapiens
aggccggugccgagccugcagcggaaaugaggcgggggaggaggaggcuuaagagacgcugaagggggaggggaggcc

SEQ ID NO: 189801 - RNA, 46 nt, Homo sapiens
caccggccucuggcacuuaauccggauggggaggggcugcugcgac

SEQ ID NO: 189802 - RNA, 47 nt, Homo sapiens
gauuuuccucucucuucccucaccucgauuugugucgcgcccaaaaa

SEQ ID NO: 189803 - RNA, 42 nt, Homo sapiens
gauauuugguuuuuugggcgcgacacaaaucgaggugaggga

SEQ ID NO: 189804 - RNA, 60 nt, Homo sapiens
aaaaacggugggcacggaggagggcgggguugccauaaaaggagggcgaggaugaggaca

SEQ ID NO: 189805 - RNA, 38 nt, Homo sapiens
ggauggcggguggagagagagaaggguagcuaauuaag

SEQ ID NO: 189806 - RNA, 38 nt, Homo sapiens
uuggaggaggggaggugggaguauugggagcagaagaa

SEQ ID NO: 189807 - RNA, 53 nt, Homo sapiens
gaaaaagaucagacauccaacacuugauaacuugaguucugccagaaauagaa

SEQ ID NO: 189808 - RNA, 62 nt, Homo sapiens
ucagggaccaccgccugcgcugcugaaggaagcugguauccagacgggaacaaggaccagau

SEQ ID NO: 189809 - RNA, 42 nt, Homo sapiens
ccuucagcagcgcaggcgguggucccugaggcccguggaagg

SEQ ID NO: 189810 - RNA, 46 nt, Homo sapiens
acuaggggaaacaaaaggugggaaacuuuccauauccgaaacccua

SEQ ID NO: 189811 - RNA, 48 nt, Homo sapiens
guuucuuccuccuccuuuucuagcuuugggucuugcuggaaacaacag

SEQ ID NO: 189812 - RNA, 45 nt, Homo sapiens
gcaagacccaaagcuagaaaaggaggaggaagaaacugacccgau

SEQ ID NO: 189813 - RNA, 21 nt, Homo sapiens
aagauauuuuauaacagcucu

SEQ ID NO: 189814 - RNA, 58 nt, Homo sapiens
agauacaagaugaaauccugucaaaaaauggaaggaaaaccagaaaaugagagugaac

SEQ ID NO: 189815 - RNA, 46 nt, Homo sapiens
gcuuaaaugccuguuguguauaucuucuuuaaacuccuggagagau

SEQ ID NO: 189816 - RNA, 51 nt, Homo sapiens
aaagaagauauacacaacaggcauuuaagcaaugaagauauguuuagagaa

SEQ ID NO: 189817 - RNA, 44 nt, Homo sapiens
ugauauuccuuuguccauauuucuacuuauaaccuguugcuauu

SEQ ID NO: 189818 - RNA, 27 nt, Homo sapiens
gguucuugguaagauauaaaauggaaa

SEQ ID NO: 189819 - RNA, 33 nt, Homo sapiens
ugguggacaggcaaaaaaaagaccgggacgaga

SEQ ID NO: 189820 - RNA, 47 nt, Homo sapiens
uaacugugcuugaagaagaaaauucccaacauggacaaaccacgcaa

SEQ ID NO: 189821 - RNA, 82 nt, Homo sapiens
ggcucguucucgcccgcaauuuagaggggacauacauggcagaaauuuaagcaaugaggagaugauacaggcagcagaugag

SEQ ID NO: 189822 - RNA, 71 nt, Homo sapiens
gugcuucgcugguacugccaccaucuccguuuccaggagucuucugcuuguucuuucuggucuuccucacg

SEQ ID NO: 189823 - RNA, 80 nt, Homo sapiens
gauccugaagggggguucucugcagagcgaccaccccaucuuccugggagagcugguucaagauuuuucugcuguggacc

SEQ ID NO: 189824 - RNA, 45 nt, Homo sapiens
ucucuucuucugcagauugcuguccacgagguugagaacccugcu

SEQ ID NO: 189825 - RNA, 81 nt, Homo sapiens
cggaaaaaaaaggcgcaguggggguucugcuguguuugcaagugagggucgugagugcaacgggcgcaaggcauuaaggcc

SEQ ID NO: 189826 - RNA, 74 nt, Homo sapiens
gugcugggguugcugugugagcggcccucguggcucgggaggugcuguguuugcgcaggcgugcgccccuggcg

SEQ ID NO: 189827 - RNA, 66 nt, Homo sapiens
gugcgugauggugggggcggugcagggagggguuugcuacugcgcgcagguuguuaucuauuucug

SEQ ID NO: 189828 - RNA, 59 nt, Homo sapiens
uguuauauuugaaaauguucuaaugaaaaggaaaauaaauaauuaaggaaaggcgacaa

SEQ ID NO: 189829 - RNA, 33 nt, Homo sapiens
uguuuuugcacccuauuuucuguagugguauug

SEQ ID NO: 189830 - RNA, 33 nt, Homo sapiens
uuagagcagugguucccaagguguguuuccugg

SEQ ID NO: 189831 - RNA, 44 nt, Homo sapiens
acagaacauuuccaccaccacagaaaguucuacuggacagugcu

SEQ ID NO: 189832 - RNA, 82 nt, Homo sapiens
aaaacuaugugguuuuguucguucuuuguuguguuuucacuguguaacuaagcaaaugacgggguuuguacacugcugggag

SEQ ID NO: 189833 - RNA, 27 nt, Homo sapiens
agggggugagaaucagugaccagaggg

SEQ ID NO: 189834 - RNA, 46 nt, Homo sapiens
cacacuaucauucuacauguaccuacugaguguugcuagguaccag

SEQ ID NO: 189835 - RNA, 46 nt, Homo sapiens
cccacauagcuuugggacugguaguugaaguucugagugggagauc

SEQ ID NO: 189836 - RNA, 47 nt, Homo sapiens
agauaggcucuaagcuacccauguaaaaugcaaaacaucauuuagag

SEQ ID NO: 189837 - RNA, 42 nt, Homo sapiens
caggaaguagggacagaaagauaaaguugagagagaaagaga

SEQ ID NO: 189838 - RNA, 48 nt, Homo sapiens
gccuauuaaaauagaacuuuuuuuccccuggcuaucuauaggggagaa

SEQ ID NO: 189839 - RNA, 52 nt, Homo sapiens
cucuaaugcacccaaugaagaucaagaagaagaaauccaacagucagaacag

SEQ ID NO: 189840 - RNA, 48 nt, Homo sapiens
uacuuaguuuugagcugcugagcuuaccacauagcgcaccccagcaag

SEQ ID NO: 189841 - RNA, 39 nt, Homo sapiens
aaagcauguuugcuggaccaccugcaccacaauccucag

SEQ ID NO: 189842 - RNA, 44 nt, Homo sapiens
uugggcagagaagaugucgcucaaaucgccccccaaaacagcac

SEQ ID NO: 189843 - RNA, 61 nt, Homo sapiens
aaugagugaugucuugcgggaaaugauguggcuacuacaaaguuuugcccgucuagccuag

SEQ ID NO: 189844 - RNA, 41 nt, Homo sapiens
cugcuucaacaguuccccauugcucucaggcugcagcccaa

SEQ ID NO: 189845 - RNA, 23 nt, Homo sapiens
cucagucugaggagcagcagguc

SEQ ID NO: 189846 - RNA, 46 nt, Homo sapiens
cagagaaacacccaggaggaaacuggaagugagggccagggagcuc

SEQ ID NO: 189847 - RNA, 54 nt, Homo sapiens
uauuugucuagggaagcagggacaggaauuguggggacagagaaaaaaaagaga

SEQ ID NO: 189848 - RNA, 77 nt, Homo sapiens
ccagacuaggauggucaggcucuccagagggcccuuuuacuagcuugcagauggccaccaucuuauuguuuccucac

SEQ ID NO: 189849 - RNA, 41 nt, Homo sapiens
cuuagucucaauggcacuuuccuaucaccagaggcauagag

SEQ ID NO: 189850 - RNA, 43 nt, Homo sapiens
ggaaagugugcagauaguaucaggcacaggaggacauacagag

SEQ ID NO: 189851 - RNA, 28 nt, Homo sapiens
ggucaaggaaucuggcuccagccucagu

SEQ ID NO: 189852 - RNA, 44 nt, Homo sapiens
caaaguagcuugcaugaaauguuuguugcaauauuguaauacag

SEQ ID NO: 189853 - RNA, 57 nt, Homo sapiens
uaacaguauuccagucaaugaaauucuuugcaccugaagcacaucccuuacccugaa

SEQ ID NO: 189854 - RNA, 68 nt, Homo sapiens
uacuugcucagcaaaugcaaguuuccauuuuccugcuucacccuucuucuuccuugagagggaagugg

SEQ ID NO: 189855 - RNA, 36 nt, Homo sapiens
cugagcuuuaaaucucuuuuuuuuuuauuuggugug

SEQ ID NO: 189856 - RNA, 43 nt, Homo sapiens
gugcccuugagggaagguucugaguacaaucucggacagccca

SEQ ID NO: 189857 - RNA, 68 nt, Homo sapiens
cucuguuuuccccucgaugucuggcaaagugcuagauacaggauaagaagagaaaagaaaagacaaag

SEQ ID NO: 189858 - RNA, 46 nt, Homo sapiens; identical to SEQ ID NO: 123091

SEQ ID NO: 189859 - RNA, 45 nt, Homo sapiens
gccagccggcuacaauuggagucagagucccaaagacauggguaa

SEQ ID NO: 189860 - RNA, 49 nt, Homo sapiens
ucuggaaaauggggacagcaauaacuacuuugucuacuuucaggguugu

SEQ ID NO: 189861 - RNA, 44 nt, Homo sapiens
uugaauauuacuuccucaggggaugaaaucccugaggaaaggca

SEQ ID NO: 189862 - RNA, 67 nt, Homo sapiens
cuggugagaagggcuuaaaguuggaguaucaacuaucacagauugauuagacuuguuuugggaguuu

SEQ ID NO: 189863 - RNA, 43 nt, Homo sapiens
ucuuuuccuguuuuuguuaacuuuggguuaaaaaaaaaaaaag

SEQ ID NO: 189864 - RNA, 43 nt, Homo sapiens
guaaacccauguguuuguagagauuuuaggcgucuucggauau

SEQ ID NO: 189865 - RNA, 64 nt, Homo sapiens
accugaugaugagauaaagacaaugaacaaguuuagaucuugggugcacguagggcucacagac

SEQ ID NO: 189866 - RNA, 43 nt, Homo sapiens
guaaaccuguguguuuguagagauuucagacaucuucugauuu

SEQ ID NO: 189867 - RNA, 50 nt, Homo sapiens
agauaaagugagaacaaauuuagaucuuaguaugcuuaaagcucucagau

SEQ ID NO: 189868 - RNA, 37 nt, Homo sapiens
guugggggcuucuguagauuuagcagccuggguaucu

SEQ ID NO: 189869 - RNA, 46 nt, Homo sapiens
caaaccaucucaacagcagucucaaugugauaauagugcugaggga

SEQ ID NO: 189870 - RNA, 43 nt, Homo sapiens
cagccgugugaaggagguaguagugugcccauuuaacaggaaa

SEQ ID NO: 189871 - RNA, 45 nt, Homo sapiens
gaauucaaguucggauucggcuuugaugaccugccagggagaaag

SEQ ID NO: 189872 - RNA, 48 nt, Homo sapiens
augucaucuuuuaucacccucuaaucugaggucaagagaucgggcagg

SEQ ID NO: 189873 - RNA, 34 nt, Homo sapiens
gacagagacuugggagugugcauaugcugauggg

SEQ ID NO: 189874 - RNA, 74 nt, Homo sapiens
gagaagagaacugauagcaaaacccaguagauaaggggagagccuaagaaauaagucacuuuaggagacugaag

SEQ ID NO: 189875 - RNA, 104 nt, Homo sapiens
ggagagaagucugggauggcgauauauauugaggaaucaccaguagauaagugauagaugaggcuauagguguaguugauauaacuagguagcauauacagagu

SEQ ID NO: 189876 - RNA, 51 nt, Homo sapiens
cgggugguaaauacaggagagaaaacacaaggaagagagcacguguaagga

SEQ ID NO: 189877 - RNA, 48 nt, Homo sapiens
agaggaauagauaaauugacaagcuuuuuagcaaguugaauggucggg

SEQ ID NO: 189878 - RNA, 74 nt, Homo sapiens
cgcaccccggcaagcagcagcgggccgcgacgcccagccugccagugagcugcgacgggcacaccccggagcgu

SEQ ID NO: 189879 - RNA, 32 nt, Homo sapiens
gcaaauccaagacuauuccuuugaagccaaug

SEQ ID NO: 189880 - RNA, 43 nt, Homo sapiens
uaaaaacuuauuauagaaaacugagggcauauaaaaaacuaua

SEQ ID NO: 189881 - RNA, 39 nt, Homo sapiens
gauuacaaaucugagaaacacauugacuuugcccaaagg

SEQ ID NO: 189882 - RNA, 46 nt, Homo sapiens
agugauggaguuucucacaaaggggugaugggccaaggaggucaug

SEQ ID NO: 189883 - RNA, 47 nt, Homo sapiens
uuauccaguccuggagauucucugacauguuuuaagguuaagaauug

SEQ ID NO: 189884 - RNA, 48 nt, Homo sapiens
aacuguuauuaccauaaauacaugauuuuugguucugucaucagaaau

SEQ ID NO: 189885 - RNA, 42 nt, Homo sapiens
guccaguguuggaaacucugcuucaaacuccagugccaacau

SEQ ID NO: 189886 - RNA, 43 nt, Homo sapiens
cuuaauguuacaauuucuuaguuuacuuuuccuaaagggccau

SEQ ID NO: 189887 - RNA, 88 nt, Homo sapiens
auuuuaagucuccccuuugaaaauaagccuuguuaacugagggcguaauacauuucccacagauuuauccagaaacauuuuauuagag

SEQ ID NO: 189888 - RNA, 52 nt, Homo sapiens
uaacaaaaugacauauauaauauuuuucuauaguuuugcaacugaauuaaag

SEQ ID NO: 189889 - RNA, 67 nt, Homo sapiens
gucauuggcaaaacuuauuuuuuuuucuggacagaucagauuucuagagagagcagauuucuagaga

SEQ ID NO: 189890 - RNA, 42 nt, Homo sapiens
uagaauuuuauagaagaaaugucugagcaguucuauguaugg

SEQ ID NO: 189891 - RNA, 48 nt, Homo sapiens
aaauuccuuuaguguuauuaaauauuuucauuuauuagucaaagguaa

SEQ ID NO: 189892 - RNA, 53 nt, Homo sapiens
aauucuggacuaguuaucuuaguauuauauuauccaaauuuuaucuguaaugu

SEQ ID NO: 189893 - RNA, 65 nt, Homo sapiens
cuuauugagacugaggucuguguggaccauccuggugguuauauccaaaagaaagcuggauaaau

SEQ ID NO: 189894 - RNA, 53 nt, Homo sapiens
ucuauagacagugaugugauaaacugagauguggaaugaagaugagggagcaa

SEQ ID NO: 189895 - RNA, 38 nt, Homo sapiens
agaggacucugaugaugauauggagauuggauagagug

SEQ ID NO: 189896 - RNA, 46 nt, Homo sapiens
ucaagugaauagcgaaccauuuucacagauuaccucaggcugcuua

SEQ ID NO: 189897 - RNA, 17 nt, Homo sapiens
aaaguacuagaaaacaa

SEQ ID NO: 189898 - RNA, 64 nt, Homo sapiens
acaacccucacaacaggagaccuuccagaggcaccacccagaaaaggguauggaagagggcaag

SEQ ID NO: 189899 - RNA, 50 nt, Homo sapiens
ggaugagucuuccucgcugcuauguuucuggcugacucgcuaugggaaga

SEQ ID NO: 189900 - RNA, 48 nt, Homo sapiens
cucuucucuucccauagcgagucagccagaaacauagcagcgaggaag

SEQ ID NO: 189901 - RNA, 45 nt, Homo sapiens
cagcuuccagaauagaugucucugugaagccagcccugagccuca

SEQ ID NO: 189902 - RNA, 42 nt, Homo sapiens
guuucaaaacucauuugacccacauaaaaaaugcugugaggu

SEQ ID NO: 189903 - RNA, 44 nt, Homo sapiens
agagagacaagagauuggcaaccaaucaaagcaguggguaaaau

SEQ ID NO: 189904 - RNA, 56 nt, Homo sapiens
uauggugacuggaggugccaaccugggaagaauuggugugaucaccaacagagaga

SEQ ID NO: 189905 - RNA, 63 nt, Homo sapiens
cacuuugcuguacaucguauuacaccugaggaggccaaguacaaguugugaaaagugagaaaa

SEQ ID NO: 189906 - RNA, 75 nt, Homo sapiens
ccugcuggauucauggaugucaucagcauugacaagaugggagagaauuucugucugaucugugacaccaagggu

SEQ ID NO: 189907 - RNA, 49 nt, Homo sapiens
augcccugacaggagaggaaguaaagaagauuugcaugcagcgguucau

SEQ ID NO: 189908 - RNA, 41 nt, Homo sapiens
auaugccaguaucacucugaaaggcugggugcucaggcaga

SEQ ID NO: 189909 - RNA, 2332 nt, Homo sapiens
aagggaaggucuuaugaagaaguggaacuuuguugcuguuugcagaugacaugauuguauaucuagaaaaccccaucgucucagcccaaaaucuccucaagcugauaagcaacuucagcaaagucucaggauacaaaaucaauguacaaaaaucacaagcauucuuauacaccaauaacagacaaacagagagccaaaucaugagugaacucccauuuacaauugcuucaaagagaauaaaauaccuaggaauccaacuuacaagggaugugaaggaccucuucaaggagaacuacaaaccacugcucaaggaaauaaaagaggauacaaacaaauagaagaacauuccaugcucauagguaggaagaaucaauaucaugaaaauggccauacugcccaagguaauuuauagauucaaugccauccccaucaagcuaccaaugacuuucuucacagaauuggaaaaaacuacuuuaaaguucauauggaaccaaaaaagagcccgcaucgccaagucaauccuaaggcaaaagaacaaagcuggaggcaucaugcuaccugacuucaaacuauacuaccaggcuacagggcuacaguaacaaaaacagcaugguacugguaccaaaacagagauauagaucaauggaacagaacagagcccucagaaauaaugccgcauaucuacaacuaucugaucuuugacaaaccugacaaaaacaagcaauggggaaaggauucccuauuuaauaaauggugcugggaaaacuggcuagccauauguagaaagcugaaacuggaucccuuccuuacaccuuauacaaaaauuaauucaagauggauuacagacuuacauguuagaccuaaaaccauaaaaacccuagaagaaaaccuaggcaauaccauucaggacauaggcaugugcaagcacuucaugucuaaaacaccaaaagcaauggcaacaaaagccaaaauugacaaaugggaucuaauuaaacuaaagagcuucugcacagcaaaagaaacuaccaucagagugaacaggcaaccuacagaaugggagaaaauuuuugcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaaaaaaugcucaucaucacuggccaucagagaaaugcaaaucaaaaccacaaugagauaccaucucacaccaguuagaauggcgaucauuaaaaagucaggaaacaacagguacuggagaggauguggagaaauaggaacacuuuuacacuguuggugggacuguaaacuaguucaaccauuguggaagucaguguggggauuccucagggaucuagaacuagaaauaccauuugacccagccaucccauuacuggguauauacccaaaggauuauaaaucaugcugcuauaaagacacaugcacacauauguuuauagcggcacuauucacaauagcaaagaguuggaaccaccccaaauguccaacaacgauagacuggauuaagaaaauguggcacauguacaccauggaauacuaugcagccauaaaaaaugaugaguucauguccuuuguagggacauggaugaaacuggaaaccaucauucucagcaaaauaucgcaaggacaaaaaaugaaacaucgcauguucucacucauaggugggaauugagcaaugagaacacauggacacaggaaggggaacaucacacacuggggacuguuguggggugggggaggggagagggauagcauuaggagauauaccuaauguuaaaugaugaguuaaugggugcagcacaccaacauggcacauguauacauauguaacaaaccugcacguugugcacauguacccuaaaacuuaaaguauaauaauaacaaaaaaagaaguggaacuuguuuuuuguuuuugagauggagucuugaucugucauccaggcuggaaugcaauggcacaaucuuggcucacuacaaccuccgccuccugauuucaaacaauuauucugccucggccucccaaguagcugggauuacagguguucaccaccacgccuggcuaauuuuuguauuuuuagucgagacgagguuuugccauguuggccaggcuggucuugaacuccugaccucaggugauccaccugccucggccuccgaaagugcugggauuacaggcaugagccaccgcacccggucaagaaguggaguuugaagaugguugagcauu

SEQ ID NO: 189910 - RNA, 18 nt, Homo sapiens
uggaaugggcccuggcug

SEQ ID NO: 189911 - RNA, 46 nt, Homo sapiens
gcuguccauugaagucuguguguuggcaugagaugaaucaggagaa

SEQ ID NO: 189912 - RNA, 45 nt, Homo sapiens
aggaaggcuugcugaagcccccaggaagcagagcagggcagggaa

SEQ ID NO: 189913 - RNA, 26 nt, Homo sapiens
ggaggaugaagaagagaaguaggagg

SEQ ID NO: 189914 - RNA, 44 nt, Homo sapiens
aaggccugucuauucagcccucugucccugacaucucugugguu

SEQ ID NO: 189915 - RNA, 76 nt, Homo sapiens
uaguguuaaaucccacuguggaaagauugaaaaauaucucccagccuuaccagagguuacgaucuaguguggaggc

SEQ ID NO: 189916 - RNA, 66 nt, Homo sapiens
auggaugggagucugcuggaaggaaaaauucagagcauugaagguucugccugugugaguguuugu

SEQ ID NO: 189917 - RNA, 50 nt, Homo sapiens
ugauauguacaacugagugguacagauaugacauggaagaucugggggag

SEQ ID NO: 189918 - RNA, 45 nt, Homo sapiens; identical to SEQ ID NO: 123234

SEQ ID NO: 189919 - RNA, 74 nt, Homo sapiens
cagccauuggggagaaagcaagaggcuaugaggagagcgaaggucauaauacaccaaaguugaagaaccagaga

SEQ ID NO: 189920 - RNA, 46 nt, Homo sapiens
auaucaggaguauuugaagcacugaaggauaugacugccccuuuac

SEQ ID NO: 189921 - RNA, 45 nt, Homo sapiens
caccaaaaguagaagagucgaaucguuuaucuuccagauuuggau

SEQ ID NO: 189922 - RNA, 44 nt, Homo sapiens
uaaauuacauacuaagcuacacauaaugaauucauaggagagcc

SEQ ID NO: 189923 - RNA, 50 nt, Homo sapiens
aaaauuuuucuugaagccagugaacagauuuagagcaaagugauggaaca

SEQ ID NO: 189924 - RNA, 41 nt, Homo sapiens
auacuaacuuacuuacuucucaauuaucaaaggccacuucu

SEQ ID NO: 189925 - RNA, 54 nt, Homo sapiens
aacuucuaugcaugcauucuauauguuaccucgacucuucucagacucccuucc

SEQ ID NO: 189926 - RNA, 48 nt, Homo sapiens
ugugggacuacaucugugaaacuugguuagaguuauaagguagaaggg

SEQ ID NO: 189927 - RNA, 22 nt, Homo sapiens
uuuucuugaguauuuuaaagca

SEQ ID NO: 189928 - RNA, 44 nt, Homo sapiens
ggaaaacuggguagaauaacugguucugcugagggagccagcau

SEQ ID NO: 189929 - RNA, 52 nt, Homo sapiens
aauuacucagguagaugauucauaagaugagaaaagccaacgcuugcugauc

SEQ ID NO: 189930 - RNA, 102 nt, Homo sapiens
uaaaauuguuuccuaaauucccuacacagagcuuaaagaaggagccaaguccaggauggacucgguuacugaaaaauacgcuuuugcauuaucuguaccacu

SEQ ID NO: 189931 - RNA, 46 nt, Homo sapiens
cugcaccugcuacagauagcauauuugcaacaagcuuggcugagau

SEQ ID NO: 189932 - RNA, 46 nt, Homo sapiens
cgcggauucucuugaccacaauuucgcuugggaagaccaaguccuc

SEQ ID NO: 189933 - RNA, 79 nt, Homo sapiens
acgcgaauuggagaaaaaguucagugggaagcaugucgucuuuaucgcucagaggagaauucugccuaagccaacucga

SEQ ID NO: 189934 - RNA, 46 nt, Homo sapiens; identical to SEQ ID NO: 136583

SEQ ID NO: 189935 - RNA, 46 nt, Homo sapiens
cuaucauaaucuuuguucccguuccucaacugaaaucuuuccagaa

SEQ ID NO: 189936 - RNA, 55 nt, Homo sapiens
guaccagacuuggcaaugguucucaaauuauuuaugagaucagcuuuggucaugc

SEQ ID NO: 189937 - RNA, 41 nt, Homo sapiens
ugugaucacaaccaguuucucugccaccagguaggcagaaa

SEQ ID NO: 189938 - RNA, 42 nt, Homo sapiens
cuaugaacugagaaugcuucuucacuacuucuuugacccgcc

SEQ ID NO: 189939 - RNA, 45 nt, Homo sapiens
guuuucuucuucuuauccuuacugcugucauccuccucaucugaa

SEQ ID NO: 189940 - RNA, 46 nt, Homo sapiens
cucaucuccagacugggaggugugacagcgcagcagcucagacagg

SEQ ID NO: 189941 - RNA, 46 nt, Homo sapiens
ugcuggucacaaugcagcagggugaagacacaagucuauuggagau

SEQ ID NO: 189942 - RNA, 78 nt, Homo sapiens
augugguuggagugggucuggggauccucaagggaaaagcccgaagauagcagggcgguuucaaacagcagcaccacc

SEQ ID NO: 189943 - RNA, 42 nt, Homo sapiens
ggcagggugaagagagacuuuaacgaugcuucuucggcggcg

SEQ ID NO: 189944 - RNA, 46 nt, Homo sapiens; identical to SEQ ID NO: 150373

SEQ ID NO: 189945 - RNA, 46 nt, Homo sapiens; identical to SEQ ID NO: 150374

SEQ ID NO: 189946 - RNA, 46 nt, Homo sapiens; identical to SEQ ID NO: 150375

SEQ ID NO: 189947 - RNA, 46 nt, Homo sapiens
cgugguuuugcaaaguacuggccuccaccgccauaggggccagagu

SEQ ID NO: 189948 - RNA, 47 nt, Homo sapiens
acccaagcagguuguauauaaauuccaaauagaaccuggcaucaccc

SEQ ID NO: 189949 - RNA, 17 nt, Homo sapiens
uggaggcgcagggguga

SEQ ID NO: 189950 - RNA, 69 nt, Homo sapiens
cggguguaggccaggaugaggccuccggccaagcaggcguagaagaucaugaugagcaggauguagaga

SEQ ID NO: 189951 - RNA, 71 nt, Homo sapiens
aaggaugccaaauccgucaagaucaagaaaaauaaggacaaugugaaguuuaaaguuugacacagcaaaua

SEQ ID NO: 189952 - RNA, 46 nt, Homo sapiens
cagaccacacaguagccaaguucuggagcaaauaaaaggccugugu

SEQ ID NO: 189953 - RNA, 43 nt, Homo sapiens
cagaucuggagcugcugcucccugcugcggagaccgcggaggc

SEQ ID NO: 189954 - RNA, 47 nt, Homo sapiens
gagugccagaggcagaaaagggaaggaggcgaggaggaguagucgug

SEQ ID NO: 189955 - RNA, 32 nt, Homo sapiens
gagcgcccggcgcggagagcgcgggagcggag

SEQ ID NO: 189956 - RNA, 38 nt, Homo sapiens
gggcgcggcggccgguccccggggcugggcgggaggcg

SEQ ID NO: 189957 - RNA, 46 nt, Homo sapiens
aaacaaaugggauugaaaaggcaaguugccagauacauaaaaauaa

SEQ ID NO: 189958 - RNA, 45 nt, Homo sapiens
gggagguauugcuuuaggccaggaaauagauaaguuggagggaaa

SEQ ID NO: 189959 - RNA, 45 nt, Homo sapiens
cccaaggaaauuugcagagaauuuuuccaucuuucauuguuacag

SEQ ID NO: 189960 - RNA, 23 nt, Homo sapiens
gucuguccaccugauccacccca

SEQ ID NO: 189961 - RNA, 39 nt, Homo sapiens
aaaugugaguggacagacuccacugggcgucagggagag

SEQ ID NO: 189962 - RNA, 53 nt, Homo sapiens
caaauugaguuucuuucucuuuaggccuuucacaacuaggacugagaauguau

SEQ ID NO: 189963 - RNA, 47 nt, Homo sapiens
ucuagcccagugccuucagucuccucauguccaucacaugccaguau

SEQ ID NO: 189964 - RNA, 73 nt, Homo sapiens
gccagaaugauacaaguaaaauacauguuggaucaugccauucccuuccuccaaaaccuuugauaacuccuua

SEQ ID NO: 189965 - RNA, 48 nt, Homo sapiens
uccaaucccuuuguuuuccagaugaggaaacuguggcuuagaggaaaa

SEQ ID NO: 189966 - RNA, 47 nt, Homo sapiens
agaagauaaaggaggagaagaggagagcaucaugcaagcuagagaag

SEQ ID NO: 189967 - RNA, 65 nt, Homo sapiens
cugauuaagaaggaauuaaaaaagcaaaucuguguguguguguuuguauguguguguguguguca

SEQ ID NO: 189968 - RNA, 34 nt, Homo sapiens
gcuggacuagcuaaucgccuucucuaacgguagg

SEQ ID NO: 189969 - RNA, 88 nt, Homo sapiens
ccuggcauucaaaaagcuuaugauauguuagauaguguguggugaaucuagaucacauaacauguauuaagcaauuacuccaggccua

SEQ ID NO: 189970 - RNA, 45 nt, Homo sapiens
auuggaugaaggacacaaugcauuagaaacacaaauguggagaga

SEQ ID NO: 189971 - RNA, 51 nt, Homo sapiens
auauuagguauucaaaaaauauuaguuacagucuuccuccuugcuccccaa

SEQ ID NO: 189972 - RNA, 38 nt, Homo sapiens
uuuaaaaauggguaaauauaaggcagaaaauaauauuu

SEQ ID NO: 189973 - RNA, 48 nt, Homo sapiens
aggaagaagcauugcuaugacaacaaauuacuuauauuugauuuagaa

SEQ ID NO: 189974 - RNA, 45 nt, Homo sapiens
ggccagauaguaaauguuuuaggcuuugugaaccaugcugugucu

SEQ ID NO: 189975 - RNA, 46 nt, Homo sapiens
cagaaacaaucugggagcccauucauucuguucucacuugccugcu

SEQ ID NO: 189976 - RNA, 42 nt, Homo sapiens
gaauuaauauuucuucccacuaccuacuccuuacugcccuca

SEQ ID NO: 189977 - RNA, 45 nt, Homo sapiens
gaugaucauaggguguaaagcaaacugacugaacgcuugcagaga

SEQ ID NO: 189978 - RNA, 53 nt, Homo sapiens
acauauuuagauucuuuuaccaguuuaaagaaguuaauuuaauggggguaaag

SEQ ID NO: 189979 - RNA, 42 nt, Homo sapiens
uucagauugcauuuucccaaggacacaauauucuucuugugg

SEQ ID NO: 189980 - RNA, 41 nt, Homo sapiens
cuuuguucucaaacacuaggaauguuuccaagcagggccgc

SEQ ID NO: 189981 - RNA, 25 nt, Homo sapiens
gugagcugcugcugugaccaggaaa

SEQ ID NO: 189982 - RNA, 46 nt, Homo sapiens
auggugcauaauucaucuugguuggauagaaaagcauguaaaaggg

SEQ ID NO: 189983 - RNA, 44 nt, Homo sapiens
gauuuagcucaccccccucccuaccuuucccccacucaccagcc

SEQ ID NO: 189984 - RNA, 46 nt, Homo sapiens
cugaggaagcugagagagugugugguuuugaauggaaccguggauu

SEQ ID NO: 189985 - RNA, 47 nt, Homo sapiens
aauuucaucuaugcugcagagagcaggaggugcauugcuggauggag

SEQ ID NO: 189986 - RNA, 56 nt, Homo sapiens
auacaaacauaauaaauguauaaaaacgugggcaacaaggaagucaacuacuuuag

SEQ ID NO: 189987 - RNA, 51 nt, Homo sapiens
uuguucuaaauguaagaguucagacucacauucuauuaaaauuuagcccua

SEQ ID NO: 189988 - RNA, 2183 nt, Homo sapiens
uaugucaacuuaguagcuuuauuuuaagacuaagcuuugagggucuuaaauccuugaugaauccagccuagaucacaccagucaaaccacagauuuuuauugagcacuuuccuguguuaaguaucaugccaugugcugcagaagauacaaaaacaaccaguguacauuccugguccucaaagaacuugcaguuuaguuagaaagauaaaguauaaaugccugaaaaguuauggcaauauuaaaguugaaaacaugaaaaaggaaaaaucaugguugggcaugguggcucauaccuguaaucccaacauuuugggaggucaaggcaggaggauugcuugagcccaggaguuugagaccagccugagcaacauauaagacccugucuuuacaaaaaauaaaaaaauagcugggcgugguggcacauguuuauaauccaagcuacuugagacucaaggcugaggugggaagauggcuugagcccaggaggucgaggcgguggugagcuauggccaacacuacugcacuucagucugggugacagagcaagacccugucacaaauaaaaaaguaaaacuuacaaggcauucaggcuugacugcuaaauugcaguugcucuauguuucaagaaaugggaaaaagauuaauauuagcauucacugagcccauacuauuuuccagguaauuuacacauauauuauucaauucucauaagaaacccauuuuacauaugaggaaacugagguucagaucagauuaaacgacuugcucagaguuacaucauuuguaagugcuaaagcuaaaccugugcacuuuguaccuuaauacacagccuccuggaguaaguggucuggaaaggcuucaugaagaaauaaagccugagccaagccuugagggaugguuagaaugugcaugcaaauugcauaggaaggaggcuguucaagcuaagggaacacauggacauggaggcagaaaauagucaacuaaguauugagauucugaagagcagggugggagucagggauuccaguuguacacagagacauuaccacuuauuugcaaaucacaagaagacacuguuucugucaugucucuuaacccuuacaguauuuagauuuuguguacauuuccuaucuuuucaaccuccacaaauaagaauuucuuauguguggaugggacuuuggaaucagaauagcucuuuuacacauaucucacccuaguguaguuguuaaggggauuggcucagggaucagauucucuagguucauguucuggcugggccacucccuugugugugugugugugugugugugugugugcgcgugugcguguguguguguguggugugugugugugugugugugugugaaggggggcaggggugggagacagagaaaacacaaggagaacaaacuugugcaaguuacuuauccucuguggaccucaguucucucaucuauaaaaugggggugauaauagugccuauuucauaaagcuauugugaggauuaaguuaguugauguguguaaagcaaauagcauugcacuguuagccauuauuagucuuugauccucaccaaaacccugugaaguguguauuagcauguccauuuuacagacagagccuuagaaaguuuaaguaacuuguacaggggggcacacaggaagugacagaacuagcaugaaaacuuuggucuuucugauaccaaaggucaucauaccaaaggaagguuuggucuucuucucuccuaguuauuuagauugauuuuuaaguauucagccauaugaccgccuuuuggcaaauuuuauacaguaucgauuagcaauuugggggcuuaauuuuacuuuuaggauuuuuuuguuacagaaauaguagaugcucaugacuacaguagcaauaauauauuguauauuucaaaguagcuagaagagaggacuugaaauguuucuaacacauagaaaugauaaauacucaagggcauggauaccccaaauacccugacuugaucauugcacauucuaugcaugcaaaaaauacucaugugcacuccauaaaucuguaaaauauuauguaucaauaaaaggaaaaagauuuuuuuaaaaaugagauaugugaaauauagugaauuauuucagauaaguucuaggaagaaaaauaauacauggucauugaaaaguaacucagag

SEQ ID NO: 189989 - RNA, 47 nt, Homo sapiens
guagcguaaguccuuccguuuucauaguagacuuuauuucuuuucca

SEQ ID NO: 189990 - RNA, 59 nt, Homo sapiens
uaguuaaauauuuaaaaauuccuaaguuuuuacuauacaaauuuucaaacauauugaaa

SEQ ID NO: 189991 - RNA, 46 nt, Homo sapiens
uguccacuggcuccuuccuucagucuauacagaaucucuccuguuc

SEQ ID NO: 189992 - RNA, 45 nt, Homo sapiens
agcauguuaugcucuacgugguacccaucuaccugcuuuggaaag

SEQ ID NO: 189993 - RNA, 46 nt, Homo sapiens
ucacagucugauucuuguccaucucuuuggccucauuucucauugc

SEQ ID NO: 189994 - RNA, 38 nt, Homo sapiens
uggggucuucucacuguguucucacacguggaaggggc

SEQ ID NO: 189995 - RNA, 37 nt, Homo sapiens
cgaggccaugggguccaagcugguguggaagaaaggc

SEQ ID NO: 189996 - RNA, 45 nt, Homo sapiens
cacuaauggacuuaauccaguagagaggaagaaauuguugacaua

SEQ ID NO: 189997 - RNA, 42 nt, Homo sapiens
ucgagaagagagaaaauauuaauuuguggccuaggagcguga

SEQ ID NO: 189998 - RNA, 41 nt, Homo sapiens
ucuccuuuccaguaacgcagaacuccuucuaauugcacaca

SEQ ID NO: 189999 - RNA, 55 nt, Homo sapiens
cacugucuggcauggagucuuacucccaauguggacucuguagauguugagugaa

SEQ ID NO: 190000 - RNA, 42 nt, Homo sapiens
aaaauugcugaguguaagaguguauaucaguggcaaaaugag

SEQ ID NO: 190001 - RNA, 70 nt, Homo sapiens; identical to SEQ ID NO: 123347

SEQ ID NO: 190002 - RNA, 53 nt, Homo sapiens
uggucaagacagaaccagccagauucuggucacuggugucccaugacucaaag

SEQ ID NO: 190003 - RNA, 52 nt, Homo sapiens
gggggcugccaaagaauuaaguccucauggguggagguucaggugcuccaca

SEQ ID NO: 190004 - RNA, 45 nt, Homo sapiens
caggaaguggcugggcauugcugacuccacauugacucccacuag

SEQ ID NO: 190005 - RNA, 79 nt, Homo sapiens
guugacauccuccacaagcuugccuuugcucugucuacagcuuaguaccccauucuggagggcacuuucuggugcuugg

SEQ ID NO: 190006 - RNA, 53 nt, Homo sapiens
gccacaugccuggcauggccaagccagagacagauccaccugucagaggaagg

SEQ ID NO: 190007 - RNA, 64 nt, Homo sapiens
ccagucuauaggcuucacaaggagccauggccuguauuuggggcauuggggagcauaaggcauc

SEQ ID NO: 190008 - RNA, 45 nt, Homo sapiens
ugcccucaguauuugguuuuguacaccaaagaugaucuggcccau

SEQ ID NO: 190009 - RNA, 48 nt, Homo sapiens
cggcgcuaacaagauaccucuaguacaguggacugucgauuuuguugc

SEQ ID NO: 190010 - RNA, 45 nt, Homo sapiens
gguucaucaguuguaacaaaugugccacucugauacaggauguug

SEQ ID NO: 190011 - RNA, 40 nt, Homo sapiens
gaggcugucacauaagguccgccccuuaaaacaucuggag

SEQ ID NO: 190012 - RNA, 48 nt, Homo sapiens
agaguuucuuuccauugcuucugccaccguggguucuuaugaguccaa

SEQ ID NO: 190013 - RNA, 34 nt, Homo sapiens
ugaaaaguuauucuugcuucccucucuucaaaau

SEQ ID NO: 190014 - RNA, 44 nt, Homo sapiens
auguacucccgugacauaugacacugguucuuucaauaguagag

SEQ ID NO: 190015 - RNA, 45 nt, Homo sapiens
cugcgaacuuguagaaacucuggaaucucuuuuuucaggucucgc

SEQ ID NO: 190016 - RNA, 48 nt, Homo sapiens
aucugcauuucuacuugcagguggucgauaaauuucaauagaagggcg

SEQ ID NO: 190017 - RNA, 44 nt, Homo sapiens
aucaugauugaauuuuuuuacuuuaacaacugaacuuaccacag

SEQ ID NO: 190018 - RNA, 47 nt, Homo sapiens
uaaaauguagguugaaagauuggauugauugugaaucuacacuaaag

SEQ ID NO: 190019 - RNA, 49 nt, Homo sapiens
gaaggaucccaaggaaugggcagcucaguaccgagaggcgauggaagcg

SEQ ID NO: 190020 - RNA, 42 nt, Homo sapiens
auguacuuugugcguauuaucucacugauuucucacacaugc

SEQ ID NO: 190021 - RNA, 38 nt, Homo sapiens
cuguccguccauggcagcuccugccauguauuugagau

SEQ ID NO: 190022 - RNA, 44 nt, Homo sapiens
cgggaaccaaagagaccugcuaauccagcuccaucgcuaugcug

SEQ ID NO: 190023 - RNA, 46 nt, Homo sapiens
agaauacacugauguguaccccgaaaucauugaacgagcaggcuau

SEQ ID NO: 190024 - RNA, 41 nt, Homo sapiens
caagagccugaagcaccaccaccucgggauguggcccuuuu

SEQ ID NO: 190025 - RNA, 41 nt, Homo sapiens
ccauugcgcaugcgcacuauguuucgcuagaaaggggcgug

SEQ ID NO: 190026 - RNA, 41 nt, Homo sapiens
ggaggggcuuggagugaguggacgcacucgggaauuguagg

SEQ ID NO: 190027 - RNA, 48 nt, Homo sapiens
aggaaaugugagguaggaauagggaguagggagccaggcuaagggaau

SEQ ID NO: 190028 - RNA, 47 nt, Homo sapiens
gagacuagcggagggaggaggggagaaaaacggggaaccaggaaugu

SEQ ID NO: 190029 - RNA, 62 nt, Homo sapiens
guucugauuuccucuuagagauaggcucaccuuaucuuccaaggcucaccuuaucuuccaag

SEQ ID NO: 190030 - RNA, 39 nt, Homo sapiens
ccccaucucuacuccuuccaggaagccaggcccacaacu

SEQ ID NO: 190031 - RNA, 47 nt, Homo sapiens
aguugccaccccacguggaguuguacgugugaagacacuggcugagg

SEQ ID NO: 190032 - RNA, 43 nt, Homo sapiens
agggggcuggcugggucaggaauggugagaugaacaugcaagu

SEQ ID NO: 190033 - RNA, 79 nt, Homo sapiens
aaaccuaggguccuuggucuuggggguggggggaccuuuuccagcauauuccccugggccuuuaguuaacauccgagug

SEQ ID NO: 190034 - RNA, 42 nt, Homo sapiens
auggcuuugggcccuuauuugcuguucuaagaguugucugua

SEQ ID NO: 190035 - RNA, 47 nt, Homo sapiens
ucugauccagacgcucagacuauuaaggaagaggauauaguggaaga

SEQ ID NO: 190036 - RNA, 42 nt, Homo sapiens
ggaugaagaugauguggacaguguggaagagauggaggugaa

SEQ ID NO: 190037 - RNA, 98 nt, Homo sapiens
agggcuaggagcuuugugggagacuuucuugaguuacugucuaauucagaaaaaguagagcauaggcccauagguaacugaagcccagagaggaaggu

SEQ ID NO: 190038 - RNA, 43 nt, Homo sapiens
uucgggggauauuaaguuugagugguagggaaagccaagagug

SEQ ID NO: 190039 - RNA, 25 nt, Homo sapiens
aauguguuauauuuggaaaguagca

SEQ ID NO: 190040 - RNA, 42 nt, Homo sapiens
auaaaacauugagauauuuuacauuuuuuaguauuaaguuuu

SEQ ID NO: 190041 - RNA, 49 nt, Homo sapiens
aacuggaaauaaaaucagguacaacuccaaaaggagacauuggagaaga

SEQ ID NO: 190042 - RNA, 45 nt, Homo sapiens
uuuggaguuguaccugauuuuauuuccaguuuucauccgaaucca

SEQ ID NO: 190043 - RNA, 41 nt, Homo sapiens
ccgcacgcuccugcgggccccgcggagccauugcggccgag

SEQ ID NO: 190044 - RNA, 43 nt, Homo sapiens
gagagaguagaggccgggccuucagcguuucucacugguucga

SEQ ID NO: 190045 - RNA, 40 nt, Homo sapiens
ucgcuucgcguagggugaagcuguagcuacuucggcuuug

SEQ ID NO: 190046 - RNA, 42 nt, Homo sapiens
caacgccuccguugucgccgccgcagugggcggauugggaag

SEQ ID NO: 190047 - RNA, 48 nt, Homo sapiens
guccucuagcccgcucugucucccccuuccauugguccccuuggcgca

SEQ ID NO: 190048 - RNA, 51 nt, Homo sapiens
uauucaacgccugcgccaaggggaccaauggaagggggagacagagcgggc

SEQ ID NO: 190049 - RNA, 42 nt, Homo sapiens
caugcugcuaaaccacuauuaagcgaaacuaugaacgggucg

SEQ ID NO: 190050 - RNA, 49 nt, Homo sapiens
gaccaagaggcuccagaaacucagagcaaggcagggaaaaggggcgguu

SEQ ID NO: 190051 - RNA, 56 nt, Homo sapiens
guggagccugagaggaggguuaucuuccuucuaagggauucagcuccuggaaaagg

SEQ ID NO: 190052 - RNA, 44 nt, Homo sapiens
cccaaguguucuaccuuuuggaaggggugccucaugcccugccu

SEQ ID NO: 190053 - RNA, 46 nt, Homo sapiens
aaaguuuuuauuugguauugucacuccuuccucucuucucagagau

SEQ ID NO: 190054 - RNA, 131 nt, Homo sapiens
gcagccugaccugaguggguuagugauccagagaaaccagcaggccaacuuggucaggaagguucgggaagcuguuggagcaguguggggaauuucccaccaggaugaguaugauuggcugugauuuuagg

SEQ ID NO: 190055 - RNA, 50 nt, Homo sapiens
ugugggaaguauuuguauuuuacuuccuggaauggagauaguaggggugg

SEQ ID NO: 190056 - RNA, 57 nt, Homo sapiens
auuggcugguccccacucccagaguuucugauucuguagaucuaggaggggccccag

SEQ ID NO: 190057 - RNA, 32 nt, Homo sapiens
uggagaauguaggacaguguggucuaggggaa

SEQ ID NO: 190058 - RNA, 33 nt, Homo sapiens
aggaaugaacaaaaugugcuauagcaguuuaca

SEQ ID NO: 190059 - RNA, 42 nt, Homo sapiens
aucucuccuuaaaacugaacuuuauuucuaaaugugccaucu

SEQ ID NO: 190060 - RNA, 49 nt, Homo sapiens
gucaacgugagaaaggcaaaaauccaaagaaagcucaguuucuuugccc

SEQ ID NO: 190061 - RNA, 41 nt, Homo sapiens
ugagggaaauauuauguaauaucauagcacugguaagagag

SEQ ID NO: 190062 - RNA, 67 nt, Homo sapiens
uuuguauauguuuugaaaagucucauaaauugaaguuauuuuaaagugagacuuuuuccugcuggau

SEQ ID NO: 190063 - RNA, 63 nt, Homo sapiens
uucaaaauaagucucgggugaaguaaguuauuuuuaagauaauuuuaaaauaacuucugacaa

SEQ ID NO: 190064 - RNA, 38 nt, Homo sapiens
aagguauuucugcaaauaauuuccagauuugucuuggg

SEQ ID NO: 190065 - RNA, 41 nt, Homo sapiens
ggaacagauuuggguuugaauccacguuuuaccacuuaaua

SEQ ID NO: 190066 - RNA, 36 nt, Homo sapiens
guaaacugggcacagucuucaucuccaaggauuaaa

SEQ ID NO: 190067 - RNA, 48 nt, Homo sapiens
cagcuaaucuaaggcauuuguuuagaugguguucuuaaucuggugcau

SEQ ID NO: 190068 - RNA, 43 nt, Homo sapiens
gggcucccuaauucuguuccauugauuuguucauucuuuuacc

SEQ ID NO: 190069 - RNA, 51 nt, Homo sapiens
acuuuagaauaaucucagcuuauuuacaaaaaaacaucuugcugggauuug

SEQ ID NO: 190070 - RNA, 46 nt, Homo sapiens
auauuuugagguuguuggcaucaggcauuuuguucauuuuguauug

SEQ ID NO: 190071 - RNA, 46 nt, Homo sapiens
agaucguaaagcugaaaauugaaaucaugaaaguagacaggacuaa

SEQ ID NO: 190072 - RNA, 55 nt, Homo sapiens
ugccugaagucagcucucaggcugcugugcaauuccuuccuaugcagaaaggaug

SEQ ID NO: 190073 - RNA, 60 nt, Homo sapiens
gagaauagaagaccuagaaaagugauccuaguguauauaagaacuagauauaugguaaua

SEQ ID NO: 190074 - RNA, 42 nt, Homo sapiens
cuauuauauugcgauaaauuuuagauaaaccaaaagucaaau

SEQ ID NO: 190075 - RNA, 44 nt, Homo sapiens
auaugaggcaucuaaaauagucaaagguguaaagguaggcagua

SEQ ID NO: 190076 - RNA, 30 nt, Homo sapiens
aguggccccaggguuugggaaauauuggga

SEQ ID NO: 190077 - RNA, 49 nt, Homo sapiens
ugugccaaggauuuuacauauauuuaauuaccaugaacauuugagguag

SEQ ID NO: 190078 - RNA, 49 nt, Homo sapiens
cagaaugccugguagguuauauugaaucagagacugaaaaguccuagug

SEQ ID NO: 190079 - RNA, 46 nt, Homo sapiens
acuucucuuggaacugcagcagaucaaaacauggaacauuggaaag

SEQ ID NO: 190080 - RNA, 45 nt, Homo sapiens
aauguuucuuggauauagauacuauccuucauaggguugauggga

SEQ ID NO: 190081 - RNA, 46 nt, Homo sapiens
ugccaaauguuguagccgaguuagcagcgggguccucuugucagau

SEQ ID NO: 190082 - RNA, 50 nt, Homo sapiens
aaaguucaaaauuagauucaauucugugugagaaggaaguauaaugcaau

SEQ ID NO: 190083 - RNA, 278 nt, Homo sapiens
guuacaguaacacuaccagauaggugaauacugugaggcucagaaguuacuuauguauuuuuuuuuuguuuuuuguuuuuuugagacggagucucgcucugucccccaggcuggagugcaguggcgcgaucuuggcucacugccagcuccaccuccuggguucaugccauucuccugucucagccucccaaguagcugggacuacaggcgcccgucaccaugcccggcuaauuuuuuuguauuuuuaguggagaugggguuucaccauuauuuuugga

SEQ ID NO: 190084 - RNA, 42 nt, Homo sapiens
uucugcuaaaaugugaagaauaauaucuguucuuccugucuu

SEQ ID NO: 190085 - RNA, 40 nt, Homo sapiens
uuuugguuugacuuaccugucuguucucuguagcaucaag

SEQ ID NO: 190086 - RNA, 23 nt, Homo sapiens
auguguaagaaucgaauuuaugg

SEQ ID NO: 190087 - RNA, 45 nt, Homo sapiens
uuagaagccaguugagccacuccccccauuaucucaggagcuugu

SEQ ID NO: 190088 - RNA, 45 nt, Homo sapiens
ggcuuuggacuugcagaauguugcagagacuugcauaugauggua

SEQ ID NO: 190089 - RNA, 54 nt, Homo sapiens
caacauaaagguuaacguguacuuuaaaaggaaguaauacauauacauguuaaa

SEQ ID NO: 190090 - RNA, 55 nt, Homo sapiens
ccacccagugcaacuacacuacacuuugaauucuaugcagauccuggggccgagg

SEQ ID NO: 190091 - RNA, 36 nt, Homo sapiens
cagaugcuguuauuuacacacauacgacuggcccau

SEQ ID NO: 190092 - RNA, 50 nt, Homo sapiens
guguucacuguauuuauucauuauccuugagcuccuuaauguuggacgag

SEQ ID NO: 190093 - RNA, 46 nt, Homo sapiens
uucuuuugucuuucuucauugccaggaguccaguguauuccacaac

SEQ ID NO: 190094 - RNA, 46 nt, Homo sapiens
auguugaauuuccucaagaaggccauccaagacccugcuuucucag

SEQ ID NO: 190095 - RNA, 54 nt, Homo sapiens
acuuaagagucagaaagggguaauaagacggaauuaagcacagagucgaaagcu

SEQ ID NO: 190096 - RNA, 142 nt, Homo sapiens
uaguugaauuugaggugcccugggcacuaaauguccauaguacauaggucagcuuguauggguagaagggaacaggaucgcugaauaaaauguauaacccugcugagcaggaguuguaacacagaagaaucaguagcccaag

SEQ ID NO: 190097 - RNA, 46 nt, Homo sapiens
ggcucccucccaaauguauucagugcacucuguuugaaugcccgag

SEQ ID NO: 190098 - RNA, 55 nt, Homo sapiens
cuugaagaaaucuguaaucuuggaagggaccccaaauacaucugucagaagccau

SEQ ID NO: 190099 - RNA, 45 nt, Homo sapiens
agcuuuaauucuacccagcaaaaugaaacugagccuaaucagcag

SEQ ID NO: 190100 - RNA, 36 nt, Homo sapiens
cacuuucaucuauaaaaagcaagagaguuguauuag

SEQ ID NO: 190101 - RNA, 67 nt, Homo sapiens
uuacuuauaucaauuaccuauauagauccaccucuaucgauaaggagugcagguguggaucccgccc

SEQ ID NO: 190102 - RNA, 43 nt, Homo sapiens
cucugucucugccccaucccgcucuccugcacccugugcccaa

SEQ ID NO: 190103 - RNA, 45 nt, Homo sapiens
gaacugucaugcugcaaauaccaauuguuagggaagggagaccuc

SEQ ID NO: 190104 - RNA, 41 nt, Homo sapiens
acaggguuguugguacagaggaacguauuccuauuccccuc

SEQ ID NO: 190105 - RNA, 42 nt, Homo sapiens
aauacaacagaugaccacugccaggaauuugugaaucagaaa

SEQ ID NO: 190106 - RNA, 43 nt, Homo sapiens; identical to SEQ ID NO: 123520

SEQ ID NO: 190107 - RNA, 46 nt, Homo sapiens
guugucuuuggauucacaaacauuuuuaaucuugauaaaguucagc

SEQ ID NO: 190108 - RNA, 77 nt, Homo sapiens
gagaaauccauuugcuuacagacuuggaaagauccauaauugugacgugacuucauuuaguuuauuuuguuuuacuc

SEQ ID NO: 190109 - RNA, 48 nt, Homo sapiens
accauuuaccaggugagagaccauggccauauccaaaaucugagaggc

SEQ ID NO: 190110 - RNA, 45 nt, Homo sapiens
ugagcccccaggggauucaauggggcgguguaagggcuccaggga

SEQ ID NO: 190111 - RNA, 41 nt, Homo sapiens
uuccaucuccguaaaccaguggggcucucaauugggucuga

SEQ ID NO: 190112 - RNA, 45 nt, Homo sapiens
ggaaccaguuucugcauaucugccuggccaaauucacacccagau

SEQ ID NO: 190113 - RNA, 55 nt, Homo sapiens
uaugcagaaacugguuccaaaggaugagaaggcagguacgacccagggcggaaaa

SEQ ID NO: 190114 - RNA, 74 nt, Homo sapiens
auacauaaugguaaaauuuagaaaauguaguugaaagaauuacccguauuucugccaccaaaaaaaaaaaaaaa

SEQ ID NO: 190115 - RNA, 90 nt, Homo sapiens
uuagagucugaagcaguagguucaucugucuccaugggagccaaugugucaccaucuagcccaaugccuucuaauaagcccuggguagaa

SEQ ID NO: 190116 - RNA, 46 nt, Homo sapiens
cucccauggagacagaugaaccuacugcuucagacucuaagggcaa

SEQ ID NO: 190117 - RNA, 42 nt, Homo sapiens
aucuagaaauauucuuccuuuggugcuuguguuauuaagcua

SEQ ID NO: 190118 - RNA, 37 nt, Homo sapiens
auuaagauuucuuuauccuaauuagggaauagucuac

SEQ ID NO: 190119 - RNA, 46 nt, Homo sapiens
gcucucacuaagcucuugacuaagggguuaucuuggcagcccccac

SEQ ID NO: 190120 - RNA, 42 nt, Homo sapiens
cucaucaaacagcauuggggaugugaaaccaacugaacagau

SEQ ID NO: 190121 - RNA, 45 nt, Homo sapiens
ugaaucccaccacggugcuugaaucuccacauucgcugccugcca

SEQ ID NO: 190122 - RNA, 46 nt, Homo sapiens
ggcagccuuuacuugcaucaaaaacuuauggaaccggaaaccccug

SEQ ID NO: 190123 - RNA, 52 nt, Homo sapiens
gauacagggcaagaggaagguggcucccgccgggaaccucaagucaaccagc

SEQ ID NO: 190124 - RNA, 45 nt, Homo sapiens
uucucauuuucagacauguccaugccaguauuuucuuuucauaau

SEQ ID NO: 190125 - RNA, 47 nt, Homo sapiens; identical to SEQ ID NO: 123544

SEQ ID NO: 190126 - RNA, 45 nt, Homo sapiens
aaagcucgggaaaagcaggaggaggaagaggcuaaaugucuagag

SEQ ID NO: 190127 - RNA, 46 nt, Homo sapiens
cugacuuauccacucugacacgguuuuugugucacuuguugucagg

SEQ ID NO: 190128 - RNA, 104 nt, Homo sapiens
acauauaugaggcauugaagacgauaaagcgaagaauaaggcaugaguccugcauuucaugagcccaguuucugauaggcugaaaugcauauaauuacguauaa

SEQ ID NO: 190129 - RNA, 45 nt, Homo sapiens
cucuuggaagugguucagcccugccuccaggcagccaaggagcag

SEQ ID NO: 190130 - RNA, 39 nt, Homo sapiens
ucaggcacucuucuggggcauguauggggcaaauuugug

SEQ ID NO: 190131 - RNA, 71 nt, Homo sapiens
gaaaucuggagagacaagcgugcgauucacugcaggccgaagaagauacacgguccaauucacuacaaugg

SEQ ID NO: 190132 - RNA, 49 nt, Homo sapiens
cucggcugaauaaaaauucaaaaaacagcaauggacaggaacuagagaa

SEQ ID NO: 190133 - RNA, 53 nt, Homo sapiens
uucucuuaauaggacccaagugcuuggccaauuacuuaggagggaggcguggg

SEQ ID NO: 190134 - RNA, 46 nt, Homo sapiens
aacacugaaaaggagacaagccuggaggaaacaaaaaucggggaga

SEQ ID NO: 190135 - RNA, 42 nt, Homo sapiens
uggucccgggugagccucagacagagacgaaggguggcaugc

SEQ ID NO: 190136 - RNA, 47 nt, Homo sapiens
cugucugaggcucacccgggaccacaaauaugccaugauguuugcag

SEQ ID NO: 190137 - RNA, 45 nt, Homo sapiens
agcacuaccucugguguugugucuggcagccucggcucucgggag

SEQ ID NO: 190138 - RNA, 28 nt, Homo sapiens
uaugauuuuaaacaaaaugucuccuaaa

SEQ ID NO: 190139 - RNA, 46 nt, Homo sapiens
gaagaaagauaaagaaggggaccgggccucugaggaaggcaaacag

SEQ ID NO: 190140 - RNA, 46 nt, Homo sapiens
ugguauugcuacccugauugccaacuacagcuacacugugggccag

SEQ ID NO: 190141 - RNA, 42 nt, Homo sapiens
ugcuagcuuuuguucuggaccaccugcucccacauacccaga

SEQ ID NO: 190142 - RNA, 45 nt, Homo sapiens
ccauugugcugggucuucgcuguggcacugcuguagaagcuggag

SEQ ID NO: 190143 - RNA, 33 nt, Homo sapiens
uauaauuugaaauucacaggacuucaaacuguu

SEQ ID NO: 190144 - RNA, 45 nt, Homo sapiens
caggaugcccaaggagccucucaagauuccaguagcaaccagcag

SEQ ID NO: 190145 - RNA, 45 nt, Homo sapiens
ucaguggugauugcugggcagccugaggugcucaguucacaagag

SEQ ID NO: 190146 - RNA, 50 nt, Homo sapiens
augagcuggaggaccugauagaugaguugcuugagagggauggcggaucu

SEQ ID NO: 190147 - RNA, 66 nt, Homo sapiens
uacaggccuguggcagucuaaaguguugccugugugggggagguggugggaguggccauugauaca

SEQ ID NO: 190148 - RNA, 50 nt, Homo sapiens; identical to SEQ ID NO: 123571

SEQ ID NO: 190149 - RNA, 41 nt, Homo sapiens; identical to SEQ ID NO: 123572

SEQ ID NO: 190150 - RNA, 42 nt, Homo sapiens; identical to SEQ ID NO: 123573

SEQ ID NO: 190151 - RNA, 46 nt, Homo sapiens
ggacuaaacugaguagcuagaaaacaggcuacugugcaggccagca

SEQ ID NO: 190152 - RNA, 79 nt, Homo sapiens
gaggaggagcacacucaggaagaggacagcaguggcaguaacgaggaugaggaugauagucaggaugaagaggaggagg

SEQ ID NO: 190153 - RNA, 46 nt, Homo sapiens
ugaaggugaagagggagaugaagacgaugacgacgauggcucugag

SEQ ID NO: 190154 - RNA, 42 nt, Homo sapiens
accuguaaaugaaaaguucgagaaaaaaauggguuggauuag

SEQ ID NO: 190155 - RNA, 46 nt, Homo sapiens
ccaggaaauaucccuaccacccauccacugauggugcgccaugcag

SEQ ID NO: 190156 - RNA, 47 nt, Homo sapiens
ucaacaacucgucucacccagggcaucgggcgcagucagaggacccu

SEQ ID NO: 190157 - RNA, 40 nt, Homo sapiens
agcugcuggaugacuuuuuccaugaucagagcacagcuac

SEQ ID NO: 190158 - RNA, 46 nt, Homo sapiens
agugguuaaaguguccauugucaaucaccuggaauuccugagggau

SEQ ID NO: 190159 - RNA, 58 nt, Homo sapiens
aagcgcaggaaacaacuggcugaggaagaaacaaagauaacugauaaaggcaaagaag

SEQ ID NO: 190160 - RNA, 46 nt, Homo sapiens
aacaaaguagauaauaaccagaacaagaaccugaacagagccaguc

SEQ ID NO: 190161 - RNA, 51 nt, Homo sapiens
aauuuggacuggaagaaaagagacauggaaggggacagaugguguuuaggg

SEQ ID NO: 190162 - RNA, 28 nt, Homo sapiens
ugccugacagcuacccaacaaccccauc

SEQ ID NO: 190163 - RNA, 47 nt, Homo sapiens
aaccccaccagcuuugggagagguuccucaggagcugcagucuccag

SEQ ID NO: 190164 - RNA, 45 nt, Homo sapiens
ggagacugcagcuccugaggaaccucucccaaagcuggugggguu

SEQ ID NO: 190165 - RNA, 56 nt, Homo sapiens
auguucaagaauugauagaaagggcuucagcugaaccuuagaaaucucaaagugag

SEQ ID NO: 190166 - RNA, 46 nt, Homo sapiens
agaaauggccacggcagaaucucugguggaagagcucucagaggau

SEQ ID NO: 190167 - RNA, 45 nt, Homo sapiens
gacaccccuauggacccugugaccuucauccagacucugcccuca

SEQ ID NO: 190168 - RNA, 45 nt, Homo sapiens
agacaagaaagggcuucgugguccagaaggagccguccucggagg

SEQ ID NO: 190169 - RNA, 99 nt, Homo sapiens
cgaagcccuuucuugucucuugguccuacuuuuuguggaugagccaaagcucaauacuagccgucuacaccgaguacugagaaaucucugcuaccaugc

SEQ ID NO: 190170 - RNA, 42 nt, Homo sapiens
ucugggcaugguagcagagauuucucaguacucgguguagac

SEQ ID NO: 190171 - RNA, 46 nt, Homo sapiens
gagagugagcuaugcauugaaacacccaaacucacuacaagugagg

SEQ ID NO: 190172 - RNA, 71 nt, Homo sapiens
gccaugagaaccguccccuggaccugcuacacaagauggagucaaagagcuccaaccagcuuuccuggcuc

SEQ ID NO: 190173 - RNA, 42 nt, Homo sapiens
cgcuggaucugaaauauauuaguccugcagccuagggcugca

SEQ ID NO: 190174 - RNA, 32 nt, Homo sapiens
gcgguggcuccaccguccacauccauccccaa

SEQ ID NO: 190175 - RNA, 47 nt, Homo sapiens
ugguaaauauugggggauaugucauauaagaguuuuauccaacagac

SEQ ID NO: 190176 - RNA, 52 nt, Homo sapiens
augccacugcuggaggacugugaggagcaugggcuacaggccuuauugcccc

SEQ ID NO: 190177 - RNA, 45 nt, Homo sapiens
augaaugucagccggaaaggcaagaacuccgugaagucagugcca

SEQ ID NO: 190178 - RNA, 44 nt, Homo sapiens
gcggaugacugggugugacaacauguucaugagcugccccagug

SEQ ID NO: 190179 - RNA, 49 nt, Homo sapiens
agacuccuuucucucaucucaauugcucucccagaaaacaaggugucag

SEQ ID NO: 190180 - RNA, 64 nt, Homo sapiens
gugguggaggaagcaccgcugccagaauuagccugugcuucugacaccuuguuuucugggagag

SEQ ID NO: 190181 - RNA, 48 nt, Homo sapiens
ugccaccucaaccacaucuaccaccaccaccacugccgccuccaccac

SEQ ID NO: 190182 - RNA, 46 nt, Homo sapiens
ccaccauugucguagcugcuucgaccacagugacuacccccacgac

SEQ ID NO: 190183 - RNA, 79 nt, Homo sapiens
uaauagcagaaguaaagcauuuucucuuucugaagguuuccacuuaggugcuuccucuuucuggaauccuuuccugaau

SEQ ID NO: 190184 - RNA, 37 nt, Homo sapiens
cuuucuucuccaugcugggcacucguaagagccccau

SEQ ID NO: 190185 - RNA, 46 nt, Homo sapiens
guggucuguggcugcuccucaggcaggccaucaggagagaggguuu

SEQ ID NO: 190186 - RNA, 43 nt, Homo sapiens
auugggcuuucccucuuccuauauuuuauaucuugccuuccuc

SEQ ID NO: 190187 - RNA, 43 nt, Homo sapiens
gaaccugggagaaagagaaagaggaaggcaagauauaaaauau

SEQ ID NO: 190188 - RNA, 46 nt, Homo sapiens
uaccuuguaugcuuuugcauuaaguuugcuauaugaaugcuucugg

SEQ ID NO: 190189 - RNA, 39 nt, Homo sapiens
ccagucggagucuagccagucagaggcgucuguccggag

SEQ ID NO: 190190 - RNA, 46 nt, Homo sapiens
aguaucuugagcacugggagauggcugguccacauccaugggugau

SEQ ID NO: 190191 - RNA, 46 nt, Homo sapiens
gaaccuugaagaauagucaggauuuggguaaaggaugaacagcaaa

SEQ ID NO: 190192 - RNA, 41 nt, Homo sapiens
aauaagcccccagugaguaucaggaaaaguaccagccaugg

SEQ ID NO: 190193 - RNA, 48 nt, Homo sapiens
ugcccuccagccuccgauggaaccccacagggggagaaggaaaaggaa

SEQ ID NO: 190194 - RNA, 46 nt, Homo sapiens
gauuccucuaguuccuuuagacacuccccaagcaugucccacagcu

SEQ ID NO: 190195 - RNA, 42 nt, Homo sapiens
uacagccugcugucgaggccuucuuucugguccaugccacag

SEQ ID NO: 190196 - RNA, 48 nt, Homo sapiens
gcacacaucaaggacgagccuccuccacucuccccugcccccuuaacc

SEQ ID NO: 190197 - RNA, 45 nt, Homo sapiens
augucuucuuuccggagccccucaucuaaacgcuccagcucuugg

SEQ ID NO: 190198 - RNA, 44 nt, Homo sapiens
aaucgauucuucauuucuucgggggauuugcgaugcagcucacg

SEQ ID NO: 190199 - RNA, 46 nt, Homo sapiens
ccuuguuccguaccucaccuggugaucgagucaccuacaccaucaa

SEQ ID NO: 190200 - RNA, 27 nt, Homo sapiens
aggugguugggguugcagugggaagau

SEQ ID NO: 190201 - RNA, 46 nt, Homo sapiens
caccauugacaucgaugaucugaaauccaacacugaauaccacaag

SEQ ID NO: 190202 - RNA, 46 nt, Homo sapiens
cagauccagugguucuggagagcauugcguucuuucgaucaagcug

SEQ ID NO: 190203 - RNA, 47 nt, Homo sapiens
cucgaaggcaugaauggcauucagaaguuucagauccaucgagauga

SEQ ID NO: 190204 - RNA, 46 nt, Homo sapiens
uuaccauuguuggaccuggggaggggggaguuaaaaaaagaaccag

SEQ ID NO: 190205 - RNA, 63 nt, Homo sapiens
aggucccugcaaaggcuacugccuuuuuaaaacacaugggguggggaucauggacggcaugga

SEQ ID NO: 190206 - RNA, 46 nt, Homo sapiens; identical to SEQ ID NO: 123632

SEQ ID NO: 190207 - RNA, 46 nt, Homo sapiens; identical to SEQ ID NO: 123633

SEQ ID NO: 190208 - RNA, 46 nt, Homo sapiens
ccagugaguucuaggugguagugguggagauaaaugccaagggagg

SEQ ID NO: 190209 - RNA, 77 nt, Homo sapiens
cugccaucaggaaagagcaggaaguacaacgcucuaagaagcaagcacaccgucaggcugagaaaacacuggauacu

SEQ ID NO: 190210 - RNA, 44 nt, Homo sapiens
gggcuccaccaggcagcugugcaggcugggcgucagcgcuguga

SEQ ID NO: 190211 - RNA, 28 nt, Homo sapiens
uggccagcuuucaaggcuaggacaagga

SEQ ID NO: 190212 - RNA, 23 nt, Homo sapiens
cgcgcggggagaguggguucgag

SEQ ID NO: 190213 - RNA, 45 nt, Homo sapiens
uccggagggggucaaguaaggcugggaagccggcuccggccgguc

SEQ ID NO: 190214 - RNA, 346 nt, Homo sapiens
augggagguuuuuuuuucuuuugagauggagucuugcucuguugccaggcuggagugcaguggcgugaucucagcucaccacaaccuccgacucccugguucaagggauucucccaccucagccucccgaauagcugggauuacaggcacacaucaccacacccagcuaacuuucuguauuuuuaguagagacaggguuucaccauguuggccaggauggucucgaucuucugaccuugugauucgcccaccucggccucccaaagugcugggauuacaggcaugagccaccacgccuggccugggaguuguuuuuuaaugggcauagauuuucauuuuugcaaga

SEQ ID NO: 190215 - RNA, 60 nt, Homo sapiens
acucagacuaaugggaagagagacuacuccucuguccccauaaagacugagcacaaccaa

SEQ ID NO: 190216 - RNA, 39 nt, Homo sapiens
caaauguguguccucauaagaugaaccuggcucaggggc

SEQ ID NO: 190217 - RNA, 53 nt, Homo sapiens
aauagagcuguccucucuuugggguucuucauggcaauagauuccacagcacc

SEQ ID NO: 190218 - RNA, 46 nt, Homo sapiens
agccuucaccauuuccuucuuucgcuugucauacuccugcgccagc

SEQ ID NO: 190219 - RNA, 38 nt, Homo sapiens
gcuucucaauuuccacuucauuaugguaaagcuuaaag

SEQ ID NO: 190220 - RNA, 51 nt, Homo sapiens
aauaacagagaaaugaguauagguacugaacuccgggcucagaggaacccu

SEQ ID NO: 190221 - RNA, 45 nt, Homo sapiens
gauuuugugggagguguucuccuuggcuuugauguacugaggccg

SEQ ID NO: 190222 - RNA, 45 nt, Homo sapiens
ccuuuacgcuucuuguagugcuucugagcauucugcagagacuuc

SEQ ID NO: 190223 - RNA, 42 nt, Homo sapiens
uuaccugauucuccuccaacgucaaaucucugcccugacucu

SEQ ID NO: 190224 - RNA, 45 nt, Homo sapiens
cucagagagcucuggggguccugcaugaagaggggcauguaggua

SEQ ID NO: 190225 - RNA, 45 nt, Homo sapiens; identical to SEQ ID NO: 146050

SEQ ID NO: 190226 - RNA, 48 nt, Homo sapiens
gacccccagcccaagcacccgcuucgggcugaccuagcugaagaauac

SEQ ID NO: 190227 - RNA, 46 nt, Homo sapiens
uagaaaucaacuuuccagcagaguacccauucaaaccaccgaagau

SEQ ID NO: 190228 - RNA, 46 nt, Homo sapiens
agauggcggccagcaggaggcugaugaaggagcuugaagaaauccg

SEQ ID NO: 190229 - RNA, 39 nt, Homo sapiens
ggguggauggggaagacagguccagaaaaaccaaagcca

SEQ ID NO: 190230 - RNA, 87 nt, Homo sapiens
ggagucagacucaaguacuacuggcauucaggaggggaaggucaggguaugccacagugaucaaggagggcuuccuaaaggggagga

SEQ ID NO: 190231 - RNA, 50 nt, Homo sapiens
ucccuggccuacccauacccuccccacagacuggguuaaguguaccuccu

SEQ ID NO: 190232 - RNA, 54 nt, Homo sapiens
uggcgaaggcugcgguaguggggaggcaaccacacaguuuggaagaaacggagc

SEQ ID NO: 190233 - RNA, 78 nt, Homo sapiens
gggacgaagaggcgguagcaguagagucagccugagacucucagagcacgacggccacacgcccccuuaggcccucgg

SEQ ID NO: 190234 - RNA, 45 nt, Homo sapiens
gucggaccccggcuccauggugggcccgaggucugggccagggau

SEQ ID NO: 190235 - RNA, 46 nt, Homo sapiens
ucgccggcggcgagacggaaugaagcaguaggauagccagcggcga

SEQ ID NO: 190236 - RNA, 41 nt, Homo sapiens
ggagaggggguggcugggaccguugugguugcggcgcggau

SEQ ID NO: 190237 - RNA, 53 nt, Homo sapiens
caggaggccguccuuuucacugcucaacagugugcuucucucuaauccaggau

SEQ ID NO: 190238 - RNA, 45 nt, Homo sapiens
cugguugaaguuugaaguacucgcucaagugaugcuugggcccag

SEQ ID NO: 190239 - RNA, 49 nt, Homo sapiens
gggugcccggaguuuuggguuugagcaccuuuuuagcuggguuaccugu

SEQ ID NO: 190240 - RNA, 44 nt, Homo sapiens
aucucaggcccuuuaaacugagagaacaaacauuaaaggcccaa

SEQ ID NO: 190241 - RNA, 116 nt, Homo sapiens
ugagcuacccugcauguguauugugagguguggucagccuuagaugucaggucauaacggugacuccuuugaauaacauuuucauuugaaaacuaguuuuaauuuuccauauuggu

SEQ ID NO: 190242 - RNA, 51 nt, Homo sapiens
ugguuggguaggauguuugcagguuaaagggucuggaguggcuagagguuu

SEQ ID NO: 190243 - RNA, 46 nt, Homo sapiens
uaaaccugaaguuguccacuuccacagcaaaggguggcugccaguc

SEQ ID NO: 190244 - RNA, 52 nt, Homo sapiens
uggaaguggacaacuucagguuuaccccccgaauccagaggcugaaugagcu

SEQ ID NO: 190245 - RNA, 42 nt, Homo sapiens
ggagcagggaugaggccaacuucagaaagcuaaggggcugag

SEQ ID NO: 190246 - RNA, 47 nt, Homo sapiens
ucugggaaauccagggcuccuccuuaaagauucccaauguagaacgg

SEQ ID NO: 190247 - RNA, 45 nt, Homo sapiens
gccaauauuuuugccugguggauaguugaggcgcugggcuacccg

SEQ ID NO: 190248 - RNA, 45 nt, Homo sapiens
acgcucccacuacgaacgcauuguuuaucccuaugaaauguacca

SEQ ID NO: 190249 - RNA, 44 nt, Homo sapiens
ccaaguucaacagcuauggccggcgggccaagagacugcagccu

SEQ ID NO: 190250 - RNA, 47 nt, Homo sapiens
uuuuucagcucuggauucuucucaaugucuuccucuguggguuccgg

SEQ ID NO: 190251 - RNA, 109 nt, Homo sapiens
gaagacauugagaagaauccagagcugaaaaagcuacagaucuauggggcaggccccaagaugaugggccugggccucauggccaaagacaagacucugcggaagaaag

SEQ ID NO: 190252 - RNA, 77 nt, Homo sapiens
ucccagauaaggaggggccugaguguccccccacaguaguggugaaggaggaguuagguggggaugugaagguggag

SEQ ID NO: 190253 - RNA, 77 nt, Homo sapiens
agagcaaggaggagcugagucacagcccagaacccugcaccaagaugaccaugaggcuacggaggaaccacagcaau

SEQ ID NO: 190254 - RNA, 26 nt, Homo sapiens
gccuccccacuccacaucugccucau

SEQ ID NO: 190255 - RNA, 97 nt, Homo sapiens
guagucagcuuuaaaggagucggccaucucgccaaagcucugcagaguguauucccggguagccugcucaaagccaaaggcuucugggggccgcuua

SEQ ID NO: 190256 - RNA, 48 nt, Homo sapiens
uggugcccacagaacuuguggagaaggaguucuggaggcugguaaaua

SEQ ID NO: 190257 - RNA, 45 nt, Homo sapiens
caauaugccagcaaaaggcugagaagaccaugcccacguagagcc

SEQ ID NO: 190258 - RNA, 61 nt, Homo sapiens
guguaugcauagcugagugcuggacagaggaguaaauaaguggaauaaagcauuaaaggug

SEQ ID NO: 190259 - RNA, 54 nt, Homo sapiens
uaaucaugugggcauggggauuccagugagaggcucucagcugaggcauuacau

SEQ ID NO: 190260 - RNA, 94 nt, Homo sapiens
ugccucuaaguagagauagauuugagaagaaaauaugacggaggugggagcugaugcaugguccaaauaaauguggagauauguuuaugaaugg

SEQ ID NO: 190261 - RNA, 58 nt, Homo sapiens
uguaaaaaguguauguuuuccacuuuugaaagaugaauaguugaggaaaucucccaaa

SEQ ID NO: 190262 - RNA, 45 nt, Homo sapiens
gggccuacccaguacaugagugaaaagaaauucauaccaagauau

SEQ ID NO: 190263 - RNA, 46 nt, Homo sapiens
ggauuuucaucuuagaauucuauauacagucaagugugagaguaag

SEQ ID NO: 190264 - RNA, 46 nt, Homo sapiens
cuucucccaugaggagcuuaucugcaagauggcugccugcccagag

SEQ ID NO: 190265 - RNA, 44 nt, Homo sapiens
gaagguggggagaguaccccagaucaagcacccuauucuggugg

SEQ ID NO: 190266 - RNA, 35 nt, Homo sapiens
augauuuacucaugaucacacagcauauaaguggc

SEQ ID NO: 190267 - RNA, 49 nt, Homo sapiens
aaagcuagaaguguuuauuuuuuaucaguaccuggaaguggccugagag

SEQ ID NO: 190268 - RNA, 31 nt, Homo sapiens
aagagcuacacuuugcaauccauccucuacu

SEQ ID NO: 190269 - RNA, 46 nt, Homo sapiens
agcugagacagcuagagcuacagguacugacagcgcacuccuggag

SEQ ID NO: 190270 - RNA, 42 nt, Homo sapiens
uguggguaggcuguugacugcacaucaccauagugacccaug

SEQ ID NO: 190271 - RNA, 45 nt, Homo sapiens
ccaacacagggccagucaacuguggcaacagcgaggacagcagcu

SEQ ID NO: 190272 - RNA, 50 nt, Homo sapiens
cccuguguuggaacugccugaggcaacccgggcccccuuggaggagcuca

SEQ ID NO: 190273 - RNA, 43 nt, Homo sapiens
ccagaagugugcggauccucuccaggucugggggcuguccagc

SEQ ID NO: 190274 - RNA, 49 nt, Homo sapiens
aggcuggacagcccccagaccuggagaggauccgcacacuucuggaggu

SEQ ID NO: 190275 - RNA, 32 nt, Homo sapiens
ggccgaguagggagcccaggccugaccacugg

SEQ ID NO: 190276 - RNA, 44 nt, Homo sapiens
agagcgucacgggagucgggcucggggccgggcccuggagaggc

SEQ ID NO: 190277 - RNA, 45 nt, Homo sapiens
aaagaggguacggagcucagggccagaggcugaggagguccagga

SEQ ID NO: 190278 - RNA, 46 nt, Homo sapiens
ucuccuccuccagcucuuccuccuccuggaccuccucagccucugg

SEQ ID NO: 190279 - RNA, 49 nt, Homo sapiens
gggcggguagcagggauggccaccccccuacccgcccaccccccaagaa

SEQ ID NO: 190280 - RNA, 44 nt, Homo sapiens
ggcggguagggggguggccaucccugcuacccgcccaccccuga

SEQ ID NO: 190281 - RNA, 45 nt, Homo sapiens
cacuggccuugucucuggaauggugauggcccagccccagccacc

SEQ ID NO: 190282 - RNA, 44 nt, Homo sapiens
uuuuaaaggaauuuggcuggggagcugaacagggcucccuguga

SEQ ID NO: 190283 - RNA, 51 nt, Homo sapiens
uucuuaaccuugggcaagacauucugauccucccccgacucuaaccccaag

SEQ ID NO: 190284 - RNA, 167 nt, Homo sapiens
uugggggguuucuaaaguguagaucugauuauauacugcuuaaaaccuuccaugaugcuuuauugcccuuaagauuauacauagaaucucguucuuccuagaauguuuuccugucuaacccaucuacugcauaauucccugauuuuucuccacagguuaugccccug

SEQ ID NO: 190285 - RNA, 36 nt, Homo sapiens
augaaacccaugaacguucagaugagaaagcaaaau

SEQ ID NO: 190286 - RNA, 39 nt, Homo sapiens
ucagcacuuaacuaccacugccaaggcagucagccacag

SEQ ID NO: 190287 - RNA, 63 nt, Homo sapiens
uggcuuuuuuucauuuugucuugucuguaaucagcugccaccaagaaauaguuccacaggggg

SEQ ID NO: 190288 - RNA, 57 nt, Homo sapiens
aauagacccacuuuuccauuuuuauuuuucucugcuccugggacuccuguugucacg

SEQ ID NO: 190289 - RNA, 45 nt, Homo sapiens
uaaagcagggacuucuguuuuguucacugcuguauccccagugcc

SEQ ID NO: 190290 - RNA, 42 nt, Homo sapiens
cuuuucagggccuuuguacuuguucuucucacugccugaaac

SEQ ID NO: 190291 - RNA, 48 nt, Homo sapiens
uagccaacaauggccacauugaggauuuccccauagaaguccucuuug

SEQ ID NO: 190292 - RNA, 68 nt, Homo sapiens
uaccaugaaaauuuuaguuuucaucucaaacuagugacuugccuuuuuacccauacuuauacacaugu

SEQ ID NO: 190293 - RNA, 49 nt, Homo sapiens
uagaagacuccuggacaguuauuucauagaauuuggguuugucucaagu

SEQ ID NO: 190294 - RNA, 62 nt, Homo sapiens
uccgccucagggguuuugcauuccguguaucuggaaugcucuuuccucaaauacccacaagg

SEQ ID NO: 190295 - RNA, 37 nt, Homo sapiens
ccaucucugucucugucccacuuuuugagacguagua

SEQ ID NO: 190296 - RNA, 46 nt, Homo sapiens
uacgaggacgugauagagaucaucucagacgaaucaguggaagaag

SEQ ID NO: 190297 - RNA, 72 nt, Homo sapiens
ugaagauaaugauggcaacgaaggugacaaugagggcagugaugaugauggcaaugaaggugacaaugaagg

SEQ ID NO: 190298 - RNA, 70 nt, Homo sapiens
cgagagugcugaugaccacgaaaccacugacaacaaugagagugcagaugacaacaacgagaauccugaa

SEQ ID NO: 190299 - RNA, 39 nt, Homo sapiens
uggucgcugagaggugguuuguuggggauggggaaaaga

SEQ ID NO: 190300 - RNA, 58 nt, Homo sapiens
gacgugcauuuugugaacacaagcuuucagcacccagugacauauaccacaugcacau

SEQ ID NO: 190301 - RNA, 48 nt, Homo sapiens
agggggaagaggaggaacauagcauuaaaaaaaggaucacagaugaua

SEQ ID NO: 190302 - RNA, 46 nt, Homo sapiens
uccguaggucagaagcccgugacaggaaaggggaaggugggggagg

SEQ ID NO: 190303 - RNA, 44 nt, Homo sapiens
cggcggaggaggaagcagaggaaggugaagagggaaagcagaga

SEQ ID NO: 190304 - RNA, 90 nt, Homo sapiens
ggggugggcgccccagagguuaguugacccgaagagcaaggaagaggcgaucaucauaguggaggaugaggaugaggaugagcgggagag

SEQ ID NO: 190305 - RNA, 45 nt, Homo sapiens
gcugaacuccccagaguagcuggaccacagagacuugggucagag

SEQ ID NO: 190306 - RNA, 48 nt, Homo sapiens
ccagaccucccaaaugguucuugugcaucuguuggagaagucaaggga

SEQ ID NO: 190307 - RNA, 59 nt, Homo sapiens
aauucagaaaaagaaaagaacacugagaaugcagguuuuucuacuaacagcugaggaga

SEQ ID NO: 190308 - RNA, 23 nt, Homo sapiens
uauuguuugggggggaugugggg

SEQ ID NO: 190309 - RNA, 74 nt, Homo sapiens
cuaagaccgcgaagaccuauaggaugugagcagggcucagccuaugucugaacgucuacauggcuaugaaucag

SEQ ID NO: 190310 - RNA, 47 nt, Homo sapiens
gaggguguggguguaucaguguuggguauauguaugaaaguaggugu

SEQ ID NO: 190311 - RNA, 45 nt, Homo sapiens
agagagagauuguaggugugccugguucagguaugagggcucuga

SEQ ID NO: 190312 - RNA, 32 nt, Homo sapiens
cuucuucuccagggucucagcagagaucuggg

SEQ ID NO: 190313 - RNA, 66 nt, Homo sapiens
cuugaucuuuuucugccaugaaguuuaaagauucuaugcccauuuccuugauugaaauggcaggau

SEQ ID NO: 190314 - RNA, 43 nt, Homo sapiens
ccacuauggacuugauggaaggcaucuuccccaaagacgagca

SEQ ID NO: 190315 - RNA, 27 nt, Homo sapiens
aagacuuuuuacauguguguggggagu

SEQ ID NO: 190316 - RNA, 79 nt, Homo sapiens
cugaagauuugguaccaaguugaugaaugguuggcauauuucuuuucauuacggaauagaaccuuugaggucauacucu

SEQ ID NO: 190317 - RNA, 42 nt, Homo sapiens
ucuuuggucugcauuuacugacucacaagaguaggugucauu

SEQ ID NO: 190318 - RNA, 52 nt, Homo sapiens
gauuaguuuuggcuauauuucuaaaugguuggaaugccuuugcuuuacuaaa

SEQ ID NO: 190319 - RNA, 44 nt, Homo sapiens
gcugcuuccuggaggggcuguggugcugaggucuggggcugcgu

SEQ ID NO: 190320 - RNA, 48 nt, Homo sapiens
uauaggcugcaaagcagcauauguuauuuggagaaaugagcaagaguu

SEQ ID NO: 190321 - RNA, 43 nt, Homo sapiens
gcuccuucauguagauuucagaauaaguaacagagauuuauca

SEQ ID NO: 190322 - RNA, 52 nt, Homo sapiens
agaguauauccuaaaucccaauaccagcugcaaaauugaaugcauacgaaau

SEQ ID NO: 190323 - RNA, 96 nt, Homo sapiens
uacaugcucaauaaaugguuggauggauggagggacugguggauggacagaugggugguugaguagacagauggauggaccaguccucagguagau

SEQ ID NO: 190324 - RNA, 46 nt, Homo sapiens
acgguucacagcugagcagaaauugaaguccuacucggaaccugag

SEQ ID NO: 190325 - RNA, 44 nt, Homo sapiens
agcucagaugugcgcuucccucagucuccucauagcggccgaca

SEQ ID NO: 190326 - RNA, 86 nt, Homo sapiens
cccuguguucucagaggcggcugcggcacagcacuuuacggcccuggcccaggcucagccucguggugaccggagaccagagcuca

SEQ ID NO: 190327 - RNA, 55 nt, Homo sapiens
ugggagguccaauuuugggccagucugguauguucccgauaagaagaaagcacca

SEQ ID NO: 190328 - RNA, 67 nt, Homo sapiens
agcucaguuguuucccgcccaggguccccggugacagcggcaaaggccccaggccagaguacaaugc

SEQ ID NO: 190329 - RNA, 50 nt, Homo sapiens
cgacucggccuacggcuccuucuccaccagcucuagcacuccugaccaca

SEQ ID NO: 190330 - RNA, 48 nt, Homo sapiens
gugcccugugugcgguccccaagcccccugcacuguuuggcacgagag

SEQ ID NO: 190331 - RNA, 42 nt, Homo sapiens
cagccuucagucuacucaaguccuucugggagcccuugaaac

SEQ ID NO: 190332 - RNA, 38 nt, Homo sapiens
acccccaccccacucccccagcaccccacccccuccag

SEQ ID NO: 190333 - RNA, 48 nt, Homo sapiens
gggagccaccgguccccaucugcagcugcaacucaagaugucuauaga

SEQ ID NO: 190334 - RNA, 31 nt, Homo sapiens
uuucccaacgugucucuuuccuggaugaguc

SEQ ID NO: 190335 - RNA, 51 nt, Homo sapiens
gcauccugucuuuguuuaagaccagaagaaaagggaaagggugguaccaga

SEQ ID NO: 190336 - RNA, 42 nt, Homo sapiens
ugcuucuaaucuaauguagaauugcagcugcagcauagaaag

SEQ ID NO: 190337 - RNA, 98 nt, Homo sapiens
aguccuaaggucagagagcucccgccuccaugaaacuaucacuguggggcagaugaugagcaaaccacacacccgaaacaucacacaugcgcccccuu

SEQ ID NO: 190338 - RNA, 55 nt, Homo sapiens
guccuugcuggcucaguguuugugugccuggccaauauaauguguggcagguucc

SEQ ID NO: 190339 - RNA, 50 nt, Homo sapiens
uaagccaaauauuuuaaaaacguguuucauguugccucucucugaccuca

SEQ ID NO: 190340 - RNA, 39 nt, Homo sapiens
ucauugcuuucccgugccacccugacaagagugguuccc

SEQ ID NO: 190341 - RNA, 32 nt, Homo sapiens
ugguaucgguacuccauucccuuccggugcca

SEQ ID NO: 190342 - RNA, 48 nt, Homo sapiens
gauucugauguccagaaucuuacagagaauuuuuuucuuuauguaaag

SEQ ID NO: 190343 - RNA, 96 nt, Homo sapiens
caggaauuucugaaauuuuaaagccuguugguuguaauaaauauugcaccccaccacauuugcuaccacauuugcgaacuuuuauuuaguauuuga

SEQ ID NO: 190344 - RNA, 41 nt, Homo sapiens
ugcucuuccuucuccuccccggggaugauuuccugggagcc

SEQ ID NO: 190345 - RNA, 39 nt, Homo sapiens
ugccaguugaggggaucucuccuuugcucagcugggcga

SEQ ID NO: 190346 - RNA, 31 nt, Homo sapiens
gauucuuccauaucugugacaguauuaaacu

SEQ ID NO: 190347 - RNA, 89 nt, Homo sapiens
cuccuaacugugauauuaggcgucgauuucauggugcucacuugagcuaaggaaagccucaucugggagguucugcaaaaguuagaagu

SEQ ID NO: 190348 - RNA, 44 nt, Homo sapiens
cugugguagcgagcacccccgaagacgaccugagcggccccgag

SEQ ID NO: 190349 - RNA, 46 nt, Homo sapiens
gccguaaugcgagagccgcagaagagaaccgcaacaaucgcaaaau

SEQ ID NO: 190350 - RNA, 47 nt, Homo sapiens
aaggguaguucccacgccagcugacuugcgcgagcagccgccgccag

SEQ ID NO: 190351 - RNA, 60 nt, Homo sapiens
aagcacugggaacuaaaguaugccuuaaggcuguugccauggggauggagaggcagaaag

SEQ ID NO: 190352 - RNA, 40 nt, Homo sapiens
caagcggugugugaguguggcauuuaauaaaugcgugcug

SEQ ID NO: 190353 - RNA, 46 nt, Homo sapiens
uguauccuccuagacaggacaucuuuauucuaauucacacaaagac

SEQ ID NO: 190354 - RNA, 43 nt, Homo sapiens
ugaagaguacugaagauuuagaagggacuggaaaggacuuguu

SEQ ID NO: 190355 - RNA, 48 nt, Homo sapiens
caaauugaagagaguauugugaauuagaacacuucuccccaccccgca

SEQ ID NO: 190356 - RNA, 56 nt, Homo sapiens
aaaaugggaccucuauucaucugaggucccacacacacagcuguacucagccguug

SEQ ID NO: 190357 - RNA, 40 nt, Homo sapiens
agucuugaaggauaacugcaauuuagcugaaggaagaaaa

SEQ ID NO: 190358 - RNA, 40 nt, Homo sapiens
gaucaaaggcagagguggaaagauugaccuugaucagaag

SEQ ID NO: 190359 - RNA, 46 nt, Homo sapiens
aaagcaguaguuacaccuugucuucguugaaagguaaauuacggug

SEQ ID NO: 190360 - RNA, 38 nt, Homo sapiens
aguauauacuaauugggcugccauggacagugaaugua

SEQ ID NO: 190361 - RNA, 46 nt, Homo sapiens
cccuaggaaauaaaggagaaggaaaccucauuucuguuauuaucgu

SEQ ID NO: 190362 - RNA, 64 nt, Homo sapiens
uuuuggaguaacuuucguuaugaggagacuuacuaaaaaacucuuucaaauaguucaaauuccc

SEQ ID NO: 190363 - RNA, 37 nt, Homo sapiens
cucuggaaugucuaccuguccaaacuucucucugcuu

SEQ ID NO: 190364 - RNA, 47 nt, Homo sapiens
uuuuaaaauauugcauugauuuuaauguuuuaguguuuuucuaguuu

SEQ ID NO: 190365 - RNA, 64 nt, Homo sapiens
uucugguagauuuggggagaaugaugaggaaaaaaguggacugaaggaugaaacugagguuuug

SEQ ID NO: 190366 - RNA, 64 nt, Homo sapiens
gcuuaggcaacugguugaauucacuaagauaagacugaaagaggaauagauuuuguaggaagaa

SEQ ID NO: 190367 - RNA, 52 nt, Homo sapiens
gacuagcuugccuuggggaagguggccaaggauggaguccugaagagcucca

SEQ ID NO: 190368 - RNA, 44 nt, Homo sapiens
uuguaagggaggaucugccagagaaguuguagguaugauaucag

SEQ ID NO: 190369 - RNA, 42 nt, Homo sapiens
gaagcggaaacuaauacccagagcuuaagugacuugcccaag

SEQ ID NO: 190370 - RNA, 40 nt, Homo sapiens
ggagagaugaugguaaguagggguagcuaggcagggcuuu

SEQ ID NO: 190371 - RNA, 52 nt, Homo sapiens
guuuguuuuuuguuacuuuuuuuuuuaauuuuuguguguaugugagguuggu

SEQ ID NO: 190372 - RNA, 33 nt, Homo sapiens
aguguguuuagaacauaaggagaggggcagaga

SEQ ID NO: 190373 - RNA, 54 nt, Homo sapiens
uuauauagauauuuuuccauaucuauauaugugucugagaaagauauauacaag

SEQ ID NO: 190374 - RNA, 46 nt, Homo sapiens
ugccacuaguuucucuuuuaaugguauauuauucuauugaggggag

SEQ ID NO: 190375 - RNA, 46 nt, Homo sapiens
gcgugaugcccauagauuugagaaaauaagcaacauuauuaagcag

SEQ ID NO: 190376 - RNA, 42 nt, Homo sapiens
agcccagugacaccauugagaaugucagugcgaaaauucaag

SEQ ID NO: 190377 - RNA, 40 nt, Homo sapiens
uguguuaaaguuaucccguuuuaauucaaaauaaagucag

SEQ ID NO: 190378 - RNA, 43 nt, Homo sapiens
uaggcugaagagguacaaguaggaaauaauuucuggaacuuua

SEQ ID NO: 190379 - RNA, 43 nt, Homo sapiens
ggauguagugauaaugguaguguauguuugcuagugggugugu

SEQ ID NO: 190380 - RNA, 57 nt, Homo sapiens
agaggaggagguggucgggggagcaggggagugaggggaggaguggaggggaacagg

SEQ ID NO: 190381 - RNA, 22 nt, Homo sapiens
ccaugugaaacagugggccuua

SEQ ID NO: 190382 - RNA, 36 nt, Homo sapiens
uauguuuaccccaccuuggcacugugcuuugcugag

SEQ ID NO: 190383 - RNA, 56 nt, Homo sapiens
cuaugacugugaaagggauaaucaagaaaggaaaagauaaagggcaaaggaaggag

SEQ ID NO: 190384 - RNA, 46 nt, Homo sapiens
gauucugccuucacaguaaggauucuagugggagagauaggcauag

SEQ ID NO: 190385 - RNA, 45 nt, Homo sapiens
uucucaagccuucuuuuuuuuauuguuguuguucuacugggagca

SEQ ID NO: 190386 - RNA, 41 nt, Homo sapiens
ccuccucauuuuccagcccggagaaauaggggagugggggc

SEQ ID NO: 190387 - RNA, 45 nt, Homo sapiens
gcuaugucagaauggggcgggugugaggggaacagcucucuugcg

SEQ ID NO: 190388 - RNA, 30 nt, Homo sapiens
cccacuugggguuucagcagugggggcggg

SEQ ID NO: 190389 - RNA, 51 nt, Homo sapiens
cggcccuuuaagacguggccaaggcaguugguucgucuguguagguggaag

SEQ ID NO: 190390 - RNA, 46 nt, Homo sapiens
acugcugauaaaauuaguguuuuucuguccuuaaaacaccuuccag

SEQ ID NO: 190391 - RNA, 45 nt, Homo sapiens
ggggagcaaugucuucagguaagccuggagggcagacaggcagaa

SEQ ID NO: 190392 - RNA, 40 nt, Homo sapiens
agaaugugaggucagguaacucucauacagcccacagggg

SEQ ID NO: 190393 - RNA, 50 nt, Homo sapiens
uguuuggcccaugguguauaaaugaauuugcuuaaguugcauaugcauau

SEQ ID NO: 190394 - RNA, 34 nt, Homo sapiens
aguagcuauucucuuugauagugauugacuagag

SEQ ID NO: 190395 - RNA, 49 nt, Homo sapiens
gcuacucaagugaagaguuaugugggaaauguaggaaaaauaagagcuu

SEQ ID NO: 190396 - RNA, 45 nt, Homo sapiens
auggagaacccagcacuguuuaaugacaucaagauugagccccca

SEQ ID NO: 190397 - RNA, 44 nt, Homo sapiens
aauggcccaaaugcagggagaagagucgcuugacuugaagagaa

SEQ ID NO: 190398 - RNA, 58 nt, Homo sapiens
cuaucuugagcauacauauccuauauauaauucaaauacaacccaaagauucugggca

SEQ ID NO: 190399 - RNA, 65 nt, Homo sapiens
ugaggcacauucccagugaauaagcugagucccauaccacacucaaaagguuuuaauaaaucuaa

SEQ ID NO: 190400 - RNA, 46 nt, Homo sapiens
auuuguuagguuaaauuuggacaaauauucaaagcacacauagaca

SEQ ID NO: 190401 - RNA, 59 nt, Homo sapiens
agaccuaggaugauccugagaacaaauagagggguuccuuuacuuguauaggauaucaa

SEQ ID NO: 190402 - RNA, 58 nt, Homo sapiens
cacaaagaagcaauugaguauauugcaugaugagaaaucacacacuagggucauguua

SEQ ID NO: 190403 - RNA, 51 nt, Homo sapiens
uucacuccauggaauuauuggcauucauuccuguguuucaaaugaaacaua

SEQ ID NO: 190404 - RNA, 58 nt, Homo sapiens
ugauguucugcaacugcuaugaaaaccuaagccauuuauuuuagcugauagcagauug

SEQ ID NO: 190405 - RNA, 41 nt, Homo sapiens
ucucuuuaaaagauugucuuuauauugaacaccuuuuucuu

SEQ ID NO: 190406 - RNA, 47 nt, Homo sapiens
uuacucauuuuuuucaaaauuuggauccugauacuccuuuuucagag

SEQ ID NO: 190407 - RNA, 45 nt, Homo sapiens
gauuaggcuuccuaggugauaaacagauaaauuugaguaagaagg

SEQ ID NO: 190408 - RNA, 71 nt, Homo sapiens
aucuuuuaagauuuuuccggcaaaaaucagcacuagcugaucgguuugggauuugaagcguuucgaaaucg

SEQ ID NO: 190409 - RNA, 52 nt, Homo sapiens
cucaagcccaggcugcuaaggccugcaaguccucccaggcuccccaacccaa

SEQ ID NO: 190410 - RNA, 63 nt, Homo sapiens
cccugagaugaugauccaaauaauggaaaaucccuuuguucagagcaugcuuucgaaucccga

SEQ ID NO: 190411 - RNA, 63 nt, Homo sapiens
auuucuggguuucucugaaucaauugcugcaucuguggauuagccauaaugagcugccucauc

SEQ ID NO: 190412 - RNA, 85 nt, Homo sapiens
ucugaugaggcagcucauuauggcuaauccacagaugcagcaauugauucagagaaacccagaaaucagucaccugcucaacaac

SEQ ID NO: 190413 - RNA, 45 nt, Homo sapiens
gaguaguuccuccucuggggaagguacgcagccuucccgcacaga

SEQ ID NO: 190414 - RNA, 46 nt, Homo sapiens
ccugcagcagaugcagaauccagacacacuaucagccaugucaaac

SEQ ID NO: 190415 - RNA, 45 nt, Homo sapiens
cuggaacagcucaacgcaaugggguucuuaaaccgugaagcaaac

SEQ ID NO: 190416 - RNA, 46 nt, Homo sapiens
uucuccuuugcuuauuuuuccuaccuucccuuccucuugucucccc

SEQ ID NO: 190417 - RNA, 46 nt, Homo sapiens
cucacaauuuuguagaaucuuacagcaucuuugauaaacuucucag

SEQ ID NO: 190418 - RNA, 48 nt, Homo sapiens
aaaaucaaccugaaucgaaaggauaugucucugugacuucucugaugg

SEQ ID NO: 190419 - RNA, 73 nt, Homo sapiens
ggaaagagaggugagcaccaggcgggaggcgagggaugggaauguacgggggaugaauaccacagagccaugg

SEQ ID NO: 190420 - RNA, 41 nt, Homo sapiens
auaccauaauuggcaaagcagugaaacacauguuugaggga

SEQ ID NO: 190421 - RNA, 52 nt, Homo sapiens
acuacaaaagaaugcuggcuuuuuuuauguuguauuccuuaguugaguuuua

SEQ ID NO: 190422 - RNA, 47 nt, Homo sapiens
cagcggaagugacaaauuuacaacuuuuauuauagaaagaagguguu

SEQ ID NO: 190423 - RNA, 39 nt, Homo sapiens
accuguauuaucccaggauguauauuauguaucgcuguu

SEQ ID NO: 190424 - RNA, 79 nt, Homo sapiens
agucagucuaaauccaacaaacaauuaggaaaaaauggagacgaagagacaccccacaaaacaacaaaagacaucaaag

SEQ ID NO: 190425 - RNA, 40 nt, Homo sapiens
auuuccucaucuaguuuuauagagccaauauucccaacca

SEQ ID NO: 190426 - RNA, 49 nt, Homo sapiens
uuaaaaggagacauucugaugaaucaaaagaaagauauacuaggagcaa

SEQ ID NO: 190427 - RNA, 1557 nt, Homo sapiens
aaaucacugaugccucaaguaaguugccauaauuuaucuauugugucauaucuauuagauguccauauugaauagaauuaucuagaaggaaaaucuuuaucuuuucuucaguuaguugauauaaaaguaaguuuuauaaagaauuacauuuuucuagcuuacuuaauuuuuuuuuuuuuuuuggagacggagucuugcuguauugcccagacuggagugcaguggcacgaucucagcucacugcaaccucugccucccagguuuaagugauucuucugccucagccucccaaguagcugggacuacaggugccugccaccacacccggcuaauuuuuguauuuuuaguagagacaggguuucaccauauuggccaggcuggucucgaacuccagaccucgugaucugcccaccucagccucccaaagugcugggauuacaggcaugagccacugcgcccggccguagcucacuuaauuuuaaaaauuguuuuuauaguccauuuguaaaaacuaaauucauaaaguaugaauuuuagauauucuugauuaugaguuaucagcaaguuaaugacuuuaaauaaauauaauuuuauuuauguauauuaagcauacaguucaacauuauuccuaucaaaaaauaaagugauaaaauuaguagauacaucucuuacuauauuguguccaucaguuguuagaauaagauucauuaaauauaagguaguaucgaaauuggaagaucuuacccuaugucaauuuucauguuaucagcaaaauauuucuggguugugaccguaggauaguuaauuuauuccagaauacuaaggacucacuugucuggugaaguuuggaaauuaaacagucugauuauuaaguuaagguuuuuauaauacauaguauauauggaucgagacuuccagugaacacaauaaauuagauaugauaaaaaccaauaacaaauacaauuuaacuguuacaguuaaggauuaaaauaauccuuaaaaugucauacaguucaacuuuaaaaaaaauuaacuauccuaucacuauuaauauuacuauaaauauuauuacaauugagaaaacuucagcccagcuuaagcuauuuuuucugaggacauaagacuaugccacuaauuuuaccacuuuguuaaaaauaaauaauaaaaauguaaaagaaaacacacacaaaaaugugaauaaaaauauuuuacuuacaguauccucaaaaauguaaauaaaauaguacuuuguggcauuaaggauauauuuuuucauucaugccaccucaguggauuauuagcuuuuuauuuguaucugucuuuuucugaagucaaacaaaucagaacuuuuagaagucaagguaucuuagguuuagucaaaacaggaguagaacccugaucucucaguccaguguauuuuuuacaguauguucugaguuauuuugaauuagccaauaggaauauguacuuuugauuuuugauacugaaauaucaaaucaugaaaaugccuuuucuucuaaacagauuauuccugguaaaaaauaugcagccagaauu

SEQ ID NO: 190428 - RNA, 12568 nt, Homo sapiens
auguucagccagguaagcauuauuaacuaauaaaaucaugaauuuuauuuuuuaaaaaguuuugauuauccuugggggaaauaagguaguuuauuuacuagcuuuauucugagugacuugaauacuagaguucagugcuuauuuugaacuggauuacauauaacagccacuuaauaucagacucuguuaccaggcugguggcucacaccuguauucccagcacuuugggaggcugacacaggagggucacaccaggaguucaugaccagccuaggcaacaaagcaagauccugucuuuacaaaauaaaaauuaaaaaauuagccaggcaugguggugugggcauguaaacucggcuacuugggaggcucaggugggaggauuccuugagcccaggaguucaaggcugcagugagcuaugaucacaugauuauaccacuguacuccagccugggugacagagugagacugugucucaaaaacaaacaaaaacauuuauggauuuuuucuuaacauagaguuguuguguggcauggauauggauaagcaguuuugguggaaugaugggugcaaaagccugauaguagugagcuuaagagaauggggaaagaauacuuggagacaauucguauagaaaacucuuuugaaggguguugauaagaaaugguggcagugcuggguauguggucaagaaaggaugguaagauaagaggguuuuggcuuuuuuaaaccaguuugggccagacacaguagcucaagucuguaaucccagcacuuugggaggccaaggugggcagaucacuugaggucaggaguuugagaccagccugggcaacauggugaaaccccaucucuacuaaaaauacaaaaauuagccagguauuguggugggcgccuguaauuccagcuacuuagguggcugaggcacaagaaucgcuggaaccugggaggcagagguugcagugagccaagaucgcaccacugcacuccagccugggugacagagugauauacucugucucaaaaaaaaaaaauaguuacauguuuuucuguugcaacuuuuuagcuauaauagugauggcauagacauggaaaauucuguuaaauaggauuaaaguuuuuucaguuguguauuacucaucaagaaaggguuuaaggagugaauaaaugaugagccacagaaucuaagcugguuaagaagggaugugagagaggaugagggauggaggaaagguaacaagaucaguggaucugaggaauuguugguuucugaguaggauguagcuagagcagcaguauuuuucgacaggagugcuauuggcguuuugagugcagaacuguauuacaggauauguacuagacauggccccccauccaccaaaugccaucauuauuuuccauucagagugaugaccaaaaagaaaccccugcacauuacuaaauauccuugaaggggugcagagugucagacacuguuguuuuuuucuaguaaguacaacuaugaccacugcacuaacuggcuaagguagaaaggaggugaaaaucauuuggaaaaaaggucaucaagaccacaguauucaaagauuaauaucuauauggauuaugaaaucacuaaaucauuaagaauuuugacaaaaguaauguuagagaaagcaacagggagccagggucugugauccaggaaucaaagacuacaacacugauaagaauagcagauaauagaguuaaauuacaaucagacaugaguaugguaaaaaggagagagaauuguccaaaaauggcaacauggaucaaggaagaagauaccuguucuucccccaggcccaguguggcaaaggauagaaaagaacacagucaccacuugaaagggcuaaagguaaccaugucuccaaaacaaagcuaaguuucaauuagagaaaggugaagaaaaaguugugaaaauauaacugauggucuagccuuucaguuuuaucucucuuagcccuucauguaguuuaguuuuucuuggaaugugggauuaauguccuguacuuccuuacuucuuugccuuuauuuucuuccuugagacuagaauuucucccuucucccuuuccucccauuuuccagugacuucucuuguaaaaacucuuccuaucuuuccagcuguaagcaaauaguuuucauauguaaaaccccuuaacuuccucuguaucuuuccuauauuuguaauuuucuauuuagugcuauauuuuauuuauuuaaauacaaauuuauuuaaaauauuuauuuauuuaaacuguggagcuuccuugggguagcaggaacaucugauucauuuuuguaccccugcaucaucaaguaggguccuauacgcagucagcagucucuaaauauuuuaauuaauuacuuucuuaagucuugagaugugcaaugcauggauuaauuauauucuaagaguuuuuagagaagcagccaucuuugauugucaggcacacaagggcuuugagacugagauguuacuuaggccccucagacucuucuuucuuguuucuaaaaugggauaguaauuucugucucacaguauuguuguaaauacuaaguuaagugugugugggguguguguacacauucaguuuugucuagugaauagugugccuaucacaggauguugcagacauggacacucaguuuuuaaauaauuuuucccccucauugucaauugucacuaauugcuguuuuugagauauuugcugaaccuuucuucaguuugacuucacuaucacacuuugagaauugcuguuucuauuaaucauaagccaugagauaggaaaacaaguaaaccaguuuauuauauuaugaauaaagcguuuuuuaaacuuagaaauauugaauguggcaucugagguuucuuggcuuauuccauguuuuuuuaagcuguauucuuccuagauggguuugacagaugaaaugacauguuauuuuacuguaucuuagauaguuuagacggggcaagacagugaccaggauaagguuaagagggacaacuagugugaugguuaguuaaaaguuuggacucuggcaucagaccuuuucucaaauuuaguucaaucacucuaaguuuucuaucuauaaauuuggaguaauaauaccuccauucuuuuguauggguuauguuaaauacugguuauauaagacuuaggccaguuucuaggcaauaauguauauucaauaaauaugagcugguaaguauuaauggcauuauuuucacuggagccaggaaaggagguugcugagucuguccugcagacucuggcugagugauggaugaaagagguaugcugacacagguauuuugccugacaguguggcuaggagacugcacagcuuagcaccgccaaugagagagugcagcagccaccaagagagugcagcccccguaagcaggccccggucgcauuuauuuaauacagauuuaaugacacaggcuuggagcaaacacaauuuguggguaauaaacauugucaacccccggaguagagagcaguccugugcgcaaaugaucaaagauugguuucuggagacaggaguaaacaaauuuaucuagauaaguuccuuuacauucccuuguuaucuacccuuugcucucaggcucuggauaagagaaucuggcugccuucagccauaauucucuucugaagcuuuugcaaaaccuccuggccuuccaaaaagauuugcaucuuucccuauaacuuuuucuuacaacuuuucccacuacccugaccgaacuccuacaucucacccuuuucuguuuuuugcaucagguuuuguugauugaagaguacagaugugugcagcaacagguuugucaggcacagcaguuaacacucguauuccggcuuugcauccuagaauuaguaaauaacauaagacaaacaugaguauaaucaguaauauucuuuuccaauuaaggagugacauguaguguuacuuggcaccucaguccagugugugucauuacuaaggaaccccacuggggguauguuaaucccuccuagccaagcaguuacguuauuagaggccgggaagggggugucugcccagguaacagggugaaagaaaggcggauuuagaagaugggccuaauagagaguagcagguacagauagcaggaaaagugagagaauaagaaaaaccaauguccuaugagaguuguaauguacaacagaaagcauaguaaggaacaaauuaucuggagugaauggugucuguguccagaacaggauucccucagccuccugaguuaucuucuucagcaucccgcagguaauguuuggggcuugugucauucaagaaaaccgcaucuucuggggcugcaggugcugcagggucguuuccuucauuucugguaccagguuggguccuagcgacaccauaguaugguuugaugcaucaugcuggaauccauagaggacuugagggggugugaacacaagcauauucucuuccccaugucaacaaaucauuuggaccacaccauacauuacuauuuacaucuuuccauaaaaccacagguuuuauguuuugaagaacuuuagugaaaugcuuuucuauggcugauugaaauuuaucaucuaaauuuuaaaaauuaaggguaaauaaggcuugugccaauaguguugcaggauccuuacucauauucccccuuuuuaguuucuugagcauauuuuuaaggguagaguggacacguucuacuauggccuguccuugagguuauaagggauaccuguggaauguuggauguuccacgugugacaaaauuguugacauugugagcuggcauaagccagaccauuaucaguuuuaauuuuugugggccaccccauaaacacaaaaguuaagagaaaauguuuaauaacauauugggaggacucuucaggaagagcaugugugcuaauuaggugagaauugguaucaauggauacauguauaucuaaguuuuccaaauucaaggaugugaauaacauuuguuugccauaaccgauuagguucuaguccucuaggguuaacaccuguugaaggaggagacaugccugugaguuggcaaugugggcauuguaaaauaauuuguuuagcuagucuuuggguagguugaaauuguuuaguuaaguuucuucaguuuugguggaaaaauugaugcaauugggugguuuggucaagcagugacgucauaacuugcaggucugcuuguucauugccauaagccagugggccaggcagugagcugugggcucgaguauguguguuaaaaauaggauauguacauugauccagcaauugcugaaguugaagaaaaaguguacacaggugggcucgagaguggacuuaaugagggcugucuuaagcuucuguaauaaauagaguaagcagagucauuaacaauauugauaagcugagcagaaaaggucuccagggccaauauuaaggcuccaaccucagcucucugagugcugguaaauccagaacaagugagggaauuaugcaguuuccaccaaauagccacuuuuccauuuuuaccagagccaucagugaaaagcguuaaagcauuggguaugggggagugaacuacuuguguagacacaacuacaggaguacgagaaaagaacugaaguaguuugucagcaggaagggcaugcucugcauggccugcauaauuagagagugcuaucugaagaucuagagauaggggcaauauugcuucgaguugcuuuuuacucaaaggaauucuuaugacaucagggucauaaccuagaaacugauugcaucaucugcagccuguauaggugacuuuacuaacuagcuggauauagggagauaguguuuuagucccaguacgugagcaaaaaacccauccuaggaagcauagcccuggggcugucuguccuauuaauccuguuggggaauguuuaguagggaaaacaaacaauugaacugaauauugcaggucugugcaaucuaguuaccucugagaaacagcuugcucuauuuuuucaauuucccuuuuugcugcaggaguuaaauaccugagagagucuaaggcuguauugcccuuuaggauagaaaacagguuauguaacuuaucaguaguuaugcccaagauggggcaaagccaauuaauaucgcccaguaauuuuugauaaucauuuaagauaugcaaguugauaguauuuaauuuaaccuuuugaggucuaacugaccaggaaguuaguauguauccaagauauuuucaaggagaagacaauuguacuuuuucaggugcuaugacuaaaccucuuagcuauguauucuuuacgacagaggcuuauaaacuuaaaaguacuggcuccguuggggaugcuaguaaaauaucaucuauaaaaugaauaaucuuguauuuaggaaauucuuuucuacuugggagcaaagccugauuuacaugauacugacacaugguaggacuguucagcaucccuugaggaagcacuucccaaugaaaucagugagcuggccuuucauuauugauagcugguauuguaaacacaaauuuuucucuguccuguucugcaaggggaauaguacaaaaacaguccuuuaaguucauaaugacuacaggccaaucuugaggaaucgccacgggggaagggagacccuguugaaggggcccuauagguuacaaauuagcacugauagcccguaagucaugcagaaaucuccauuugccagacuuuugggaaaugaugaaaaugggcgaauuccaagggcuguuugacgguucuguauggcuggcuuuuaauugcuccucaacuaauucaugggccaacuaauucaugggcucuuuguaauuuuucucccuuuaaaggcuacuguucuacccaaauaggauuuugagagagccaugucagggggaggagaggaauaacaguggccauuauuagaaagaggucugcagaaugaccucaguuaacccucucauaaaugggcuagcagcuguuuucuuuaaugcuuuuccuuaucucuuuauaagugccgaaaguaaugaguucauauaccccauugccuuguugaucuugcauugccaggcaggcuaagagcuccccuucuaaugcugcuaccuaagacagggucccauagcuauaguguaucccuugucuuucuuccaauuuauuggaggaggggccucaggcaaaaccucuguuuccccuuugguauuuuugcccuuuacugguggggcugagggagaaggaggaggcgguaagguaggugacgguuucuccucccuucccuuuuuagguuauucuguguagugcgggaccaaagcagcccuaacuaagggccauaacauuagagaugcuacugggaccugauauccuugggcaugauguuaagauuucuccacacuuguucucagagcccuaugucuagcauaccuucuucugggaaccauggguuaugggaaacagcaguuugcauuaugucccuuaauugagccugcgaaacuggggcuccacuagcuuuaagcagcuguuucaguacuuuuauauacuguuucuguugagcugacaaccacugucccaugaugaaacccuagccugaacaauucccucgaacuuggaaaucccaagcgggcaccaaugacuuacugugcagucucuuaaccuucguuuuugaggguuccaucgcaauccauugcagccuuccucacacggggcaccaccugccgagucugucccacagacucuggccgagugauggaugaaagaaguacacugacacaggaauuuugcgugacagcguggcuaggggaccgcauggcucagcaccaccaacaagagagugcagcagccaccaagagagugcagccccccuaagccagcccugcuagcauuuauuuaguucagauuuaaugauaaaggcuuggagcaaacacaauuuguggguaaugaacauugucgaccccccaaguagagagcaguccugugcaugaauaaucaaagguugauuucuagagaaaggaguaaacaaauuuaucuagauaaauuccuuuacauucccuuaucuacucuuuucucucagacuccugauaagagaaucuggcggccuucagccauaauucccuucggaagcuuuugcaaagccuccuggccuuccaagaagguuugcaucuuucccuauaacuuuuucuuacaacuuuucccaccacccugaccaaacuccuacaggagguggcaaaaaagugauguauaaugcagggaagaaggcugaaagagaauggauagcaaauggcucuguagguauauuuguucauugggcacguauuugagaauuuaccaugugucaagacacuguuuuaagugcuggggaauccagaagaaauaaaacaaauuuccucccuucguggaguuuccauucuaaauaaaggcauaaacauaaguaaacaaauacacaccacauguaaauauauauauauauacacacacacaaaauauauauauacacacacacauaugcaugcacauguguauuuauaugaaagugauaaaagcuauaaaaagggcauagagauuagaaauuuucagagaaagucucuucgagaugauaauaaacagagcaaccuucgcacauauacucugguguaauuuuaaguaucacuggcuaugcagaaaacagugaagaaaagcaggaagaucauuuagaaggcuuuugcaguaacccaaagacaugauugaguuguaauuuuuuaauagcaaucuugaaguacaugugacauacaauagacuauacauguuuaaaauacauaauuugauaaguuucggcauauguauauuaucugugagaccauaauuacaauuaagauacugaaaauauccaucaaccccucaaauuccuuggauccuuuucugauaccucccucuuaccccuuuucaccccagccuucucuaagcaaaagcuuucuaucacuacagauaaugugcuuuuucuaaaauuguguaugaauggaauuauacucuauggacucucucuuuuuuuuuuuucuuggcuuuuuuacucugcacaguuauuuugauacucauucauguuguuguaugaaucaaaaacccauaccuugguauggcugaguaguauuccuucacguagauauaccacaguuuguuuauccauuuaccuguugauggauguuuggauuguucacaguuuggagcuguuacaaacauggcuguuacgaacauucauauaccagucuuuauggauauauguuuucauuucucuuagguaaaaaccugagagaaaaauggcauggucauaugauuucuguauguuuaacuuuuuaaaggcugcuaaauuauguuccaaaaaauguauuucccaccagcaguauaggagagcucuccugccuuucuuaauucuucauuugcugagaauuuuuaacacaaguaaauguuggauucugucaaaugcuuuugugcaccauuugagaugaugauaagguuuuuauuuuuuuugucuguuaauacaguggauaucaucaauugauuucauaauguuaaaacaaccuugccuucaguaauacacaauuugauugugacuuauuaucuuuauuauauuuuauuuguuaaaaugcuauuaguaauuuuuacaucuauauuuaugaaggauagagaguuccuaggagauuccagauauuuauaaauuuauuuuuuuaaauaaauugauaauuuuguggacaggaaauacugaaacucuacauaauugccuaagccaucaaugugagaauacuucacuguugggcagcuaauauuucacuguugggcagcuguguauuagucauacacaguugccugaaaacuucccagccacaucacauuugcaucccuaggcaggaugacugagaucauaugugaaccagugucuaauaacuacugucauuucaaauaaauggugacuguaaaccuguguacacagguguuuguuacuauuaaaaacacaugcaaacauucaugcagguaaguugauaaccuuuagcagugagguaaguucccuucuaaacaaaguuccuuuguuuuccuagugaaaauaugauauuagagaugugaggagagauaagaaaugaaagagacucaacuaggauucuggaaaaauuaacugauuauagaaaccuaguauugacaaacugagacuacauuugagauuugugagguccucauuuaccauugaauuaaaagcuagauuguuaacucaugcugcuguuguuuuggauagguacugguaagagugggcuuguucuuugaaguuccuuuaguuucuuuagucauuuaaaugucauugauuuuuuacaucuugccuucuuuucuuaccuuuuguuaauacuuaaauuuaucuuaaaagugauacuauuuuacccucuagaaucuuaaaacuuuguaaauuauaaagaauugcuuagaaauuaggucuuucauuuuauuagcuguauugaguggccuuuuugaugcuaaacaauaucuaauugcaucucugcucuuugaaaacauagggcugcuauacucuagugucugaagucuacauuaaugacaauaucuccuggccuuaauucuaagagcaugauuucaauggauaguaauucaccucauuuuuuaucuaaguauauaaccucuuucuuuucuaacauugguuggggauaauuucaauaacauuuuaaauacucagcuggcauaauuacaguuuuauuuuaacaaauuuucaguuuauucuuaaauucuuaguguauaauuuuuucagguucuauguaccuuagcuuuuccuaaauaacauucugagcucuauaaacauaugguauggauuuaucugguaaaaaaaaaaaaaaagauauaaaagcaaagacuaccccauauuuuuaauugacaauaauaguacauauucaugggauauauagugauguuuugauacauauaaugcaagcaaauacccugaucuaaucacuauacugcauauuuuauaugcaauuggauaauacaaugauuuucagcccugauucuacaucagaauugccuuugacacuuuuuaugaacauauuuuugcagauuucauuucugaacauuauguuuugauggaccuagguggggcugaaguaucugacuuuuuuuuaaacuacacagguauucugauuugcagccagaauuaagaauggcuagcuuaaacguuuuuuuugcuugaccccuccuggcuccaugagacucagcaauacaucuaaaaagaaaaaaaucuacuuccuuacuccuaaacuuaucuauaaucaaaccuggaccgcaucugccaguuuuugugcagugcacacaauugccagccuaaaacauuauauagcaaguucuuaggacuguuacucagggaaugcccaagauauauaugcuuggccccuauguguccuaggaguugcaggcaaagaauuauugcacaauugcaaaauaauugguaucacaaggcaaguaguaaucauaaugaaccuuuucauguauuuuaguucguguugaguauaaacugucugauuuaagaucuucuaccuuccuucuaucauuauuccaaaccuuugaaauauuuacuggcaaguauaucuuuuuaaaaagcuacuguacaaugaauccucaucucuuuccuauuucagcuacauuuuuuuuccuaucccugaauaaauuugcugggauuuuuacuuuccacaucagaaaaugagacauaaguuccugacauucuaaaauuaacacaaccuuuuaaaaaaaucuaaaauuaauuuuaaggaguuaauuaucauuuaaaagagcugggccacugcaucuuaaguaauacuauuaucauuauguuccauuauacucucauucuagccacagucacaaaaauuuuuaaaaaucgaauggcaaaguuuuuuuucagucucuuugccccuguuccaccaugaugcauauuuguuauaacacuugaaauaauucuaaaaauccugaugauucauuuuacuuguagaguugagcuguaccuuuugagugaauuccuaagcuaugagauuaaguaaauggaagcaagcuuuaguguaguaaaauacaaugaaggaagguaauaaaaauuucuucauuaccuuuaucucuggaagcaagcuuuaguguaguaaaauacaaugaaggaagguaauaaaaauuucuucauuaccuuuaucucucuuaugucucaacucuucaaaaauccauucaaauaguuuuuucaugccauguauguauuuucugucuuuacaugcuuuaaguaauuuuguguauaccauugguuuuaaguuauaacaaguuaaauuacaagaacuuuaaggaagaagcaggaccuguugccugcuuuugcauuuuugccuaguguguuuguuucuggaaauaugucuucucauuaguuacauugaauacuuguuuauauaucaaauacauuuaaucauuucauugaguauauugaauauaucaguuguauacuugccaacaaaugauuguuuuaaaauuuuagaugauauuggugcccauaugaauguaggaagaa

SEQ ID NO: 190429 - RNA, 45 nt, Homo sapiens
ucauuccuuaaaaacauuccacagaaauugggauugggagucuga

SEQ ID NO: 190430 - RNA, 42 nt, Homo sapiens
guauggacuccaauugccuugacaguguuuuuaguggcuguu

SEQ ID NO: 190431 - RNA, 46 nt, Homo sapiens
gcauuguugguuuugccauguacuauuuuaccuaugacccguggau

SEQ ID NO: 190432 - RNA, 41 nt, Homo sapiens
uggggagagcaaauugaaaaugcguaaauuggaaggcaagu

SEQ ID NO: 190433 - RNA, 30 nt, Homo sapiens
gcuaaaaggggaaguugucugggugguugc

SEQ ID NO: 190434 - RNA, 47 nt, Homo sapiens
ggcuaaauaugaauacauggaagaacaaguaaucuuaacugaaaaag

SEQ ID NO: 190435 - RNA, 28 nt, Homo sapiens
gccgccaccccgcccgcccgccccauuc

SEQ ID NO: 190436 - RNA, 48 nt, Homo sapiens
ggaagaaaagcaaaagacgaaaauggcuaaauucgugauccgcccagc

SEQ ID NO: 190437 - RNA, 55 nt, Homo sapiens
uacauccuccccuccagacaaagugcuaaauggacagaggaagaaucccaaagau

SEQ ID NO: 190438 - RNA, 44 nt, Homo sapiens
aggaggaagaagaggaaaaaagacaggcagaaaaaaggcgaaga

SEQ ID NO: 190439 - RNA, 46 nt, Homo sapiens
caaggcaugggcaacuaaugucagacuacucauuauguacuuuggc

SEQ ID NO: 190440 - RNA, 49 nt, Homo sapiens
aauaaaaauauuugucuuuuggaauagccgaaauuaguaggcaggacaa

SEQ ID NO: 190441 - RNA, 46 nt, Homo sapiens
acuacguuugguucaagcauuccaguacacugacaaacacggagaa

SEQ ID NO: 190442 - RNA, 46 nt, Homo sapiens
uuugacccaucagaucucaaaggacuaugguguauaccuagaggac

SEQ ID NO: 190443 - RNA, 46 nt, Homo sapiens
gguagcaugcucuguugauucacaguuuacccauuuggccugguca

SEQ ID NO: 190444 - RNA, 38 nt, Homo sapiens
aguagaaauuucaguagacauaaaaaaugacaggccuu

SEQ ID NO: 190445 - RNA, 76 nt, Homo sapiens
caagccagcgcccuacugggaaggaacagcugugaucgauggagaauuuaaggagcugaaguuaacugauuaucgu

SEQ ID NO: 190446 - RNA, 42 nt, Homo sapiens
aagucuguaagcuucaccagacugccaaagagaucuaaaggu

SEQ ID NO: 190447 - RNA, 45 nt, Homo sapiens
augaagaaccuauuacagaguguacuuuugagggaaaugggggaa

SEQ ID NO: 190448 - RNA, 45 nt, Homo sapiens
aggggaguucuagcugugaagaaagguaugguuuccacugaucag

SEQ ID NO: 190449 - RNA, 58 nt, Homo sapiens
gcagcggcaagcggggcggugcccacggcggggagauggguggggagggcagggaaaa

SEQ ID NO: 190450 - RNA, 41 nt, Homo sapiens; identical to SEQ ID NO: 124063

SEQ ID NO: 190451 - RNA, 68 nt, Homo sapiens
uaaaacaauuucuuuugcauuuagucucuuagcggccucaagagcuucauucgcagugucugcuacaa

SEQ ID NO: 190452 - RNA, 64 nt, Homo sapiens
caguuucuugcucuggcauuccugcaggcucagccaucuucuggagguuaauugaacugcccgg

SEQ ID NO: 190453 - RNA, 40 nt, Homo sapiens
uggaagaaucagaacaccacaauaauguuacuaggaaaaa

SEQ ID NO: 190454 - RNA, 56 nt, Homo sapiens
agacccaguaacaugccaaggacuuaacaggggauucaacauaacaguaauaguag

SEQ ID NO: 190455 - RNA, 52 nt, Homo sapiens
auuaucacauagugaagaugggaguauuuuauauacgaugggccaagaaaag

SEQ ID NO: 190456 - RNA, 55 nt, Homo sapiens
gggggcgagguaguauuuucugacugggccuucaguugcaucauucuuaggagga

SEQ ID NO: 190457 - RNA, 56 nt, Homo sapiens
gguugagagcuuaaauaauaguuuguuucgauguucuguuguacucaugagaggug

SEQ ID NO: 190458 - RNA, 44 nt, Homo sapiens
accuuggaaacuugagguuggaaugucugcagaaagugaagcca

SEQ ID NO: 190459 - RNA, 54 nt, Homo sapiens
cuuucuaggcugccgagguguuagcagcauuccugcagcuuggcauugcuguga

SEQ ID NO: 190460 - RNA, 86 nt, Homo sapiens
agcuagaaggugcaugggagaaagggcagugcugagguaaaguugggaaaagaguuuggagucagauugcgggguggcuggaauga

SEQ ID NO: 190461 - RNA, 42 nt, Homo sapiens
auuuuugaaaucagaugagaggcagagauuggccaaagaaag

SEQ ID NO: 190462 - RNA, 43 nt, Homo sapiens
gaaaacuggaagagcagcggcagcgggaggaccaaaagagagc

SEQ ID NO: 190463 - RNA, 45 nt, Homo sapiens
gcacauaauuaccccuacagaguucuuuauuacuaaauuuugaaa

SEQ ID NO: 190464 - RNA, 42 nt, Homo sapiens
uuugccuugcccuuuccccauccucuguugaucaucagauga

SEQ ID NO: 190465 - RNA, 51 nt, Homo sapiens
aaaaagaaguauucguggggagcaccacuggccauuggacccggaggacau

SEQ ID NO: 190466 - RNA, 38 nt, Homo sapiens
aacaguugagugagguugaacauuugaaauugaagaug

SEQ ID NO: 190467 - RNA, 46 nt, Homo sapiens
uaaugcauuucucugcagcaugugacaaacuuucaacaucaacuau

SEQ ID NO: 190468 - RNA, 46 nt, Homo sapiens
agugaacauguagacuuggucucucuaguuuguuucuuuucuggug

SEQ ID NO: 190469 - RNA, 35 nt, Homo sapiens
ugguauaugaauuauguaucaaaaaacccuagcaa

SEQ ID NO: 190470 - RNA, 36 nt, Homo sapiens
agugaaaggaugcaagcaaagucagcaaaggagaaa

SEQ ID NO: 190471 - RNA, 49 nt, Homo sapiens
uugggcugugcuuuuucccucacuuuagcuagcaugcuacagucaaaag

SEQ ID NO: 190472 - RNA, 44 nt, Homo sapiens
uuguugcacaguaggugcucaguauguguguguguuagucuguu

SEQ ID NO: 190473 - RNA, 42 nt, Homo sapiens
aagcuucucugggagauguguggcuugguuauccucucccac

SEQ ID NO: 190474 - RNA, 48 nt, Homo sapiens
cgcuuaccugcccuuucuggccaagacaugcccaagaggaaagcggag

SEQ ID NO: 190475 - RNA, 41 nt, Homo sapiens
aaagagaagacaggcccggcugcagaaggaacaggaggagc

SEQ ID NO: 190476 - RNA, 36 nt, Homo sapiens
aaagccacagaaauguugccagauaaaauaauuuag

SEQ ID NO: 190477 - RNA, 46 nt, Homo sapiens
agagguggggcaggaaaccuuagacgccggguccacccuggggaag

SEQ ID NO: 190478 - RNA, 860 nt, Homo sapiens
auagcuacuagggguucacaugaaagaauauuccagccagacgcaauggcuuguaccuguagucccagcuacuugaaaggcugaggugggaggaucacuagaggccaggaguucgaguugagccugggcaacguagagagaccccaucuuuuuaaaaaauugaaggaaagagaauauuccaguuagacagcucccuacgagcaaggucacguaggcaggcuaaaguuucuugucgaagcaagaguuagcccaggccaggaaccacaggcagaggucuucgaggcugcucagaccuggcuuuuugcugcugagccuacagguggcaggugguuuuggugagagcuagggcaggugggggcacaugcgauguggggcagcaggauguagcagcagcugaggcaggaagggaaagccaagagagguaggagagagccagggucaugcagccuuauguagcacagggcuguagggagagccacaugggcaggacuuuugauaagacauaggcuuaucaaagacgaaggcuguuggucuugggauuuaggagaugaaaagagauuuuggagggaaauuguugagaaguaggauagagacaaagcagccugaagagaugaguggauacaggcccagaauauaagcuggcuguuaagcagucaugaaugagaagcagcugagagaggacugaggaggguugcuugugauucccgagacaugagcauuuuuccagggcauggaaaacaugcaugcagaagguugaaacugacaaaugaagggaagaggggcuagugggagggacacauagcuguggaggauguggaauucacagcacaagugguggcauuuccaucuaagcagaggaa

SEQ ID NO: 190479 - RNA, 47 nt, Homo sapiens
cauagugaggaaagggagagggacuugggugaaugacaagaacaagg

SEQ ID NO: 190480 - RNA, 54 nt, Homo sapiens
uucgccuagaagaggaagcccgaaagcaggaagaagaaaggaagcggcaggaag

SEQ ID NO: 190481 - RNA, 41 nt, Homo sapiens
agcuguuguugaaagaaaagcaagaacaagaaaaacaagag

SEQ ID NO: 190482 - RNA, 55 nt, Homo sapiens
acagaugcgucucgagagagaacagauuaugcugcagauugagcaggagagacug

SEQ ID NO: 190483 - RNA, 30 nt, Homo sapiens
uucugucagguuuuguuuuauauauauuua

SEQ ID NO: 190484 - RNA, 29 nt, Homo sapiens
auagaugaaaucaugaagagaacaaggaa

SEQ ID NO: 190485 - RNA, 58 nt, Homo sapiens
uuuaauaguuuauguacuaaguagaaaagaacagcagaauacacucagugaaauugua

SEQ ID NO: 190486 - RNA, 37 nt, Homo sapiens
guguggaaaagaagacaaaacugguuguccccaacaa

SEQ ID NO: 190487 - RNA, 43 nt, Homo sapiens
agcugaccccaugggagcucuggaggaugaauuuccaccagag

SEQ ID NO: 190488 - RNA, 45 nt, Homo sapiens
acuguaacaaaaaccuuaucgaaggauuuaacaguccuggccaag

SEQ ID NO: 190489 - RNA, 51 nt, Homo sapiens
ggguuaaaguaguaaguuugguugaggaaggaagucaaaacagucaguaau

SEQ ID NO: 190490 - RNA, 55 nt, Homo sapiens
cgcuguguuuacauauuuaaaaaugccauuguucaauuaauaguuuaagaacuug

SEQ ID NO: 190491 - RNA, 122 nt, Homo sapiens
cuacacacuuaauggaaguuuccaagaauuucauugaauuucauugacuggguuuucuuccuccuuaaccaaguugagaacacugucugguagcccccugaagguauaaccucuccuucucc

SEQ ID NO: 190492 - RNA, 46 nt, Homo sapiens
gaguagaugugguagcccagcucuuccaaagguggcucaggaucgg

SEQ ID NO: 190493 - RNA, 46 nt, Homo sapiens
gcaagauugcuguucaccauccuguccuugagaagcauaauagggu

SEQ ID NO: 190494 - RNA, 46 nt, Homo sapiens
guagcaucauuugcaaaauuacgggaugcuaccagcacucugcuug

SEQ ID NO: 190495 - RNA, 39 nt, Homo sapiens
uuccacacgugucacucguugaauccucaagacaacccc

SEQ ID NO: 190496 - RNA, 120 nt, Homo sapiens
cugcuucacugcuuuaauaaaauaccucagacaaggccauuuauacagaaccgaaaugcuuuuucucgcaguucuggaggcugggaaguccaugaccaaggcacuaccaggcucaguugu

SEQ ID NO: 190497 - RNA, 61 nt, Homo sapiens
aucgguuuguaaauaccacguagguucaguguucugugucucaguugugacuuuggcucca

SEQ ID NO: 190498 - RNA, 65 nt, Homo sapiens
uggcaugcacuuuugucccacuugaauauuuucuucuaaaauucugcacagaggucgcaugaacu

SEQ ID NO: 190499 - RNA, 84 nt, Homo sapiens
uguauuuaaucugauuagcauauuugucaaaagucagcaucaaggaugugaaauucaaguggcacaguuaccccagccaccuga

SEQ ID NO: 190500 - RNA, 42 nt, Homo sapiens
cgaagugaaacuagccagacagcaaggugggggucaggggag

SEQ ID NO: 190501 - RNA, 75 nt, Homo sapiens
ccugccuccuccccgcucgcggguaccgaggucugaggcgcucuucucucucucuccaaacuuggaacgagacuu

SEQ ID NO: 190502 - RNA, 42 nt, Homo sapiens
gcuggcgcuccugccuuucccaagcgcgucacacuccccacu

SEQ ID NO: 190503 - RNA, 40 nt, Homo sapiens
acucucuuuacucgccaucuugcgucgggucguucgcccc

SEQ ID NO: 190504 - RNA, 22 nt, Homo sapiens
ggaagggaagaggggggcccag

SEQ ID NO: 190505 - RNA, 35 nt, Homo sapiens
cauggucaaguuccuacuagaaaaggugcaaguga

SEQ ID NO: 190506 - RNA, 40 nt, Homo sapiens
cagcuccauccuguccucaggaaggcugcacuccccagca

SEQ ID NO: 190507 - RNA, 46 nt, Homo sapiens
cugacagggcgcgguccgcacgggcguuuugagcaccuccugacag

SEQ ID NO: 190508 - RNA, 35 nt, Homo sapiens
gcggcguuguggacggagcugcuuuuccuucacgu

SEQ ID NO: 190509 - RNA, 42 nt, Homo sapiens
cugucgccgugcugaggaagagaagccguggugcugugggga

SEQ ID NO: 190510 - RNA, 43 nt, Homo sapiens
cgcggccgccguaagucccugggggcgaaagggggcgccgggg

SEQ ID NO: 190511 - RNA, 49 nt, Homo sapiens
gguccauucuuuuccaaguucugguaacggguuugcaguaaaugcccag

SEQ ID NO: 190512 - RNA, 43 nt, Homo sapiens
accaaagugccucccgugcaaguccugaagauagcggcauucg

SEQ ID NO: 190513 - RNA, 74 nt, Homo sapiens
uagcaagaaauucuuuuggacagaucuuccucuagaugcaaaccuuccaaucccaccuuguuccacauuaaguu

SEQ ID NO: 190514 - RNA, 46 nt, Homo sapiens
uuuuucuucucuuugucugauagugggacauaccauuuuugcaguc

SEQ ID NO: 190515 - RNA, 45 nt, Homo sapiens
cugcaaaaaugguaugucccacuaucagacaaagagaagaaaaag

SEQ ID NO: 190516 - RNA, 46 nt, Homo sapiens
uuuuagcacggaaaccuaaaaugugcagcuuccuugaguggcgaga

SEQ ID NO: 190517 - RNA, 39 nt, Homo sapiens
uaagcuuagaggcaaagauuuuaaacagggcuggaaaaa

SEQ ID NO: 190518 - RNA, 17 nt, Homo sapiens
cgccuggguucaggauc

SEQ ID NO: 190519 - RNA, 45 nt, Homo sapiens
auugaacuuuaugcaacaucuggcauuggugaaauuucucauucc

SEQ ID NO: 190520 - RNA, 47 nt, Homo sapiens
auagaacucucgauguaauggggcgaagugugaagagguggagaaau

SEQ ID NO: 190521 - RNA, 49 nt, Homo sapiens
aggugguuuguuuucccuacugcuggaagcgaagagcuuuuuaagcagg

SEQ ID NO: 190522 - RNA, 45 nt, Homo sapiens
uuucaaaauuucuguuaugcguuuauuacuuuuguagucuaugag

SEQ ID NO: 190523 - RNA, 46 nt, Homo sapiens
cuagugccuagugaagagaauaaguagcuuaccuccugcaguagau

SEQ ID NO: 190524 - RNA, 37 nt, Homo sapiens
gucaaacugcauucuugucuuaccuccauauccccag

SEQ ID NO: 190525 - RNA, 46 nt, Homo sapiens
cuguguucauuucacuacugaagaguagauggcaccagggcugcca

SEQ ID NO: 190526 - RNA, 44 nt, Homo sapiens
uaaucugugggacugcauacaaauggaaagguaagaaucuuagg

SEQ ID NO: 190527 - RNA, 57 nt, Homo sapiens
aaaauuauuuuaauaaguacuuuuugaaguauugaauaacauaucuuuuaauaugaa

SEQ ID NO: 190528 - RNA, 49 nt, Homo sapiens
ugaaguuugauuacauuaaugcuugaaauggaagugcuugaaaggaagg

SEQ ID NO: 190529 - RNA, 33 nt, Homo sapiens
uccucaaaauuuugaaaaguaugaaaagaaaaa

SEQ ID NO: 190530 - RNA, 43 nt, Homo sapiens
uuuuucuuuucauacuuuucaaaauuuugaggauuuuccgcuu

SEQ ID NO: 190531 - RNA, 44 nt, Homo sapiens
aauacccuaaauuaggguuuuucaaagguaaaagauuucuugga

SEQ ID NO: 190532 - RNA, 41 nt, Homo sapiens
uuuaccuuugaaaaacccuaauuuaggguauuccaaggcaa

SEQ ID NO: 190533 - RNA, 61 nt, Homo sapiens
uuauuuuuaagacaaauuuauaagacaaguguaauagaaauagaucaacagcacaauagaa

SEQ ID NO: 190534 - RNA, 45 nt, Homo sapiens
gagugcuuucaauucuucuguuuuuucauucauugcucaaaauag

SEQ ID NO: 190535 - RNA, 48 nt, Homo sapiens
auagugcaaggaauaagugaagaaguccuuuuauaagaaaaacugcag

SEQ ID NO: 190536 - RNA, 56 nt, Homo sapiens
uacuuuucauuaaauguaaauuauuuucuuuuaccacauuguacuacuagaaagag

SEQ ID NO: 190537 - RNA, 38 nt, Homo sapiens
caugcaggggaaaguggaagugcauguuuucuaagaag

SEQ ID NO: 190538 - RNA, 382 nt, Homo sapiens
uagaauaaaagaaaaaguauauuggggcugggcauagugguucacuauguaaucccagcacuuugggaggcugaggcggguggaucaugaggucaggaguucgagaccagccuggccaagauggugaaaccccaucucuacuaaaaaaaaaaaaaaaauacaaaaauuagccgggcacaguggugggugccuguaaucccagcuacucaggaagcugaggcaggagaaucgcuugaacccgugagguggagauugcagugagcugagaucaagccacugccuucuagccugggcgacagagcaagacucugucucaaaaaaaaaaaauuauauauauauauauauauauauauauauauauauauauauuuuggaagggaga

SEQ ID NO: 190539 - RNA, 54 nt, Homo sapiens
aaugacaucaucuaaaggagaaucguugggacuggggagaaggggaggggugua

SEQ ID NO: 190540 - RNA, 54 nt, Homo sapiens
cuccucacacuguccucaagcuauacaccccuccccuucuccccagucccaacg

SEQ ID NO: 190541 - RNA, 48 nt, Homo sapiens
caguagacuugguggggagcaaauuagugaggagcaaaaaagauuucc

SEQ ID NO: 190542 - RNA, 56 nt, Homo sapiens
cuaauugauauaauuuuuaugugacucacaagagguacuggugguaagagguauaa

SEQ ID NO: 190543 - RNA, 41 nt, Homo sapiens
uucucccuaugaagaguauucucacauuuaauagaugguaa

SEQ ID NO: 190544 - RNA, 45 nt, Homo sapiens
agacuauguaucacagcaagaguuucauuggguuuaagaaagcgu

SEQ ID NO: 190545 - RNA, 70 nt, Homo sapiens
uugacaauaaagcauucauuaaauacugugaaucacuaaugccauugauacagaagaauuucccuaugaa

SEQ ID NO: 190546 - RNA, 43 nt, Homo sapiens
guuucaacuugaauaaauauuaaaaugaggauacuuuaaagac

SEQ ID NO: 190547 - RNA, 45 nt, Homo sapiens
agaggaaauagaaugcugauauacauaugaaagaaaauauccuca

SEQ ID NO: 190548 - RNA, 48 nt, Homo sapiens
augugaaaauauuacaagaaacuaaaauuaauuuguaccauuauauaa

SEQ ID NO: 190549 - RNA, 43 nt, Homo sapiens
caguauuaagaaauuuuguagugccacauuuauugaaucacau

SEQ ID NO: 190550 - RNA, 41 nt, Homo sapiens
aacuucacaagauguucaaaucgauuuaucacugaaagaag

SEQ ID NO: 190551 - RNA, 49 nt, Homo sapiens
ugauugaugugcguuuuaagucucuuuuaaucuuuaacaaaucgucugc

SEQ ID NO: 190552 - RNA, 46 nt, Homo sapiens
ugugacacgaaauugcuuucuugauucucuaaaacaagcauguucu

SEQ ID NO: 190553 - RNA, 46 nt, Homo sapiens
aagaauuccuggcaaauuaccauucucacuuuauuuuggggcauca

SEQ ID NO: 190554 - RNA, 52 nt, Homo sapiens
ggaaggagaaacccuaguccagaccacuccuacaaaagaaauggggaauccg

SEQ ID NO: 190555 - RNA, 49 nt, Homo sapiens
cuugucuccagaucggacuggcuccuccuuugggaagaacuccgaaagg

SEQ ID NO: 190556 - RNA, 46 nt, Homo sapiens
cggaguucuucccaaaggaggagccaguccgaucuggagacaagua

SEQ ID NO: 190557 - RNA, 43 nt, Homo sapiens
uuccugauuggguugccacuguccgaugucagucugacugcau

SEQ ID NO: 190558 - RNA, 43 nt, Homo sapiens
guaaggcaggaaaugcuaugggcaagguaacguagguggucau

SEQ ID NO: 190559 - RNA, 29 nt, Homo sapiens
guguacauuaguaaaaccacuucagagag

SEQ ID NO: 190560 - RNA, 46 nt, Homo sapiens
augcuaauauauguuuaugauuucaugugguauugacgugacauug

SEQ ID NO: 190561 - RNA, 107 nt, Homo sapiens
uccaguccuacccuucuuauuaagagcauguuuacgacguuuggaauggagcagugcaggagggaugacuaugacccugacgcaagccuggaguacagcgaggaaga

SEQ ID NO: 190562 - RNA, 48 nt, Homo sapiens
acggaagcugagaccuagaaaagcacacuugcccaagucagucauaug

SEQ ID NO: 190563 - RNA, 29 nt, Homo sapiens
cguuuucccagcugaucauccucugcuuu

SEQ ID NO: 190564 - RNA, 51 nt, Homo sapiens
uaccacauggcaaaacccagaaccacccguggauuucagaguaauggagaa

SEQ ID NO: 190565 - RNA, 45 nt, Homo sapiens
agaaauaauaguuccaguaauguuaguuucgugguagguuaguua

SEQ ID NO: 190566 - RNA, 36 nt, Homo sapiens
caacacuauucacugagggagcauucagguggaugu

SEQ ID NO: 190567 - RNA, 43 nt, Homo sapiens
gcuaguuuuuuauaugggagugugagaugauaagcaaaacaga

SEQ ID NO: 190568 - RNA, 95 nt, Homo sapiens
ccccuuuaaagagaaaguuaaaggaacaaugggaagaacagcagaggaaagagagagaagaggaggagcagaaacgacaggagaagaaagaaaaa

SEQ ID NO: 190569 - RNA, 43 nt, Homo sapiens
gaauaaagaaggaaaaggaagaggcggcuaaaaaacggcaaga

SEQ ID NO: 190570 - RNA, 39 nt, Homo sapiens
agugguugcuaagagagcagaaggcacaagaagaauuca

SEQ ID NO: 190571 - RNA, 46 nt, Homo sapiens
ucucuuuccaauagcuucucuucuucuaguuguuguucuucaauaa

SEQ ID NO: 190572 - RNA, 51 nt, Homo sapiens
agaggaggacacuuuuauugaagaacaacaacuagaagaagagaagcuauu

SEQ ID NO: 190573 - RNA, 39 nt, Homo sapiens
aacagcugguauuuguauuguuuugauuuuuuuuuuccu

SEQ ID NO: 190574 - RNA, 29 nt, Homo sapiens
caggaacuugcucgacugagagacucagg

SEQ ID NO: 190575 - RNA, 101 nt, Homo sapiens
gauggcugcgcccgagaagaugacguuucccgagaaaccaagguaagcgccguacggggagaugagcaggcgagcgggccgaucgugggcauggaggaugu

SEQ ID NO: 190576 - RNA, 32 nt, Homo sapiens
uugccggcaccgccccgccccuccaggucugg

SEQ ID NO: 190577 - RNA, 86 nt, Homo sapiens
acuucuagggcgggguaaaagccccagaguauuuuugcuggaaggagguauuuauuugagcaggguucuggaagacgagccgccga

SEQ ID NO: 190578 - RNA, 44 nt, Homo sapiens
cugcuagggcgaggagggagacagugauacagcacugggcaagu

SEQ ID NO: 190579 - RNA, 76 nt, Homo sapiens
gcccagugcuguaucacugucucccuccucgcccuagcaggacguguuguggcuaggcgguuaaagucguacucug

SEQ ID NO: 190580 - RNA, 41 nt, Homo sapiens
agguuccgcguccuuccgccgauccaccuaucagcgccuca

SEQ ID NO: 190581 - RNA, 59 nt, Homo sapiens
uugacgcaacagagucugaacauaggcuuagaggcauucagaaacauuccaagauauuu

SEQ ID NO: 190582 - RNA, 45 nt, Homo sapiens
caucugaugcaucagcauaaguccauuacaacccuacagggagag

SEQ ID NO: 190583 - RNA, 4754 nt, Homo sapiens
acuaugcacuuugaaagucuugcuggaguauggagaauagucagaaaucucugguaagaugcugccccgcgcaucucucagaggagucacuauucauagccugcaucagaguucacaaugaaccaaaguucaccccaccuccccugucuucagggacuuagugaaaagcugcacuguucuugaauauuuuggaaaugaaaaacuuucugggcuauuuuaaaucaguaccugggcuggaauuaaccgaaaggcgaaacagcaagggcaccauucucugugccuauacguagcugcccugugcuuggaaccaagcaaaaaggcugccacugcucacaguugcaauggaauaaagguugagugccuugugauugcauaugaauauuaaggaaaucugauggaaagagggaaauucaucaugucacuggccacacuggggcaguuaguugcaacacacaaaucagguauaauauauuuugaaaccuuuggcaaccucagauugggaucacacucucaaggaagaagugagugagaggaggaagcuaagcuuucuuaagacauagcagcguaaucucuaauuuaaguuucaggaaauugcaaaaggcaggcuuccuuuugaaaucaggaguugagaaaaugaagagucaaucugaugccaaucaaggaauuuuucaauauaauuguaaccuuuuguuaguacuuuuccugucucuuucgcauaaguugcuuaaucaggcagaguucaagcuaugaggcauuuaauaaauacauuacuuaugaaugacauuuaaagacuuuuagaaucuuuucuuuuuucacacauuucuaaggcugcaaaacaacagaaaaagaacauguuaguaauauccaaggcauacaugaauaaucagugacagcaaaggauguguagcacagaaggcuuagcucuccuaggcgguauccagccacacacugguaauuguugaaauggaguauuggauauauagaugauuuauucucaccauuuuuuuguacaaguuugaaguuugcccuaauaaggggaaaacagauucuaaauucaguugacccauggacuauugcuguuuaaaccugcuaagugaauucagauagugaaguuauuuaaaaaccagaugcucuuaccuggcugcaggaacuaucaagauaagauauugaaagcuuauuggcagucugucuuuuaaauccugagccagacuuuuuuacauggcuucaacaaggugauuuuucaucuccuuagacauuuugacauacacacucccacuaaaaacuguauuuacacaaacacagauaaaacuaaacaaaagugauuuuaacuuugguuugagaauugucagcaccuuuuaggcaacgcagacauacuuuaggugucacuggcuguuacgaguucaauugcacccucccaucucaaacucauauacguuuaagucuuaagccccaguaccucagaaugugaccucauauggagauugggucuguauaaagguaauuauggucauuagggugaccacuaguccaauauaacugguguccuuaauuaaaagggaaauuuggacacagacaagaugagaauggcuuacgaaaauuggauuuaaugcugacacaagccaaggaauuaccagaagcaagguuuauuagguguucuccagagaaacaaaaccaauuguguguguguauguguauauauguguguguguauguauguaugugugggugugccugugugugugcuugugcguguguguguguguguguguuuagagagagauuuauuuuuaaaaauuggcucgugaauguaggcucgugaaauuugcagugcaggccagcagacuggagaccagggaagaauugauauuacagccugucuuacucaguuuugugcuguaacagaauaccugacacuggauaauuuauaaugaacagaaauuuauguggcucaugauucuggaggcugggaaguccaagggcauggugccagcaucugcucagcaucuagugagggcucucucuugcaucaucccauagcacaaggcagaagggcaagaacaugugcaugugaggggugggagugguugggggugaagaaggagggagggagggaagggaaagaagccaaauuuauccuuauaucaggaacccacuaccucagaaacuaaccagcucccccuaauaauggcauuaauccauucaugaggggagggcccucaugauuuaaucaccucccaacacuuuugcguugcagauuaaguuuccaaaacgugaacuuuggggacacauucagacuggauugugagcacaaacuggugccauggcacagcuccaguccaaaggcagucuggagguagaauuuccucuuccucaggggaccugucuuuuucaacuuaaggcuuucgacggauuggguagggcccacccacaugaaggguaauaaucuuuauuccaagucuacugauuuaaauguuaaucuuaucuaaaaaauacauucacagugacauuuaaacugguauuugaccaaacaucuggguaccaugaccuacccaaguuggcacauaaaauuaaccauccaaguagaaaggccuggaacagagcgcucauugcccucagaaggaaccaacccugcagagaacuuggaccucagauuucuaaccuccagaaccaugagacaacaaaaauuuuuaagccaaccagucuaugguacuuucuuacgagcuaauacauuggccuaaagaccuccgguagggagucaagccuagagguaaggaaccuccacaggauucacuaacuuccuaccaguccccuuuaauguaauggcugcacaucucuggcucccugaguucagcgcacauuagcaaagugaugcauaugcaaagcaaagcgcauggcacugugccaaaagacuggcuucucauccugcugugcuuuauuucacaaugcacauagagaugauucucgcuccuuucacguagguguagucuucucucuagcuuagauggagcaggaucaaggacagcaguacagaggagaagagcuaguucacagccaauuacuagcaugaaugugcacaaagagaggggaggaugaaagcacguuugccuccuuucucagcaucacugaggaccaugauguggguuuuauaucuuacauucuucuuggaaagaugguguaaagaaauaaaguucagauuuguaagggaaaugugucuuuagugccccucaacuucuacauuugugccuuuugccacccauucccaccuaccccaacccccaccacuaccccaccauggccauacugcugagagccccucuuuuggcaagagaaggcagaaucugagguggcaaaaaacacccugcugcaaacugguuugcucuguguuucucuuacccauacuaugugcauuucaggaggcuccuaagggagaaauuacauaccuggaagguacaguucaagucuuggucaucuuugcaucauagcacccaccacugugcuuggagcaaaagaaaugacaauacauuuugaaaugaaagugcuaacuggcagaaucccagcccugugagacuagaugagguucauacucagggaggguccucuuuuuagaucaggcaggauuugggggguccuuuggaucuuuuagauagggguaugagacccuccucucaaaggagaaauauuuaaaaguguuuuaaaaguauagacaucccuacaaaugggugaugacguuugagaaaaggaaagaccccuaguacugucucagagcaugcuggcagucauggcacaguucuuaguucuugaaaugcggaccaacaucuuugucaccaagggagccuacucgggucaguuggcuaguacucccagcacccauuuugaaugaggcacugugucccuaagagaugcagcucugaccaaggcagacacggucccuaccaccauggggcuuagauacuggagaggaugcagucauaaaguacauuccuggugagguauuaauucgacugugauaagcacugugaccacaaagcaguucugggcugaccuggugagcuuguggucgggggagcuuagaggaagugacgcuggugucagucaccugaaguggggguagggauucaccagucacagauggagggagaguccaggaaaggaagggcaucugcacaggccagagggaaaggcaggaguuggaagaacuaaaguccauguggcuggugggcgggcagaagcgcaaagugaaugugagugaaagcaagugggucugucaucuuggggugaccaaugaguuugaggaacaagaguggauaauugacucccauuugcccuccccuucaccucagggugcguauuacgagucugaauauuguccuacuuagagguuuucucaugaucuuaagucucuauuguuuacagcuuucacuucucugcccucuucccucuagguuauuggguuccugcaaguuaucugggaacugaucaaaguuucaggguaagaugguggugaugaacacccugagggucacucguccuguguccccaugcaaauugcuguggagaagcuuccagauuccaaggcccaggccauucugcagccucuguacuuguacuuacaaaauccagaaauaagccugagaguacaccauuucauuaaagagaggagaaaaggcuuguugguuuuauaaaaaucacgcguguuaagcguuuguagcugugaugucaugggcauuccagugugagauuauaugccuuaugga

SEQ ID NO: 190584 - RNA, 51 nt, Homo sapiens
uugcuggaaaagcuugggaaaugacuuaacgaagaugcguaaaccuuaauu

SEQ ID NO: 190585 - RNA, 27 nt, Homo sapiens
guuuuucuguugugccuugccccagag

SEQ ID NO: 190586 - RNA, 46 nt, Homo sapiens
acucuggcuauagguaaguccugaaauaugagauacauugccaaga

SEQ ID NO: 190587 - RNA, 47 nt, Homo sapiens
auguucaccaucauuaugguuguuuuaaaucaccuaacccaggcccu

SEQ ID NO: 190588 - RNA, 45 nt, Homo sapiens
uggcaugauuugagagugaagguaacagauauaagaaggaagcua

SEQ ID NO: 190589 - RNA, 35 nt, Homo sapiens
gugagugcacucaugaguuuagaaguggaggcaga

SEQ ID NO: 190590 - RNA, 41 nt, Homo sapiens
cuuuuuguuaaaaccaccuuuuggaacuugugaaggugcgu

SEQ ID NO: 190591 - RNA, 46 nt, Homo sapiens
aucugcugggcugaaggggugaguggcggcucuuuucacucagcug

SEQ ID NO: 190592 - RNA, 46 nt, Homo sapiens
guuuauuauuccccucgaugcccaggggcucugauagcagcacugg

SEQ ID NO: 190593 - RNA, 46 nt, Homo sapiens
uggcaagggagccgggcuuucaugcucccuuacccaauggucauug

SEQ ID NO: 190594 - RNA, 49 nt, Homo sapiens
uggauauuuaacaaauguucccuuuggggugaggguagcagggauaagg

SEQ ID NO: 190595 - RNA, 36 nt, Homo sapiens
uuuaggcauccugaugcaggcugcauaggcaaccag

SEQ ID NO: 190596 - RNA, 46 nt, Homo sapiens
ugagucagcacgcuagaaaucauggcaggcuaaugggaaagcagag

SEQ ID NO: 190597 - RNA, 52 nt, Homo sapiens
caaccucccacccccacguguuauucucuaguuacaaagaagcgauacacag

SEQ ID NO: 190598 - RNA, 41 nt, Homo sapiens
aaauuugugucuaacaccagcuuuuaacuugguugguguag

SEQ ID NO: 190599 - RNA, 44 nt, Homo sapiens
gauggguugaugugguaaauuuggggauuggggaguugaucaag

SEQ ID NO: 190600 - RNA, 44 nt, Homo sapiens
gaaaguuuccuaaauacuuucaacacaggauugugaaauggaaa

SEQ ID NO: 190601 - RNA, 46 nt, Homo sapiens
caaguggaagacuggaggugggaaaguuggagcaauuauuggccag

SEQ ID NO: 190602 - RNA, 46 nt, Homo sapiens
auuugucgaguuucugacaguaccagauuccuuucacauuggccac

SEQ ID NO: 190603 - RNA, 45 nt, Homo sapiens
caagacugaggcagaaggaaaaugacccggguuaaggcaaggaau

SEQ ID NO: 190604 - RNA, 46 nt, Homo sapiens
gcacaccccggcuaugccuuauucauuuuuguaucuuccucuaaag

SEQ ID NO: 190605 - RNA, 48 nt, Homo sapiens
uauguacacagcuuaaacuauauuaaccaucuggaagagaugauauau

SEQ ID NO: 190606 - RNA, 27 nt, Homo sapiens
acugcauaaaauggaaauuuaggaggg

SEQ ID NO: 190607 - RNA, 486 nt, Homo sapiens
ccagaacaacuaaggcagaugcuuuguaaaagugaauugcuaaaggaaaugccuuugacacggaaagacaaacaucauauguucucaguucuuugugggaucuaaagaucaaaacaauaugaacucaugaacauagagaguagaaagaagguuaccaugaguucaugaggcugggaaugguaguugggggcugggcagggggagguggggaugguuaauggguacaaaaaaauagaaagaaugaauaagaucuacuauuuuacaacauggugacuauagugaauaauaacuuaauugcaaauuuuaaaauaacuacaagaguguaauuggauuguuuguaacacaaaguauaaaugcuugaggggauggauacuccccaugcuccacgaugugauuauucugccuugcaugccugaaucaaaacaucucauauaccccauaaauauauacaccuacuauguucccacaaaaauuaaaaauuuaaua

SEQ ID NO: 190608 - RNA, 45 nt, Homo sapiens
uuauucucugauuauuuuguguguauagauuuaguuugcuccagc

SEQ ID NO: 190609 - RNA, 46 nt, Homo sapiens
ucaauccaauacaggaaagaggcaugaaagcuacacauaggccaga

SEQ ID NO: 190610 - RNA, 48 nt, Homo sapiens
ucauuuuggcuuuguuuauuguuuuauucuaaauaagauauaccuaaa

SEQ ID NO: 190611 - RNA, 46 nt, Homo sapiens
auaucauuguuguuugauuaaaugaggaacaucuaaaagcaauuaa

SEQ ID NO: 190612 - RNA, 41 nt, Homo sapiens
guaagcauugguggccacaccaccuccuuacaaagcaacua

SEQ ID NO: 190613 - RNA, 44 nt, Homo sapiens
ugcuuaguaaucaguggauauugaaauauucaaaauguacagag

SEQ ID NO: 190614 - RNA, 31 nt, Homo sapiens
ccagggagggccgagggacaagagacgacag

SEQ ID NO: 190615 - RNA, 46 nt, Homo sapiens
gccagugagcuggggaagaguaccaacacauucuucaagcccccuu

SEQ ID NO: 190616 - RNA, 23 nt, Homo sapiens
agugauugagaaaaauuuaauga

SEQ ID NO: 190617 - RNA, 46 nt, Homo sapiens
ccccgccauccauacucaauuaucagaagauccauccagaucccug

SEQ ID NO: 190618 - RNA, 45 nt, Homo sapiens
caacaaauguaaauguguuuugcaggaggaaaauccacuugcugg

SEQ ID NO: 190619 - RNA, 68 nt, Homo sapiens
caggaaccagcucucugugggccacacaugauguuugacgaagaucguugcgagugugucuguaaaac

SEQ ID NO: 190620 - RNA, 69 nt, Homo sapiens
accaugucccaaagaucuaauccagcaccccaaaaacugcaguugcuuugagugcaaagaaagucugga

SEQ ID NO: 190621 - RNA, 46 nt, Homo sapiens
agaugccccuuucauaccagaccaugugcaaguggcaaaacagcau

SEQ ID NO: 190622 - RNA, 37 nt, Homo sapiens
caugcugcuuugccaaguugcugucacuguuuuuuuc

SEQ ID NO: 190623 - RNA, 44 nt, Homo sapiens
uggaugucuucuagcugcagaugccucugcgcaccaaggaaugg

SEQ ID NO: 190624 - RNA, 65 nt, Homo sapiens
aaucacagguaaaacauuaaauuuucucauuuauauuguaucacuuauuguuauauuugaagcag

SEQ ID NO: 190625 - RNA, 30 nt, Homo sapiens
uaaugucuuugccacuuuaaguggcugggu

SEQ ID NO: 190626 - RNA, 46 nt, Homo sapiens
gagcugggaauggccaccgugccucagcuacacucucucggguuag

SEQ ID NO: 190627 - RNA, 46 nt, Homo sapiens
gauugaaagagggcauaagguuauaauugucacccaugcuuaugga

SEQ ID NO: 190628 - RNA, 48 nt, Homo sapiens
ggaauuguaccuaauuuauuuuuuaaccaaauagcauaucuucuugag

SEQ ID NO: 190629 - RNA, 48 nt, Homo sapiens
cugcagaaaguaacauucugaaaaggaacagccaugccuguagcccaa

SEQ ID NO: 190630 - RNA, 62 nt, Homo sapiens
augggcucuuaaccuuguacgagaaagaaaagggugaggaagaaaauggauugaaggaauug

SEQ ID NO: 190631 - RNA, 51 nt, Homo sapiens
acaauucuuaugugugugugcauuuuuaaaauuaauaaacuuagcucuagg

SEQ ID NO: 190632 - RNA, 78 nt, Homo sapiens
cucuugggggaccacugccaguuugcaaacaauuccacuccuggaaaagguuuaagagaguuucucuccuuuauggag

SEQ ID NO: 190633 - RNA, 77 nt, Homo sapiens
ugucagaaauauccagauuuaaauuucauaauuggaggagagggaccaaagagaaucauuuuggaagaaguucggga

SEQ ID NO: 190634 - RNA, 46 nt, Homo sapiens
aaauagcagacuugguuuauaaauuaaauuucuuuuguagcaugag

SEQ ID NO: 190635 - RNA, 50 nt, Homo sapiens
cuguuaaguugugacuugaccuucuucauugacaucguauaaaccccaga

SEQ ID NO: 190636 - RNA, 45 nt, Homo sapiens
ugagaauaaugagauaucugaaaccagguagaaggaagccuagau

SEQ ID NO: 190637 - RNA, 36 nt, Homo sapiens
acuacuaguacuuuguuccuguuguaugcauucucc

SEQ ID NO: 190638 - RNA, 30 nt, Homo sapiens
cuccaucuucaguuguguuugugaagguau

SEQ ID NO: 190639 - RNA, 36 nt, Homo sapiens
auuauccacaugguguguauuaugaauucuuugaac

SEQ ID NO: 190640 - RNA, 48 nt, Homo sapiens
acaacauucacaaaauuuauuacuuuuuaaaaaauaacaugccuauua

SEQ ID NO: 190641 - RNA, 47 nt, Homo sapiens
aagaaauauauuuguguuuuguuuguacuaaaaugcaaaagcaagag

SEQ ID NO: 190642 - RNA, 44 nt, Homo sapiens
cucuacccugcuacuuaguugauuuuaaagugaauuuacaguga

SEQ ID NO: 190643 - RNA, 48 nt, Homo sapiens
ggccucaaauuucauacuaccauaacuguuuuuauauauugccacuaa

SEQ ID NO: 190644 - RNA, 45 nt, Homo sapiens
uauagcuauguuuuauguauaucucuuaugaacaauauagccaga

SEQ ID NO: 190645 - RNA, 41 nt, Homo sapiens
cacuguuggucuuucuucuauggccaguuccuacccuaagu

SEQ ID NO: 190646 - RNA, 47 nt, Homo sapiens
gaaucaacaugaauccuucacaaauucuuccaagaaauagaagaaga

SEQ ID NO: 190647 - RNA, 42 nt, Homo sapiens
guaguauaaauauuauuauuacuuuguaaaauacaucugaga

SEQ ID NO: 190648 - RNA, 57 nt, Homo sapiens
aaacuaauucuaggucucuaaauaaaauuuaaaaagccagaaauggaguagauacag

SEQ ID NO: 190649 - RNA, 74 nt, Homo sapiens
uguaaaagaccagaaaaccauauuggacaaaaagaagcucauagcauucugguuggaacguuaugcuaagaggg

SEQ ID NO: 190650 - RNA, 359 nt, Homo sapiens
uuaagaaaacaaaguuagaagacuauucuggguugggcgcgguggcucacgccuguaaucccagaacuuugggaggccgaggcggguggauuaugaggucaggagaucaagaccauccuggcgaacacggugaaacccugucucugcuaaaaauacaaaaaaaaaaaaaauuagcugggcgugguggugggcaccuguagucccagcuacucgggaggcugaggcagaauggcgugaacccaggagguggagcuugcagugagcacagaucacaccacugcacuccagccugggcgacagagcaagacuccaucucaaaaaaaaaaaaaauuccguauauaauuuuguguauuauaaaa

SEQ ID NO: 190651 - RNA, 43 nt, Homo sapiens
aauauagcaauacuuaaauauauacauaagaagauugguccaa

SEQ ID NO: 190652 - RNA, 44 nt, Homo sapiens
ugagcauccccaacuuugcuggaguguuugugaguguauuugug

SEQ ID NO: 190653 - RNA, 42 nt, Homo sapiens
cgcccagaauaaagccaagcucaucucugagacccggaggag

SEQ ID NO: 190654 - RNA, 43 nt, Homo sapiens
caacuggaaucaauuugcauuugaaaauuagaucagcacaaag

SEQ ID NO: 190655 - RNA, 32 nt, Homo sapiens
ggaaguccuuguuuuccaguugucuaaaggaa

SEQ ID NO: 190656 - RNA, 46 nt, Homo sapiens
gcguuugaguuuuaaacuaggcuaugagaugaaggauggccuaagg

SEQ ID NO: 190657 - RNA, 46 nt, Homo sapiens
uggcaaaguuguuagugugucagguaacuuuuccucuauucagugg

SEQ ID NO: 190658 - RNA, 46 nt, Homo sapiens
uuuauaacacugcacaacugagcauaacccaaauacccaucaauug

SEQ ID NO: 190659 - RNA, 46 nt, Homo sapiens
ugggggcuguuauaauuuuaauuuuauuuaaaaauuuugcuaugaa

SEQ ID NO: 190660 - RNA, 42 nt, Homo sapiens
uaugguaucguguaauagaugauagcuugguuguuggaguga

SEQ ID NO: 190661 - RNA, 41 nt, Homo sapiens
gaaugagcuuuuagauuaaaccaaagucuggguuuuuuaca

SEQ ID NO: 190662 - RNA, 46 nt, Homo sapiens
uguuuccucaaaaaucuaaaaucaggaagugagaauuuccuaauug

SEQ ID NO: 190663 - RNA, 70 nt, Homo sapiens
aaaucuagacuaaagauuaguaacgcaacacuucuaggauuauuuaugcucacagcccccaugaauugua

SEQ ID NO: 190664 - RNA, 46 nt, Homo sapiens
uuugcuagcauaauuuaucggaauaacagucucuuuguaauuucaa

SEQ ID NO: 190665 - RNA, 41 nt, Homo sapiens
cuccaucauuaacauaaauucauccuuucauaauguccugg

SEQ ID NO: 190666 - RNA, 28 nt, Homo sapiens
uuauuccauauuugaggcuaucacacuu

SEQ ID NO: 190667 - RNA, 44 nt, Homo sapiens
aguaggauccaggcauccacaaaagaagaccaagcuuuguccaa

SEQ ID NO: 190668 - RNA, 39 nt, Homo sapiens
aggaaaacugccagugauugagaauccguuuucguugga

SEQ ID NO: 190669 - RNA, 45 nt, Homo sapiens
uaaaguacuuucacaugcuggcugugaccaucagugcacagccug

SEQ ID NO: 190670 - RNA, 45 nt, Homo sapiens
uuuauguuguugguaacaguucaauucauuaacguucuugccuag

SEQ ID NO: 190671 - RNA, 41 nt, Homo sapiens
uucucagcgccaguuccuggcagucacuaccaguugauuag

SEQ ID NO: 190672 - RNA, 23 nt, Homo sapiens
gaccuugcucuuaaugccaccua

SEQ ID NO: 190673 - RNA, 47 nt, Homo sapiens
cagaggcuaggaauagugauccugcuauaaugugagaacccaaauca

SEQ ID NO: 190674 - RNA, 41 nt, Homo sapiens
cuugacuauucuagaaguuauacuuggauuuuuuccuggga

SEQ ID NO: 190675 - RNA, 42 nt, Homo sapiens
aaaauuaaacuaauguugcugcuucauuaguuggugggagaa

SEQ ID NO: 190676 - RNA, 82 nt, Homo sapiens
gauuguugaugcauucuaaccaacucacacauauacacaaaaucaacauggggauggagaagagaauuagcguuugcagcag

SEQ ID NO: 190677 - RNA, 37 nt, Homo sapiens
uuaugcagaugugaaagagccugagagcuuuccuuuu

SEQ ID NO: 190678 - RNA, 42 nt, Homo sapiens
cagagguucugacugcugccugcuuacuuuuagugucgauga

SEQ ID NO: 190679 - RNA, 46 nt, Homo sapiens
ccauacaauagguguggaauuuuuaaauaaagauuuggaaguggau

SEQ ID NO: 190680 - RNA, 48 nt, Homo sapiens
ggcaggaaaaucaucacuuuuuaaaguaauucuccuuggagauggugg

SEQ ID NO: 190681 - RNA, 374 nt, Homo sapiens
aaauuaagguaaaauuuaugaccuauguaauaugcuuuucuuauauagauuucuuucuuucuuuuuuuuuuuuuuuagauagagucuagcucugucccccaggcuagagugcaguggugcaaucuuggcucacugcaaccuccaccucucagguucaaguaauucucaugccuccgccuccugaguagcugggauuacaggcaugugcuaccacgcccggcuaauuuuuguauuuuuagcagagaugagaugaggucucaccauguuggccaggcuggucucgaacuccugaccucaagugaucuguccgccccagccucccaaagugcugggauuacaggcaugagccacugugccuggccccuuauucagau

SEQ ID NO: 190682 - RNA, 27 nt, Homo sapiens
ugaauuugaucuguaggacuaggaucc

SEQ ID NO: 190683 - RNA, 67 nt, Homo sapiens
uuaggaaacagacacauacacaacugaaggugauuagagcauaaguaaaugagagcuguaaagaggu

SEQ ID NO: 190684 - RNA, 25 nt, Homo sapiens
cagagugguuuuauggacaauuagg

SEQ ID NO: 190685 - RNA, 55 nt, Homo sapiens
aaaaagccuuacagaccucuguuucuacaacuugcugugcagaacucuaacagau

SEQ ID NO: 190686 - RNA, 37 nt, Homo sapiens
uucauugccacauucuuuauucaagugugacagagag

SEQ ID NO: 190687 - RNA, 47 nt, Homo sapiens
acuaaguaggccaucaacagagaacauuuauuaaggacuuuuuugua

SEQ ID NO: 190688 - RNA, 49 nt, Homo sapiens
accauuucuucugucuggacuacaguacucuggaggccuaaagagaaga

SEQ ID NO: 190689 - RNA, 69 nt, Homo sapiens
uugugucugcugugguaaauuccucguuuauacuacaaaguuucucuucuggagacuuuugggaucugg

SEQ ID NO: 190690 - RNA, 61 nt, Homo sapiens
ugcauguuggugaaggaagaagugggguggaagaaguggggugggacgacagugaaaucua

SEQ ID NO: 190691 - RNA, 40 nt, Homo sapiens
ugacugugcugccccuuucacaucaaagaacuacugacaa

SEQ ID NO: 190692 - RNA, 57 nt, Homo sapiens
ccuccgcaaccaugucugacaaacccgauauggcugagaucgagaaauucgauaagu

SEQ ID NO: 190693 - RNA, 44 nt, Homo sapiens
cggcccgcauccuugcggagaggccgcggcuaggaaauggaaac

SEQ ID NO: 190694 - RNA, 39 nt, Homo sapiens
cgcggcggccgcuuugugugcggggcugcauugugacgc

SEQ ID NO: 190695 - RNA, 44 nt, Homo sapiens
gggagcuggggggaugcgaaacacccuagauacuggauaauggg

SEQ ID NO: 190696 - RNA, 46 nt, Homo sapiens
aaugugcuccaggcugcagagccccugcagagggagaauuucacaa

SEQ ID NO: 190697 - RNA, 49 nt, Homo sapiens
aaacugaaaucaaauagugccaagaaaauaugaagagucaguugcagga

SEQ ID NO: 190698 - RNA, 45 nt, Homo sapiens
aacucucucccaguccgccuuuguugaauccauccacgccacagu

SEQ ID NO: 190699 - RNA, 46 nt, Homo sapiens
uuuuuucuuccaauuaaggaaagugccacaagcacuaacagguaag

SEQ ID NO: 190700 - RNA, 42 nt, Homo sapiens
gaagcagcuggaggaugauuguuacuacauuaacaggaggaa

SEQ ID NO: 190701 - RNA, 38 nt, Homo sapiens
aagcaguuccucugacuguagugaaaacaaggaugaag

SEQ ID NO: 190702 - RNA, 46 nt, Homo sapiens
aacguuagcagagucaugcuugugacuacugcccucucggccagca

SEQ ID NO: 190703 - RNA, 96 nt, Homo sapiens
agcacaggaagaaagaagaagcgcugcagguugccugguguggacucugucuuaaaaggccuccccacugaagaaaaagaugaaaaugaugaaaac

SEQ ID NO: 190704 - RNA, 45 nt, Homo sapiens
gauuacagcguaaauuggcaagaaaagcuguagcucgccuguaag

SEQ ID NO: 190705 - RNA, 88 nt, Homo sapiens
aaauauuucuucguuucagauuguugauguuauuguugggaaagacgaaaaaggcagaaagaucccagaauaucugauccauuuuaau

SEQ ID NO: 190706 - RNA, 43 nt, Homo sapiens
gccgccgcggagggacagggaggaggcgcgggcugggggaccc

SEQ ID NO: 190707 - RNA, 49 nt, Homo sapiens
gaacuuaccuuucucuguaaauguuauauuaugugaaauguauacagga

SEQ ID NO: 190708 - RNA, 45 nt, Homo sapiens
ucagucagaaggauauguauaauaucauuagaauucacaaucaga

SEQ ID NO: 190709 - RNA, 46 nt, Homo sapiens
aguggguuuacccuucugagcagauguucuggaaugcaauguuaaa

SEQ ID NO: 190710 - RNA, 45 nt, Homo sapiens
ucagacuucucacauaauuugacuguuuugaagagucacauuacu

SEQ ID NO: 190711 - RNA, 42 nt, Homo sapiens
acacuccacguacucauaggcgcguuccuggugggcaggcac

SEQ ID NO: 190712 - RNA, 42 nt, Homo sapiens
caggcuguccagugaauacagagccaucuggcccaaccugug

SEQ ID NO: 190713 - RNA, 42 nt, Homo sapiens
uuggaucugggcuucucuggaacuagugaauggaaagucaag

SEQ ID NO: 190714 - RNA, 22 nt, Homo sapiens
uuucugcacgagagaauaacau

SEQ ID NO: 190715 - RNA, 33 nt, Homo sapiens
cuucaugcaucgggcauccugaagguggggacg

SEQ ID NO: 190716 - RNA, 30 nt, Homo sapiens
gcagcagugacuucacgccgccgccgccgc

SEQ ID NO: 190717 - RNA, 49 nt, Mus musculus
uuggaagccagaaggaaaaucaccgaaauucaguuuucauguagagaga

SEQ ID NO: 190718 - RNA, 53 nt, Mus musculus
cucaucagccaagaugugugacuucaccgaggaccagaccgcagaauucaagg

SEQ ID NO: 190719 - RNA, 46 nt, Mus musculus
gaguccagaaaagagaucacuuaauucuaguagccagggcauucag

SEQ ID NO: 190720 - RNA, 45 nt, Mus musculus
gaaaagaacaagaaggaagaaaaagaauuaagaugcccuggugac

SEQ ID NO: 190721 - RNA, 46 nt, Mus musculus
ucauuuaaaaaaaaaaaaaaaaagaaagaaagaaagaaaaaaagaa

SEQ ID NO: 190722 - RNA, 23 nt, Mus musculus
gccccugcuggcaccccggccug

SEQ ID NO: 190723 - RNA, 46 nt, Mus musculus
ucuuacauccugaagacuucgguuaaggauucagccucagcuuaga

SEQ ID NO: 190724 - RNA, 45 nt, Mus musculus
uuuauugauuuuaacaaaauuuguuuguguguuugugugcuguuu

SEQ ID NO: 190725 - RNA, 46 nt, Mus musculus
ggacagaacgcacccugagccaaggcucucuaggauugcaccacag

SEQ ID NO: 190726 - RNA, 46 nt, Mus musculus
cuaauuaaaaaaauaaauaaauaaaaaaaagaaaguagcagcuuau

SEQ ID NO: 190727 - RNA, 45 nt, Mus musculus
gguguucugugucagaaccaauagaucucucagaacuggaagcug

SEQ ID NO: 190728 - RNA, 46 nt, Mus musculus
uucaaacuuggcucaaaaucguggaccugauuuugcucucggaaau

SEQ ID NO: 190729 - RNA, 46 nt, Mus musculus
acaaaaaggaaaaacaaacaaacaaaacaaagauaaaauggaccag

SEQ ID NO: 190730 - RNA, 45 nt, Mus musculus
cccuaggaguccuucaauaacguuaaacaguggcugcaggagaua

SEQ ID NO: 190731 - RNA, 46 nt, Mus musculus
cuggugguagccaucagugagccaagaugggugcauucaaauauau

SEQ ID NO: 190732 - RNA, 45 nt, Mus musculus
uugcaggcucucccuguggaauccaguuugacucuccccagagcu

SEQ ID NO: 190733 - RNA, 46 nt, Mus musculus
uauaaaauggaaaacuaagauauaccuuccagaguuucucggugga

SEQ ID NO: 190734 - RNA, 60 nt, Mus musculus
uguaagguuugagcuugucccaagaucagagcuucuagaccuaggaagaguaagaccaca

SEQ ID NO: 190735 - RNA, 41 nt, Mus musculus
uugggugggggcaccggagagcagggagcugguucugggga

SEQ ID NO: 190736 - RNA, 48 nt, Mus musculus
cuuugcacacaggaaaacaaaacugaaaguguuugcccagccugacuc

SEQ ID NO: 190737 - RNA, 45 nt, Mus musculus
uugcagaagcugauugaagagacagacagauuuguaguauucaca

SEQ ID NO: 190738 - RNA, 45 nt, Mus musculus
agcuggauagcuucugugugagagaugagucacuagccgugggga

SEQ ID NO: 190739 - RNA, 46 nt, Mus musculus
cagaaggucgcuacugcgugcagcucucccagauucaaagccagau

SEQ ID NO: 190740 - RNA, 46 nt, Mus musculus
ugguucuguguuuaggagaauuaaaagacuuguuggauugggcuag

SEQ ID NO: 190741 - RNA, 41 nt, Mus musculus
ggaggcgcaggcgcacaccaacacaccacagaggcccaaga

SEQ ID NO: 190742 - RNA, 45 nt, Mus musculus
aggacgggcuugcaggagucugccccgcccaucacacacccauua

SEQ ID NO: 190743 - RNA, 45 nt, Mus musculus
gcuguuacagggcugaucccacuuaacauguccugagaccugaac

SEQ ID NO: 190744 - RNA, 51 nt, Mus musculus
gauggucauuucuacguggcuuuguugugucugccagugaguugcggaagc

SEQ ID NO: 190745 - RNA, 41 nt, Mus musculus
cagccgcugggggcgccagagaggcgccgugugcgcggggc

SEQ ID NO: 190746 - RNA, 44 nt, Mus musculus
ucccaagguucccuuuauauagccagaggcuuggcguucauuca

SEQ ID NO: 190747 - RNA, 45 nt, Mus musculus
aaaauugaacucuuuguggguggugagcuuauugauccuggagau

SEQ ID NO: 190748 - RNA, 42 nt, Mus musculus
aguguucugaaacaaagcuguauaggaacagugaggccagaa

SEQ ID NO: 190749 - RNA, 46 nt, Mus musculus
gggcgcacgcgcgugacgugaccgcggcgaggggcggggcggagau

SEQ ID NO: 190750 - RNA, 45 nt, Mus musculus
aguuuucugauuuauucuuuuugguugugaaaaggccgugcagau

SEQ ID NO: 190751 - RNA, 61 nt, Mus musculus
ccaguauuuuugacccuugcuucgggcuggugucagcauugugccugauggagagauuaug

SEQ ID NO: 190752 - RNA, 41 nt, Mus musculus
cguuuucuuuuuuuuuuuucuuuucuuuuuuuuuuuuuuuu

SEQ ID NO: 190753 - RNA, 45 nt, Mus musculus
agcagauccggaaaccucccuuccgguucccagguccgcguuucg

SEQ ID NO: 190754 - RNA, 41 nt, Mus musculus
gcggggcgggggucugugggacaggcagggaggcggggcag

SEQ ID NO: 190755 - RNA, 45 nt, Mus musculus
cugggacaagaaaaaggcaagagaacaugugagguaaauguagag

SEQ ID NO: 190756 - RNA, 45 nt, Mus musculus
ucaaccgcuggaccauacugagugccucuaagcacuaucccugga

SEQ ID NO: 190757 - RNA, 46 nt, Mus musculus
aaaaaaaaaaaagaaaagaaaaaccuuaaaaacucauuggauaaau

SEQ ID NO: 190758 - RNA, 41 nt, Mus musculus
ggagucgggcggccgcgcggggccugugggaagcggaguga

SEQ ID NO: 190759 - RNA, 45 nt, Mus musculus
cgugagcggggcggcacuggcugcgggcgaacgcggcgcgcaggc

SEQ ID NO: 190760 - RNA, 42 nt, Mus musculus
uacccgcuaggaugaagcugcccacacaagagaugaagccag

SEQ ID NO: 190761 - RNA, 46 nt, Mus musculus
aaauacugaagaaagccucgaaggcacuggguaguccuuuguaggg

SEQ ID NO: 190762 - RNA, 46 nt, Mus musculus
cuuacaucacacccaacuauucacaaagauguuucuccugccagag

SEQ ID NO: 190763 - RNA, 46 nt, Mus musculus
cuuggguuaacagugcaggagacaccagaccugguccaguuuuggg

SEQ ID NO: 190764 - RNA, 46 nt, Mus musculus
cuucucauuuggugucucacaaucaagccagggucucaggucagaa

SEQ ID NO: 190765 - RNA, 46 nt, Mus musculus
uauuuucugcugggucuacauauagccuuuguauuguucccuugag

SEQ ID NO: 190766 - RNA, 46 nt, Mus musculus
gcuaccuuacagcuauuuuauuauggucugauucuugggguggguu

SEQ ID NO: 190767 - RNA, 46 nt, Mus musculus
aauaauaauaauaauaauaauaauaauaauaauaaagguaggaucu

SEQ ID NO: 190768 - RNA, 87 nt, Mus musculus
aaaaagggcugugacggaucuacgcaagagaggugaaccaucagaugcaguugaggaacucguguggaaacugaugcagguggauga

SEQ ID NO: 190769 - RNA, 46 nt, Mus musculus
auuuuaaaaccguuguuugcuuauaguagcauuaaucagagcagau

SEQ ID NO: 190770 - RNA, 50 nt, Mus musculus
ucuguagcaccuuguccacagcuaucaacuauuuagaggcaggaggucau

SEQ ID NO: 190771 - RNA, 41 nt, Mus musculus
cuggggcuggggagcaacuggggaggaugucaccuggagcg

SEQ ID NO: 190772 - RNA, 46 nt, Mus musculus
uuucugcagagaacaaagacaaggagucacucagagguuuguagag

SEQ ID NO: 190773 - RNA, 42 nt, Mus musculus
cggggcuccccgcccacacuggguacgugguucgguagugag

SEQ ID NO: 190774 - RNA, 46 nt, Mus musculus
aaggaaauaaaaaacccuugaccaaaauucuggaaccccagugaaa

SEQ ID NO: 190775 - RNA, 46 nt, Mus musculus
cugggaacccaagaacaaaaagaaggcagauugggcaacgcagcag

SEQ ID NO: 190776 - RNA, 46 nt, Mus musculus
agaacagaagcaggagaccaguuauaaauuguguuuuaacugugag

SEQ ID NO: 190777 - RNA, 42 nt, Mus musculus
ggggggggaggaggaggaggaggaggaggaggaggaguaugg

SEQ ID NO: 190778 - RNA, 45 nt, Mus musculus
aagucaaucaauaggugaaaaggaggaggcuggccuucugaguca

SEQ ID NO: 190779 - RNA, 41 nt, Mus musculus
ccacuucccuccuaauacuucugguacugcagcaaaauagg

SEQ ID NO: 190780 - RNA, 46 nt, Mus musculus
acaguguaucuguucugugccuuuagcuuuuuuggucgggcuuuug

SEQ ID NO: 190781 - RNA, 41 nt, Mus musculus
ugggcuccagugagcgccgguuccauugggggggcgggggg

SEQ ID NO: 190782 - RNA, 46 nt, Mus musculus
uugucuccagaagagcuggauauucuuuguuacaauuauggcagac

SEQ ID NO: 190783 - RNA, 46 nt, Mus musculus
auacgugaauuuguuuacuuauuuugaaauaacaggucaccacucu

SEQ ID NO: 190784 - RNA, 46 nt, Mus musculus
uuugccuuugauuaauauuaguacaaaaaaggaauguuuugugcag

SEQ ID NO: 190785 - RNA, 46 nt, Mus musculus
auacauauaagcaugcaauaacaauuagggaggaaaaggccaugaa

SEQ ID NO: 190786 - RNA, 42 nt, Mus musculus
aggaaggugagugaggcaggaagucccgccuuuuagccccag

SEQ ID NO: 190787 - RNA, 45 nt, Mus musculus
augaaaauacacuggaaaauccuucaaguagucuaaaaaagagag

SEQ ID NO: 190788 - RNA, 42 nt, Mus musculus
uaguuauaucaagaagaagaagaaagagaaggagggggagga

SEQ ID NO: 190789 - RNA, 51 nt, Mus musculus
uucuuccaagagccucuucccacuuugucacugagaauuugggacacacgg

SEQ ID NO: 190790 - RNA, 42 nt, Mus musculus
guguagugguaucaugcaagauucccauucuugcgacccggg

SEQ ID NO: 190791 - RNA, 45 nt, Mus musculus
uucucugcuuuguccuggaacucacucuguagaucaggcugaccu

SEQ ID NO: 190792 - RNA, 45 nt, Mus musculus
cagaaauccuaaaagaagcccgcgugcguuagcgcacucacuuua

SEQ ID NO: 190793 - RNA, 46 nt, Mus musculus
uccuccaaggagaacagccugcuaauuuaaucaccguggcaggaag

SEQ ID NO: 190794 - RNA, 41 nt, Mus musculus
cugaaaugagagagagagagagagagagagagggagagaga

SEQ ID NO: 190795 - RNA, 41 nt, Mus musculus
agccuaauugaugaaggaagaggaagaggaggaggggggaa

SEQ ID NO: 190796 - RNA, 46 nt, Mus musculus
gaugaugaaggaaagagacaaggaaagaaaaagaaguaugcacaga

SEQ ID NO: 190797 - RNA, 41 nt, Mus musculus
uaaacaacuaaauaugugguuauacguugcaaugggugacu

SEQ ID NO: 190798 - RNA, 42 nt, Mus musculus
uucaaaccaucacagugcaccucauuguucaagagaggggca

SEQ ID NO: 190799 - RNA, 46 nt, Mus musculus
uuucucugacucuucaggaccuucuguccuucaaccucggcuagaa

SEQ ID NO: 190800 - RNA, 46 nt, Mus musculus
aauguuucugggcaacuuguauuugugucuccugugguuuguagua

SEQ ID NO: 190801 - RNA, 42 nt, Mus musculus
caaaaaaaaaaaaaaagaaaaaaagaaaagaaaaagaaaaag

SEQ ID NO: 190802 - RNA, 45 nt, Mus musculus
uggggugugugugugugugagagagagagagagagagagacucga

SEQ ID NO: 190803 - RNA, 46 nt, Mus musculus
uuuuaaauuccuuuuuuuaaacuuccaguuuauuguguaccaagag

SEQ ID NO: 190804 - RNA, 45 nt, Mus musculus
uuuacguguguggguguuuugcuugcaagcuuggugcccccagga

SEQ ID NO: 190805 - RNA, 44 nt, Mus musculus
gacaucacagugaacagccagcucuccccagcuccguugcccaa

SEQ ID NO: 190806 - RNA, 77 nt, Mus musculus
aagcugcaucagagacaacugaagaugaaaaaaauaaagccaaaagggaaaaaacaaaaaacaaaaaacuacugucc

SEQ ID NO: 190807 - RNA, 41 nt, Mus musculus
acagagaacgagauccguggucugugccucaaaucccggga

SEQ ID NO: 190808 - RNA, 95 nt, Mus musculus
agguuacugccaaacacaaaaggguccucuccuggggaaggcccacaugauagagggagggaaugaaaagccaccauugggagagguaugagaga

SEQ ID NO: 190809 - RNA, 47 nt, Mus musculus
ccuggcguuuccgucgccgaucccugcuuaauacccugcggcgcuug

SEQ ID NO: 190810 - RNA, 46 nt, Mus musculus
acugcacuucccgggaggaaacugccgcccuaaaugcguuguagac

SEQ ID NO: 190811 - RNA, 46 nt, Mus musculus
ucuugucuuagcccucacagguaaacuucuagauggauggcuggga

SEQ ID NO: 190812 - RNA, 46 nt, Mus musculus
augucuuuuucucuuaaauuuuucuuuacauuuuuauuuagugugc

SEQ ID NO: 190813 - RNA, 42 nt, Mus musculus
caccgcccgaaccguaagugccaccgcgcuccccgcccugcc

SEQ ID NO: 190814 - RNA, 64 nt, Mus musculus
gucaccguuucucuuuaagugucugcccuacugcccacaguucucuguugugacuugaagugcc

SEQ ID NO: 190815 - RNA, 84 nt, Mus musculus
ucagcuuuuauacaauaaagcugugucucuucacccguaaaaaaaaaaaaaaaaaaaaaaaaaaaaggaaaaagaaaagaaaua

SEQ ID NO: 190816 - RNA, 55 nt, Mus musculus
aucuggggcgcgcgcgcagguggcggaggagcgagcaggagggcgugggcggugu

SEQ ID NO: 190817 - RNA, 45 nt, Mus musculus
caucccucuauuaagagaacuuaagagaaaacauuaagagauuaa

SEQ ID NO: 190818 - RNA, 46 nt, Mus musculus
uugacuggacuuucucaugggggcggggguggaugggagugguuag

SEQ ID NO: 190819 - RNA, 93 nt, Mus musculus
cgguaggggguagaggaaccagaaguacauaacagaggauuguggguaaucggagggcggcugagcgcggaucgcuuaaagggcuagggugag

SEQ ID NO: 190820 - RNA, 45 nt, Mus musculus
uugcugcuccccccgccccccgcagccauggaaacggggaaagag

SEQ ID NO: 190821 - RNA, 46 nt, Mus musculus
uaacaaaauuaaacauucaaaaaggcuuaaaaaaauggaggcagaa

SEQ ID NO: 190822 - RNA, 23 nt, Mus musculus
ugagaaaugccaaacccucgaga

SEQ ID NO: 190823 - RNA, 27 nt, Mus musculus
ucaugggcucugcccuccuggagcagg

SEQ ID NO: 190824 - RNA, 72 nt, Mus musculus
gucuggggaaaaaaauccaguccggguuuugucugaacggagaccaggaaggcagcgaggacuggggaagag

SEQ ID NO: 190825 - RNA, 45 nt, Mus musculus
ggccccaacacauccccaccccaccccccagggccgcccagaggc

SEQ ID NO: 190826 - RNA, 54 nt, Mus musculus
aucgcgccauagaggaagccgaagaccaccgugagaagcagcagcgucuggaag

SEQ ID NO: 190827 - RNA, 42 nt, Mus musculus
uuuaaacaaauccugagcugugccgaagugcggggggugggg

SEQ ID NO: 190828 - RNA, 45 nt, Mus musculus
ucgggauauaguucagcagugggaugcugugcagggcccugagau

SEQ ID NO: 190829 - RNA, 46 nt, Mus musculus
gucuccgcauuccaugagaagccuucuaugagggauacagcccuua

SEQ ID NO: 190830 - RNA, 42 nt, Mus musculus
gccguaguuugcaaagugcaaagcucacaaccacccccugcc

SEQ ID NO: 190831 - RNA, 42 nt, Mus musculus
gucaguuaagauguguacuuaucuuuuacugcugcuggaacc

SEQ ID NO: 190832 - RNA, 42 nt, Mus musculus
aucacuuauuacuagagucaaugucuuuuuugggggggaggg

SEQ ID NO: 190833 - RNA, 46 nt, Mus musculus
gaaaucccgcgauguuucagcgcugacgcgcgauuggcggggggug

SEQ ID NO: 190834 - RNA, 46 nt, Mus musculus
gcugcucuacuaguuacaacacccaagaaauaggaccagcccaggu

SEQ ID NO: 190835 - RNA, 46 nt, Mus musculus
aacgguuuuccugaaccuuuccccagcccucaccaauucgggccac

SEQ ID NO: 190836 - RNA, 46 nt, Mus musculus
guaauaacaauaguuuugaaaauagaauaaauauugaacucgaguu

SEQ ID NO: 190837 - RNA, 41 nt, Mus musculus
ucagacuuccucacaaucaguucaagaagccuagcccaaga

SEQ ID NO: 190838 - RNA, 41 nt, Mus musculus
agugcugggauuaaaggcauucgccaccacgcccggcugcu

SEQ ID NO: 190839 - RNA, 42 nt, Mus musculus
ggguucauugauaaaaacgucggacucccccuugcccuggcg

SEQ ID NO: 190840 - RNA, 46 nt, Mus musculus
cuauaauuucuuuugacuuucgggcauuuuacccaucaaaccauuc

SEQ ID NO: 190841 - RNA, 46 nt, Mus musculus
gugcuugccuguuuagccuugugcuaaacuuuuaugccuggcagca

SEQ ID NO: 190842 - RNA, 42 nt, Mus musculus
gucuuagccaaggacuccccuccgaguucuucaccugcagau

SEQ ID NO: 190843 - RNA, 57 nt, Mus musculus
guuagggugagguuggggccaagaggacagggccuggcagaucuucagucauuggga

SEQ ID NO: 190844 - RNA, 42 nt, Mus musculus
ggcucagggaaguaauggauugagggagaaugggggcccaga

SEQ ID NO: 190845 - RNA, 42 nt, Mus musculus
gauccggagcggaggggcggggccggcggcgagaggaggaga

SEQ ID NO: 190846 - RNA, 42 nt, Mus musculus
cgcuuucccgcgccccacucggcgccccuuuccccuccacac

SEQ ID NO: 190847 - RNA, 45 nt, Mus musculus
ccaacucauuaaaaaaaacucaaaguuuagauuuuaggagucaga

SEQ ID NO: 190848 - RNA, 45 nt, Mus musculus
uuuucuuuuuuaauuuucuccagucccugggagcaaguugcaguc

SEQ ID NO: 190849 - RNA, 46 nt, Mus musculus
ugcaucuaaaaauucaaaaaaaauuccaagucguauaaagccagaa

SEQ ID NO: 190850 - RNA, 46 nt, Mus musculus
cagaagacacgaacucuauugucccgcuagacuaccaacugcagug

SEQ ID NO: 190851 - RNA, 35 nt, Mus musculus
cucucugauuggccucaggaagacacacccgccuc

SEQ ID NO: 190852 - RNA, 46 nt, Mus musculus
uuauuuaccuuuuggcgggugugagggacacccagagggauuauug

SEQ ID NO: 190853 - RNA, 47 nt, Mus musculus
acuuucuuccccgcguggccggauuuccgggagcaaugaccuccgag

SEQ ID NO: 190854 - RNA, 49 nt, Mus musculus
gggguggcuuuggaggguguguuuagccagggggcuauggagaaaugag

SEQ ID NO: 190855 - RNA, 26 nt, Mus musculus
ugcggcgcugacccggaggcggcggc

SEQ ID NO: 190856 - RNA, 46 nt, Mus musculus
aauuguguccugaucauuucagcgcccgcuggcaucaagaauggag

SEQ ID NO: 190857 - RNA, 41 nt, Mus musculus
cagggccagcuagagcaacaaaggagcccgguagucggcag

SEQ ID NO: 190858 - RNA, 42 nt, Mus musculus
ugagaaggaaaagcagcagagacagcauuagggggaggaggg

SEQ ID NO: 190859 - RNA, 45 nt, Mus musculus
gagggcaucuuguugagggaggaucuguucagacaggcuccagag

SEQ ID NO: 190860 - RNA, 74 nt, Mus musculus
gugcuccuaugucuuuauuggcuguuacagaaugaguggcuggcagauugguuaugaaagcauggcccccgacg

SEQ ID NO: 190861 - RNA, 46 nt, Mus musculus
aaaaaauaaagauguuuuugguuaacugugauuugauuuauuaugu

SEQ ID NO: 190862 - RNA, 45 nt, Mus musculus
gcggcaggccgugacggcccagcccaggaggcgcgaggaagcgga

SEQ ID NO: 190863 - RNA, 45 nt, Mus musculus
ggugaauuaaauuagaauuagacucuuagaauuaaagggaugggg

SEQ ID NO: 190864 - RNA, 46 nt, Mus musculus
cggaagcuguugcgaccggcaggugcugcgucgccuucgcugcuua

SEQ ID NO: 190865 - RNA, 46 nt, Mus musculus
gaacuuggcugugaagacuuuuuauuguuccaguggcuacgguggu

SEQ ID NO: 190866 - RNA, 60 nt, Mus musculus
auuaaauuucguacagugccucagcuuguaucgaauugcuggagugggaagccggcggag

SEQ ID NO: 190867 - RNA, 45 nt, Mus musculus
caaggagccuccugugggucuccagaacuuccuuucuggcugagg

SEQ ID NO: 190868 - RNA, 46 nt, Mus musculus
aaagccugccccccccccgcaagcuguaccccaacaacaggcucag

SEQ ID NO: 190869 - RNA, 46 nt, Mus musculus
cugcucccagccacggcccacagaucccuguacuguaccuucagcu

SEQ ID NO: 190870 - RNA, 45 nt, Mus musculus
aaagugcaguaaccauguggauguucugcugaagcguuuccucaa

SEQ ID NO: 190871 - RNA, 42 nt, Mus musculus
aguuuuguggucuugugaccccuuugugauguguggggagag

SEQ ID NO: 190872 - RNA, 40 nt, Mus musculus
aucaaaauguuugccgaaagcuauccaguaaccagcuuau

SEQ ID NO: 190873 - RNA, 46 nt, Mus musculus
uccuuaaccuggcuuuuauuuguuuuauuauuuuaugugcauagau

SEQ ID NO: 190874 - RNA, 41 nt, Mus musculus
ggggcccaggugaggcgccugugcugcccggcaggugaagg

SEQ ID NO: 190875 - RNA, 45 nt, Mus musculus
aagaggcagcugguguuguuagggaccgaggaguuagcuguucag

SEQ ID NO: 190876 - RNA, 52 nt, Mus musculus
ugugcgggcuguggguucucgguuccaccaccagcccagaguuuuauuuuug

SEQ ID NO: 190877 - RNA, 46 nt, Mus musculus
cauaaugguuugaguuuccuuuuccuguggguggggauggguagag

SEQ ID NO: 190878 - RNA, 89 nt, Mus musculus
uaaaaaaaaaaaauuaccguacgguagaucaugugaugagacuuaguuggggagucugaggugggguguuuuagcugguuugauugcag

SEQ ID NO: 190879 - RNA, 42 nt, Mus musculus
uggcaagcuuccccuccuguguuaucuacgucacagucgaaa

SEQ ID NO: 190880 - RNA, 24 nt, Mus musculus
cugcccucaucccucuucagcagu

SEQ ID NO: 190881 - RNA, 42 nt, Mus musculus
gaguccgccgguccuaugguuuuuaugaacagauucugccag

SEQ ID NO: 190882 - RNA, 46 nt, Mus musculus
gaaaaaaagaacaucauguuguaaguauucaucuuuuggcauccaa

SEQ ID NO: 190883 - RNA, 45 nt, Mus musculus
gggaaugggggaagacagggagaggaagggaggauucggcuauga

SEQ ID NO: 190884 - RNA, 44 nt, Mus musculus
uuaaaauaaaacagaaacggcuacaguucuuagcaggagagcca

SEQ ID NO: 190885 - RNA, 46 nt, Mus musculus
agggagggagagagagagagagagagagagagagagagagauguuu

SEQ ID NO: 190886 - RNA, 46 nt, Mus musculus
gagaacacuggauccccugugggugggugggugggcuguugaaaau

SEQ ID NO: 190887 - RNA, 46 nt, Mus musculus
auauauauacauacauacauauaaucuuuaaaaaauagggguaggu

SEQ ID NO: 190888 - RNA, 46 nt, Mus musculus
uccuauggcuuugaaauugcugacuuguaaucucuugcggccagcc

SEQ ID NO: 190889 - RNA, 42 nt, Mus musculus
cuaugggaaccgccugcuggccaaucauuaagagaaauacag

SEQ ID NO: 190890 - RNA, 47 nt, Mus musculus
gauguugugaaggagcuuggaagauaaugaugagaacagugcaggag

SEQ ID NO: 190891 - RNA, 45 nt, Mus musculus
cuguggagacaagaggucacaggcagaguaaccaggauucaggga

SEQ ID NO: 190892 - RNA, 45 nt, Mus musculus
ggcugagaaguuguuguggugguguuugugguguuauucauggug

SEQ ID NO: 190893 - RNA, 34 nt, Mus musculus
caacucagugugacgaggacaugggcagccucag

SEQ ID NO: 190894 - RNA, 46 nt, Mus musculus
caaauaauuuuuaagagguucucagauagcucuaauuggccauguu

SEQ ID NO: 190895 - RNA, 46 nt, Mus musculus
gccacgucauaaacaugagaccauuugugugaaaacccaugugaca

SEQ ID NO: 190896 - RNA, 45 nt, Mus musculus
cuggagcugaacauggcuucauccuuacggagugccaacuuauaa

SEQ ID NO: 190897 - RNA, 46 nt, Mus musculus
uucccuccggaaaccgcgggccggcaggaagugacgaaggcgaggu

SEQ ID NO: 190898 - RNA, 48 nt, Mus musculus
ucccuucucaguguagaguggacgguuggagccuggcagccuggcagu

SEQ ID NO: 190899 - RNA, 46 nt, Mus musculus
aauuguaagcugccaugugagugcuaggaauugaaccugggucuga

SEQ ID NO: 190900 - RNA, 111 nt, Mus musculus
caacuauuuauuugggaaaacauucagauggccuuugaaaucagcagauccuaaaggagacacugggaagguagauggagggaaagaugcucauguucuuagccucaguag

SEQ ID NO: 190901 - RNA, 46 nt, Mus musculus
uguguugguguaccauuaaaaugacuggugccaugaaguccaguag

SEQ ID NO: 190902 - RNA, 23 nt, Mus musculus
aaauacaggaaguaagcaucaaa

SEQ ID NO: 190903 - RNA, 95 nt, Mus musculus
aagcugucaggugggaaaagguaaggcgggcaggagaagaagcugucaggugaaaagguaaggcgggcaggagaagaagcugucaggugggaaaa

SEQ ID NO: 190904 - RNA, 153 nt, Mus musculus
ggagaagaagcugucaggugggaaaaggugggaaaaggcgggcaggagaagaagcugucaggugggaaaaggugggaaaaggcgggcaggagaagaagcugucaggugggaaaagguaaggcgggcaggagaagaagcugucaggugggaaaa

SEQ ID NO: 190905 - RNA, 42 nt, Mus musculus
ccucuggaagcucagcuacauucacuucaaaccgguccugaa

SEQ ID NO: 190906 - RNA, 42 nt, Mus musculus
caggccccgcggggugugugugugugugugugugugugugug

SEQ ID NO: 190907 - RNA, 42 nt, Mus musculus
gcccagacacgcacguauucauccaagugaugggggcccagg

SEQ ID NO: 190908 - RNA, 88 nt, Mus musculus
cuaugucccgcaucuaagauggcgaggcaaguguuugcaaugggagaucacgugucuggggcggagccuauggcuagggggcggggug

SEQ ID NO: 190909 - RNA, 46 nt, Mus musculus
agcugaggaggugcuccccgugcaccgcggcucugcaucggucagg

SEQ ID NO: 190910 - RNA, 42 nt, Mus musculus
aaacggcagcgucuuaaggcgcgugcgcggacgagccagcac

SEQ ID NO: 190911 - RNA, 46 nt, Mus musculus
cauauauguguaucaugugcauuccuaguacccauagaauccagag

SEQ ID NO: 190912 - RNA, 42 nt, Mus musculus
uggugcggagugaacauggggaagcaaaagaaaacaaggaaa

SEQ ID NO: 190913 - RNA, 73 nt, Mus musculus
ccccuccccccgggcugacaucacgggagagcgggugagaggcuggaucggcgagugagagaaagagagggag

SEQ ID NO: 190914 - RNA, 29 nt, Mus musculus
uucucuccuaacugaucauuugggagaag

SEQ ID NO: 190915 - RNA, 45 nt, Mus musculus
uucacccucaagagaccucacuaaacaauuaaaaagcccccagag

SEQ ID NO: 190916 - RNA, 116 nt, Mus musculus
uccuacauccacuacgacuuacgaccuuccucuuagcucugugcccucauaauucggugcccuccucuuaaucucuacuugaaauaauuccccuacucaccccacccccacccccc

SEQ ID NO: 190917 - RNA, 42 nt, Mus musculus
cggcagcagccuccaccccucuggcucaucaugcccccaggc

SEQ ID NO: 190918 - RNA, 44 nt, Mus musculus
ccaaagcauauacuuaaggauuuccuauggcuuaaauggucuaa

SEQ ID NO: 190919 - RNA, 46 nt, Mus musculus
ucucuuagauuuacuuaugucuguguaugugagcauucgugcagac

SEQ ID NO: 190920 - RNA, 42 nt, Mus musculus
cugauaucugugcugguggugagggugaugaggccuggggag

SEQ ID NO: 190921 - RNA, 46 nt, Mus musculus
agguaccaauaaagaugcucuauuuuuaaguguggucuucuuggug

SEQ ID NO: 190922 - RNA, 46 nt, Mus musculus
auugucgaauguggguguuuuauuuuuuauuuaaagaaaaugccag

SEQ ID NO: 190923 - RNA, 46 nt, Mus musculus
uaugguuugugggucaugcaaaaguauauguguucauuauugagug

SEQ ID NO: 190924 - RNA, 46 nt, Mus musculus
uauaaauggaaauuucaucucaaggauggcguuaugaaucuuaacg

SEQ ID NO: 190925 - RNA, 23 nt, Mus musculus
gggaggggaggagggcagcgaga

SEQ ID NO: 190926 - RNA, 54 nt, Mus musculus
guggccacguacagagagccucauagccgcgggugcaggagacaaaaaccaggg

SEQ ID NO: 190927 - RNA, 41 nt, Mus musculus
uaugugagagggccccucccagaucguugagggcggggcuu

SEQ ID NO: 190928 - RNA, 54 nt, Mus musculus
ugaaaaccuagcggugggaggaggagagaagagaacuugugcgagaggaagauc

SEQ ID NO: 190929 - RNA, 46 nt, Mus musculus
agcugcauaauucacaagugcaaaacacaugaauugguuuuuauug

SEQ ID NO: 190930 - RNA, 45 nt, Mus musculus
ucucagccucucuuccagccauggcuucacuuguggccaaggucu

SEQ ID NO: 190931 - RNA, 72 nt, Mus musculus
gcaggaaugaauggccuuuggguucccagggagugccugcuggaguuggggucugcaauaaagcaaugagua

SEQ ID NO: 190932 - RNA, 41 nt, Mus musculus
cuaaaaaauugaaugggaauuaucuggcauggucuggggga

SEQ ID NO: 190933 - RNA, 41 nt, Mus musculus
ugcccugcucuugcuaggaacacagcaggauuccagccaag

SEQ ID NO: 190934 - RNA, 49 nt, Homo sapiens
uuggaagcaagaagaaaaauaacugaaauucaguauacauguagagaaa

SEQ ID NO: 190935 - RNA, 53 nt, Homo sapiens
cugagcagucaugaugugugacuucaccgaggaccagaccacagaguucaagg

SEQ ID NO: 190936 - RNA, 486 nt, Homo sapiens
ggaaccagauaggacagggcguaauuauuagaaagacaggauauuuuauuuuguuuauuuauuuauuuauuuauuuauuuauuuauuuauuuauuuuugugugagcaauaaagcuuuuuaaucaccugggugcaggcgggcugagucggaaaagagagucagcgaagggagaugggguggggccguuuuauaggauuuggguagguaaaggaaaauuacagucaaaggggguucucuggcgggcaggggugggggucacaaggugcucagugggggagcuuuugaaccaggaugagccaggaaaaggaauuucacaagguaauaucaucaguuaaggcaggaacagcccauuuucacuucuuuugugguggaaugucaucaguuaaggcaggaaccgaccaucuggauguguacgugcaggucacaggggauaugauggcuuagcuuuggugcagaggccugacuuuccaaagacaggguauuuua

SEQ ID NO: 190937 - RNA, 23 nt, Homo sapiens
gccccugcuggcaccccggccgg

SEQ ID NO: 190938 - RNA, 73 nt, Homo sapiens
uauacguccagaacgcuugccuguucuuucacuuuccagacauaugggacuugggauucagcuccagcugaga

SEQ ID NO: 190939 - RNA, 54 nt, Homo sapiens
gcaguuuuggggucagaaccaacagaucucuaauauucuuuggucugaaaacug

SEQ ID NO: 190940 - RNA, 45 nt, Homo sapiens
uuuuaggaguccuucaauaauguuaaacaguggcugcaggaaaua

SEQ ID NO: 190941 - RNA, 47 nt, Homo sapiens
cuggcggcagccaucagguaagccaagaugggugcauacaaguacau

SEQ ID NO: 190942 - RNA, 45 nt, Homo sapiens
uugcaggcuuucccuauggaauccaguuugacuuuccccagagcu

SEQ ID NO: 190943 - RNA, 48 nt, Homo sapiens
uagaaaauggggauccugacauccaucuucuagaccucugucugugga

SEQ ID NO: 190944 - RNA, 41 nt, Homo sapiens
uuggguggggggacuggagaccggggagcagguucugggga

SEQ ID NO: 190945 - RNA, 47 nt, Homo sapiens
cuugcaggcaaggaaacaaaacugaaaguuuuccgauggcccagccc

SEQ ID NO: 190946 - RNA, 45 nt, Homo sapiens
uugcagaagcuaauugaagagacagauagguuuguaguguucaca

SEQ ID NO: 190947 - RNA, 43 nt, Homo sapiens
ggccagaugaccucuaugaaagauggaggauuagcugugggga

SEQ ID NO: 190948 - RNA, 46 nt, Homo sapiens
cagaaggucgcuacugugugcagcucucacagauucaggcccagau

SEQ ID NO: 190949 - RNA, 54 nt, Homo sapiens
ggaugacaggaucccucgcgcaggcgcgcuccagcacauggcgcccugcugcag

SEQ ID NO: 190950 - RNA, 43 nt, Homo sapiens
acauccugggugcaggagugggcuggggggcacauaccuguua

SEQ ID NO: 190951 - RNA, 38 nt, Homo sapiens
aauggccauuucuaagugucaucuguuuaaucuacaau

SEQ ID NO: 190952 - RNA, 58 nt, Homo sapiens
cggccgccaggggcagcagagaggcaccugcaguccgcgcccgcccgcccgccggggc

SEQ ID NO: 190953 - RNA, 46 nt, Homo sapiens
ccucaagcuucccuuuauauauccauagagguuuggcguucauuca

SEQ ID NO: 190954 - RNA, 45 nt, Homo sapiens
aaaauugagcucuuugugggcggugagcugauagauccugcagau

SEQ ID NO: 190955 - RNA, 30 nt, Homo sapiens
acaaaaauguauugcauauuaaaguuauaa

SEQ ID NO: 190956 - RNA, 58 nt, Homo sapiens
gagcgcacgcgcccgugacguagcccaggcgccgcggcgcgcgggguggggcggaggu

SEQ ID NO: 190957 - RNA, 45 nt, Homo sapiens
gccgaggccggaagcuucucuuccggcucccaagaccgcguuccg

SEQ ID NO: 190958 - RNA, 45 nt, Homo sapiens
ucaaacgcuggaccauucugagugccuguagacagcaucccugga

SEQ ID NO: 190959 - RNA, 41 nt, Homo sapiens
ggggucgggcggccgcgcggggacugugggaagcggaguga

SEQ ID NO: 190960 - RNA, 71 nt, Homo sapiens
cgugcugcuagacggaacggggcggggcaggccacugguugcggagugagcugggcgcgcggcgcgcaggc

SEQ ID NO: 190961 - RNA, 42 nt, Homo sapiens
uacccgcuaggaugaaacuccccacacaagagaugaagcccg

SEQ ID NO: 190962 - RNA, 46 nt, Homo sapiens
aaacaauaaauaaagcacaggugauggugugugguccucuccaggu

SEQ ID NO: 190963 - RNA, 34 nt, Homo sapiens
uucacacugcccugaauuauuuacaaguauagcu

SEQ ID NO: 190964 - RNA, 44 nt, Homo sapiens
cucgggcuaacggugcgcuggagggacuuugguccaucccugag

SEQ ID NO: 190965 - RNA, 58 nt, Homo sapiens
cucagggacugaguuuccaucugugucucagaaaccaagcaagggcuccagaccagag

SEQ ID NO: 190966 - RNA, 65 nt, Homo sapiens
cauuuucuacugggucuagauauggccucaauauuguucccaccuaccuggaucuggcccuugag

SEQ ID NO: 190967 - RNA, 40 nt, Homo sapiens
ggugacccagagccuccacugggccuaauucagaugguuu

SEQ ID NO: 190968 - RNA, 95 nt, Homo sapiens
aaagaggacuguggcggcucugcuggagaggugcauaccauuugggauggugacaaggaguuggagaacgcguguggaaauugacacagguggcu

SEQ ID NO: 190969 - RNA, 50 nt, Homo sapiens
auaucaaauaucuuauuuguuugguuaaaaucaaauuaaucagggcaagu

SEQ ID NO: 190970 - RNA, 41 nt, Homo sapiens
cccgggcuggggaaacgcuagggaggaggccaccuggagcc

SEQ ID NO: 190971 - RNA, 46 nt, Homo sapiens
uuucugcagagagcaaggagaaagggccacuuaaaaauccguaaag

SEQ ID NO: 190972 - RNA, 42 nt, Homo sapiens
cggggcuccucgccaacgcugggcaggugguccgggagcgag

SEQ ID NO: 190973 - RNA, 47 nt, Homo sapiens
gagaaagaaaaaugauccuugaccaacaugcuagaaucucagugggg

SEQ ID NO: 190974 - RNA, 49 nt, Homo sapiens
ccaggggacccagggaacaaauaggguggcagauuuggcaacauacuaa

SEQ ID NO: 190975 - RNA, 48 nt, Homo sapiens
aggacagaagcagggaaaccaguuaugaaucuauguuuugauugucag

SEQ ID NO: 190976 - RNA, 80 nt, Homo sapiens
gcgauucuuacgcccuguauuucuggucuaacaucaaccaacacuuuggcgaaauauaauaaaaugaaauuacuaggaga

SEQ ID NO: 190977 - RNA, 39 nt, Homo sapiens
augucuugugugucagcagcuuuuuugggagggcguuug

SEQ ID NO: 190978 - RNA, 42 nt, Homo sapiens
ugggcuucaccgagcgccgguccgauuggccggggggcggag

SEQ ID NO: 190979 - RNA, 46 nt, Homo sapiens
uuuucuccagaagagcuggauauucuuucgcacaguucuagcagac

SEQ ID NO: 190980 - RNA, 49 nt, Homo sapiens
augaauuaauuuauuggcaucuuauuuggagguaauaggccacaacucu

SEQ ID NO: 190981 - RNA, 46 nt, Homo sapiens
uccuccuuugauuaguguuagcaugaaaaaggaguacuuacuauau

SEQ ID NO: 190982 - RNA, 42 nt, Homo sapiens
aggaagguaagcgaagcaggaagucccgccuuucagccccag

SEQ ID NO: 190983 - RNA, 45 nt, Homo sapiens
augaaagcacacuggaaaauaaugcagguaaucuaaaaaggacgg

SEQ ID NO: 190984 - RNA, 65 nt, Homo sapiens
uucccccagccuccaccuuuuugagaacuaaggggaauggaugauugagaauuggggacgcuggg

SEQ ID NO: 190985 - RNA, 42 nt, Homo sapiens; identical to SEQ ID NO: 190790

SEQ ID NO: 190986 - RNA, 56 nt, Homo sapiens
ucugaagcgccgcaagcugaaagaagcacacgugcggggucaacgcacucucuuua

SEQ ID NO: 190987 - RNA, 47 nt, Homo sapiens
uucuccuaggagaagcagccuccuaauuugaucacaguggcgagagg

SEQ ID NO: 190988 - RNA, 53 nt, Homo sapiens
cguggauaaggaaggaaauacauaaaagacaagggguuagaagugugcuuaug

SEQ ID NO: 190989 - RNA, 45 nt, Homo sapiens
uaaacauccaaauaaagaugccuuuccaaguugcagugggugcua

SEQ ID NO: 190990 - RNA, 28 nt, Homo sapiens
auaccacuauuugagaaagggccaagga

SEQ ID NO: 190991 - RNA, 49 nt, Homo sapiens
aguuuuucuuggcagccuauuguuuauauuuuccaaauaucugcucucu

SEQ ID NO: 190992 - RNA, 46 nt, Homo sapiens
uuuuaaauuccuuuuuuuaaacuuccaguuuauugcguaccaagag

SEQ ID NO: 190993 - RNA, 44 nt, Homo sapiens
aacuucagagcgaacggccacaucuccccaccucucacccccac

SEQ ID NO: 190994 - RNA, 42 nt, Homo sapiens
aagcugcaucagagacaacugaagaugaaaaaacuaccaucc

SEQ ID NO: 190995 - RNA, 41 nt, Homo sapiens
acagagaacgagauccgcggucugugccugaaaucccggga

SEQ ID NO: 190996 - RNA, 93 nt, Homo sapiens
agguuacugccgaacacuuaacaggaucaucuccuggggaaggcccacaugguagagggcaugaaaaaccacaaccaggaaagguaugggcca

SEQ ID NO: 190997 - RNA, 47 nt, Homo sapiens
cccggugccucagacgccgcucccgauucaacacccgccggcguuug

SEQ ID NO: 190998 - RNA, 79 nt, Homo sapiens
acuacauugcccacaaugccccagggaacauuuguagcucuagaacuacaugacccaaaaugccgagugguggcaagag

SEQ ID NO: 190999 - RNA, 46 nt, Homo sapiens
ucuugucuuagccguugcaggugaaccacuggauggauggcugaaa

SEQ ID NO: 191000 - RNA, 48 nt, Homo sapiens
caccgcccgaaccguaagugccuccgcgcccggcccccgcccgcugcc

SEQ ID NO: 191001 - RNA, 65 nt, Homo sapiens
gucaguuuuuuccuuuaagcaccacucaggcagcaagcucuaugcugugagaguugcuggaggcc

SEQ ID NO: 191002 - RNA, 51 nt, Homo sapiens
agggcgcgggugcaggcggcggugaagggcuaggcagggcuuuggcggugu

SEQ ID NO: 191003 - RNA, 36 nt, Homo sapiens
acacauauaaaaugcaagauagaaauuucugccuuu

SEQ ID NO: 191004 - RNA, 49 nt, Homo sapiens
cuaaccgacuuucccgcggagggagggugggaugggggagguugauuag

SEQ ID NO: 191005 - RNA, 90 nt, Homo sapiens
cggcugagcuagauaaaccggaaauacgugacgagaggauugugggaugguggacgacguuugggcgcccacagcuaggaagucgagucg

SEQ ID NO: 191006 - RNA, 44 nt, Homo sapiens
uugcugcuccccccgccgcccgcagccauggaaacggggaagga

SEQ ID NO: 191007 - RNA, 23 nt, Homo sapiens
ugcgaaacgccaaauccucgaga

SEQ ID NO: 191008 - RNA, 38 nt, Homo sapiens
ucaccaggcucucccagcugcucuccucuuggagcagg

SEQ ID NO: 191009 - RNA, 79 nt, Homo sapiens
guaagagaaaaaaaaaauccaguccggguuuugucugagcggggggaccggaggguugugaggaauggcucgcgaagag

SEQ ID NO: 191010 - RNA, 40 nt, Homo sapiens
ugacccaccgcgcccccaagguccggccgcgcgccgaguc

SEQ ID NO: 191011 - RNA, 54 nt, Homo sapiens
aucgcgccguagagaaagccgaacacgacggucagcagcagcagcgucuggaaa

SEQ ID NO: 191012 - RNA, 42 nt, Homo sapiens
uuuaaacaaauccugagcuguggcgaaguggugggggugggg

SEQ ID NO: 191013 - RNA, 46 nt, Homo sapiens
gucucugcauuccagagcaagcuguauauaaggauuagggccauca

SEQ ID NO: 191014 - RNA, 46 nt, Homo sapiens
gccuguuaagguguuuagugugugaucuuucauugcuaugugaauc

SEQ ID NO: 191015 - RNA, 31 nt, Homo sapiens
auugcccuucacuaaaauuaccuucuucauu

SEQ ID NO: 191016 - RNA, 43 nt, Homo sapiens
aaaaucucgcgauguuuccgaggcaacgcgcugguguggguua

SEQ ID NO: 191017 - RNA, 46 nt, Homo sapiens
aacgguucucccgaaccucucccccgccccuacuaucuuggccuac

SEQ ID NO: 191018 - RNA, 54 nt, Homo sapiens
ucaggcuccuucacaaucuucuuuauugggucuggccuaaaagccagcccaaga

SEQ ID NO: 191019 - RNA, 35 nt, Homo sapiens
gcguucauugauaaaacgcugggcuccccugggcg

SEQ ID NO: 191020 - RNA, 46 nt, Homo sapiens
cucgaauaaguuugacuuguguuuuaucuuaaccaccaggucauuc

SEQ ID NO: 191021 - RNA, 41 nt, Homo sapiens
uuguuggccgagggcuccgcucuagcuuuucaccugcagau

SEQ ID NO: 191022 - RNA, 60 nt, Homo sapiens
gccagggauggggugggggccaaaaggacagagccugguaugucuucauagucauugaga

SEQ ID NO: 191023 - RNA, 46 nt, Homo sapiens
uagaagucagggggcggggccggggggggggggcggaggaggugga

SEQ ID NO: 191024 - RNA, 37 nt, Homo sapiens
ccccuucgcgcgccccccuccacgcuccccuccacgc

SEQ ID NO: 191025 - RNA, 45 nt, Homo sapiens
uuuagggaaaaaaaaaaucucgugaccuaaaucuuuccacuauaa

SEQ ID NO: 191026 - RNA, 40 nt, Homo sapiens
uuuuuaaauuuucuccaguuccugggagcaaguugcaguc

SEQ ID NO: 191027 - RNA, 37 nt, Homo sapiens
cgcucugauuggcuggccugaaguacaacgccuccuc

SEQ ID NO: 191028 - RNA, 48 nt, Homo sapiens
cuuuauaauuuggcaagugugaggaacgcuauuuuggagggauggagg

SEQ ID NO: 191029 - RNA, 46 nt, Homo sapiens
guuggcuccucuggguggacagacuuccggcaggacgacccucgag

SEQ ID NO: 191030 - RNA, 44 nt, Homo sapiens
aguaggcuuggagaauguuuuuagccaggggcuguugagagaug

SEQ ID NO: 191031 - RNA, 26 nt, Homo sapiens
cgcggcgcugacccggaggcggcggc

SEQ ID NO: 191032 - RNA, 48 nt, Homo sapiens
aacuguguccugaucauuucagcaucuaccagcaucaagggaaugggg

SEQ ID NO: 191033 - RNA, 41 nt, Homo sapiens
cccagcgagcuagagcaacaaaggagccgggucgccggcgg

SEQ ID NO: 191034 - RNA, 79 nt, Homo sapiens
uggggaggagaggcaccaagagagacgucaggggccgacacauggggaggaaggaaugggaggaggggcaggagggcag

SEQ ID NO: 191035 - RNA, 52 nt, Homo sapiens
gagggcaucuucuccagggagguucugcuaagucucagcuccuacugcagag

SEQ ID NO: 191036 - RNA, 87 nt, Homo sapiens
gcacauagcucccucaucauuggcuuuuagagagugagcggcaggcagguuguccauuggauaccaagauauggcggcccccugacu

SEQ ID NO: 191037 - RNA, 46 nt, Homo sapiens
ugaaaauaaagguguuuuugguuaacugucauuuuguuuauucuac

SEQ ID NO: 191038 - RNA, 84 nt, Homo sapiens
gcgggcgcggcaggcuggccagcgguccauugcgcgcgcguucccgggccgcgggcgggggcgagagcgcgcggcgggggcggg

SEQ ID NO: 191039 - RNA, 41 nt, Homo sapiens
ccgagaccuuacaggcagagcuggagcucccucgccucucg

SEQ ID NO: 191040 - RNA, 34 nt, Homo sapiens
caauaugguuuuggaggcuuauuauuguuccagu

SEQ ID NO: 191041 - RNA, 94 nt, Homo sapiens
auuaaauuacauccggugcuucggcuuguacagaacugggggagugggauguugugggcagaccagucuccgguauacacguauuuugccccug

SEQ ID NO: 191042 - RNA, 45 nt, Homo sapiens
gaaggccccacccuucccaagcuguaccccaggacacaggcucau

SEQ ID NO: 191043 - RNA, 67 nt, Homo sapiens
cuccuggccagcagcccccugccccaggcccgcagccccccaggcccgacauccuguaccuugagcu

SEQ ID NO: 191044 - RNA, 45 nt, Homo sapiens
aaagugcaguaaccauguggaugugcugcugaagcguuuccucaa

SEQ ID NO: 191045 - RNA, 42 nt, Homo sapiens
ccuccucgguagucuugugauccaucgucuuugggucugggg

SEQ ID NO: 191046 - RNA, 29 nt, Homo sapiens
cuaaauaguacauucauuaaccaguuucu

SEQ ID NO: 191047 - RNA, 45 nt, Homo sapiens
ggggcccagguaaggagccugcgcuggcugcccggcaggcggaga

SEQ ID NO: 191048 - RNA, 45 nt, Homo sapiens
aagaggcagcugguguuguuggggacugaggagcuagcuguucgg

SEQ ID NO: 191049 - RNA, 46 nt, Homo sapiens
uuuaaugguuugacuuuuuuucccugagggugagggauggguggga

SEQ ID NO: 191050 - RNA, 79 nt, Homo sapiens
aaaaaauacagucccccagaucgugugacgaaaccugcuucggcggcccgagguggggguuuugagucgguuaguggag

SEQ ID NO: 191051 - RNA, 38 nt, Homo sapiens
cagugagcuucccuucacacgucauuggccagaucaca

SEQ ID NO: 191052 - RNA, 24 nt, Homo sapiens
uggcgcgccucacggugcagcggg

SEQ ID NO: 191053 - RNA, 27 nt, Homo sapiens
gaaaaagaaaaaaaaaaagauccauuu

SEQ ID NO: 191054 - RNA, 368 nt, Homo sapiens
gaauacacucauugauuccacacaguggguaauaaacuuuuuuuuuuuuuuuuuuuuuugagacagagucucgcucugucacccaggcuggagugcaguggugugaucucggcucacugcaaccuccgccugcuagguucaagugauucuccugccucaggguccccaguagcugggacuacaggugugcgccaccacgccuggcuaaauuuuguauuuuuaguagagacgggguuucaccauguugguuggccagguuggucuggaacuucugaccucaacugaccuacucaccuuggccucccaaagugcuggggauuacaggcauugagccacuguacccagcucauaaugaacuuuuuuaaaag

SEQ ID NO: 191055 - RNA, 39 nt, Homo sapiens
cuaugggaacugccucuuggccaaucaccgagagaaaga

SEQ ID NO: 191056 - RNA, 22 nt, Homo sapiens
caaguguggggagcggccuccg

SEQ ID NO: 191057 - RNA, 47 nt, Homo sapiens
caaauacuuuauaagaguuuaucagacaucucuaauuuggccauguc

SEQ ID NO: 191058 - RNA, 54 nt, Homo sapiens
cucgaacugaacauggcuuucuccugggagaacuugccgagcgccggcuuagga

SEQ ID NO: 191059 - RNA, 48 nt, Homo sapiens
uuucauccggaaaccgaccggccggcaggaaaugacgaaggcagaggg

SEQ ID NO: 191060 - RNA, 63 nt, Homo sapiens
ucguuuucagcacggagaggcuacagguuggccagagccuggcagacagugauucugggcaca

SEQ ID NO: 191061 - RNA, 26 nt, Homo sapiens
aaauacaaaaaauacacaugggcaag

SEQ ID NO: 191062 - RNA, 42 nt, Homo sapiens
ccucuggaaguucugccacauuaacuucaaaccgguccugga

SEQ ID NO: 191063 - RNA, 31 nt, Homo sapiens
ccaaagccccgggagaacaggcuguuguggg

SEQ ID NO: 191064 - RNA, 42 nt, Homo sapiens
gcccagacacgcacguacucauccagguggugggggcccagg

SEQ ID NO: 191065 - RNA, 117 nt, Homo sapiens
acggugcccggauccaagauggcggggcuggaggcaagagcgggcguagggaggagauuacguuccgaggcggagccugggcuugggggcggggcggggccugcgccuaggggggcg

SEQ ID NO: 191066 - RNA, 39 nt, Homo sapiens
agcgucaccuuauggacauguggcgucucauuccccaga

SEQ ID NO: 191067 - RNA, 42 nt, Homo sapiens
caaugccaucgguuaaagcgcaugcgcaagaugagcuauugc

SEQ ID NO: 191068 - RNA, 42 nt, Homo sapiens
uggugaggggagaaaaauggccagcaaaagaaaaaaaaaaga

SEQ ID NO: 191069 - RNA, 75 nt, Homo sapiens
ccccuccccucuggcugacaucacgggcgagcgggugagaggcuggagcucggcgagugagagaaagagagcgag

SEQ ID NO: 191070 - RNA, 34 nt, Homo sapiens
ugcaaucugucuuaaucgaugguuuugggggaaa

SEQ ID NO: 191071 - RNA, 44 nt, Homo sapiens
auugcccuuugagaccucuccgaacaauuaaaagcccccaagag

SEQ ID NO: 191072 - RNA, 105 nt, Homo sapiens
uccccucuuccuccuuaagucugguccuuccacccccuccucuucaagcugugcguguccccugauucuaaugcuuucuguguaacucauugaaacugcguucug

SEQ ID NO: 191073 - RNA, 41 nt, Homo sapiens
agcggcagccuccgcccggccagcucgccauggcacggggu

SEQ ID NO: 191074 - RNA, 43 nt, Homo sapiens
ccaaggcauauacuuaaggauauacuauguacauacuguauac

SEQ ID NO: 191075 - RNA, 40 nt, Homo sapiens
ucucacuaucuuaaggugguucgccugagccuucuuaaag

SEQ ID NO: 191076 - RNA, 42 nt, Homo sapiens
cuguuacuggugcuggugaugagaguguuguggcuugggcag

SEQ ID NO: 191077 - RNA, 49 nt, Homo sapiens
agguaccaauaaagaggcuuuauuuuuagcaaugugguauguauuugug

SEQ ID NO: 191078 - RNA, 50 nt, Homo sapiens
uaaaaacaaauggaaauuucaucucaaggauggcauuaugaaucuuaaug

SEQ ID NO: 191079 - RNA, 23 nt, Homo sapiens
agagagagagaauaugagagaau

SEQ ID NO: 191080 - RNA, 47 nt, Homo sapiens
guaaccaacaccgagacgaauagcgagggcucggggagaaaaaacgg

SEQ ID NO: 191081 - RNA, 49 nt, Homo sapiens
ccugccggucggcccgcgcuggggccaauggaggugcgaggcggggcuc

SEQ ID NO: 191082 - RNA, 50 nt, Homo sapiens
ugaaagaccaaguggugggagggggaaaggagaggagaaaaagggagagg

SEQ ID NO: 191083 - RNA, 55 nt, Homo sapiens
aacuucugaaguucuuaaaguucugaaguucuuaaagcccauggauccuuucuca

SEQ ID NO: 191084 - RNA, 33 nt, Homo sapiens
ucuuaaucucugcuucauuuauggccaaggucu

SEQ ID NO: 191085 - RNA, 43 nt, Homo sapiens
cuaaaauugcaagagacuuagcuggucugguguggagcggaga

SEQ ID NO: 191086 - RNA, 41 nt, Homo sapiens
ugcccugcuauugguagggacgcaacaggauuacagccaag

SEQ ID NO: 191087 - RNA, 3152 nt, Homo sapiens
ggguuuccucgagaacugcaggccugguugcccccggacugucagagccggaggccggggagcugccagccacgugcgccuguggccugcugagagguugaaaagcugccaagggacgaaggccgagaagacaggaccuaggggcuguggaagauucacccaacucuuccuuuuacucaggucuugggaccuaagaggggguggggauagucaugauaauaacuaccgcaaucuccagugcuggcacugagcugaaaaacauucaaagcuuucaaagcauuuugaugugcuucaucuuacuugaaucucacaaaaaccuugugaagauugaucuccauuucuaaauggcguugagacuggaagagauguacaacauucuacacuugguguuccuuaaacuuacaaacaacuaugaaauaauggcgagugagagaaagaagcugggugacugggaaacccaccccgccuucgcaauuagaccccauucgggacucaggcccggccaggucgcgccugcagacaaggucuguauucagcguugccaguucuccucugugguucgcuuaagcccggcgucgccuccccuccuugcuuagccaccacagugaucaaugcucaguucgucggggccugagagcgccccccagagaagccccugggaaggaagggcaaggagccgggcuucgcucuggucuuucgcaacaccagcggcgagcgcgucucccugcgcaaacguaggguggccuccccagcucugccguggggaccgcacaaaaacgcgggcgcaggugggagggcggaggguguccugagcuuucuuuacccugguaaagaagguaggcggugagaaaagcgaauguuauuauagaaguuggcuuuguauugagggaguaagagcucucuucaaggagagggcugaaaucuuuaaaaauaaauaaaacuuucucuacuguaauugcuauuaauaaaaaaagggagcccggaugaauuaaguagcucaaaacugccuguucgucaugaucaggagcuccuucucuacaaggaggggaaagaaaaugugaaaacaaaaacuaaauucaagaagcuccuugaccagcgcgggugucuuggaggcaccugccggggccggccggggagcgcuccgcccucccagccccuggcgcgcagaggagacuaaaacagcuaaggagaaagcaaaacaaaaacaaugauaaaaacguuuaaaauccaaggacaaaaaccggagucggucucaaaauccgcgccguucagugcuccacucgguagucgacucggcugcaggccccggccuggccggagcaacgcgggggacacccccgauuccgcuggggagcgcagcccacagcucccccucgccaggcgcccaaggacccucaaggcgcggggcccacacuugaagccugggaacgcgcagacaggaaacccucuuccuccuaagcaguuucuugcucgucggaugagaggcgcccaauugaagcagaaugauccucaucuacuaauauccagcguggccacaaagcgacuggccauuuacgccaccacuuuaaacaaagauauuugguuauucccgggaagcaagagcacuuuugcauggcugagcugcgggcggaggcgagccucggcccagccucccgcccgcugagcugcccgcaccucggcauucgcccccuccuggccagcgcuccagccgccgggguucaggcucaguuccgcccggcaacagacagacgggcacucacgccgcucccugcucgcgcgcucccugaagcaucagaggggaaaacagcguggcucugggcucgggugcuggggcugugauguccucggaaagucagcuccagccccagauccccgcgugucugggagaugggcgagggucagggacaccagguuuguucgagguggggcaacuucagugacggacccucccgugagaccccuucccauccucccagcucugggggccagugcuguguuugcucggccggggguggggggggggggggaagaccuugggggaggcguguuagcggggguggcccacugaaaaaccccugagcugcgggggcggguuguggcucggggauccgggacagccuccgggaggcagucgauccccuacucagcgcccccuccgcccgcucggauucucuccgguagggggaaagggggcggggagcagaggugucccucugacggcggcagaagagaggcagacagacugacagacacguagaccaacagugcggccccaggguucguccccagacucgcucgcucauuuguuggcgacuggggcucagcgcagcgaagcccgaugugguccggaggcagugggaaggcgcggggcugggaggccgcggcgggagggaggagcagccccggcaggcucaggugaaacccccacccugucccucagcccccuccuccuaaagaccuguccgugcccggggaaccccgaccgaauuggaaagugguuccacuuuguaacuccgcaaguugguugcaaagcagcauucaccuuccuuccucucaaccaucucuccuccucuguuacucccccaccccaccuccugcccuccccgcucucgguucccuccuccuuccccuccccuccaccuccuccccgcgcuccgcugguaccccacaaaaaauggggguggggguguccaagggaggggggaaaugcuuugggucucgucucugccucucucucucucucuuugagaccuaaaaauccugacaagugaaacuuaaagguguuuaccuugucaucagcauguaagcuaauuaucucgggcaagauguaggcuucuauugucuuguugcuuuagcgcuuacgccccgccucugguggcugccuaaaaccuggcgccgggcuaaaacaaacgcgaggcagcccccgagccuccacucaagccaauuaaggaggacucgguccacuccguuacguguacauccaacaagaucggcguuaagguaacaccagaauauuuggcaaagggagaaaaaaaaagcagcgaggcuucgccuucccccucucccuuuuuuuuccuccucuuccuuccuccuccagccgccgccgaaucaugucgaugaguccaaagcacacgacuccguucucagugucu

SEQ ID NO: 191088 - RNA, 2151 nt, Mus musculus
uggaaaggagccuacccugcugaauuaaguaguucaaaacugcuuguucauuaucgggagcucccucacuacaaggaggggaaagaaaaugugaaaacaaaaaccaaaaucaagaagccuccuugacuggccgccgaagugucuaggaggcaccugccgggccaggaagcacuccgcccucccagccucuagcgcuccaagaaagcucgaacagcagacaagcaaagccaaaacaaaaacaaacaauaacgaaaacgcuuaaauuccaaggagaaaaaaaaaaaaacggagguggucuccaaaucugugccaugcagggcuuggcuggguaacccacuuagcugcugauccugaccugguaacagcaaugaggcugacgcccccgggcccgcuagggagcacagcccacagcucccccuugccaggcgcccaaggacccucaaggcgcggggcucacacuugaagccugggaacgcucagacaggaaacccacuuccuccuaagcaguuucuuccuagccggaugagaggcgcccaauugaagcagaaugauccucaucuacuaauauccagcguggccacaaagcgaccggccauuuacgccgccacuuuagacaaagauauuugguuauucccggggaagcaagugcacuuuugcauggcugagcuccgggaggaggcgagccucagcccagccucccgcccgcugggcugcgggcgucgagauauucgccuccucccggacaacgaguuccacccggguucagacucaguuccacucugcaacggaucugcgggcgcucacgcggcuccccgcccgggcuuucacugaagcaucggaagggaaaacugcggggaucugagcuggggugcugggacugggauguccucggaaagacagcaucagcuucugaagccgaaguauccaggccaugggcaagggucaggggcaccagguuuguucgagauggggcaacuuccgugguggacucuccuguuaaucccccgcacccuuagccucguagcucagagggccagcgguguacuugccugggccggcaaaagggguggagaaagggagcggcgggguggggugggcugggggggcugguccgcuagggagccaggagcuuggugggggguggcgcggggaucggugacagccucccggaggcagucguucccuuacucagcucccccuccgcccgcugggauucucucggguaaggggaaagggggcggggagcagaggugucccucugacggcggcggcagaagaagcagacagacugacagacacauagaccaacagugcagccccaggguucauccccagacucgcacacucuuuugguggugacuggggcucagcgcagcgaagcccgaugugguccggaggcggugggaaggcgcggggcugggaggccgcagcgggagggaggagcagccccggcaggcucaggugaaaucccgcucccugcuccucagcccccuucucccccaaaggccagccccugaccucggaaccccgaccaaauuggaccgcgguuccacuuuguaacuccccaaguugguugcaaagcaguauucaccuuccguucuccuuuccaucccuccccuuagguuauucucuaccccaccucuggcccucccgcucucgguucccuccuccuucccccccccccgccuuuuccucgcgcgccacaggcaccccacaaaaauggggguggggguguccaagggagggggaaaguaaugcuuugguucucucucucucucucucucucucucucucucucucucucucucucucucccucucuccuucuuucucucuuugagaccuaaaaaucuugacaagugaagcuuaaagguguuuaccuugucaucagcauguaagcuaauuaucucgggcaagauguaggcuucuauugucuuguugcuuuagcgcuuaugccccgccucugguggcugccuaaaaccuggcgccgggcuaaaacaaacgcgaggcagcccccgagccuccacucaagccaauuaaggcggacucgguccacuccguuacguguacauccaacaagaucggcguuaagguaacaccagaauauuuggcaaagggagaaaaaaaaaguagcgaggcuucgccuuccccc

SEQ ID NO: 191089 - RNA, 92009 nt, Homo sapiens
guuucccggcaugcgccgcggaggaagagacggagucgacaauaacaaaccaagccgcggcgguguccgcggcccugccgagcccucggcguugccucagaaucccccagucgccugggccccucggcucugacaggccgcggccuucugucccccggccccagacccagagccgaggggccugcucgcguccuuguccgcccggaccccucccugccuccuagaguucggggccgcggcgggcgggcgcccgggacgccggcgguugugucggcuuagcggugccgaaugggcgguugguaaccgcugccgaggacuaggcggcggcggaagauggugccgggggucgcuggcucugcugcugccgccggcgaaggaggaggcguugccggguaagugucgccgccgcccgcguccccuucccccaucuggcacagcggucgcgcggcgggcccuggcacggugggccggggucgcaugguccaggguuccggucggccugagcccggcccacgcgcaggugugugcacgggagggccccggcgccucccgccccggcagguguugcccacuggccgcuuucccggcgcgacagccccuguggagacaaaagcgguucgagucgaugcuccacuaggcugccggaggugugggucggacucgugcugcggggcugccugcggcuuccucggccggagccuugggaucccucccucugcgcugccgcuuaguacccggccuaguugccggaguggccgagggcgagggacguccgaaccucccaagacgcaucuugacuugugcucaucgcugccagggaucagcccuuaauucuguguuggacucgagaaacgggagaguggaguuuggccgaggccgaacgaagcucaccgaaugggaggaacggagagaugaugucuuugucccgaccccagagugcgaggaucgguauaaaguuacuccuaggaaugacucagccugcgcccgccccacggauagauuugggaugggugugcacgcggauuucacagcuuccuugguagaaacaaaaauacauuaaccaacaguagaaauagcagcuucugaauggaauaucucuauaguuucuuccaccgccugguggaugugcuguguuuacuguuuaugguuucguaaucuagucguuuccaucaugacucuuuaaaguguggucauaccuugaaguaguguagacuuggcugccaaggaagacucaugugcucacuguugauaaagagucacguuacuacgagacauucagccagaugggaauguucucaagucugcugcaaacauuuaaaguguaccuauuugcuaacuauuuuauuguguaguuucuuaaguuuuuguguuuuggugaagcuuguaugauuuauacauaaguuuggacaguuagcaauuuaggaagagacuuaaguagacuuaauuguguguuuaaucaagaauguuauuacauugugauagacgauaaaaagaggguccuuccacuucugaucagauaaaacugugagaaaccaaggaacuacugagggagguggcugauuuuaguuuuuggauuauuggauuuauaagcagaccauugcuaggaaugugaaaauauguucgcuuuuuauauuuguuguaacagaauauggcccuaaugaagauauuuucucaauaacauuccugucaugucuuuuaauguuugugauuguguucaaaaccuggauaaaguuuuaugucagggaugcuuuaggcacauaaugcuuacguugagaaaccucuguugauggaaaguggauauugacauaguucauauuuuuaaaguaauuuuauuuagucuauuuugaacuuuuuaugguaaucaagauaugauuauuuauguaccuaauccuuuauauguuuguuauuggacgacagggaagacaaugaagcgguacuuuugucccugaguuuuuuuuuuuuuuuuuuuuggcucuugcugccaaacacaagaucaggaugcauggcagauuuacuuuagcaaaucaaguucauaaaggcagaagacacaagacuuuuguuuucgaaauuuugaaccuaaauuuugauuauguuagccugagaaaaguuuuuagacucuaauauuaacuuaaaauuuuauaucauacauucagcagauauuugagcaccuacaugcuuuacuuugcagauguguaugucuuaugaauaucuuuuuaaaagaauggcugauaaaauuuucucauucagguaaugauauuuucugacuccaguuacacuuuucuuuuguaguaauacuggccuaagacacuuugaaaaucuagcagucccuuucaacacacuuucacgauucuuuuauuaucuuuuuaccacugugagguuuuugaacuaguuacaugaggaacauaaaaauguuuaaguaauuguucuugaguagagacgggguuuuaccauguuggccaggcuggucuugaacuccugaccucaggugaucugccugccucggacucccaaagcccggccacugauugccuuuugaauaaaggcccaagagaaguaagggguguaagugugugacucucgaaaggaauuuuuggcagaagaaacaguaaauggaaaggcucugauauacauggcauauaccaagaaaaaugaaguuacugaagcuggacugguaugagagaggcgauaguaaugguagauuguggggcucuacauauucagguuuggaagucauaguaaggaaacuaaugugcucuaacucacaaaggucuacagaugaauucaaguaaacccagcauggcuggaaagcaguugaagccaaauucacuucauuuauuccugaaaugcuaauugaaccccugcagcauacucuuuuagcuucagcaaugcaacagugaacaagaaagacauaucugucuauguauauauauuuauuuauaggaaauggguaaccacuggaaauuuucauggagguaaaugacaaacgcagauuacuuugaggauguagaguagauaaaaggcuagcuaagccgauuguauagugcuagguugaugaguuuuugcuuaacucacauagauaaaaggaugugaagauuacuugucucugauuauuuauuauggaccaaaucaacuuaauuugacuguaaacuguacccccauuguuuaggguccugagaggauggcauuucuuucuaucccuuuguaaaguuccgguucuguuggauuacuuuuuguaagugcaguacuugaaugccuccaaguacccucuuuccuuggcuaauuuguuucugcuuucauggcuguuuagugagugcuuugaggauuguggaauaacaauccucgcccauuuuuuuucauccaugauuuuuuucuacccguuaguuugcucuuuugaacucucauauuuuauuggcuuguaauugugcuaggagauaaaaauaauuguguuccauuuccuuuuuuugucacugauuugagacuguccacucauuuuuccuucacauuccacacauuauacuuguucaguaacuguccagcauaccuguugaaauauuaauucaauaccauauuauauuacaguaauauaacggcuuuuaguaauuguuuuacugcaaauaccagauuugggcaggcugguuuaauaauuugguuauauguuuauagauaaucuugguuuaauagaaugcagcuaauucuacauuuucuuuuuuuuccccauuuucccugucuuauauaauucuauauuugcuauauagauaauuuugguuuuacuguuaguuuccguuauaaaauaaaacacaacuagaaaauuuucacuaaaaucaugcauuuuauguaguuuuuauaaacgauagggacaccaaaauguguaaugcauuuauauguacugauacagaaagauuucuguuauuuuaugcaguucaagcaaaguccauaguaguauguagggugucaccucauuuuuauaaaaccauauugccugaauauacacauauuuccuguacaccuagggaaaaaaaccugaaggguguacuccaaaguauuuuucauuuuuguuuuaaaaguauuccuguucugcuauuuuuaccucauuugcugucuuugggcacuaccuuucuaaaugcucgcuucauucuuuuggcgaaguugcuugucuaguuuguagacaaggcguauauuuaggaagucugaacuuuuaugaaaaagguuuucuuucagggaaaugugaggaaaaugccugaccuacucaucuuucauucuuuuucuuggcagagaagggguaggaucagauuagaauacaucugauuuggggagacugaugcccaguuuucagucccugggcaaccuagacacuccguuugugguggacauuaucuccauugaugcaguagcccgugaccccucaaugagggagaauugcuaauaauugcaguuuacagaauuagagaucaggcaaaauuauuuccaaucaucuuuucucugaagcuuuuaguccacuuuaggguuaucugagucucauguguucuauucagcuggaaagcaucuugaagauauuuguauuccaggcaccuagcagugucuggcuuauguuuagaugcccccaaaauaguggaugaauaaugaauguguccaguuuugaaggucagagauugucauuggggugucccccuuucaccuuaucauauaaggaagcgaauucuguuuuguuuguuuguuuuuguuuuuuaaggcagagucuuacuuugucgcccaggcaggcgacaggcaauggugugaucuaggcucacuacaaccacugccucgugggcucagaugauccucccacuucagccucccaguaggugggauuacaggcaugcacuaccacugccaacuaauucuuguauucuuaguagagacgggguuucaccauguuucccaggcuggucuugaacuccuggccugaagugagccacccaccucggccucccaaagugcugggauuacaggcaggagccacugugucuggccuaauucuaaguuuugacuguauuagaauaguugacaguaaggcugggauaauugacuuuaucaucaugauaaucucucgagaaaauuguaaaucuccacuugauaaguuggauagauuuuaaugaguaugugagauacuuucugguucuuuuccucaaauauggauauauauggguucaguuguuauuccuguacaucuggaaacaaaugcagugggaucaauauauuuuuauuuuuauuuauuuuuuugagauggaguuucacucuuguugcccaggcuggagugcaauggcaugaucucagcugaccgcaaccucugacucccggguucaagcgagucuccugccucagccuccugaguagcugggauuacaggcaugugcuaccacacucagauaauuuuguguuuuuaguagaaaugggguuuauccauguuggucaggcuggucucaaacucgcgaccucaggugaucuguccgccucugccucccaaagugcuggguggcauauaaaguggacuaaaagcuucagagagaaaagaugauuagaaauaauuuugccugaucccuaguucuguaaacugcaguuauuagcaauucucccucauugaggggucacgggcuacuaccgcaucaauggagauaauguccaccacccugucggaucaauauuuuuuaaaauacagcucucuucuccccuucauuuauagcugacuguauccuaggaggauuuaggaggaccagauguccucauaaugagagauagguuuuuccccccagauaagagaauuccugcuaccuuauauuaacuacuuaagaguucuguaaauucagagaaaggagaaagaauacuauaggccaccugugauaagggaagacuucccagaagugguaauaggacaauacuuggacuuuuguuuguuuguuuguuuguuuguuuuugagacgagucucgcucuguugcccaggcuggagugcaguggugugaucucaacuuacugcaagcuccgccuccuggguucacgccauucucccaccucagccucccaagcagcugggacuacaggcauccgccaccaugcccggcuaauuuuuuuguauuuuuagcagagacgggguuucacuguguuagccaggauggucucgaucuccuuaccuugugauccacccgccucagccucccaaagugcugggauuacaggcgugagccagugugcccggcaauacuuugacuuuuaaagaugaguaaaauucagaucagcaaagauggggguauuuuaccuggcaggaguauguaaagugaggguauagguuugucauguaagggaguaguugaugauacugcuacaaaaauaaacugggguuaauuaugaaguucuugagugcuggaguuuaauuaaagucauaauugccaccauuuuuaaagcuuuuaguauauuccuagcaccguaaaggacucugaaguacauuauugcuauccuucucaucucugugaaagguaucguugcaauuuauagauugucaacugauauguggagguuaccugagccucagugagauagaugguauucaaauacaaguaaauuuuguuccuaagucugccauuuuuauguuaaucuagccuauaucaaguuggcaaauucacaugcuaagaggggugggcagauaguacaauuaagugaaacugucugaguacugaaccggaggugacaaagagaguguagcuguaaagaaacuacagauuugugcccugcuguaggcaacaguaaggugcuagggaagauacuugagggaagcagccugacuaccuugguuguaacugguagggaguauuuaggaaggauugaagccggauagagauuuaaagacagagagaagagguugcaguuuccuaaguaaggguuaugucauuggaaaaugagggguuggauuagaaaggaaaaaaauggguaggacuuggacagaaauaacugaagccugguccauugucacuuuggaaaguuuguaaaaaaaaaaaaaaaaaaagaaagaaagaaaaagaaaagaaaaauaacugaaguuuggggcaauaguagaaugauaguucauugacagugaauaaauuagggaauagauuuaaaggaaaagcaccgaauuuaaauuuggacauguugaguuugagguaacaguaggauuuccagcuggaaauaugaagcaucaguuacugcuagcucuaaacucagaacagagaucuggauuaguuaauaacaguaauugauguuuguauuucacuuuaugguuuacauaacuuccauauauguauagauuauucguuagauccugaccacaacccugugagacagguacuuuuacuuuuuguaaucaaaugaaaaaacuuguuaggugaagucaguucaggucacauugggccaggacuugaauauacuucuuuugauuccaaaucucauguucuuuucacaguucuguucucccucuuauguuuacauaaagauaacaauuggggcguggugacucaugccuguauucccagaacuuugggaggcugaggcagacagaucacuuggggucaggaguuugagaccagccuggccagcauggcgaaacccugucucuacuaaaaauacaaaaaaaauuagcugggugugguggugggugccuauaaucccagcuacucuggaggcugaggagagagaaucucucucucucuuuuuuuuuuuuuuuugaaacagagggagucucguucuguagcccaggcuagagugcaguggcgagaucucggcuuacugcaagcuccgccuccuggguucacgccauucuccugccucagccucccgaguagcugggacuacaggugccugccaccacgcccggcuaauuuuuuguauuuuuaguagagacgggguuucacuguguuagccaggauggucucaaucuccugaccucaugauccgccugccucggccucccaaaggagaaucucuugaaccugggaggcggaggcuacaacgagcugaaggcugcagugagcggagaucgcaccacugcacccagccccuaggugacugagugaaaguccaucucaaaaaaaaaaaaaaagauaacaguuggaagacuaaacaugaaugaccauuuagggaaggcuauauuuagaaugggaguggggcagaacuccccuaggaccucagauugggacugaaauagggaaggcuggugggaaucuuugucuugcucucuuggugggacuaacucuuuuggugcaacaaauucagguucuuuauuucuuuguaauguauagggugucaucuuuuuuuuuuaauggauauguguuuuuccccucuaauuauaaaugugauuuuuaaaagaacugggagaaaguaaaagucuggcauccagagauagccaguguuaaaaagauugcuauuaaauugauccagacuuuuuaagugcuugcauauacauauguccuccugcauuaguuguaaaaauaaaauccacaaacagaaucacauaauauauacuguaaauugcuuuuuguacugaucaauacguauagaucaaaacauuuuuaaaugucuaaaauuugauaccuuauaggguuguguaauaauuuauuauuuuuuuggagagaggaucuugcugggucacccagccuggaguguagugaugccaucauagcucacuguagccuccagcucccaggcucaagcaagccauauccuccugccucaaccuucugaguagcuaggacuauaggcauaauuuauuuaaccaaccuccauugauaguuuuuaaauucaucauuuuaaaaagugaugguauaaugaaaaucauugcauauauauaccuuuguacacuuguuucauucuuugcucccagaaguagaauugcugguuuguacauuuuaaauuuugauacauagugccagauuaaauucccuuaaaaguuauaccaguuuauauuuuugucagaaaugugccaguggacccacuguuaaucuugucaacacuuagcacucauuuuaaucauuaguaguaaucugaaggguaaaaaguaguaccuuguugauguuuuaguucucauuagugaauauguaccuccagauaguuuauuuuucuucaugcuauggauagccauuugucauaauaccauugcaugaaaaguugauccuuucuccccaauuugaaaucccaccauuauuguauagauacacaagugcagguaugcauguauaaagaucaauuuggaucuguucaguuucaugcauuauguuuauuaaugcaucaugauuccuacuaacuuguuaacuaccgugugaguuaugaguauguuugacauguuuugacaguuguucuguccuacgaagucucaguauauaugguaggcaguuuauaguaauucuuaguggguagaaacuaaagacuguuuaagcagagggucaaauaauuuaagaaaaucuugugucaguuguugaguuacuaaccuguuacuuuuaauuuagaauuggcuuguguuaacuuguauaguauuaaauaugguuucauuuuauaaaaguuaagaaggacuuuauauaaaaugagcaucaagucagauuuuaggaaaucgugacuauuuggugaaaaguaauacuuauguacuaggcuuauuuauauaaggcuuauaaaguuacuuuauaauuccuugaauagcaguugauuucugugcuuguaccuuacuuaacaauuacaugcaauaacuuuaguucuagaucauagagagucaacccacuuacaggauuuaauggacuuuacguaaauuagggguacauguacauaauaagcauucccaaaguugcaaguuaauaaaagaauuagcuccuuuuaaugauuguuuucuuaaaagaaaucauugguuuauuaaguuuauccucuuaaguuuuaguaaugugaucagugaggguaaacugucaguuucuaguuggaacuugauuuuacauauacuuuuguguuuuuuuuuuuuuuuuuuuaaugucaccuuugugugaauucuuguccauucuuucucagucuaacuuuugcauaccucucuucauauuaguauuauugaacuuuuuggaaggcagguaaugugcuuuuuauuacuuuuuggcacuaacacacaauaaguuucuuaaaauuaguauuuguucaguguguuagacucauguuuaauguaugauuugacuauuuauagaagaucagaagaauaaucuaguguaccccuuuauguuuuaagaugacgaaacugagauucagagaaauuggauaacuccugaaaucacaggaguaaagaugugaagcuaggacuaaaaaccagaucucuuauuucuuuccaaguauuuuuuauuucagggugaccaaauauguacuugguuacugaugucccuuuuugcugaauguuuuuuaacaauuguggcauacaaaggagagaauucaguuucaugggaucauguuauuuugauagcauauaggaguauguaacauaaaguauacagucuugugaauaaauagcgacaguguuccuguggauucucucugagcaacuuucugauuucaguuuugguugccguaguccuuauccaugguuuugaccgcaaacauuuauugacuguuuacugucucuagguaguauguuagguauugagguaugauaugucaugaccaaaauuuuuuuuagccauuugcaauacagcuugggcgauguaaguuauuuggcaaguggcaaaaaaguguagcagggcauuuauuuauguucugaauaccaacacuuacuugaauaguuggaauuugaaguaugggcugucaguacuucaggaacaagaccacugacagccaguacauugaggaagacuuuacgacagaauauuugugaauucuugguuacauaauggaagcuguggaaugacaugaguagaggcaugaaaauccauuuauucaugcaccucauuucaggagaucagccuaaaugguauggagcuucauguagggacccaaauaaaggaaauaguggagugucagucuaaggaauuuauacuugaguagaaguuaugaagcauuuuuaguuuggggagaaguaaacauuaaaagaaucuaagauuauguaguugguggugucaucugagauggaaucugcagauaguaggugcucagauagguaauuguuagagcccgauaugcaguaggaagaucugaauuagauagcuuaaugggaauaagguggaagagaggauacacauacuuaguaacuguuuauguggaaccaaggaguacuuauucauauaugauguuaaaauauauuaaaccaaguugauuacuuuuuuuuuuuuaauauaagauacugggaacacauuggcugauaaagaaacugcugaaaauuagcuaccugcaugugaucucucucuguuacuaaguuacuauuuggauucugcuuugucauuugcuuagaguacugcuacuagaaccccaagaguacauuugcuuaugaaacccuguuuauucaacagaugcuuuugagugcuuuguguuaugucacagaguuacuuccugucccuagagaacauuuugggaauauuuacugugauuucuuuuuuuuuucugcaacagccauaugagguagguaugauaaauauccccauuuacagauuagagaauggaaauuuagacagacauguauugaugaagaaaguuguuuucuuguuuuaucuacauuuuuuucuucuucuuuucuuuuuuuuugagucucacucugccaaccagcuggaaugcaguggcaugcucucggcucacugcaaccuccaccugccgggugcgagugauccuccugccucagccuccugaguagcugggauuacaggcgagagccagcaugcccagcuaacuuuuguauuuucaguagagaugggguuucaccauguuggccaggcagucucgaacuccugaccucaagugauccaccugccucggccucccaaagugcuggaauuacaggcaugaaccacugugccuggccuguuuuaucuacauuucuuucccugauaauaaagccaugcagcucauggaucuucuggagaagauucauucaguagaauuuuauaacuuugacuuagauuacacaaaauuggucuauguaggucauaugauacuucuuuuaauaagagaacuuaaaacauuagcaugaauagguauauuuuauucauccugguacccauacagaguauuuaacuaauuuuauaaaccauacauuucaauuaaaaucugaccagcuuuauuacaugaccacauaaagauuaauaauccaggguugaaauaacagcuaaagauagaaauagauaguuuuggcugugcaagguggcucacgccuguaauccuagcacuuugggaggccgagguggguggaucaccuaaggucaagaguucgagaccagccuggccaacauugugaaacuucaucucuacuaaaaauacaaaaaugagcuggacgugguggcaggugccuguaaucccagcuacuugggaggcugaggcagggagaauugcuugaacccgggaggcggagguugcagugagcugagauugugccacugcacuccagccugggugacagagugagacuccaucucaaaagaaaaaaaaaagugauuuuuuuuuuuuucaaagaagacuuuagugguauaggagcuaagguaaagaagagaaaauuugagaucaagcagcuuuaucaagagauuuaagugacagaaaagugaugaucuggccgagcauggugagucacaccuguaaucccagcacuuggagaagccaaggugggaggaucauuugagggcuggaauucaugaccagccugagcaacauagagagaccccaucucuuaaagaaaaagaaaagaagaaaaggaaguaaugauccuugugagcaaaaacaggucaguauccucuuguuuugacuggaucagaguguucaggcaaagcaguaaucaaacuccuuuuuccauuuacugcuguuguauagaucuggucccuuggccagucacaguggcucaagccuguaaucucaacacuuggggaggccgagacaggugaauuaccugaggucaggaguuugagaccagccuggccaacgugcugaaacccugucucuacuaaaaaauacaaaaaauuagcugggugugguggugggugcguguaaucaaagcugcucgggaggcugaagcaggagaauuccuugaacccaggaggcggagguugcagugagcugagaucacgccauugcacucuagccugggcaacaagagcaaaauuccaucucaaaaaaaaaaaaagaucugguccuucacacauuguuauauacauaagguuguacagccauuugagaaagagaccaguuaugucuguuucccuaaacaacuggcuugagaguccaauuuauacaacuuacuuguagaaucuuuaguaauuaggcacuuugggugucaccuaggucaaccucccucuuaaugcagugacagguccagggaaauucaauucaaguaaagauuucacguuucaugccugcagugguuguuguuaaacauugagauugagaguguagucugagaauaagaaaaccuugaauauccuuuauauugguuagauguuggugcaauuuguuuuuguguauacauguuuacuuauaggaaacuguaauuuucauuauuggcaauuguuucuauguucccuuuauuuaguaaagcauauuuaguguuuaugccuugccauggauacaggguggucauaucagacauuguuuguauguucugcucauguuaauggauuggcugcaaauaagauaugccaaugaccaauaagauaugcuuaguccacacuuaauuaagaacauguugcugauuuuuuuucuuuucuuuuuguuuuuucuaaagauagucuugcucuguugccuaggcuggagugcuguggcacagucucugcuugcugcagccucaaccucccagguucaagccauccuccugccucagcgcccccaccccacccccccauaacugggacuacaggugugcgucaccacaccuggauaauuuuuguauauuuguagauauggagucucaccauguugcccagguuggucuggaacucuugaucucaagcaauccaccugccuuggccucccaagggugcugccaaugcacccagcauguugcugauuuucuuugagacauaguggcaaagaaaauuuucucagcucugucuuaccaccgugaaagacugccuucagaguguuucaguuaccucuucccaucaauaugagaaaagaugagugugaggaauagguagagggaaaaauuaaaguuuuuuguguagcaugaauuaugggaggggauuauauagguaauucuagcaugcacauagcucuuguauaggcauugugccaguagguagguauuagaguagacaugguucuuuguaguagccuuuuauaaaauugacuugcuuuggugaaacagcuccuggcaucauucagacauuuuuauccuguuguguggguguggaaacacugggauuguucuauaagcuuucuuuuguuuuuguguguauauauauauauauauauauauauauauuuuuuuuuuuuuuuuuuuuuuuuuuugagacggagauucacugcagugcaguggcagaaucucggcucacugcaaccucugccucccggguucaagugauucucuugccucagccucucagguagcugggauuacaggcaugugccaccaugcccagcuaauuuuguauuuuuuuuuuuuuuucacuagagacaggguuucaccauguuggccaggcuggucuugaacuccugaccucaagugauccaccugccuuucccuuccaaagugcugggauuacaggcgugagccaccaugcccggcuguauuuuuauaauucuuaauggaaaucaaaaacacagaaagauaggcaauagaagaaugagcuaugauguacccaucauuuugauucaguuaucaucacgucauggccaaucuuguuuuagcuauacuuccaucugcuucucauucucuuguuacuuuugaccuguaaauuuugaagaacagauauccccuacaguagcccugugaggaagauguuaucucuacuuuugagaugagaaaauugaauguuaggauaaauuucuuuucuaaaaucacccagcuuguaaguggcagaauaagaauuuuaaccaggucuguuaaguucuuccucugcagucaguuguuuuuccuucuguuuaggucagauuauaaccaaggagggugguguauucugacagcagcuaaauguuuuacuggaguauuaccaauucaguaccuacagacacuuguuaauuguuuuggguuaggguuagcuuagaguuagauuuuuuuccuuuccucugcauuauuuuugaccauuuaaaaaaucauauugaaggccgggugcgcugguucaugccuguaaucccagcacuuugggaggcugaggcagacagaucaccugaggugaggaguuccagaccagccuagccaacauggcgaaacccugccuuacuaaaaauacaaaacaauuagccgggcgugguggcaggcgccuguagucccagcuacuccgaggcugaggcaggagaaucacuugaauucgggaaggggagguugcaguucacuccagccugggcgacagaccgagacucugucucaaaaaaaaaaaaaaaaaaaaaaaaaaaaaaaaaaaaaaaaaaaaaaaaaaaaaaaaaccaaccauuacauauacaguuuuuguuaauacuguaagccuuauuaaaaguuauucucuggccaggcgcaguggcucacaccuguaaucccagcacuuugggaggcugaggcaggcggaucacgaggucggagaucaagaccacccuggcuaacacagugaaaccccgucucuacuaaaacauacaaaaaauuggcugggcguggugguagucccagcuacucgggaggcugaggcgagagaauggcgugaaccugggaggcggagcuuccggugagccaagauggcgccacuguacuccagccugggcgacagagcgagacuccguguaaaaaaaaaaaaguuauucucucauauuuuaaaauuucuauucaagacaacccugggcaacauggagaaacgccgucucuacaaaaaaauacaaaaaauuagcugggcaugguagugcaugcccauagucccaguuacuugagaggcuuaagugggaggauugcuugagccggggagguugugagguugcugugagcugugaucccgccacuauacucuagccugggugacaggacgagaucuugucuuaaaaaauguauaaauaaaucaaauuuuuaauuuuuauccguaacauuuuaaauccugucuuaaaauaugaauaauaaaaguauggguagacaaauauuuguuacuaauaaauguaggaaagugucuuguguaugcuuuaacuauauuucaaauuuuuucccuaaaauugauuucaugguacaguuauuggcuuaaggaaaugugauuuuauaaaaccuuugcuuaccuaccucuacaaacaccaguugcuuuccagaaacaucauaauuauuuaaaauacauucugaccuguaauaugaauguugaaugugauuaaaauaauacauuuucuaguguuuuauuauggaaauuugcaaacauauacaaaaguagagagaauguuacagugaaccuaauauagccaucucacuugcuuuaauaaguaccaacauuuugccaaucucaccuuucuacugcccagcuaauucuguucuuuccuuccagccuuccuuccuucgcuuauuuuugcuagacuaguuuaaagcaagacucaggcaucauuuuacacacuaauuuuucagaguucauuuucuguuacuacaaugccauuaucauccaaacaaaaguaauucuaauucuuuaguauaauccgauacccuguccguauuuagauuugcacauuuaucccaaaaauguuauuauacaguuguuuuaagucaggauccaggaucugaacaaauucacacauggcauuuguuuauuuugucucguccaucuuuuuuaguuuauaaaaagucuucuuuuuuuuuuuuuuuuuuaguaaccauuuguugaagaaacagagucauuguucuguggaaugcuuauucugaauuuaacugauucaucauaauguuugucuuuuucuuuauacuccauauuuccuagaaacuggaaaccguagguacauauaguugcuugauuaaauucagguuuacuuuuucagagguggucugggguggcaagaaaacuuuauacuugggcuguguccaguugaaucgcuauuagcuggagguuuuccauauaaauggacugaaauacguaucuuuuuuguuuuguuuuguuuuuuguuuugagacggucucucucccuugcccaggcuggaguacaguggugugaucuuggcucacugcauccuccaucccccaggcugaaacaauccucccaccucagccccgcaaguagcugggaguacaggugugcaccaucaugccuggcuaauuuuuguauauuuuguagagacaggguuuugccauguuacccaggcuggucuugaacuccugagcucaagugaucagccugccuaggccucccaaagugcuagaauuacaggcaugagccacugugcccagcuauccaaaauacauuucauauaggaaggacagugcuuaauuucuuugcuuuuuaaguuuuuaucauggguucuaucuuagcucacugagguuuuuuguuuuuguuuuuuugaguaucauuaugcagcauggauuuuuauggguuuuugccauucaguuacuuguacucauucuuuugauggucagacugucccaucauagccaguagaagccuuuuaaaguuguuuuccuugccuuuuugaccuaaucucuuuagucuuuguuagcugucuugcuuuauggcauauuaagauguuccaggcuuaugugauugguacauuuucuacuuuagacauuuagcauuagccacuucuccaaagguucuuucuagaaaccaaaguaggccgggcgugguggcucacaccuguaaucccagcacuuugggaggccgaggcggguggaucaugaggucaggaguucgagaccauccuggccaacauggagaaacucugucucucugaaaauacaaaaauuagccgggcgugguggugggugccuguaaucccagcuacuugggaggcugaggcaggagaaucgcuugaacccaggagacagagguugcagugagccgagauugugccauugcacuccagucugggcgacaagagcaagacuccgucugaaaaacaaaaaaaccauaguaugaguguguaaugagguuagccaacucuacaguuagaaggaacagucccacaaaacugcccucauuucagguacuaguggcaaguuuggcggugcccagaacccacccucacuucaaaccagcugacuacaaacucacagguuccccauauccacccucucuuuggagaauucacuggaacaggucagggaacgaaggaaagcacuauacucacaauuacacuuuuauuauaagagaaggauacaaaaauuaaaaucaggcaauggcagagagcagaaucuggaagggguccaaacucagagcuucuggccaucauugcugguggagucauagacaguguuaccuucucuuggccacaacgcgugacaguauacacagaguauugcucacuagggaagcucaccugagucuuugguguccagaguuuuuauuauggcuugauccuguacuguccacaugacucaccuuuagucucuagcccuuucuggaggucagaccaaugucuuuagucaguaguuccucuggaggucagaacuuaacugauacaugagucacguugcuacacugacgugacugaagcccuaaggcaaacaaacacaguucuaucugucaggauauuacaggggccuagagaucaccucccaguagcgaagggcaaaggccagaccuuucuuugguuaauguuaauuuuucacugccuguugugcuguggguacuucuggcucuaggucugucaaugccuucuuuucaauggagcuauggaauaaauguuuuauggaaagagaaaaauucuuguuuauacuaguauuucuaaaguacuuuuuacuucuuuauacauuuuauuucuuuucucuuggguugaaaaccuuggaaucuuaggucgaaaaucuugcuugcuuaguaggagaaaaauacugucuucuuuuuagauuuguaauucuuugauuacugaagaggccucaaauauuuuccacauuuguuaaccacuugauaaccuacucaugcccuuugccuauuuaucuauugugagucuuugugauuuucuuauuaauuuauaggaacuccuacuaaaaagcuaauaguaauccuuagucacuuguuauugucauuuucaccaguaaucacaucuuuggauauuugaauuaaaugauggguggcagguauggaaaauaucuucuucuuuuugguuuucuacccuuuccucucccacuaaacuagaauaccagucauugugugaucaguccugggucuaucaucuguuagaaagaaaacugggaaauugggcuugucucugggcaggacuucuuuguauuguugcugucacuuccauaugauggaagugcugcuuaccaggagguucaguccuucacuaguagaugccugguauuaacuaaaguaugugcagcucucacugaaguggcuguaguugcuuaagcuuuggaggaagaggcacacacuuucucucuaaaggaccagauaguuaaguauuuuaggcuuuacucuccaagaggcaaaauugaggcuaugauguauagauguuuaauguaauaagagagaaaacuccugcugcgucccguuuguccgggaugagccauccaggauggugggcauguuuugugcccaguuggcaucaguucgagacugucuccggauccacaggggacuacccgggggggaugagccugggaguagaggccaacaccauguuauuuucugcuuugagagcagauccugaaucacccuccucuucuuccugaaagccuggugggagaccacgugaccuguugagucuuccacucuagagccaagauuauacuccucacuguccugcaguugccagcaguaggguggaguucccuauuugaagguggccccaguguguguccugggagugaagugugugaggaugcaaagggguagcugucuguguuaaacacucagcucuguucuuggcuacgauagguagguucuccucuauauguuucuuuagcugugaaguguucaguaugcacauuucuagagaauuccacacugccaggaugaccagguauggaaaaauuucucucugcuacaugccaagaucaccuuuucuuuucuuaaauuuuaaguuaaaggguacaugugcgggauauauggguuuguuacauagguaaacaugugccauggugguuugcugcacagauuaucccaucaccuaaguauuaagcccagcauccauuagcuauucuuccugaugcugucccuccucccacccuucacccucugacaggccccagugaguguuguuuccccauccuacccccgugugucuauauguucucaucaguaacaggauugcuggguuaaaugguauuucugccucaaggucuuugaggaaucgccacacugucuuccacaaugguugaacuaauuuacacucccaccaacaguguaaaagcauuccuuuuucuccacaaccuugccagcaucugucuuuuucuuugacuuuuuaauaauauccauucugacugguguaagaugauauaucauuaugguuuugcuuuacauuucucuaaugaucuuugauguugagcuuuuuuuucauguuuguuggcuacauguauguuuucuuuuucuuguaaauuuguuuaaguuccuugaagaugcuggauauuagaccuuugucagauggauagauugcaaaaauuuucuuccaucccguagguugucuguucacucugaugauaguuuguuuugcugugcagaagcucuuuaguuuaauuagauuccauuugucaauuuuugcuuuuguugcaauugcuuuuggcuuuuuugucaugaaaccuuugcugugccuauguccugaaugguauugccuagguauucuucuaggguuucauaguuuuggguuuuacauuuaagucuuuaauccaucuugaguugauuuuuguaugugguguaaggaagggauuccguuucaguuuucugcauauggcuagccaagacuccaagcaccguuuauuaaauagggaauccuuuccccauugcuuguuucugucagguuuguggaagaucaggugguuguaggugaagaucaccuuuucauuuauggacacaaggaaaucuuguucucucaggaucuggguccaugccauuucuuggaugaugacuuugcuuucuguugaaaaccuuaccuugucacauuuaaaguguucuguuauuccacucuucuuacuucauauugaaagagguuuuuuuuguauuguauuuaguaaaggaaauuuuuuaaauggucacauaagggagaaaaucugcaaggggaaaaaaguguugcuauuucuaaaggaauaguaaagucccaagucauagaauaugcuuacuacauguagucuuauuuaagggauuuuaauguaguauguucauguucuuuuuucccccgugauccagcuauggauuuuaaguuuuuacaacuuucuuucuaugugacuuuaggaaauaacuucuuugagccauaguuuugucauaugaaugaugcggauaauucuuaaccucucucacuauaggauuuguaagaauaucauauacuucauacaguucuuacucauguuuccagucaauggaagcuauugcuaugccaacaguaucauuaucucuaaagaauaaaagcaaaguggaaguauguauuuuggaacuucauguuuguuuuuacuuuaaaaaaaagauuuuuuguagcuuuuuucccccugaaaguagguaucauggaguuuuauauaaauauaaaauuuucauguugcccacuaugauauuaaaauucaugagagcagacaguuuuauuauuuuguauuuuauucccaaaguuaagaaaaugccugguaccuaacuagauucucaggugauauuuuuauugaaugaaugaauuuauugaccuguguucacaccccuggcuaaguuuacuuuuguuuugguuuacuaaguuuguuccuuuagacaaguuuaaucugaauuguaauuucucaucugcaaauggaaacccuaaugauaugaauguauuacauguaaugauaaaugaagucaugcauguaaagcuacuuagcauuaugagugguauacaaugaauaacucaauaaguauuagcaaugauuaugauuaugauuuuaugugccauuuacuuaggacauguggaggaaagaagagcauuuguggccgugaaagcaaugagcgucacauuuccucacagguuaccgguacugguagacccaugggaaaugaugccuuguguuaguaguuggauuuuucucuguuguucuuggguagacuuuugguagcuggcaguuagugaggauguagagagugaaaauauuuagaagaggcuucugauuaaagaugccagucuuaggacuauacacaauggaugaaaacgugggaaaaugauauugucauuaacaucacuuaggagcuguuagaaauuuguauacuggagucaaauuuuagguucuagagucacaguuaucaaaacuauccuugaagugguuuaaauuaauuuuaaccuagguucuggagccaguguaaucaaaacuauccuuaaaauaguuuaaauuguucaucaaguauguagacaaacucauucucaauuagguuuauuucuuucagcuuuuuuuggucagcauuguuuaugauuaugguuucuuagggugaggugugugcaugucaaaugaagagauuaguguuuguuuaaaggcacacagcugcuacagcuuauuggaguuucccucaauuugcuuuaaguaucauggaagaggagaauggaacugaggucgucuauacucuaacgauuucuaaagcuucugauugaaagcaauauauuggcuguagaucaugcagaggaaaagcugaacugucccagauuggaagagauuaaauagauauuacagcuaaaagcaauaugaugauccugaaauaaauccuggaucugaggggcggaaacuacaaaggauauuauugaggcaguaguuugaauauggacuguagauuagauaauaauagugcaucaguguuaaauuuuaugauuugauaaauguacuuugguuaugaaggagaaaauucuugcuguuagguaagacauucugaaguauuuauggauaaagggaaauucugucugcaaauuacaguaguucaggaaaaaauauaucccuguguguauacguauguggagagagagcauguauggagugugcacugacacaagugauaaauagaacacaaguguucacaguuggugaucugaguaagggggacgggaguucuuuguacuauucuuguaauuuuucucuaacuggaauuauaucaaaacaaaagauaauauucaaaggaaaacgagaaaacaaaaaacaauacagugauuauuauugaagauuuuguguuuagucucacaaaaauggugugucuccuuguacugcuuuacaucuucucaguucaggccucuucuuaucccaacaauaccguuuaaauguaacccacguagaggccuccuuugaucacauaaaucuaaaguaagucguucuuccuacccacucuuuucuuuugugcguugauuacagcuuauaucauguuugcuuuguucuuguuuaaugcugcuuucuccuucaagacugaacuccaugaggacaaagacuaugucuguuuuuucccccacagaauacccaguccuggcacauaauaucaauacacguguuuuggauuuggaugaaugaaugaaugaaggaauauuccuuccacuuuagucagcaucccuuagcuaccuaaucucugagaaaacaaaaugccuccuguaagauaaagcuguaagauaaagccuaugcuuuuggauuugguauucauucacucauucauucagcaaaucuuuauuuaauacagucaucugauuccuguuuaucucuagcuuccuuuuguuaacaucucucagaucugcaugacuuuucuaggucugcaccuucuggccagucuucugucaaucuguuaagugcguuucauaguucccugucacucuccacauauuucuuagaaaguaucacauuuaugauaauuaugccuacuuucccuggcuguagauacugccuuuuuuuuuucuuuugagaaagagucuggcucugucgccuaggcuggagugcagugguacgaucccagcucacugcaaccuccgccucccaguucaagcaguucucuugagucuggaagaagauguguaugaggcuagggcagguggaaggggugaucauagcaggcagggcaaauagaauccuaagcguggaaaacugccccaugaagacucagagacuuuagcagcucgauuuguuuagggaguucaagcagugugauauuugggacugauaaguugggggagggguagaggaugagggugaaaaguugugguggaaaggaagagcauauuauauuugcugucuuagguguuauugucauuuaauaaagcauuuagaauaguuuccuggaauauaaugaauacaaagugguagcugcugcccuaaaagucauaaucgucuugaguuuuaaagcagcagaaaaacuuggaucaaccuaccuagcauguaggaagauuucuuugaaggcagcauggagguugacggacuagugauugaggaaaucagugcagguugaaaacagggucugauuuaaggcaguagggauagaaauagggauaucgugucauuaaguauuuaaauguuagaauuuacaggacaaauuugcugauguucguaugucuuuuaggaggaagacaaaucuaggauaauaugugagagauugggugaaucuagacuucaucaacaaagagaaaugaaaaauuaaagcaaggagauuuaaggggcagagcucaguuuuagaaacaauaauguugaagaaaugcauauaggagauugauuuggauuuguugaguuucagagggauuggauagauaguuuaggagagauuugggagucagcaaucaacaguggugguagcagcagcuaugggaguaagugagcucuacuacaaagguaaggcggcugagaucccucccaaacuuuggagaguugacuuaucugccaaguaccacauuuuuucuuugacauccuauugggggaacccacccccaauauuucacuguagguucuauuuuccauuagugucggccggcugagaaauaaagagagacaguauaaauagaggaauuuuacagcugggccgccgggggcgacaucacauaucgguaggacagugaugcccgcauaagccucaaaaccagcaaguuuuuauuaaggguuucaaaaggggaggggguguaagaacagggaguagguacaagaucacaugcuucaaaggacaaaaagcagaacuaauaagagucuaacaaagaucacaugcuucugagggaacaggacaaaagacaaaagcagaacuacugauaagggucuauguucagccaugcauguauuaccuugauaaacaucuuaaacaacagaaaacaggguuugagagcagagagccagucugaccacagauuuacuagggcggaguuuuuccccaccaccguaguaagccugaggguacugcaggagaccaggguguaucucaguccuuaucucaaccgcauaagacaggcguucccagagcagccauuuguagaccuccccacaggaaugcauuccuuucccaggguauuaauauuccuugcuaggaaaagaguuuagcaacaucucuccuacuugcacauauguuuauaggcucucuacaagaagaaaaauauggcucuuuuugccugacccugcaggcagucagaccuuaugguugucuucccuuguucccuaaaaaucgcuguuaauucugcucuuuuucaaggugcacugauugcauauuguucaaacacacauguuuuacaaucaauuuguacaguuaacacaauuaucacagugguccuaagaugacguacauccucaguuuacgaagauaacaggauuaagagauuaaagacaggcauaagaaauuauaaaaguauuauuuggcaacugauaaauguccaugaaauguucacaauuuauguuccucugcuguggcuccagcuggucgcucuguuuggggucccugacuucccacaacaacauccuccuaauaucccugugauaugguuguguuauauuaaucaucuauuguugagugagaaauuacaguaaacuugauuguuugaagcaacauaaaucuauuauuuuauagauucugggcauggcuucacugggcccuuuugggucucugcaagacuucagucaaaguguuggccagggcugaggucuucucugaggcucaacuaggaaaggaucugcuuaugggcuuguggugguugucaagauucaguuccuugagaauugucagacugagacuguagcuucuugcuagcuggccaucuucaauuccuuaucaggugggccucucuauauggcagcuugcuucaucaaagcuggcaagagagagucagcuggcaagaugggaguuauaaucuuaaguaacgauuaccuacaugauaucccaucauuuuugcaauauuuuuuugguuagaaacagaucacaggcccugccuacacuugaggguggggauuucacuggaguaugaauacaguagguggaugugguacagauaauugcugcugucuuagaggcugucugcugcaggugccauuuuuauuccuauuuacaaaagaggaagccaaaacaguuguccaagaucauauaauugcaaguaauggaccccaaaccaaacccaagcuuucuaacuccacugccuggauacuucuuuaccauaauauuuuaaggaaugaggaauuguuguggaaauggccguuuugaggaauuuauuggugacuuuuguuugaugccauggauugauguggguugaagucaugugguuguuauuauagugaaugugcaaguagaagggccugaguagagauuauucuuagacgguaguuuuaaaaggaagaaaggaacaauagccauauguuguuucguacugaauuguuucucuuuauaaccagaaauuuuucuuuuccaguuuucugaguuuaaccaguaaugccauucaguugccaaucucaagcaaagcaaacauaagccaguuuuaaucuacuuuuuaagaaaagugguaguccuuuucacagugccugacgguaagucacaguuucuaccuguauagcagaguuuaaucuauugccuuuaaaauaaugauucuggaaaucuuaauuuuaaaaccuuauuugcuuuuuccuucucuaauaauucucuaaggcuuauguggaaagagcauaaguaaagguaccuacuacuuucugggaauuuauuuauaguuaucguucaccaguuucauuaaucuuauggaucuuuuccuccauuuguugaaaguaaaaugcuagaccaugaaaucuguccccuuuuuaugucauuauuuuaaguuuuuuuucuuucucuuuuucuuuugagauagggccuuucucuguugcccaggcuggagugcaguggcacaaucguagcucacugcagucuugaacuccuuggcucaagccauccuccugccucagccucccaaguugcuaggaccacaggcaugcgccaccaagugugucuaauuuuuuuaaacauuuugugcagacaggguguugcuguguugcccaggcuagucuugaacuccuggccucaagugauccuccugccuuggccucccaaaguucugggauugcaggcaugagccacuguggcuuguuguguauguuauccucauuuuauagaugaaaaagcuuuauuuucuagaugagguuuuuccuugggcauguuaaucacagaguuguuuuaaauauucugaucuccagaccuguacacuugcuacuguuacacaaagugauggaacuauuaaggaggauuucuugcucaguguagaggugaaaagcaguucaacaggcagcugauggaagugauggaacuauuauggaggauuucuagcucaguguagaggugaaacacagaugauggaaggaauugggauucauuuccccuaauuugcaaguaacggcuacucuuaauuugcgauuaguaaguuuaaccuuaauacuaaucuauuuuuuauuauguugaggaagaaguggggggaaaacucucagggauaagaugauugaccaacuguuuuauucuuaauguaaaacacugagugaaauaugcacauagcaaccuuuacucuagcuacuggccuuuuacuucuugaagaaucaaacuuuuuuuccuguggcagaacaguuaugcuuuucuuuucacuaaacucauuacuauuuauuuuuauuuuuuuuuaagcauugaguuuacugaacuauccaguuagccauccuagacaucaaagcccauuuugauauuuuuguuauuuauauaguaauacuguacugugucauaaugaugauaguauuugugauuguaguugcauuuguaaaauugaucacuucucuuguuucuucuaguaacuguaucagagggugagguauaagcucacagaauucagauaaaucaucaugaaguuauauguauuucugguuaacacuggaacuacucuaacauuugacacugaacuuacagugcaaacgugaguuguauuucauuuauuuuuuuuucgcauucugucugcaugcagaaaguuaaagaaauauuauucuacuguuuaaaaaguaggauaauggcggccgggugcgguaccucacgccuguaaucccagcacuuugggaggcugaggcgggcggaucacgaggucaagaaagaucgagaccauccuggccaacauggugaaaccccguuccuacuaaaaauacaaaaauuagcugggugugguggcgcaugccuguagucccaguuaaucgggaggcugaggcaggagaaucacuugaaccccggggggcagagguugcagugagucaagaucgcaccacugcacuccagcccagcgacugagcaggacucuugucucaaaaaaaaaaaaaaaaaaggucacauaauggcaagucuuaaaucuuuuaucccaacauauuuuauauguaauuguuaucuuucucuaaaagacuaguuacauucuuuaaauugugcuuuguccuguuggcaugaauauaauauucauguaaacaguaaacagaucaguaaacagaucuacucacacaaaacaaacugauuuccauuguuguaaguaccuauagucaauugcuauucuauuuuucacaggccauuguuaagggaauuaucggaagcuucauaaaacaauguauaucacuuccaugguuuuuggucauuuguuuuuauucaguuuaugaauaaaugucaauagguuuauuuuguuuguuaaggagagaaaagauaaauuuaauauuuucauccaaauuuagugggacucagguaucuaauaauucucuggcuugacaggacaggaaagaaauagaaguaguaaauaucauuuccaacgcuguuuauauuuuuauagugaccauaauagcaaagacuuuauggcaaugcagaauaaaacugacauuggaauuauuauaaauagugugugaaauaauaaucuuuguuguaaaaauugaauuauggauuuuuuuuccagaauuaguuuucauuaaacuugauuuuacacuuacaugaaugauuuuuuggaagauagggauaggaaggaaucuucacauguguuagacuuaauguaguuucuaaaacguguggagauuuuaacaaaaauuauguagccugaggauuuuaauagaccugauaaccaguuugagcauauucuuuugcuguuauuuaccuaagaucagccaguuguuauggaauccuguucauuaaauaggaagcuuauauuuuuauuacuguuuuuggggaagguuuuagagugaaauucauuaaccucuaagguguuuuuacauaguacuacuuggaaaauaaagucauugggcaaauauaaacaacugauuuauuuuauuucauuuuuugaaguguggcagaccuuaagcaugccauucaaagcaaauacaagauugcuauucaacaccaggugcugguggucaauggaggagaaugcauggcugcagaucgaagaguguguaccuacagugcugggacgguagguauucaagaguccuuucacacaagaaugcaacaucuuuacaucacauugggaacucaguguucaaaaguaagguuuauuugcuucauauauugaaggcaaugugcacgcucaguauuuauaacauuuuauuuugguuauuucuccuuuuuuaaaaaauauaggauacaaauccaauuuuucuuuuuaacaaagaaaugaucuuaugugaucguccaccugcuauuccuaaaacuaccuuuucgacagaaaaugacauggaaauaaaaguugaagaaucucuuaugaugccugcaguuuuucauacuguugcuucaaggacacagcuugcauugguaagauauaaacaauuauuuuaacugauuguuucuaaaagcauucggaucuaaauagcacaguagucuaaauugcauaggaaguaugcaaaaaguuugacaaauaaacuuuaaaaauauuuuccgguuaauauaucuaguuuuaaaauuucugggucauacauugcuaguuauucuacuuugauaaugacaguauuuuagaguggaaaagcugucuuaacaugauuuggucaccuucuuuccuagauaauauguaaauaguuacuuuugaacauuaauuaauaaaggaccuacguuagaguagauguuaacaaagagaacuuaaauagcucuaaaaauguauuuauuuuuuccauauuugugguuaguuccuggaggagaauuagguuucuuucuaauauauagcucuuaacacugcuacuugcaguucccacggauuguuucccagucauuugauuuuccuuuuuaauuuacuauuuaccuucuaguaauaucauugacauuaagcuaucagugguaagcuacauuuuucuuuuaaucauggaaaaaauguguuagaaccaaugaaauaauaguauuuaccuuuuguaaaaauaaauaacauuacugaacauuagcuuuaauuaguaaaacucuuagagauuuguuuuaagcaguauauacauuuguacaaauacccccauuuuucacauaggauacaacauuaaaaggaaauaaccucaucugugugaaacauauuuaauaaacauuugagaguccaaaagugcuuugagaggacaaaauuuuaaaaaauauacuuauguaaacugaauuuacauaauagaaucuuuuagaguuguuuuuuugauuugguugaaaaguguacauacuacauuuugauagagaaaguauuaaauaugaaaauaaguuaaaggauaacuaggauauauaauuuucaagugauuagaaagagcaauuaaaacuauauucaacgaaagaaugaaaacaagaaaguaaaaagaaaagauaaaaugucagaaauacguauaucaggaauuaaauauaagcuggcauuauuucucuuuuaaugcaucauauuuaaaauauuuuuuaaauacauaaauaguaaucugagauucagauaccaagcauucuauaucagucuguuuucaugcugcugauaaagacauaacccgagccugggacgaaaaagagguuuaauuggacuuaacaguuccucguggcugaagaggccucggaauuauggcaggaggcgaaaggugaaauuggccaaaacaaagggguuacaggucccaugcaaguucgaaauccagcauggcagccaaguuuugaagcuccaaaaucaucuccuuugacuccaggucucacaucuaggucucacuaauacaagagguggguucccauggacuuggggcagcucugucccuguggcuuugcagggugcagccucccucccggcugcuuucacaggcuggcguugugucuguggcuuuuccaggugcacagugcaagcuguuggugggucuuccauucuggggucuggaggaccgugacccucuucucagagcuccacuagggagugcccccaguagggacucugugugggggcuccgaccccacauuuuccuucuacacugcccuaacagguucuccaugagggcccugccccugcagcaaacuuaccugggcaucuaggcguuuccguacaucuucugaaaucuaggcggugguuccccaacgucaacuugucauuuacauuagguauuuuauugacuuauuauauagagacaggaucucacugcguugccgagguuggucucaaacuccugggcucaaaugauccuccugucuuggccucccuaagugcugggauuauaggcgugaaucagcauaccuggccucuuuucagauuuauaaaauacauugagccaccaugccugcccucuuuucagauuuauaaaacaaauucuaaagcugcuauaaccaaaacaguaacauaggucuaaucaauucauuaugugaggaauuagaggugauauuucuucaugguccgggauguggucucuaaagucagauuuucugaguuuaugucugauuacuucauuuaccuguggugugaccuuuuacucauuuaccuuauugguaaauuuaagaauagauuuuuguuuauugagauauacugaaaaaugcacaaaccauaauuguacauccauucuuagugaauuuucacaaugaacacauugauaaaaauaguuucaggugugguagcuuaugccuguaaucccagcacuuugggaggccaaggcaggcggaucaugaggucaggaguuugagaccagccugacuaauauggugaaacccugucucuacuuaaaaaaaaaaugcaaaaauuagccgggcaugcuggcaugugccuguagucccagcugcucgggaggcugagguaggagaauugcuugaacccaggaggcagagguugcagugagccaagaucgcaccacugcacuccagccugugugacagagugagacuucaucucaaaaaaaaaaaaaaacacacacacacacacacacacacacaaaaccccacaaaaacaaauaguuucaacccagaagcccuacuuaggacuuucuccccaucaguuuucauccucccuguucauuaaugcuaaccaguaucuugacuucuaaaccaacauuacuuggucucuuuuugaauguaaauaaauggaauaauguaguuucuguucuuuugugucuagccucuuuuacgcaacaugauguuccugagaaugauucaugcuguugcauguauccgugguuuguauucuuugcugcauuguauucuauuguacgaauaugccacaguuuuuuuuuaaaucuguucugcuacuaguagguauugagauuguuuccaguguucaacuauugugacuaaaccugcugugaauguccuaguacauucuuuugacuacuguaguguagagaaaucagaauacuuugacaguguuaaaucugucuucucuucuacuucugcaaucucuucuguaccgaaauguccauaguucuuucagauuucaucuugaaauggacucagugcacacugucuuuuuucuuccauauauuagcuaucauuuacaugguaauucuauuaauuucacuugucuugguuguuaaagcuugauuuagacuucucuguuuucagccgugucuucuuccaguguagccuucaaucagugauacguuucuuuuuaacuuauuuccugagcuaaaucucuguguugaguucuuuuuuauaaagcaaaauuagaccaaguucuuaggaaaagaauuugguuauaauuuccauuugcucuuggagaaaguuuuucugcauuuaguuuuuuuuacuuuuaauucuuuuuuucuacacuaaauuaggguaauuuaguguagauuucauguuaaaauuuuugcuuguguuugaaugaauagaauuauuccucuauaagacaguguaggaaaggguauaagauagcacuuccuggugagcaggaagcugcccuggaucacaggggauccccaguuagaagcagaaucuauauguguaagagagggauggagaugacuuauuuuguccuucuccuuggacaaaauuuagcaguucuagggcuuuuucucacguuuuuuccuuuggcuuuuugcaaguauguaacauaaauagguauuauuucuucugcuacucucuaauuucagauagggccccaagagguucuugcuguccacccaagcuucccacaaggaggauucaguucucccaaguuuugcuaaaugucugcaauaguggugugaaccuaaauuaucgugagacaggucacaaucaauuuagaaaauuuauuuugucaagguuaaggacacacccaagacauagcuucaggggguccugguaacaugugcccaagguggucaggguacaguuugcuuuuauacauuuuagggagacaugagacaugauuauguguaagaaguacauugguuugguucagaagggcaggauaacucgaagcggggucuuucgaguccuugaucagccuuucacucaauacauaauuuagucuggcucagugcaucugcauuuuuacauaaacaauaaacaguaagacagaggaagcagauaggccuuuguuucaggucagcagaggugugacuuucugucccgcacauaugaagauaugcugucaguuuacauugugaaggugaaauucagcagaacuguuuuagguuaaagaucuugaagccuacaagaaauuucccuguggcaaaauugugagggagguauguagcuuucuuaucuuuguagcuaucuuauuuaggaauaaaauuggaggcagguuugccugacauaguucccagcuugauuuuuccauuggcuuagugauuuuggguucccgagauuuguuauucuuucacagugggugcccuuuuuauuugacccaaguugaucaguuuucauauucuucacagguuugcugcauauauuguauguguggggugguaguuguuuccugguuucaucaagauggugucuuguuucccuuuuguauuugguugguuucaugaaggagaagcaggcaaagacaucuuuacuucauuaucuuacaacugaaacuauuagcccuuucuuauacacauauggaauuaagaacaggugaagauaagucauuucuucaaggccagauagccagggagaagaagaaccucuuuucuccaaggccagugcucuuuacauucauaucauuguacuuccagaaaguaaacuuucauauuuuaccuguaaagauauuucuuuucaccuaaauuuguucauuaacaauauuaucuucuaaaacagaauggucauaauuuuggcauccuuaucagccaaauauaucagcaaauauaucagcaaaauauauagagaaaauacuuccucuuucguugcaucccccacuccaucuuaaugaugguggaacauuuguuuugcauuuuccuagacuuugauauacacacaaaaugcauuucucucucauaccucuguuguuucacauuucuaacugaccuuagccuccccaaauaaaugaaagcauacuauacuuuuuuuguuguuguuuuugaguuggaguuuucgcucuugccacccaggcuggaauucaguugugcgaucuuggcucacuguaaccucugccuccuggguucaagugauucuccucccucagcuuccccaguagcugggauuacagguacgugccaccacacccagcuaauuuuuguauuuuugguagagauggguuucaccaucuuggccaggcugaccucaaacuccugaccgcaggugaucgcccgccucagccucccaaaguacuaggauuacaggugagagccacugcacccggcccauacuauauauauuauuccuuuuucauuguugcaagguacucccauuuuugaaauaucauaaauuuauuuuccuaguaaacagugcuacaguugaacuuauuuuacauuuauaaauuuuaacaauucauaaaauugaaacauuugaauauuuuauauccuccaucuuuuguguguuuaagaaucuuccuccuacauuuucuacaugcgcugcaagaacuucuugcuuuaauguacccaacagcucuuuuacucgucauuucaagggugucaccucucuuucaucuguuuaaaaaaaucugaaaacauuuuauuuguuauuucauaauuccagaguuuuuuuccccacucuauuuuaguggcagcaugauugauuaauugacauuaauugacauggcacauaaucauuuuacugacauuccuaccccauaaagaccaucuuacuuauuuacuuugguaacuagauaacuuacaguagcuuuuuuacaguuugccuggacaacuuaaaaauaaucauuuuacauccauucuuucaggugccuucccguuccaccuuaugacauuuucuguauuaucagucuucuuaaagcuucuauuugauuacauucuucauguuaaagaguucuugaggaggucuuuucugaguaaaguccaauuccuccuuccuuaccuuaguaucuucugggucuuugaucaucuggcccucuuucucucgcuuuuuccuccagaccauuuguucuuaaccaauagugcuucauauuuccugucuuugccacuucguguuccacucuuuugaaguacuucuuucccuaucuuuguucauauucuuuucauaccuuuauacuuaaguuaaaugccuucaguuaacuuugacuucucauuuccugucucuuuugugacuuuuauaucugucucauaccaguuaacaaagguagaaugaucugucuuauuuccuugccaacuaaaauauuuuauaacaguggacuucuuuauauaucuccauauauaaagcaaucuacauugcugccuuguaauuuauccuuaauaaauauuuuuguacuucauuguuuggaacugaaugucagaugucuauuuucugaagguauuuucacugcuuaaauauuuucuagaaucucauuuaggguuacuaaaucuguuauaguuauacuaaucuagaaguagaugacguauuuuagcuuugccuucaccaaaaauuguuuuuaacaugaaugucuugagauaauaccagaggacagugacauuugagauggcagauguugaucauuagucaaauaauugaaagcccuacuccuuuguuuuucagagguagcgucuuauggauucuucuuuugacugucucuuaggauaccugcucggaaacaccucacuuauguuuaggcugucuuuuacagaagagaacagagauaaacuaaaacaguccuuugaaauacuuuguuaaaugugcucuacaacgcauccacacguacauguuuguaaacauaugcaaacuucugcaaacaaaccauugccuucuuuuacuuucuuuuguauucuuuuucaauauaggaaauguaugaaguugccaagaaacuuuguucuuuuugugaaggucuuguacaugaugaacaucuucaacaccaaggcugggcugcaaucauggccaaccuggaggacuguucaaauucauaccaaaagcuacuuuucaaguuugaaaguauuuauucaaauuaucugcaguccauagaagacaucaaguuaaaacuuacucaguauguuugccauuaaaauggauaauauuuguuuaaaaugccuuugaaauuuaucaguagguuuaauuacugcaaauuuguuucuuauaggccauauauuuauuguaacugagguuuauucuuugagccuuuucugauagugauuuguagguuauaguuuuuaauuuaaaaaaugauaauucucuuuacauguaugagucucccacauuucuuucucuuggguuguuuuacuuguaauaaggcuccaaauacuuuugaaaucauuuauaaaaccaagaaucuuugcuuaugucuuguccacuaaacaaaaggcaagaugugaaaaauaacaucuaacagaaauaggcacauuaucaaacacuggacaauggaggaaaauuuuaaguucuuuguaaauauugccauccugauacagguuugaugagguggaaaaaaagcccuuguguugucuguuuucuuuucuuuuuuuuuuuuuuuuuucugagacggaggcucgcucuguugcccaggcuggaguacaguggugugaucucagcucacugcaaccuccaccucccagguuuacuccauucuucugccucagccucccaaguagcugggacuacaggugcccgccaccacgcucagcuaauuuuuuuuuuuuuuuuuuuuuuuggauuuuuaguagagaugggguuucaccguguuaggcaggauggucucgaucuccugaccucaugauccacccgccuuggccuuccaaagugccgggauuacaggcgugagccacugcaccuggccagcccauguguuuucaaugcucauuaagauggcaaguuuuaguucuuugcauagaaguacauuuaauacacauugauucuuuuuuuaaaagggcuguaguuaaccugaaaauauaaugguaauucagcaugaaacuaacccuuauugugugugugugcauaugcuuuuagcauuuuguguucagguuuuuuguuuuggaucuguagauuuuuuuuucuuuuaauuaucuugaccuugcauuagaggcaaguagcauguucugguuuuaaucuuugucuuuuuguuucuuugauuuuuuuaaauuuggguaaccuuuuaaauucagauuucucuguuuugugguaugaauauuaguuuuuggccuuaaaaauggaaaaaucuugagaggaaagagaaggauucauuaagacuagaaagaucuuuuuaaaguuuaaaugagaaccuuuuccaguaacuuucuaaggguucuguuagcuguaucaguuuaaaguagggaccuacaucauauugcacaucauuuuauagaaguuaaaucaccaggauuucauauuuucccuaugcuuuugacaacauaaaccuguuuucaggguguuaugaguacaagaguuaucuucauuaggauuguuauuuuuauccugugcuuugaauauaucaaauauauuugauuuacuuaaggccauaagguuauauucuaagauacugcuauggugaaucuuuuuguaaauuuaaauuuguuacaucuuuaagguuuuguaaaagccuaguguucacuuguuuaguauagcuacuuuacuuuagaguguuuuuuuuuuuuuuuugagacggagccuugcucugucacccaggcggcuggagugcaguggcaccaucucagcucacugcagccuccgccucccagguucaagcgauucuugugccucagccuccugaguagcugggauugcaggugccugccaccacacucggcuaauuuuuguacguuuaguagaacuggguuuugccguguuggccaggcuggucucaaacuccugaccucaaaugauuugcugcccuccaccucccaaagugcuggcauuacaggugugagccaccacgcccagcccuagagugauauuuuaauggguuaacgauagccucucucugcuaaacuagacuuuuagugaauagcuagcucauagacuaguuuauguauguauaauguuauggagagguggugagauuuguguguauaauaauaugugauuucauucaaacaugcuaauuccuaauuagagcagucucauaguuuuacugacagaucuuuuguauuuuaaguuuaggaacugcaguuucaguaauggccaagauuccacuguuggagugccuaaccagacauaguuacagagaauguuugggaagacuggauucuuuaccugaacaugaagacucagaaaaagcugagaugaaaagauccacugaacuggugcucucuccugauaugccuagaacaacuaacgaaucuuuguuaaccucauuucccaagucaguggaacauguguccccagauaccgcagaugcugaaaguggcaaagaaauuagggaaucuugucaaaguacuguucaucagcaagaugaaacuacgauugacacuaaagauggugaucugcccuuuuuuaaugucucuuuguuagacuggauaaauguucaagauagaccuaaugauguggaaucuuuggucaggaagugcuuugauucuaugagcaggguaaguaacguuaauuugauguuuguuuugucauuuuacuacuuuauauuauuuauccuaaauauuuuauguacugagagaauggguauuaccuuuuaguagaaauaaaugagucuuggagugaaacuuuuaacauagguugaaucaauuuaauucauaauuuuauuuaugaauugauuguaaauuugugaagguuauuugagauuaauaggaaaaauuucuagugcaauaagaauaauuuacauacaguaaacuacacaggucuugagugguucaugcaagaaauaaccaccacacaaauuaagauaaugaaaauuucauugcccagaaaguccccgugugacucuuuccagucacuauuuccuuagaggcaacuucuuucugacuuuuaaagaagaaauuucaaaugcugcaucugccugagaucuuuaaaauucgaaacguagacacuguauuuuuuaguuguguuuuauaguuauagugagcuuguauuuuggauuaaggucuucuccagcacaccugaaaaccuuuuaaaccugaggaauaaauaccccuucauaucugaucugcaaacugaugcaaaaucuuugacaccaggaaggaaguugauggggcauguuucauuguuacagaaauguuaaauaauguugugaaggcugcuguugucaaaagauaauuguuaaaaauaguuaaacuuuucaaggagcaugcagucgaagaagaguucaucuuugauucacuauuuagagcaggauagcacauugucugggaugccuaaaaaagaauacauacauugcuguuaaaguuauaggauauaguaaaauggaaaacaaaaaaucuagguuuugucauucuuucaguauccaguuucuugaugacauucuguaggcuaagcauuucuuucaauuaagacauguuugccagagaaguauguaauauguuaugcaaagauugaucacugccaaaaaugaauuaaaguuaguguuccugcuuaaacuauugacaauguaguggccugaaaauuccauuuaugauuguagauaauugcuuacaugauugugaucagaauaauuaagguauuuuguuuuguuuuguuuuuugaguuagggucucacucugucgcccaggccggaguacaguggcaugauuauagcucauugguucuccaccucccaggcucaggcaacccucccaccucagccucccgaguagcugggaccacaggcacacaccaccauguccagcuaauuuuuucauuguuugcacagacggggucuucuuccuauguugcuuagccuggucucagauugccgggcucaagcaguucucuugccucagccuuccaaagugcugggauuacaggcaugagccacugcaccuggccuaucauuuuuucuguaauuaagcugugccagaugucaaaacagaguuauauauaugaagcgaaccugaaaucggcuuuguauuuccauguucagugugaaauuucacggagucuuagguuuuuuucaauuuguaugacuaaaggaaaggaacagugauucucugacuuaaugaaaagucagccaggcacaguggccuguaccaguaaucccagugacuugggaggcugaggcgagaggaucacgugagguaagaaguucaagaccagcuugggcaacauagugagacucuaucucuaaauaaugaaugaaagaauaaaugucagaaauauuuauaccuucagaaaauagaagguagcuauaguguuauuacuaagcaaucacuuuuuucuuuuuagaaguuaaugcuacauugaauagggcauagcaacaacaucugaagucuuugugauauuuuacaugaccauuauauuaaaaaagcaaaauacaaacuuguauuugguuauuguuguuuguuaucaaauuagcuaacgugacuuuaaaauagugccuauaauauaguacucauuaguuguauaugcccauuagauuuuuuuuuuacuuacucuaucaggaggaguagcuauuggaugcugggcuuaauaccuaggugcuaggaugaucugugcagcaaaccaccauggcauacauuuacacauuuauguaacaaaccagcacaugcugcacguguaugccagaauuuaaaauaaauguuugaaguuaaaaaauauauauuauucugaagcaguuaaaauccaauuuggaaaaauuuauuuauauuuuacaaaguauaugaucuguaaaugugauguauugcguaaugaauggcacuuuaccaugauguuuuuauuagaucaguauuuuucuccucucaggaguacuauacuuuuucuugauaagacuaggggcauuucugaagaugaaccgaguaugagauuucucucugauuggagaugguuuuuuacucucauuuuauuaaacgguuguccaaaacaacuaaccuaccugauaucugaucgcaguagcacuguuuuccaaugaaguaauaaaaauauaugccaagauuuuuuuuccguaaaaggaaauucaguuuaaaucuaucguuuuugcagauuaauuccaauuguaacaguauuuuguaacauguacuuucaacuggcaaauuaaaaugucuuucucaggaaauuagucgagacauagguauuuuggaaauuaggauuuggaauuggaauagcaggggcucaaaucugggcauugagauucauuuacuaucugucauccauaagucacuuaacaugggauuccuaguuuuauauuuuuguggauuaagagaugcuaguuuuguaaauuauuguuuuuccccccauuuuaucugucagaaaaaauuuagaauuguugcugcauuuucguagacucauauuuuuagauuuuaguguauucuugcuaaaaagacucuuuuuuuuuuuuugaguuggagucucgcucugucacccaggcuggcgugcacuggcacgaucucggcucacugcagccuucaccuccuggguagcugggacuacaggcacccgccaccacaccuggcaaauuuuuguuuuuuuuaauagagauagaguuuggccauguuggccaggcuggcuuugaacuccucaccucaguugauuugccuggcucugccucccaaagugcugggauuacaggugugagccacugcacccggccuuaagaugacucuugaguguucuguuucaguuuauacuacaaaaggcacacugauuuguguuucuaacgauuaauaauuggaagugucugcauuuagcacauuucuaaacuguccagguuaaugcagcauaauuuauugagcuuuagcauuucuuucagacaacuugugaucuuaaggaaucuaugcaggggaguggguuuaaaggucagaggcuuaagaauagagaguguaagaaacuuuguuuuauaguuucuuucucaguuaaaaauaauguuagccuuuguagaugccaaagagcccaagaguaaaaauuaauguaucacugacuguuaauuauugaaaauuggcuaaauaauuacuaaugagauucugugguuuacauauauguaauuuaaaacauuucuucaaagauuuuuauuaucugugaacaaauggaauaaaauauuaagugcagugagauuuuaggaagucagcugggcacggugacucaugccuauaauccuagcacuuugggaggccaaggugggaguccauugccugagcccaggaguuugagaccagccuagguaacagggcgauacccaugucuacaaaaaauuagcugauugugguggcacaugccuguagucccagcaguuagggaugcugaggccguaggaucgcuugagccuguagugagcugugaucaugccagugcacucuaucuugggcaacagagccagaacguggcucaaaaauaaauuuuuuuuaggaaguuguguaaacuauuuagugaaucauaaaauacucuccuauguuugucagugcaguuauacuuucaaugaauuauuaaauucagauacguuguauucaggagcccuuguuuuugguuuaaguuguugguauguuaaguuuauguauaauuguaauuuugccuagguugaacauuugaaccaguuuucaucuuuaucaugcuaauaauuuguaaccaggcuuugaugugcauaguacucugguguagaaauacauacacauuggacucaguuaccacaaaauugagaaaagugagaaaauguucacaaauguacaaguagcaguugagacaacauugugcaaaacuaguggugccuauucugaaauaaugguuuuguuaauuuuuucgguaguguuagacaugcacccucuuaacuacacuggauucuugauaauaacaauaaaauaguuuaguuuaauugcuuuuguauguucucuguguacaagacucuaugcauuaaucaguuuuuuccgacuguagagaaggcagcaugaaggagguauuugacuaggaucuuuagagggagagguugacuuaaacaguuaauagaagaauugugaacaaagaucagagauagaaaaacacgguuuaucuugaaaugauagacauuucagcuugaaaagaugagaggcuugaaagauuuuuuucugauaucagaucaaugaagccuuuauuauauucuacauuuauuggauauuaucugugggcagaagaaagucauuugaggguuuuauuaggaacaagcauaguaagucaauaauagaagguuucaugguugcuacccaaauguagauguuaguaaacagucagaaacacaguuugagaaucugugagacugaucagugauugaaguagacuugggaguuaucuccagaaaaguuauacuuaaugcugaaaucauauugagaacaguaaaaaugggcuaaggacaaaauccuucugaaucaucuguuuuagaaagauuagacagagcaaaaggagccagaaaaggaugcugugaaggaaccaguagaaguaacuucccagagccuuuaagguugggaaaagguuaucugccaugcuaacuguugaagagccucaagugaagcaaggucauugguaguuuuuggcugagcaguuuuuauggaaaacgcagacagaaaggcugccagguaaaauauuuuuuuaagggaccaggagcauuaucggaaaauuuuauagguuccaugaauuucagcaaauguguagaauuagagccagggaacaggagagauggaagagugagaaagcauaauugagcaagccgauucguugaggagauagaaauagagaauaaggaaguuuuaucuucuaucuccaggagggagauaaauuugccgaagaaguuuauauguuuuaaagagaaguugcauugauaagagaauuaaugauauuaugcugacauugaaaauaccuuuuucugagagauauugacaagugauuaaauuguagcacugauugaaaugugugauucuugaaaauguauuccuaauuauguauucuaguguaaauucaguguugucaaggauauuuauccuguacuugaccuucuuaugaaaguauaacuuagaguucccaugcuuuugcuuuuuuauaucuuuuaucacuuauuuucucucaagcuguaugucagaauagcaugaaauacauuuuaaacuauuugcugaaaauuguauucguauguguuuccuugucauuuagcuugauccaaggauuauucgaccauuuauagcagaaugccgucaaacuauugccaaacuugauaaucagaauaugaaagccauuaaaggacuugaagaucggcucuacgcccuggaccagaugauugcuagcuguggccgacuggugaaugaacagaaagagcuugcucagguaccuauuuuagacuuuucucaggaaaaggaauuuauaguuuuuuuguacacauguuuuauaugcaguaucaauuuggugugcaccauauuuucacuuuuuccuugaauauuuuuaauguauuaauauuguuuccuuguaauaaaacagaaaagcauguucuuaaugauugaguuuccuauagauaaaccaugaaacugcuacuugaagcugggggcagaaaucaacauuuuuugauauguugaaagcagaugaucauaucaguuauugugcuaaaaauuucaaugcuuccuacuaccccccauaggacgaaggauaagaaaugaaauuuuuuaagaauaggagaauacgaaaucuugaagaauuuacuaauacuucuaauaguaauaccuagguuuuagaucugauuuaaugccauaauccuagaacuguugaaaaaguggauuuuaaaccaaaggaaggugauggaauggcuaaguaagagugguaaauguggacguuucuaagcaaaccagugccucucuuaaauucaugauugccuguccuucacccaccauggcuagcauuguggcaaaaccacccauagcugaauaguugaaugucauaaucagauucugacagcuguuuuucuaguuuaauuuuccuugccaauauuuuuccucuaauuguguucuuucauuggaacauauaaauaauuacaucccccauauuaacuuuuccuuuuuuuuaaggcaaaacauacuucguugauguuauaguuaaggcugauauaaauuagaauguccuuuaguauuuccuuuuagugauaaguucaauuuuguuguuugaaaaucucuuaaaucaccuugauuucuggaggauauuuuuaccugguucauuuaaaauucuggguuguuagcauuuuacuuuuggucuuuuccuucuguuugguuuuuagcaauuuuaguaugaggugccaagauguggcauucuuuguauuuauccuacuuugggcuuguagugcaucuugaaucugugguuuaaugacuuauaccauuugggaaaaaucugagucaguuucucuucagaucuugcuuuucccucacuugcuuuuccuucucuuucagugauuccaguuagacguguuagaccuuucaccauauccguuucauuuacacuuguuuccuguauuuucuuucuuuuuaucuaucugugcuucauucuagauauuuuccuuuaaccuacauuuuaacuuuuucucuuuuuuuaguggcuaacuguagcuaaccacuugcucauuucuuaauuuuguucauuuuucagcucuacaguuucaguuugguucuuuuguauauaguuucauauucucuacccaaauauuuagucuuagccauucaucaucucuuugaucacauuaagcacauagcaguuuaaaagucuguaucuguucacuguauugccuguuccugugugucuguuuauauuuggugguguuucuuucuuucuuucuuuuuuuuuuuuuugagaggaaguuucgcucuuguagcccagacuagagugcaguggcgcuaucucgucucacugcaacgucugccuccugggugcaagcgauucuuuugccucagucuccgaaguagcugggauuacaggcaugcaccaccacgccugguuaauuuuguauuuuuaguggagacaggguuuuuccauguuggucaggcuggucucaaauuccuaaccucaggccugccucggccuccaaaagugcugggauuacaggugugagccacggcgcccagccguauauuuggugguguuucuuauaauucucacucuuauggucuugccuuuucauguaccugauuuuuuuuuuaauaagaaaaaucaaagaaauauugugaggccuaggauaacguuuucuucugcagauaauuuauguuugcuuuugguaugugcuuugggcaguuaccaucguaaauuacuuuaguucaguuucagagauuuggaugauuggacauugguauucuaguucuugggauggccauucuacuuuuaguuuaccccuaaucauaggauauagguuuuaaggaucugaacgcaaauaaacuguuccauuguaccuucccuuggcuggcucuggucuucaacuuuuaauuuucuagcucuucagggaagucaggacugcugacuacuuauuuuuaauuuuggacuccucuucaagaaucagcagaauucuucagagcaaauggcauuccuagucaccuaauuucucucucuugguuucguucuucuccuggauccuagcccuuucacugugccuggcuucuucacugcuuuccuagagccacagggagcuuguugacauuacaggcuaccauuacuagagacagaacucugcauuccugaucuuuugcuucuucugcaguguaguuguuuuuuaacuuccauagaaugaaucaaacaaaauuuauuuaaccauacuucuuuuggugauuauuuaguuuguuucaguuuuuccauauuagaaauauucauugaguaucucaauacacccauuuuuacaugcauguucuaguauuucuuuaggcacaaucuucaauaaugggauuguuggauuaaggucuuuguucauuuuaaauauuaauuaauaauguucuaaugccugccauagaagcaaaaucagucaacacuuccaguaaguaagaagaguaauuucucuguuuucagcguuugccauguauuuacucugaauugucauucgccacauuuucuuuuucauguuuuuguuagaauuuaucauauauugucuagauaguucuuugucuauuauagaucauacagauauugucucuguugauaauuuaucuggaucgaaaaacagaagcuuuaaauuuugaugcagucaaauucauucguauauuuauucauauuaaauuuuaugaacccaucauucuauaaaaucgucuagauuucuuuauaacuguuucucagauugaauaaacuagggcuuucaauuaucuuaccuuagacacucgauuuuucucucucuacuuuuucuuugcuccccuuaaucucucaguauauuaaaauauugcuauuaguccuccugcuuuauaucacuugaacagucaaucaggcagguacauuggaugguuuuauauuuguuaguaauauaaaaagauauuuauugcugauauugcccucaagucuacuugguuucagcaaauggaguuuugucauacaaggaaaagucuuuuucugggaguaugguuggggugauaauacuguuuucucaaaauggaagaaugcauuauuugcgauuugagcuuuucuuguuugcuuucuaaaucugaccauuuaaccucccugaauccaaacugaaguaaaauucagugaaaauuucuuaugcuguuccuauggauauuacaaaauuaguuuuuguugucuugugcucauagagcauccucuuucaacaucuucauucccccuaauuuauuuguaguauuuugcuauuguuuuaaacuaugguagcucauggaauauaccaaaagaauacuauagguaauauuguuacuuuuagaaaauaucuuuucuuucuucgauaccugagugguauaguccuuuuaaacauuucgagacaauuaaauauuuaauuauuuaaguucuccaauggauauuuuuugguacuccuaaguauucauaagaagucaucuacauugucugguuguauauugggagcaaaauuuaagacagaaauauagaccccaagguagacaguuuucaauugagugugccugaaugaaucugaaugugauaggauucaguuuaauaagauuauuuucagugagcucauuagagaaaagggauacccaguugaagcuaggagguauauggugagugagacaacuuuucacaccuauauugucauguauuuggcugccgccaagggauguacagagucaagguuuuagcagaagcaucacuuccucagccaaacuuuccugaucuugaagucuuggucacaucaucagguucauuuucucuuaguaugcuguacuuauccuguaccacaguuguaauuauuaauuacaugcuguuuaauacagucucuucccagaauauaagcuccaaggaggcaggacacuacucuaucuuccauugcuuuaucuacaaggucuuaccacacauuccugauacauacauaguaggaacacaucaauacuuaauaaaaugagaauuuggauuuguguuuuuuugaauuugagaaaugucacaauucuaucuagucuuuggcuggucuggaauuuuuauuuacagaugucucaucaguuacuuuuguugcugcuaaugguauuucccuguugcagauaguuugucaguacuuccuuuagaauguguuuggugaaaaguagauaaauucagauuauccaauuuuaggaguugauuuuacaucuugcuaaacacauuuacaacguaguauaauacauucuagcuacauagcaauuaaaacuuaaaaccacucccaauuaaaagggaaaagaaauuguggaaagggauuuauuauuuauugccugaacaucucauaagauagagaccauuucaaaugccuuugaagggguaauuucuuaaaaccacaacauuuaugaggauuguuguagacccuucuacaugguuuuggcaaaaaaaaaaaccucacucaccaaaccuaugaagcuguguaacacuggagcccugaauauucauucucuagccauucguauccuugaggguuaucagcaaaauuaggaaauaucagggaguuuucuuccugaaccaaauuuggcugaaugcaucuggaacacgauugugaguacuacagugcuaucauguagcucauguagcugucaaaccuuauuugcguguaaaaauauuaguaaugaauuaguacuagaugauuuaugaggauuuuuucuauuuagucugaauuauauugaguaugguugagcaaauaugaaauucaauuuauugaaaaacuuuauuuuuuccuucuuuuagcaauacaguacuuacaugcuuuuggugucaggaaauccuuuacuaauggucuagaauuuaaauuugggauugauucuauauuuuucauggauucaauaaaaaguaauugaaaaccagacuuugcgaaaggaguuaaaaguagcaaauuguuuuuuaauagauuacauuauagaaaaauuauaguugcaguuaaccaaagaguauauugaaagggaaaaaaaaggcauacaguuacuaugaaaauugucuuccuuucagauauugaaccaguuugacuucaguauauaucauucaaaucuaaaugucaugauauuuaggaaaacaugaaacagagaacuaccagaaaauuggaagacacacuuguccuuuagcuggucauaaaguuaaguuccuagaaggauaaugauuuauuuacaguaucaauacagcaaucagauggauguacaaaaccuacaacauuauuacauauaagccacuugguauauagcauaggaaaaaacuuugugguagcaauaaaguauguaguaauaaccuuauuaaguuaucuuuggaccacauauaaagaaaacuaaauauacuugagagauaaaugaaggaagauuauggcagaucuaucuaaauuaauuaguaacuuaaucccuacuugacagauacaccguucaccuacaaaaacaaaugaguaaggacaguuaagaaaaacagaaaaaauguuuuucuaccaaauaauaaaguauaaacucuguguaaaaucacacaauucagucauuguccuagcaaugggagcacagaucaguggaacaaaauauaguccagagauaacuggagagggcagugacuuuucgauaaauauuuuaagggcauuuuauuauuuuuauauuugggaaagugucuaauauacuacuguauaauguuugcuagauuaaaucccuuauuguuuuucagugaccuuguuuuguuugugcugugacugaccgauaguguuauaggauucuagacacauagcuucuaauucucauugacuauuaaguauguccuuggcuaaggggcuuuaucuuucuagccuuuauuuucuucuaguuugaaaaauuaaagaugagcauaggauucuuaaaaauucuaggucuugugccauuuaugcaucuacuacauucgagaaaaauagaggauuuaaaaauauuguuagaaggcacaaaacggguuguguuuaacauaaagauuuuccacuuaacugaauguccauaccuuucaugaaacaaaauuaauguccuuugaaacauuuuuuuucucaaagggauuuuuagcuaaucagaagagagcugaaaacuuaaaggaugcaucuguauuaccugauuuaugccugagucacgcaaaucaguugaugauuauguugcaaaaucauagaaaacuguuagauauuaagcagaaguguaccacugccaaacaagaacuagcaaauaaccuacaugucagacugaaguaagugauucauuuauaucuguuuuaagauguuuagaauugguauuuauauuuauuucucccaaaugauggagugauuuuucccuaccauuuuauugaaauaccuuauugaugaacuuuggaauuagacuauuuuuguagagcuuauauaucuugauuucuuuggcuuaacuaaguuaguaagcuuacuaaguaaguaacuaaguuaguaccaguuuugugaauguugaaaauaauggauuuuauucucuaggugguguugcuuuguaaugcuucaugcugaucaagauggagagaaguuacaagcuuugcuccgccucguaauagagcuguuagaaagagucaaaauuguugaagcucuuaguacaguuccucagauguacugcuuagcuguuguugagguuguaagaagaaaaauguucauaaaacacuacagggagguaugcaaguugaauucuauuuuaacuguauaugaacuuuaacgaauugguguauguuuauguuuaacauaagcuuuccucuucuagugggcuggugcuuuagucaaagauggaaagagauuauaugaagcagaaaaaucaaaaagggaauccuuugggaaauuauuuaguaaguguucauuaauaauuuuaauuacuuuuguaaaggauaaaaguuuuuauaagcuuggauuuucuguagcauacuucauguauaugcuguuaauugccauugauaucuaggaaauauuccuuuuaaaguguauagaauugaauccauuguuaaauuuuaaacuugaaguacugucaacuuuuaauuuaccuuuucaaaaaccagagauaauuuuuugccuuaaauaaagcucuaaaauaaccauauuguuaauuucuuuauacagggaagucuuuuuuaagaaaucgucuguuuaggggacuggacuccuggcccccuuccuuuuguguauguauuuauuuucuaaccaugacuaaauuccauauguuuuaaaaccuuuuuuccagaaguagagacauuuaucagaaacuugcagaaauuguugugguuuaaaaaaaaucaaaauaaaaguguuuuuggcuuuaaaagccaguuagcauaaagcuuuaagauugauauuuguauucauaauuuuuuauaaagaaucuucauaacacaggaagauaccuuauacugcacuguuaggauugguagaaauagauucacuugguuuuuuuguuuucuugucucuuccuuuuuuucuuuccacccuucccucuucuuucuuccacugcucuucucccucccuccuccuuuacagccuccaccuccuccuugcccuucuauauuucuuuucacaccaccccccuuuauauuuugacaaaucagaauaauaaagccucaguuagacuucacuggaauuaaacguuaguuugauauguuucuaaaccauuguuaucuggggucauuaauuguauuacaugagaagaaacguuuccaugaucaaagcaauaugggggcuuuuacccccaucagauguacucuuagcuguguuguuguuguuuuggagacaagagucuugcucuguuguccaggcuggagugcaguggcacaaucucaucucacugcaaccucagccuccuggguucaagcuguucuugugccucagccucccaaguagcugggacuagaggugccugccaccacauccagcuaaguuuuuguauuuuaguagagacgggguuucaccguguuggccagcuggucucaaacuccuggccccaaguguucugcccaccuuggccucccaaauuguucagguuacaggcgugagccaccacgcccagccaugcuuagcuguuaaacauguuucuauacugcaggauuucuuaguguuuuaaauguaugcauuuuuuaauacauaagaauuggugacauagcgauucccauacuuauuuauccgagaacucuuuuuuaugaagagcaucuuggcaucuccacaucugcuugaguaaugauuuaaaacaaguuuuuuuuuaaugcaacucuuggcaauuuuauaaauaaugaauugguaggauuuaccgguuaauauuuuuuacagaagcuaaaauugaccaaaacuuugucuucuggaaaauguaauggaaaagucaaggcaaaagcaaauaagaaaguguuacauggaaaaaaaauacaugugugcauuuuaauauauuaguggcuuuaacaugguaaauauuauauauauacgcacacacuuacauauguguuuaccauauguauauguacauacauacacauacaggauaggaauauuguaauucccauaaaaugaugcuaaaagcagagaaggggaggaacaagugcaucccuugaucacuagcaguucacgucgcaguuuacuaaaggcucaggaaaauaauaugccauaucuuuauugaauggucuuuuuuuguuucuuaaucauuuaaagcacuuuaguuuguuugguauaguaaauuuaauuauaguaagaaaucauauaaauuugcugucuguuuuugguugaaaaaaaauuuuuuaaguaauuaauuuuuuugguacagacucaaaagccucgaaaguuugacugugaacuuccagauauuucauuaaaagauuuacaguuucugcaaucauuuuguccuucggaaguucagccauuccucagguaaaugucauuaguauuuucaguuaauuuauaaccuuaaaauguuuuuauuauucuggaguugugccagguaguaccaguaaucuuaagaggugccaagauaagaaauauuuaagauagacuggcuuuccugugacugcuuugagaaauuucuggggaauaaaaaaugauggaaaaugaagguaaaguaaaggaagacaugccuuacauguaauuauuuuuuucuaguaguuacuuuuugcaugcuguugggaaauuucugacuuuuuacuuuuuuuuuuuuuuuuuuuuuucuugagacggagucucgcucucucgcccaggcuggagugcaauggugugauacuggcucacugcaaccuucaccucccauguuccagcaguucuccugccucagccuccugaguagcugggauuacaggagcccaccaccaugcccugcuaauuuuuguauuuuuaguagagaugugguuucaccauguuggccaggcuggucucgaacuccugaccucaugauccacccgccuaggccucccaaagugcuuggauuauaggugugauccaccacgcccggcccuaaguuuuuacuuuacugauuaugacacaaacuucuuaaaauacuucugguauuaauuuaaaaaggaaugauaaggcucuuguuauuuuugacauauuaaaauauuugguagcaguuaucuacuaguucauuaaaaaaucagaagucuaauugcauugcauucuguuucaggguucccuuacuuugugacuuugaaccucuacaccagcauguacuugcucuacauaauuugguaaaagcagcacaaaguuuggaugaaaugucacagaccauuacagaucuacugagugaacaaaaggcaaauucaauucuuucaaacaguuuucgucauuaguguaaaauguuuguguuccugcagcucuuuaagccuuucuuucuguuuuccaggcaucugugagucagacauccccacagucugcuucuucaccaaggauggaaaguacagcaggaauuacaacuacuaccucaccgagaacuccuccaccacugacuguucaggaucccuuauguccugcaguuugucccuuagaagaauuaucuccagauaguauugaugcacauacguuugauuuugaaacuauuccccauccaaacauagaacagacuauucaccaaguuucuuuagacuuggauucauuagcagaaaguccugaaucagauuuuaugucugcugugaaugaguuuguaauagaagaaaauuugucgucuccuaauccuauaagugauccacaaagcccagaaaugaugguggaaucacuuuauucaucaguuaucaaugcgauagacaguagacgaaugcaggauacaaauguaugugguaaggaggauuuuggagaucauacuucucugaauguccaguuggaaagauguagaguuguugcccaagacucucacuucaguauacaaaccauuaaggaagaccuuugccacuuuagaacauuuguacaaaaagaacagugugacuucucaaauucauuaaaauguacagcaguagaaauaagaaacauuauugaaaaaguaaaauguucucuggaaauaacacuaaaagaaaaacaucaaaaagaacuacugucuuuaaaaaaugaauaugaagguaaacuugacggacuaauaaaggaaacugaagagaaugaaaacaaaauuaaaaaauugaagggagaguuaguaugccuugaggagguuuuacaaaauaaagauaaugaauuugcuuugguuaaacaugaaaaagaagcuguaaucugccugcagaaugaaaaggaucagaaguuguuagagauggaaaauauaaugcacucucaaaauugugaaauuaaagaacugaagcagucacgagaaauaguguuagaagacuuaaaaaagcuccauguugaaaaugaugagaaguuacaguuauugagggcagaacuucaguccuuggagcaaagucaucuaaaggaauuagaggacacacuucagguuaggcacauacaagaguuugagaagguuaugacagaccacagaguuucuuuggaggaauuaaaaaaggaaaaccaacaaauaauuaaucaaauacaagaaucucaugcugaaauuauccaggaaaaagaaaaacaguuacaggaauuaaaacucaagguuucugauuugucagacacgagaugcaaguuagagguugaacuugcguugaaggaagcagaaacugaugaaauaaaaauuuugcuggaagaaagcagagcccagcagaaggagaccuugaaaucucuucuugaacaagagacagaaaauuugagaacagaaauuaguaaacucaaccaaaagauucaggauaauaaugaaaauuaucaggugggcuuagcagagcuaagaacuuuaaugacaauugaaaaagaucaguguauuuccgaguuaauuaguagacaugaagaagaaucuaauauacuuaaagcugaauuaaacaaaguaacaucuuugcauaaccaagcauuugaaauagaaaaaaaccuaaaagaacaaauaauugaacugcagaguaaauuggauucagaauugagugcucuugaaagacaaaaagaugaaaaaauuacccaacaagaagagaaauacgaagcuauuauccagaaccuugagaaagacagacaaaaauuggucagcagccaggagcaagacagagaacaguuaauucagaagcuuaauugugaaaaagaugaagcuauucagacugcccuaaaagaauuuaaauuggagagagaaguuguugagaaagaguuauuagaaaaaguuaaacaucuugagaaucaaauagcaaaaagguaagaauuaaguuuagucuguaauuauaaaauuaaaauaucagugauucguuuguguguaaucacaguaccuugauuuacucauuuaccuuggguaaauguagcaacuaggguauuuucaugaaguaaaaacuuacuuuuuagucaguguuucuugcaaacagaaauaacagacuaaauccaugaguggcuuuuaaaaaaugaaucagcaguuuggauuuucagagaaauuuuuuguugaaaguuugaaauguuuuaaagagcucuuuguuuuuccuuuuuuaauucauaaguuucucucuugauuuauuugcaguuuuuuucuaaacucuucaguagaaaauuacuuauauucucuuuaaauuuaguauauauauuaaagacuaaaauuuuguucuguauauuguuuacuaaaggcuaaaucauaggaacauguagaguguuccuuauuguuauuuucuuaauacaguuucaguuauuuccucugugcuugaaagauguuuuuaaacugcagguuugauacugugguuguggauuggugguguuuuuacauguuuauuauuguuacugucugauauuacugccuuuugaucacagaagaugguuuuuaguauuuuuacuuuuaaucuggguuuaauuggguuuugugacccaguaaacaguuucuagaacauaauuaauaugucaauucauucuaucaugaauucuccaagugaauacauauauauuucaaccugugucuugccuuaucacuuuuauacaaucucuugugauugucugcucuauaauacucauauauugguauacuguuaaaccuccccuuuuggcuuaaaauuagaagcucuuuagguauucugggggagggggcauuagaggguuuaauagaggaauuaggguuugcauguauguuuaaaagcuggaugagagaagguuaacagagucacugccaaaggccaggagagcuugucaaagagaaucagagauggacaguacuuaaagcaguaaaaacagauuauauucagacacuauugcaguauggaaaauagaccucauuauagaacuaggcucaauucugaauacagcaugaacaaguugagauuuauagcuaaggaggguaggggucaguggauggaaaauuacuaagaggaaacauaaggaauaaggggaauuuugguuaaauugaucuaacaggauucuuacugaaggcaggccagggcaauaaaauaccaaggguggggacgauaauuuguucagauauugauggagagauacucucuaaacugaguuagcaagacacuugauacagcuggacagcguaggcccaagaagaauagaugucaaggucgaagccuagaggagccugauugaaguuuaguucaggagagcccuuuucaagcucaaagugaaauaagaggaaaacagaggcugaagcacccaugaaagcugaugguucuccauggcucacugggaagcugcuacaagauucaagaaucucuucaaagcaccagucugacucaaucugcaucacaaaauggauaguucucaguuacuugccaggaagcuacugugaaacugcaucuggcuacagccaccucuggagaauaaaccugugcugcuuuucugccuuccaaaaccuugcacaucuucuuuucauuggcaaacuggaagcuauaccugggauuuugggaaauguuggaucucuguauugcagugcauaugagaucauaaaagaggagcaagggcaaagccuauggaauacuagacaguccagcacuuuauaccccauuuaaaacucagcauuuagacagauaaaugucuuuugcccauauugagcuuccaaauaaagacacuuaaaauaggaaacagcaguuggauugaagacaccaccugaagaaauucauuaaaauccauuguuugucuccaugucuucuggacaggacacauacuuaauguugaauaagaacaugguagaaaccucccuccccugugucgugaagugagaguuuuaggaauuuuacuuggccuuuucuaccauaauaguccuuguuccacgaguaagggaagcaacauggggauucugccaguuucuucugucuauuccaguaacgauucuggaucuaaggauguacagggugaguaucccaaauccaacaugcuccaaaaucugaaacuuuuugagcccugacaugaugcuuaaaggaaaugcucauuggaucauuuuggauuuuggauuuucaacauuugagauauucagcugguaaauauaaugcaaauauuccagaaacugaaauucagaccacuucugcugccaagcauuuccgauaaggguuauucagcuuguuccugucucgaugagggaaccauugggcccaaacucugucacaugagcaccaauaaucuccuccuccuaguggaccacagucacuucagucuucucagagccaguguuugggugaagguuagaauucucuugguaaguuaagccucugaauacuagaucuagaguuuucuguuuugucuuguuuuuacaguuuuaguaggucuuuaaccgguucauucuauuagggccuacggacaaccacuaccacagauuucucugggucaaaaccuucuaauuacugcucuggcucuguugcuugugauagagccacauuauguuucugguggugaagugccacuaacuggccucugccacuccagaagccugucauucccauuaaauucauugaauuucaguguucucaucucccucugcuguuuccugcagagcaccacuacagagccuuuuaagcuuguauuuugcaaagccuugguaaagaacauauucucugggaccucugaggguauaaguaauaaaucccuuccaguauaccugccuuuggaugccuuccuuguagaucaggagucagcaaacuuguuuuuuuguuuguuuuuuguuuguuuguuuuuugagacggaguuucgcucuuguuacccaggcuggagugcaguggcgugaucucucuucaccacaaccucugccucccaaguucaagcaauucuccugccucagccuccugaguagcugggauuauaggcauguaccaccacgccuggcuaauuuuguauuuuuaguagagacaggguuucuccauguuggucaggcuggucucgaacuccugaccucaggugauccaccugccucagccucccaaagugcugggauuauaggcaugagccaccacgccuggccagcaaacuuguuuuuuaaagguccagauaguaaaaauuuuagcauuugcaggucacacacagacuuauucauauaaucugugugcaugcguguuuaccaucuuuuaaauaugugaaaaacaagaacaguggcucucuaacuucugucacaguaucuuuuuacgcucucaaaaauugacuccagacugauuuuguucauagggauuaugucaguauuucuguacuaaaaauuaauggcaagaaauugaaacuuagucauuuucaaauaaccucauuacaugguggcauacauaagacuuuuuuuuuuuuuuuuuuuugagacagagucuugcucugaugcccaggcuggagugcaguggcgcaaucacggcucacugcaaccucccagguucaagugauucuccugccucagccucccgaguagcugggacuacaggugcgugacaccacgcccagcuaauuuguuguauuuuuaguagagaugggguuucgccauguuagccaggauggucucgaucuccugaccuugugaucugcccaccucggccucccaagugcugggauuacaggcgugagccaccaugcuuggccauacauaagauuuuuuaauaaaaacuuucugaaaugaaaacuaguuagaagaguaccauuguucuauguauuugcaaaucucuuaaguuuugauugaaguauaugaaaaaaaauccaaccuuaugcugaaugcaauuggaaaaggaaaggaauauuuaaauagccuuuucagaugauugucgauauucuucuuuguuacuaaaucaaaauucagcaagugguaauuucugaacauuaguuuuuauuguggaauaugcagcuauuaguggauuuucucauaaucuuaacauuuauugguacaucucuuguacuuuuuuacucaugcaugauuuuauagcgucaugaguuggucauuuggaaaacacgaguucacggaguuaaugcagaucuuccaaauguuaacauauuuuagagcuaguaguuuuuacuauucaagaauauucuaagaaaaaacagccuccccuuuuuccuccccacuuugagugcuuuguggugaaagaaaacgacuacaaguaaaguuuggugcuaauggcuuuaauuuguguucagguaccagcaguuugaucaucagugccaauaucaacaaggugaaaaaggcaacacuugguguuacuaugaaaacaguucugacuucacuuguccucugaauguguuugguuaaccccaggcuucuauggaucacucuuugggaaucauuagccuaaagaaaugguuggcaaacuuuuauaaaggcccagauaguaaguaguuuaaguuuugugggccaaauggccucuauccaaacuacccaacuguaccauuuuagcaagacagcagugagacuauauaaaugaaugguuuuggcuguguuccgcaaaaaagcggauuggauuuaccugcccuugaucuagaguaucucauuuugccaucucauuuucauuuaauguugguuauucuuaagucuacuuuccaggcagucaacuuggcaaaguguuaauagccaauauugagucuggaaucuguggucauuacacccguauaaauaauuuuggccucacuccacauugucccuccucuuguaacugucauuagaucuauucccauauguauuuuccauuuuucugccaaaauauauuaaagauucuguaauugcuuugcaauuccuucuuuguuagauuuuuaacucuccagagaucuggcaauuugaguguagcaaugaguauggaaguaauuaaauggugggagagguuguugaaaaggaucaucucauugagaagaggacuaccucaagugaagggacacugauuuccucagacaagguagaaaaaggcuguugcuuccaggaaggaagguuuggugggauuuggaggcacagcugggacaugucucaaagccuugccuuccuuagucacugguuuuucaaacaacuacaaguguguacuguuaugccauguacugcccugguuuuccaguguucuauuuugcacuggcacugaggucauuacugcuuucagaucagagaauuaaucucaguuuccauguuuuaugggauuuuuuuuuccucuagagucauuuuuuuguaucaggauugagcuuauaaaacaaccacuuuuaaauauuucaggauuaaagggauuaauacuagauuuagaguuuacaugaauguugggagaacuaggagacuggauaguaaucuggugaaggccaagagaucuauaauagaaagucaucugaagcaccaaaguugguggcuuaggaaacugauacaguucuuugaagacuuucgucaguugucuaccaagacccccaaacaggugguuuacuuggaagucucuuacgaaucucacauugcccacauguuuggcuacaaccaccuccagagucucucucuucagcaucccaggucagguguggguaucuugcauuggcaaucucaaacauagaaccuaccgaggagggaauucuggauaauaucccuggcuucucugucaugcagaggaaaccuuugaagaagaaagaugcuuaugugaggacacacaguccggcauauuucccuuucaccacuugguucuacauaugccagaagcaacacugaggggccagcugccaaggagaaacauuucuaagauauguauauuagcuaugucuguagcucccacaguaagucaauaagaaaaaggcacauaaucuguuagaaaaauggacagaggauaugaagagaucaaagaagaaauacaaauggccaacauguagauacuguucgguccacuugugauuaaggaaaugcaagaucagaauaucuucuauuuaauuuggaauuauuaaaguuuauauuaguuuugaaauguuuaguuuugaaaauauaggagaaagcuuucuccuguaccuuuguacaaagaaauaagaguggaacguguguaugugguuugcguggguugggaaaucuaccuacuacaugauugauggccuugcucccaggaaguagugauguggaucugagugaguaugggugggagcauuuuaauuuuguaauucuaauuucaaaagagauuuuuauuuuauuauuuuuuugagacggagucucacucuguugcccaggcuggagugcaguggcaugaucucggcuuacugccaccucugccuccaggguucaagugauagaagagauuuuuuugaaaaaacagugaacuaauuguuuacuaggccccauuuuaauucagucaguguuaagaguucaagcaucaagacaaucuaguuuauguucaauguaaauuuucuaguugcuagaaauauuuggauauaauacaguccuuugcuagaacugacauuuuaauggugggaaaaacugucagccuuuagagaugccuuuuuucaaguuuccgugauacuaaaguucccagcugguaacaaauguaucugcuuccuugaguuucaauguccaggccucuuuaaaguauucagguaugcaaagacaggauuaugcaaguuucuuuuaguuggacaaccuuuauugaugaauuucuuagguuucugugguaguguuguuagauuaaauacagucauucccucuugucuaguuucguuuuaugugauuucgcucuuaugguuucacuuaccccaugguucgaaaguauuaaaugaaauaaacaauuccugaguuuuaaauuggacacuguuuugaguagcaugauuuguccaguguauccacacugugggcacucuccacacauuagucacuuguuagccaucuggguuaucaguauugcaguccuuguguucaaguaaccuuuauuuaauggcuccaaagcacaagaguaaugaugucgacaauuuggauaugccaaaaagaagccuugaagugcuucguuuaagugaaaagaugaaaguucuugauuuaguaagaaaaaaaaucaaaugcugagauugcaaagaucuacaguaagacccaaccuaucugugaaacugugcaggaggagcccauucauucucuuuuugccaucacaccucaaacugcaaaaguuaggaccacagugcauauauuggaaaaaauacaggguuuguuacuaucuacaguuucaggcauccacugggggucucggaacauauucccuguggguaaagggggacuacuguauuuuucuaacugaacugugauacgcuguaaccuuuucuucaugaccucccuccccucuacacagcuucuugcuccccauagaaagcuaggcagugaugcuaguuaaaacacaaaaccuauuuuagcuguuagccuuucauugcuaggguuaauuccccugauagcagggccauuucagauccuaggguaauguaaaauuaaaguuguguggcggauagucacuuggaacauuuucuaaugggagcuucaaacaauauggcauaguauguacuuuuggccggauuaauacagccacaagaaaccugucuucaguacaggauaaugauuauuuuucaugucauaaccugugcaaucuuugcuuuuacuuugagucaguaaaugagauacccuaugcuaaucaucuaguguucuuauucugguuuuggggauaugguguuuacagagagugucaggggugucuauaucuguuuguguaccuggaacuguguccucuugucccuguauuaucucagcacagcacugacccugaaauggaguaccccaagcaauccaaagaugcaggacaccuagaaauuauaaguacugccugugcauggccuccccuuccucucuugcacaauuugaaccacacuuuuucuaguacaauucuaggauccuuuaucauguugaaagcucuccuucaggcuucuuuacugugccacauuucuuacuaauauccuuucucacaauagucuuuucaaagccuagauucacacgauaucauucucuagaccaaaccuuucaaugacuuuauaugguacuugcaauaaaauucauaaccuuuacuguucacuaucuguccuucacaucuccaaccucagugcucucuugauuuccuccuuaaaaccuggccuuauuuuuuauuccuaaaaguuucagcuuaccuuagaacuguggagauuucuucaaggaagaaaucggccaagcaggauucuuuguaaacccugccuauaccuauuuuuaucccaagcacuucauuauuaguagucugagucucuuuguaagucucuuuguguuccuuaguaagccuuugauuuauguaguaugucaguuuuccagccauggaguaguuuaaacuugcacaucccccucuucuucagccccaaaggagaaacuuuaaaaguaaauccuucgccuuaauuaauuauauuauggaauauauauuccuuccuuuaauuaacuauauuaugaaauaggggauuccuauuccagccuuucugggaacuaaguaaggagucucagacuuugauagagauauuauguuucaaacugcauauucugcauuuggcuguauaaagcuaucccuuuggaggaaagguuaucugagcagcaaguuuaaguuauuagauuuuuaucaggaaauuuggaagcaugaauaaaaggauuccaauaauuuuuuguaugauuauugauauaguguauucuugucauauaauuagaugaggaaauuacauaagaaacauguagagugaacauuuuaaauacaugcccauauuaauugcagaacacacccugauuucaaaaacauuaaaauaucauuuaaaaacaaagagggacauuuaagccuaaaaauugaccugguaaagugguuuuuaguaacagcaacuuuuugaggcuuagcauguuuuaauacuaaugggauuuuucaucugcuucuuggagaaaccuuuuuuuaaugcuaaggauuaaguugaaaguagauaagauuaauacuuagaaguuauaauuagaaguuaaugaguuauuaauuagaaguuaaacuaaucauuaaccaguguuuguucauuucuucuuacauuguccuauucucaucucuagcacuuugucagcaaccccuaagagguuaguaagucuugaggaaaaugaguaugaguucaggaauauguagauuuguucguguaagcgcuuuucaguuuuagcuuuguguuaccuacuugcuagcagaaaugaaccaaagacuauuuuauggaaauuaaagcauuucaacauaugcaaucuuuagguguuucuuuuuuccuaagucauuguguaaauuucauguauaggaauagcaaaacugacauuugaaguugaguuuaccuaucucuuauguguauagucccuuaccagaaaauacuuuuuccuuauguugcccaggcaggauuugaacuucugggcucaagcaguucuccuaccucagcaugcaccacugugcuuggcuguuguuuuuuuuuguuguuuguuuguuuguuuguuuaagagacggggucucacuuuguugccaggcugaucucaaacucuuggacucaagugauccucccgccugggccucccaaagugcuaggauuacaggugugagccacagagcucggccaaagaauaaaagaauggcuacuccaugggcagagcagccucuugauuuuuauguauguugauauaagcaaauuaucuggaauuuaucugcuauacugauaaaaaucaguaaaccuuguuagugucagcaucuaaucuguauuaaacuuuuacuuauuucccuuuacuuuuuagauucaaagagaggguucacacagauaucuuucaugcuacauuauugagcuuaaggaagauaaauuucccaaauaugauauuugguauauuugugugucuguaauuuuuuuuuuaauuuaaugcuguauuuaauuuguaaguccugccauugacucuaccagaggagauucuucaagcuuaguugcugaacuucaagaaaagcuucaggaagaaaaagcuaaguuucuagaacaacuugaagagcaagaaaaaagaaagaaugaagaaaugcaaaauguucgaacaucuuugauugcggaacaacaggucuguaucucuuuucccauuucauuugagaacuaaagaagguagacauaaauuaacaaauauaauuucuuuauguagcugaggguuucuuauaucuuagaugugauguuccuuacauugauccuguuaauaaauuuccucuugacaaaagcguguauuuuuaagaauuuuuuuuaguuuuuuuacucaucuggagaauaauauuuuucauguuaacaugucacaugacaauaccaggugcuucaaaaugagauagucuuagauuagaagcgagggaauguaaauucuguuccugguuucuucgcuaccuaugugaucuuggguagaucauuuaaccucuugagaacuaagauuaguuuucuaugaaaugauguuuuuaauuuaaaaaaugauuuuauuuuuucucuaagcuucaaauucucuaaacuuuguuauccuaaauuacauucagaucaacauaaauaucuuacccuuucuguaauucuuauccuucugauaggcuggugguagauuaagauggaauauuauugaauuuuguuaauguacuuacuguuguuggucaauaguaagagguagugcuugugaaguauauugggguuagauaaaaaaccagaugccuuguuagagagcuuguacuuuaccuaaaguaccggacagcaacuaauuacaauggcauaauuagauuuaugcuuaaugaagaucacccacuggaacauggagaaagauuggagaacugcaaagcagucagcuggaagagcaauuugguagcuacugcuagaauucaggccagggauaauauugcaguuugggguauacauuuugagggauacauuucugaaacugcauauuuaugguuauuguacacauguaauauuaugugguauuuuuccuuuuccuaaaauguuaugauuaauuagugucuuuguggaauuugaaaaaauguaaaucagagaacagaaagaaaauaaaguauaguugaaaccucuaacaauuuuagauuuuuaaggccuagggaaagaaagaagagccugggaaaagggaaugagaaaagcacaaccagaaaaaaaaguguguggcuuaagggaagccaaggaaaguuaaguguucagggaggaggaauagccaaguuuuaaguaagaauuaacaaugaggaggucaguaguaaccucucucuaagaaucuggauuuauagauucuucucuaugauucauucugcauauugaucucuuuaucuccuuguguugcauugucucuuuguguguucucuuauaagcacauguacaauuucuaaaauuaaguaaagaaugaauuaacugaaaccaaaaguauaguauugacagcugucuaauuuacuucuucauguuuugaugucucuuuuaauauuuauaaaauaagagugggagaaaugacuucuaagguaccuuccaauuuuccaugauguguauguuaaguuguauuuauuuaagguuauuuguaccuagcucuguauaggugauuucugaguuggaacuaauugguucuuaacuagcccccuuuuuucauaugccaauuacaaauugugaucuuccuaaaaauucauuucaaauuacagaaauggcaaaaaucaugaaaauaaacauaaugguuuauauguuuuuguguuuauuuucuauauauaaauaaaauacauagagauggcuuaauacaaagccauaucauaaauguuucuuuuugagagaucuuccuguaugcuuuguggccagaaauuguauuuaauuaaauauuuaaugaauuuauuaaaauuuuauuaaaaaugcuguauuacuuuuccuaaaucucccuauugccagcauuguuagcauuauucauugauccaaggaccguagagcucuuaaaauuuuggaauuagaaaugcugggcagaugagaagagucaguuuagaucauuucaucauucaucuauugcuuuuacauuucaagaagcucaaaaaucuuguaaguaaauuuuuuuuuuuuuuuuuuuuuuugccucuuagagacagggucuuacucugucauucaggcuggaauucaguggugcaaucauggcaugcuauaaccuggaacuccugggcucaagcaguccucccuccuuagccucccgaauggcugggacuacaggcaugugccaccacacccagauaauuuuuguagagacucgaucuuguguugcucaggcuggucucaaacuccugggcucaagcaguccucccaccucagucucccaaagugcugagauuacaggcaugagccaccaaguccggccuaagcaaaauuuuuauacagauucagucaucuuuauuaaagaaacugugcaguuaaaauugccagauugucucaugagauccaugcaggcaguuggauaugugagcuucauaguagaguuuauaaaagugggggaguaauaagucuagccaauauaaaucagcauuccagugaccauugcagauauccaaauaagagaaauaaggaagauagagucauaucuaaaauguuaggguggugaucaaaugcuaaagacaaaaggaagguuucagaggcaggaugauuacuccaggaaaaaaguaagugucuaacagcacucuaaguuauugaugcuucuaauucuucaaaauuucaaaaucucugacaguaaauauauggacaauaauaagaaaauaggauuugcuuucaagagacuuaaauuggaaccaagaaaguagaaccuuugccacaguauguuacauuuucauuuuuaaaacauuucaugaaucauaccccaucaucuccauguacaaaugugccacagaaaagaauauuugcaaguguauuuucuaaguccuagcugcuaaguacauguagauaaauuuaaauaauuauucucuuguuccagaccaauuuuaacacuguuuuaacaagagagaaaaugagaaaagaaaacauaauaaaugaucuuagugauaaguugaaaaguacaaugcagcaacaagaacgggauaaagguuuguacuguuuuguacuauuuuuuuuaauuuuuuaaaguggaaaagauacauucaugcaaagugguuuuuuuaauuacaugauacuuuuuuaaauuuggguguccuucagauuugauagagucacuuucugaagaucgagcucguuugcuugaggaaaagaaaaagcuugaagaagaagucaguaaguugcguaguagcaguuuuguuccuucaccauauguagcuacagccccagaacuuuauggagcuugugcaccugaacucccaggugaaucagauagauccgcuguggaaacagcagaugaaggaagaguggauucagcaauggagacaagcaugaugucuguacaguaaguauggcuguuuucaacuguuuuuaaggcuguugcaauuccaugaguuauaaagcucugaagagaggaaauauuuuuagcauuacugguuguccacagcccauguaucugaaaguugugcuauuuuaauucuuuaaacuguaagugugagaaaacauuacugaaugaauuauuuugggguacucucauacuauacaaaguaugugcaccagaauuaucccauacugccaagauaaggaucauggcaguaguauugagccauucuuauuuacagggaauguugacauuuugggguccauuaccuauaaagggguuauuguaguaaugaauauauucauuuuggugaggaaaagcagggaaggguuuuuuauuauuauuauuauuauuuguuuauucauauauagcaaauguuuacugcauuacauugaaaucguggcagagcuuacuggaauuuagaacuuucuuaccaguucuccuuugaauauagugaaagaccacuaaaauugugcuuacaauuauaucuaugggagagacagaauugggaggagaaagugcuccucuccaaaggacguugcaaguagaguuugcauuucuaguugcaccucugggauuucagauaugggaacugagauuccaagggcagaaaguccagaucauuaugccacacaaagaauuaugcccagugggucagugaacacuacacccccaugugagaugaaguaauucgaacaagugauuaccaaaagauaucauagaaucagcgugguccccucguucaaacagauccagguucaaguccugagucuagcaccugcuugggaacuugagcaagucaucaucccuuauuuuuccaucaagauaacaguuaugauaacaagacaacaguuaugauacaccagcaggguugcuuugggcauuaauauuuuauuuuauuuuauuuuaauuuuuuuuuuuuuuuuuuuugagaugaagucucacucuuaucccccaggguggagugugauggcacaaucucggcucacugcaaccuccgccuccuggguucaagugauucuucugccuuagccuccugaauagccgggauuacaggcgccugccaccacgccuggcuaauuuuuguauuuuuaguagagacgggguuucaccauguuggacaggcuggucucgaacuccugaccucaggugauccacucaccucagccucccaaagugcugggauuacaggugugagucaucgcgcccggccaggcauuaaauuuaaugagcacccgugagaaggugugguacacaguaagaaaccaguaagugcaggguccuucguaccccaccccugcccacucagaggaacgcaguuaguugcaucuucauauaagcccauuaucugccugaccuuugagaaacuuugguaggggaguuuuuuguuuguuuguuuuugaaaaauaaaauuacuuagguuucugucugguugaaaggaaaauaauagaaacugguuaccuuuagacuuugaaagguauaaggcuuaagaauguauauuaaaaauaaaauagaacaaaaaaaguaauucaaaaaagcaaaucaagaaaacaugguuaagcaaaucaagaaaacaugguuauuuagcaaacaugaaugacauaaauauguccggacaugugugaaaaaagugaaccaccguaugaaaaccucuuuaaaaaaauauauccaacuucauucuacauauaggagagguaccuagagccaaaugauacagaaaguuuacuauaauaugauucagaaagauauagaagggaaaaauauaaaagcaauucaaagcaaaaggcuuuaaaaagcuuuaggaauuuaaggcuuuuuugauugacacauaaauuauacauauuuaugguuuacagugugauguaguuacauguguacauucaaauuagaguaauccaucaccucaaacguuuaucauuucuuuauggugagaacauucaaaaugcucuuuucuagcuauuuugagauagcgcaguacauuauugaacaccaaaacuuauuccuccuaucuggcuguagcuuuguacccguugaccaaccucuccucaucuccucuccucuguacucuccccagccucugguaaccacuauucugcucucugccuccaugagauaaacuuaagauucugcauauuagucagaucauauguagguuuuuuuauaaauaugaaaauugaguuauucagaaccaaaguaucaaaaacagauaugacgaaagugguacucugagagaacuguguaguuccuuuauuuuuaaaugaauuaauaaaaacaaaugagccacaauaaaauaaaaguuguuuaguagauauugggauaaauagaagguacaaauaaauauauguaaugaaaagagggacauaaccuuaguuauaguuuuaaaaauuacagagaacaugauacaaguuaaucucaccugugaauuauaaauacaaggaauccugaagacaauuuuagcuuaucaaaugccuugugguuuuaugaugauauagucaucaugacccaguggaguauuuuaggaaugccagaguaauaacuaaacaguacaauaccuaaccauacucacugauuacuugagaagguuuauagagucaugucaguagaagcugaaaugacaauugauauaaugcagugcccauuuauuuaauaauuuaacaaaauccuuagcaaacuaggaguagaugggaacuucuuuuuauuuguaaguauaugggagagacauagcaagcaucguauuucauauugaaacauuuagaaguauuuuucauaaauucaggaagaacacaaugccagcugucaccauugcuauucagcaagacaauaaauaaaauuuggaaacaacuuuuucuguccucauuuucagacaguauccuuuacaaaccacaaagaccuaaagacauauuagaauuaacagaguacaucagaguguagaucauagauauauccaaagaggaguaguuugcauauuuaccagcaaaagcugacuuuaauauguauaaaagaucccaauaaaaauuuaaaggaauaacuuacuuguaauuaauuuaacaaaaaugcgcaagacuucgugaagaaaacuaauuuuaugaagaggccugaaagcuguacguggaaagauagauggaaauggaguauuauuaagauaucauuuuucuccucagauguauucagugauuuaaucuauuacucaauuaaaauucuaacaauauguuagguuaaaaagugauguuugaugcuagaauucauauugaaaaauguguaaaaauaauugauagcauuucuaaauaaagaucagagaguagagauuuguccugcuagguguuaagauauagucuuaaacuacauagauaguauuuaaugcaguacauuauugguauagccacaggcaaauagauuaauagaguuaguaaucuugaaacaaaccaguggauauauauggaaaucuacauguagcauuuuaaaucaguuugguaaaaggauggacuccucagaaugggacauuagaggcauuguugaucuauuggugagaggugagccauauuuuacauuguauauauaaacaaaaugauagauguaguaaagacuaaauuuuuuuuugaacuuacagaguuucuuaaagaaaauaaaagacuacucugaaaucagaguaggagagcacuuggaaaacaauaaucaauauuacauugaaauuuaaagcuugaguacaacagaaaacaaacagcagaagucuggugguuaauauuuuuaauaaauaaaagauaaaaaccaaacuuuuaaauaaugccaguuuuuuauaaucucuuuuaaaaaauaggagagaacucuucccaacuuauccucugaggccaguauuauauacuaauaccaaaucagacaaauauaucaaaagaagaaaauacaucuucuauaacuauugacacaaauauuaucggcaaaauacuaauagauccagucuggcagaauacaaaaggaauuccaauuggcuuuauuucagaaaugcaagguugguuuaacaucuaaaagucaauuuaugucauacacuauaucaguagaaugaaaggacagaaaaacacaugauuaucucaauagaugaagaaaaagcauuugacaaaacccaacagccuuucaucauaaaaacacucaacaaacuaggaauugacuuccucaaccuauugaaaggcaucugugagaacccacaauuaacaucauacucaaugguguaagacugaaugcuuuuccccuaaaaucaagaugaagauggccugcucuugccacugcugcucaacauuguacuuggaaguucuaucacgggcacuuaggcaagaaaaagaaauuaaaggcauuggccaggcgcaguggcucaugccuguaaucccagcacuuugggaggccaaaguaggcagaucaccugaggucaggaguucaagaucagccuggccaacauggugaaacccagucucuacuaaaaauagaaaaauuagcugggcaugguggugggcaccuguaauuccagcuacaugggaggcugagacaggagaauugauugaaccugggaggcagagguugcagauugcgacccugcccuccauccugggugacagaacaagacucugucucaaaaaauaaauauauaaauaaauaaauaaauaaauaaaugcaucuagauugguaaggaagaaaaaacacuauuugcauacauagccugaucuuuuauugagaaaauccuaaggucuccucuaaaaaaauacuguaauuaacaaacuaguucaguaauguuggaggauacagguucagugugcaaaaaucaauuggagcuggcugugguggugcacagcuguggucccagcuacucaggaggcugaggcagcaggaucccuugagccuagggguuugugaacagggaugacauaacaagacccugucucuuaaaaaauugucauucuuucuacuagcaaugaaucauccaaaaaugagauuuaaaagacaguuucuuuucugauggcaucaaaaagguaaaaauacuuaggaauagauuuaacaaaagaaguucaauacuuguacaaauuacaaaacauggaaaaaaguuaagacaguagggcauccuguguuuacugacuggaagacuuaaucgccuuaagaugguagcccuccccaaauuggucugccaguucaacacaauucuuaucguaaucugaacuguguuauguugcagaaaagggcaggcugauccuaaaauucauauggaauugcaagagucccaaaauagccaaagcaaucuugaaaaauaacaaagucucacacuguuugacuaaucuuaaaauuuguaagcaaggguaauaagacacuguagugcuagccugacuguaucaguggaauagaauugagaguccaaaauuagcccucguauucauggucgguugaacccuugcauuuugguuaaaggugcugagacgguuccgugaaggaaauagcuuuuucagcaaauggugcagggauagcauagcuggauauucugaugcaaaaggaugaaguuggacccuuuccucaccauaugcgcagguugacuuaaauagaucauagacuuaaguguaaaagcuaaaauuauaaaacucuuacagaagucaaucuuuaugaccuuauauuaggcaaagcgucuuccuaaagaaguagcauguugaagaagacagaauaccugccuugcaucaaguuacuugaaauauaauuuggggauuauaccuguagaugaauuuuaaaaccuaaauaauaauuguuuuucucuuuucuaauuuuauagcauuuuuuaaaauuuucuaauuuguuuuuggauguuuuaguguauugggcaaauucacaccuggcauaguaacuagugaguacauagcauccacuuaguaaaucuacugaagucuuuagccacucaagaacuacgacuuuaucauggauucacucacaaauauuaagaagagugguucuuaaugccugggaaaaauaagaaauuuaaagacaucucuagauaaaugcauacacagaguuuuacuuauuauuucaaaagguuuauagaucuaggucugcuacagagaauauacaacauugaaauuacaugcuaacugaaauaagcuacuuuugaaaauuuaugaaaacccuuaaauuguuaaagugaucuguauuaauauuuuaauuucuaaaaucuugaagaauguaaaguuuagaauuucaaacugaaacucaauuauucucacuuuuagagaaaauauucauauguugucugaagaaaaacagcggauaaugcuguuagaacgaguaaguaaauuaucuucuugaaguaccauguuuaauauguucacuuuuggauacaguuaaacuucauucuggaaacauacaauagacuauuuguguuuauaaauuaagccuuuuuaugauuaacuuauuuuuguggucacuguuuugggaagucuugucauuuuaugaucuuacuagcuaaacaguugacaguauuucagcccucccauuuguuguaauuucccaaugaaugaagucuguaugagaggaaaaaguugguaguuuuuauuaaaucaauguguaaaguaauaguuuuaccuaauaguugagaauucagcaaaauaacaugaauggcaauuuuaaacaucuauuucaaaaacaaaguauuaaauacuuuuuagaaauuggcaaaaacaaaaauaaguaaugaagggaguuauguuuuaaauaaagaauugaaauggacaagaaaaaacugauaauaaaggguuuccuuuauuaaggguacuauaagaucaaauugguacacauuuggcagaucauuguucauagauuacuuuucauucuuuaggccuauaagauuuucaacaaugccuuuuuuucuuuacaaguguaauugucugauaaaaauccaaauucagaauuguacaacuucauuugaauauagcauguuuucuauuaugaaaggguuaugugauuuccuaccucagcauaaccugagauguauguuacagaugccagauguauucucuuaggcacgacuuaguuaacaaagucucuggggauagaucucagauuuuuacuacauauuuauauauuccacagguguuucuaacgcauauuaauguuugacaguccuugguaaauguaucuaaaauugcucugguucucauuuaagcuaguagauaaugaaaacauuuggaaagaauucauagaaaauaauauccccaucaacuuuucauacccgaaccaaacauuuuugucugaugaaaacuuugacaaucacuguuuagauuuauuugaguagguacaaggauaaaccacaggucucuuuuuuccaccugcagacauugcaauugaaagaagaagaaaauaaacgguuaaaucaaagacugguaagauuuuucuucuugguaaauuggucuuaacauuuuuaaaugauuugcauuauauuucauuaugaagauauuccaucagaggauguaugcuuugauugacuuaucuauaguagguuuguugguccguguuggucauugaauccuauugauuuucagaaugcugaagucaggccagaguuaucuccugacuguagagucagacuuuuuccuuagcgugaaauuaaauaaugucuuggcgaauuuacggcuguaggucugaccaguugaagcaccuaagauucuuaaaaucaucaaaaucaguuuugaguuauguuucauaagucuuuugaagauuaauauauuuacucacaagugugcguaauuuuaauacauuguaucuuuucaugauuuuuuuuuuuuaagacagucuugcucuguagcuuaggcuggaguggugugaucucgacucacugcaaccuccaccucccggguucaagugauucuugugcauuagccucccgaguagcugggauuacaagugugcugcgccgucacacccggcuaauuuuuacauaauuaauagagacaggauuucuccauuuuggacaggcuggucucaaaccccuggccucaggugaucugcgcaccuuggacucccaaagugcugggaguuacaggugugaaacauugcacccagcccuuuucaugaaucuuauuuuuaagugaaagugccugaaaggcaagagaucccaugugguacuguaaauugcccugguuuuuauugauuuguuuuguuucguuuuuaauuaaaaaaaaaaaaucgagacaaggucucucucuguugcccaggcugaagugugguguugcgaucuuggcucacugcagcuucaaccucuuuggcucaagcaauccuccugucucagcucagcaaguagcugggaguacaggcgagugccgcugcacccagcuaauuuuuguuuuguuuugguuuuagguuuuguuuuuuuguuuucguagagaugggguuucaccaucuuguccaggcuggucucgaacugcugagcuuaagcgauccgccugccucagccuccccaagugcugggauuccaggcaaauuggaauugccuggaauuuugcugcacccaaccaaacugccuuggcuuuaaccugugaauuuaaccaauuauuugaacagcccauuuuacagccaauuauauguuuuaauaaagcaauaacuuuauuuuuucaaguucuauuaauuacaguuuacaagguaguaggaacaguuuaaggcuucuguucagugcuuuugaaaaguuuugaaauacuuuuuagaauuuaguuuguuuaaaaaauaaaaauaucuuguagugagacaucuccuuucuucuuuauaccuuaacuugaacagcaaaaaucacauauuuuguagugauuauacugugaaucauuaauuuuaucacaaagacuuagaagaauggucuaucucagacaugacucaauacguguuuuauguaguaugcuuuauuuauccucaauagaauauaagcucuguuuggcaacgauuuuaaucaguuuuggucaccgcuacauucuuagcaucuagaaugguaacugguauacuauagaugcuuggcauauguuuguagauuaauugugaacccaaaaguaucugagacaggucucaaucaauuuagaaaguuuauuuugccaagguuaaggacgagcucaugacacagccucgggagguccugacgugugcccaagguggucaggacacagcuugguuuuauacauuuuagggaaacaugagauaucaaccaguauguguaagauguucugucuggaaaggugggacaacucaaagcugggaagagggcuuccaggucauagguagauaagagacaaaugguugcauuauuuugaaacugugauuagccuuucacugaauacacaauuuacaugucagaggaugguagaggaauugucacuuaugcuucagucugacuuagugaagcaguggggccgagaaagcaaucauauacgcauuugucucacaugagcagaggaacagagggaugacuuuaaguucugucuguuuuuuguccacaaggaauuuucuugugggcaaauugugaggucuuuguagcuaucuuauuuuaggaauaaaaugggaggcagguuugcuugauguaguucccagcuugaccucccuuuuccuuagugauuuuugguucccaagauuuauuuucuuuucacagaauaaauugucuuucagacccagagagcaucacagucacauucagaaagguguccaaauguaaaucacacuuucacauagaauuacagcuauauuaacaaauuuuuucuuccauugucuucauuuguaauauauaaaaaacuuaagcuuuuaaaaaacuaaaguugaauuauggucuuaaaaaugauggucaaucuuaucuucacuggcaggauauagaccauuugucuggauaauuuuaguaaguugcuauacaguuuuaggccuuccuaguuauuauuuguuguguuauuucucuuuuuaaaacccugcauuguaccagauagcguucagagggaaguggaggaaauucagagcaucaaaauuugacuuaauaaacaaaauauccuuaucuguccuugguuugugcaaccaugcauugggcucacuuugcuugggaaaaauagguguuuuuaucacccuuucaagcuucaaagaccuugguuuccaugcuucaggucuuaugagaugguguggauaaauggauugaagcuuguuugaagaggagaacagucccggcuaagccauggcuauagcuuaucagcuagcaaguaccauuugauugugcucaucaucaguagaggaaguggguggcuaucacaaaauucauuguuucgugauuguucacaaauuuuuuuaaacugagacaucucagaaguuucauugaagaugagaaaagagguuuguucucagccuucagaacuuuaugcucccaccccaguuuaaccagaguaguaguguuugcuaggcaaggugucagagcgcuggcauugcaaagugguugacucugguuugguaagaagaauuuacugacaacaguauagguuugaaaaaggaaaguuuuauuagagcgaaugaugcugaagaguguagcggggugccucagcaagagaggacugagcacgcuguggugaauuuucccgacgagcauauauggaccuuaaggcaggaucuuaaagguaguuuggaccaauguuggccguguaggucaugauaaaugauuacauuuguagacauuuuugugucuugaugucagcaaggguugcucagugaguuuuggcaugcauacauuccagagauguauagaaauucuaguuacuuacaacauuuuugaaagagaccuguaaccacaugcuaggaaaguuuaauuacuucuaaauuccucagcguucugccuccagauggccuguuugauggucaccaggugucuuugcuugcugcauuauacuucuaaccucugccuuccaggcucaagugaucuucccaccucagacuuccgaguagcugggaccauaggcgcuugccauuaugcccagcuaauuuuuuguauuuuugguagagaugggguuucaccauuuugcccaggcuggagauuuuaaaucuuuuugguuuuuuuguuguuguucguugggacaacuaaguuccucuucaaagacucaacuuccuggucauaaguuguaagauuguaaaucaaccccauccccuucuccccucugccuucuccuuuucucacaaaucgcacauuuacccuauuuggaaaaaguuuaggucuaagcuaaccgggaucagcuuagauugugugguccaaccccagccaauaggggaaggacacagaaacagaaacugcauuagagauaaaaccccuuccuuccuuuguuugguguucucuugcaauugugacggcugugagcagcagccuucugcagaaguaaaguugccuugccaagaaauuuucuaaguguggguuucuuuuggcuacacugagcacuuguuuccaacauuguuguuuuuccaaaaugaaagauuuugaaucuaaugcauuagaauuuucaaagucuucuugaaaaaucuguccuuuucucuguguuuuauuuuuaagauuaaauauguaauauaaauaaaaugugauucaaaaaucaguuuuuaaucuaaccaaauuuacuaaugguugaaauaaaggaauuauuaaugaacauaagaacuauauuaguuugggcucuuuaaagcuggacacaggcuugaauguguauaacagugggugaaauuuuugcaguaagaaugcaugugguacucaaauuguguaaguucauaaacuuuuuuuuuuuuuuuagaugucucagagcaugucuucaguaucuucaaggcauucugaaaagauagcuauuagagaguaaguauuuuaguuuugugaguauuuuucugugaaaaacauucacugaauuguuaaugaaaauguauuucagugacaguaauucagguccagguucauugagcugaguguuuugcacucaguaguaguaaaaguuuuuuacuggaaagcaggauuuuucuaaauuguuauucuggaaacauuuagauugccaaaacuuuccaguuauagcauuaugauuaacauaaauauccuugaagccuuuuccuccaguuaacuuuucagcaugugcuaccucuuuuaaaucccauuuaucuccuuagucuuguuaaucuauauuggagaguuuugauuuguuuuuaaguugcaguguuuccucauuuuuaguuuuuagauuucauuuuauuaauauucuacaaauucauaauaaacaaauugucaaugaaaaagucaaacucuguaaaauauuugaagauauuuauucugagccaaauaugagugaccauggccugugacacagcccucaggagccccugagaacaugugcccaaggugauuggaugacggugagggggaaacuugguuucauacauuuuagggagacaugagacauugaagauacaaguugguuugguccagaaaggugggacaaaugaaagcugggaggguagcuuccaaaguauagguagauuuuuaaaguuuucugauuggcaguugguugaaagagcugucaguagaaaggaaugucuagguuaagauaagagguuguggagaccaaaguuuugucaugcagaugaagccuccagguagcaggcuugacagauaauaguuuguaaauguuucuuaucaggcuuaaccucuguguuaguguuaaauucuuguugacuuuuccugaauucuaagagggaagaggacaugaugaggcaaguccaaccccugccuuuugucauggccugaaccggucuuucagguuaaauuuauagggcacuggccuagaggaggaaguucauucagaugguugguugggggggcuucaaauuuuauuuuugguuuacagaauuuaucaauugaaugguuuaauaauuuuccugcacuguauuaccccauaguuaaaauuuuucuuuagcuuugguuauuuaaauggagcucuggaauaauaaaagcauuguuagcaacuuaugaauaguguucagccuuuuauccugacaggaagguugugaaaguuaagacccuuuauuuaacuucuuguauuuuauuucuaaauuucuaaauuuguugaccacauuuuugguugucagauaucugugauucugacuuuucaugucucauuaaaauuucagcuucucucagugauuugaaagggcuuagugguaucugucuuuaccagcuguaugucaugucaaugggccguucauuaauguucuuucagagacuagagagagaggagcuccaaaaauacugccucauagaggccccauuucccaucuccccauuuuaaguuauuagcuuuuggcauuuagccaaaacagugccugccacaugguuguuagguaaucacuaaguauuuguaggguaacuuaauaaauaaaagacauuaaaaguuuccccagcugauuuugaugauuuauuagguauaggaucuaccaauuuaaaugaucuugacaacugaaaaauaugagauugauuuucaaggccuuuugauguuuugaacaacaguucugaaaaaggcuguaaagagacaaacaccacuuaagcauguaauugguuguacccacuucucucuuucccugucuucuuucgggcuuauaccccaaaauaguaauaucuguugacuuguuuagaccuaauuaagcaccugacuucuggaccuagcucaguugcuuuuucuuguaaauugaagagcacuacgcuuggagacaagaucuaauuuuucuuugacacugugacuguauaugagaugucucucugaauuuuuggugugaaaugaaagauuaggagaaaaaaaucuugcuaugacuggauaaacuguaaugggugcuuuuucugcuuuucauccaguuccuuaacguuagauaauggaaacuuuauuaaagaaauuuuugguuuuugacagccccugacaucauccuuugaauaucugugcaugaccagcagucccauuaggaccugggcagaaugcaaaaagaguaucauguaaaugugaaauuuaauauugcauuaauaucuuaauauguaguugagcauuaaguauauaugcuaaguuuucagaauagggggauugaaaguaacucuaagucaauaaaauugcauuucuuuauucaguuuucaggugggagauuugguacucaucauccuagacgaacgccaugacaauuauguguuauuuacuguuaguccuacuuuauauuuucuacauucagagucucuaccugcccuggaucucaaaccaggugagggugguaagugucauuccaugacuaaaauauaaaccuggaauggaggaaauuauauaaguaaagauuuuuuuuucccuguuuaauuacauaagaauuaagucacuaagagggaacccuguguaaucugcuuuuuuauaaaaucuguauuaucuagauuauuuucauggauuccauuuacaauucagaauuaaggaguguagcuuauacaagggaccaguugaucagaaugugcagugauucggacaucucauaacccuagcaguuggauaauuauauugucaaaguucucauguacagacuauucaaaauuaauguaugcuuauuuguuuauauaaaagcauuauuuuuuggcaaaaaaaacuuucuuaaauuauaaaaugucuagucuauccuauaucauccuauguuccuaccuuguuuaucauuauacuguucuauacacuuauuuuuuuaaaaaggaaauaagcuuuguuaaaauauacuaaguaacaaugucuauuaucuauuugauuuuuaaaauacuaaaaaagaacagaauagauauccugguguacuuagccuaaguagaauuauuuuuaacacuaaaacgaaguaaguccauuuagauugauguuccuaaucuaauuggacugacucgcaacaaagucaaguaucuuaucuauauauuuauagguagauauuuuuuuucgaaacggagucuugcucugucgccuaggcuggagugcgguggcacgaucucagcucacugcaaccucugccucccagguucaagcaauucuccugccucagcuucccgaguagcuggaauuacaggcgugugccaccacgcccagcuaauuuuuguauuuuuaguagaggcggguuuuuaccuguuggcuaggcuggucucaaaacuccugaccuugugaucugccugccucaggcucccaaagugcugggauuacaggcuuaagccaccguacccggccuuuuuuuucuuuaagacaaguuuuugcucuguuacccaggcuggagugcaguggcaugaucauuggucacuguagccuugaacuccugggcccaagcaauccuccugccucagccuccugaguagcugggacuagguacuauagauuugcaccaccacuaugcccauuuuuuguuuuguuuuguagaggcagggucucacuuuguuggccaggcuggcaaauuccuagucuugaacuaggccacuuuccccaugacaacuccaucauggcuauuugugguuggcuguuuagaguauccaugaaacaguaaucauguaaccaugaaaaaugagaagauagcuuauaacuuacuauuuuuacuuaguacuuuuuaccuugaaaauaaugaaccugauauuucuuuugucuuuuaugggguuuuuuguuuuucaguuguuuaaaccuuuuauuugaauaugauuuuuaaacuuagaaaacgucgcaaagauuaauauaguacaaagaaaaccuauauuucuuuacccagauucaucuguuaacauuuuaccccacuugcaauaucuuuuuauguguauguaucuaagauauaaauauacacaaaugugugcacacuuuuuucccccagaaccguaugaugauaaguuacaucuuagcccauuaccuuucaacauuuccauguucauuuugaagacuucaguguuuaaaucugggaaacauuaaaaaacuuuuuuaaaaaugcacacugccauuuuaaaggcuuucacaaguacugcagaaaagaauuuauuuauuuagcagucuuacuuaaccauuaauaaacccccguuccuuuuuuccuuugaggaaugccaguugggaucaugcuaccccuguguuguugccuugggagagugcggauuaccagaguguuuuuaugccuuuuguuaguggggcucauuacucuucuggcaucauacaagcauuuauuuuuagaugauucuuuuuggauguuaguaauuggcugugaagugcuaguuugcucuucagagaauucaccacauccuauuguccaggggcuuuucuguuucugucaugugaucguauucuucagguucauuucugauuauuuauuugggauaucuuucguguauaucuucccaaauuauuuguauggaauaaaaauccguaugccuucuuucaaaggcuuuagccuaaacacaauacagacaguucccaacuuaugguaguucuacuuaaaacuuuuugacuuuaccauggugugaaagugauacacauucauagaaacccuacuuucgguauccacacaaccauucuguuuuucacuuuuaguauucaauaaauuacaugagacauucaacacuuuaaaauaugcuuuuuguuagaugauuuugcccaacugaaggcuaauguaaauguucugagacuaggcuaagcuaugguguaugguagauuagaaguauuaaaugcauuuucaacuuagauauuuucaauauaggauggguuuaaucuggacauaaccuuaucauaaguugaaaggcaucuguaguuuauugccugaauacuuuugaagucaacuuuaauaagacagcuucuuuucugaugaauuuaaaaagagaauggguaccacuuggcuugucacauuuuggcuuuaugaggacuaggauuauccugucuucucucacauuuuucagcuuuccuucauucacacaaguacugcccuucuagaauuuuuugguucuuagcccuuauuaauuuauugaguaccaacuguauacacacugcugugccaagcacuguggcauacagaugugagaacuguucacuugcugccuuugagaacuuguauuaaaaauacugcccaucaaaaaugaguguuuugcuuugaaccuauacauuuuguuugcuuaaagaaaugggaaaggucaucuuuauuaguucuuucaauagauggcacuacugaguuagccuagaauuccuacauauuuguucaugauuuguauuuagauuauuaguguuuccugaacuguuauuucugugauuugacauaucauguauauuuaaugaguaacaagagcuacgcacacauuacugguugaaaaguaacaugaauuuaguuuuguaaauuguuaagcauuucagugauuucgguaguuuuuaaagucuuacauauucuuccacucaugagagcuuuuuuagucuguuuuaauucuggcaguuauguuuccaugaauaauuauaaucauacuuucaaaaagagauuaacuauuuaauuucauuagcuucaggugcaucuagaagacccuggguacuuggaaaaguaauggaaaaagaauacugucaagccaaaaagguaaaaacgacaucaugugauacuaagccugggaacuguaaagaagauuuuaauacugcuuuauauagaaaucauuaccacugcuguucuuggccuuuaugcucauuucaguuagagcuugaauuuaaugagagugaguuugaacuggcaauuuauaaguauucaugcugcccuuagauaguagagauagauuaacuacaagcuaucaacauauaauggaaaacuacuacgaagucuguguucuaugacuguuggguugcuaguguaacuaauuugcaagaaaaaaaaucccugcauaacuagagacaaaaagggaauuuuauuuauaaauacaguugaucuuuuauuauuuucauacucugcccccauugaagaaagguaguguaaaguauuugguggcuuaacaaauggacugauuguauaacaauaucagugcucuagagucagugaagucuucugagcauucuuccugacucacuauaauuuggggccucaauguacaaaauacgaauagaacuugaaccauauaguauugagguuucuuugauacuuaaaacaaugauguauggcccacuuuguauuauauucuuuagcaguggcuaccaacuuugucuuuccuauucacucaauauauucccuguucgugagggguagaucuuacauaguuugauaaagacccccacaucccuccaaccccucaauacucagcaaugaguaauaugauaggaggguacuugugugaugugguuuauuuauuuuuuuguuucuuuuuguuuuuugggugugugugugugugugugagagagagagaugugguuuaaucacucuagugauuccauuuuuucuuucccucuuaggcacaaaacagauuuaaaguuccuuuggggacaaaguuuuacagagugaaagccguaucauggaauaagaaaguauaacuuauggacaaaauuaauacauucuaugacauuuuuuucugauuuguccugcagugcucauucaucacuccaaaaacagcaggccaucuuuuuaugcaaaagucagcgugacaauauacuucacugguguacaucguuuacuuuuuaacuggcuucauuuuaggaauaauaaauucaucagaauccuuggcugaauuaaaaugguuuuuguuuuuugguuuuuuuuuuuacccagacaacucuagaaaugcggaccaaacuacuucauuuucucaaagggcauaccuugugcauuguggcuuaugaugagccauauuaauugccuguuaaauauacacuagcuugaacuuagauguuaaauguuauuauuaccagcauuuguccuuuugugaaaucaguaucagaauacuugcacucuuuaacacauucuuuauaaaauguauaaauuauucagaacuauuuaaaauaaagaggaguguuauugcaugcugauaaucauuuugaguuugccucaguagauacuaaagcaaauuguuucaguuuuuuuaaaugcccuuugauguuucaaaaaaaaaaaggaacuguaauuugauugacugauuuuaagaucagccauaaguaaucagcaaucuucaaaagcacuuucaguggauuggucaucuggguucuaaagggaagagucugugcuacuaaccauuucaaaugcagacucaaaccuucccaacaucuuuaugacucuagaauaaucauauugaugaaaucguaauucaugguugaguuucagaacaaaagauauucauugcacauuaaccauuuagaggucauuuaaauaacaaaauauuguauuguaaaagaacuguacaauuuuaaaacaauaaagauuugaaccuguaaaugugugugccuuuuaaagaaggauacauuuuuaauauauuugagugauugcugggaagugugaaaauauuguuauguaucauaucaaagagaaacauguuuauuacaaaaauguucuuuaacuauauacuauguaacaggguaaacaguguuauguagaauagaauuguguaaacuagaucuuuagagaaguugccauugagcaaaguuauuuaaaugaguuaguugaguuggaugagaauuguuugagguuuguugcuagagaacaauaauaaaauaauucuuuuucagaaaauauuuaauuucuucauaaaaauaaguuaaauauuuuuuuaaauauguauaucuaauaguacaaaauggaauaaacaucauaguguauagaaaacugaauuugacaaguuaaugaauaaaugaacaaaugauuuca

SEQ ID NO: 191090 - RNA, 132247 nt, Homo sapiens
gaggggcggagccccggcccggaggucugucaugcuguucccgcuccagguggccgcuguaaccucuucgguccgcgacgauccucuagagcacugugugucuccccggacgcgagcccgcuccccugaguaagagucagccagccgcggauggggagcgugaguggcgagguguggccuggggugguguagguugaggguggaggguccuggggcugcauucgcugccccggagcgggggcaggggcaguggcucccucggggcguaggucucgaggcaacuaggccggcgacgugccagaguuacaggcucuggaaucugggggugggggugggguuucuugucggcagggggucucguggcggcugggugcggugggggaggugcccgaguuaaggguguggagaguugggauuucgccgccgugaggccggcaucggugacuacgaguuaugaggguugggggcgggaguucugugagcaggggucuugcagcugccggggucggggagguucccugguuacacgguccggauuccugggccacugcggucgcugcugcccgcgguguuguugauagcugguugccugacgacgcuuccuagucagccaccuccagggcccgggggcgagcgguuccuugguucccaugcgccuucucuccccaacggccaggcccccccugcuccgucaagccuccccgagcgccuuucuugccccucggugcuuguuauuguuaacgugggagcgcuugugcgcacugcuuugcuaguaaaacuuauuuaaucuucaccguagcucguagcucguacuguugugaccguauuuccccccgugauugcccgacugcuugagcuugaaccucuuguuucuaacugccuugauuuuaggaaucuuaugugggacucaaauccaguugucaguacauguuauuaaugggacucaucuuuugagagaggcuagcucucaagauuguaggauuaagacgcuuaacuaggauugcggggaagacuaaauucugaaguaaaccaucaccuacuuuccaaacaccuuggaaaaugcaggggcuuaaaagcaaccgauaggaauuuauaaaaagccuaaauuaggcuuuauucugugugaaggaaugacuuguaauguugacaagcuccauggaagcuauugagguauuuucuuuucuccauaucauucuucucccuaggaggucgcuagcuuucuggugauuaaaugucugcugaaaugcuccacaaggaucaaguuuuuuuguuuguuuguuuuguuuuguuuuuggagacagggucucgcucuguuguacaggcuggagugcaguggcauuaguagagaaggggguuucaccuuguuggccaggcuggucucgaacuccugaccucaagugauccguuugccucggcuucccaaagugcuggaauuacggcccugagccauugugcccguucaaguuugggucuucugccagauggccgccugggagggagugggugaguuuagacagaguaaauugaaacaggcuacuuucgguacaguuuuucucagaugaagcuuucagacaaauaugaauuaacuguuacacauuugagcagauuucagauuauccuuuuaacaucauucugacuuagguucugauguacuuuccugaguggcaggcaaggguguuugagcaaguguuucagcaauuuggcauaacccaaaggcuaauuuaugcuacugccguuaaucaccauuaaggguguauuauuaauagcuacugaaagacuucaacaugguuuuauauauuuauucacucucucuuuguauccugucucccagccucccucucuuucccccagcaacaguauuuacaucuuagcaauauuuagggaaauuugucaaaauuuugguguacccaugggaggaaguugcucauguggaugccaucugccaggaggaagauggagaaccuuucauucgguagauggaucucuggauggaugagaagugagaaacauuguccuggucacuuugucccucccuuucuucuaaagcucuuucacuggccccuccccccaccgcacauguuaucacacuuugacaccuguucuagguccuguuccccuacucuagggucucuuuuuccagacaaaacucuucucccacagccuuaaugauuauuuuaaacacugcuagaucuuuauuuccagccuggguucuauucugaguuguagacauuuucagauugauuucuucguaucuccgguguauccauuauggauaucucacauucagcuccuaaaccccugucagccucuguagcagggggcauuaucuuguccaaauuugaggacaagaaucauguuuauauauauacauauauauacacacacacauauauacacacauauauauuuguuuuuuguuuguuuguuuguuuguuuuuugagacagagucucacucuguuacccaugcuggagugcaguggugugaucucggcucacugcaaccucugcuucccauuuucaagcaaugguucugccuccugcuacacccagcuaauuuuuuuauucguaguaaagaugggguuuugucauguuggccagccuggucucaaacuccugaccucaagcgauccgcccgucuuggccucccaaagugcugggauuacaggcgugagccacggugcccagccacauuuuauauuuuugacuacgccagccucuagcacaaugucaugcuuuaggagggaagucauuuuccauuucucaugcucccauaguggggaggaaauuuguacuccacuccuugagagggaaaaggauaggagcaacauuuucccaucuuuuugugacugauggauuugggagaaggaauugggcaaacucaguuuuaacuggguucuguuuguuuauuggauuugacuagacuuagcagaauggguaugcucuggucugcuuauaucuauaugauaagcauaaagagccaaagguuaagguuuagagauguugguguggauuaugauaaccaaguaucaauuauugauuauuuaaaucucagcauacuuuacguuugcaggcucuguuuuuuuuguuuguuuguuuguuuguuuugguuuuugagacaagagucucgcucugucaccuaggcuggagugcaguggcacgaucucagcucacugcaagcucugccucccagguucacuccauucuccugccucagccuucugaguagcuggaacuacaggcgccugccaccaagccuggcuaauuuuuuguacuuuuaguagagacgggguuucaccguguuagccaggauggucuugaucuccugaccucgugauccgcccgccucggccucccaaaguguugggauuacaggugugagccacaacgcgcggcugcaggcucuguuuuuaagagguaaaucuucauauaugcaaagacuguaaagauacaaccauaaacaauaaaagaauugaucuguugauuucuuuuuuuuuuuuuuuugacagaguauugcucugucaucgaggcuguaguacaguggcgugaucugggcucacuacagccucugcuuccuggguucaagcaauucuccugccucagccuccugaguagcugggacuacagaggugugccaccaugccuggcuaauuuuuguauuuuuaguggagauggguuuugcuguguuagccagacuggucucaaacuccuaaccucaggugauccacucuccuuggcuucccacagugcugggauuacaggcaugggccacugcgccuggccugaucuguugauuucuaaguguuagguucucugucauaauuuuuauaugcauuauuuucuuuuuucuucauaauauacuagaauaaaugauauuucuguuuuauagauuaggcauagagcaguuaaggaacaugcuugaggucauucauguugagaucaauaagugauagaaguauauuucaaacucaguucuuucaauuaaacuauuuuccugaaaacuguuuaucaucuacauacuauguacacagcuacuggagaaauaauacuuggccaugaugucuugaaaaaaguugugagugacuuuauauuguagagugucauauauaaauaaucucauuuagguuucuuucagcugauuuauuuuuggcaacuuaauccuuaaauuauaaacuuucuuacucuauauuguaccuaugccauauuuauuaacccagucucugugauucaccaaguaauucuugaauaauuguguaguugaaauauguuuucuguaaguuaccacaugcuuuuaggagugagaaaaagaaaaguggccgugauaucuagaaacugguauugcuagaaacuagccuggcauucacaguaacuuuguguuuuucuguugaagauaaacuauuguacagaaugucaacaucagauaaggccgcucugugucuaugauggaucaagacaaaaacauuccaucagugucuccaaacacagacaaaacguaaauauuguccaagaaccgagauaccaaacauucccuuucccagcugaugugaaugacuacugcuuguuuaccaguuacagcauuagccucccccuauauuuuagauuuauugagugguaccaucauagaauuaaccccacuucuaacaguguucaauccugagcaaagcuccacuuccucaaauuaagccuucccccaaaucacccaacacauauaagucuuuuccaauacccucuuaccacgauaccacaggguuccccaugguguguguucuccgugcauuccuuaaugcaaugaguaguacauccaacuuaacugugguaguuuuccugguguucuuuggcuggagaucauuaccaggagaaagcucauuagugucuuugacucuuuaauauuaaagucauuauaaucuaaucagauuagauacaggaaaaauuuagaaaugauuagaaauguacuuauaucucggauaaaucuuauguuuuaguuauggcauaugcuauauuuacuaugguuguuuaaaaguauguuuuauuuguacuuuuuguacuuuugauuacuguaaguuaaaaucaguucuauaauuuauaauguuaaauaauuacaguaaagagaaagauaagcaucuauaaauucaagagggagaucuuucaaagccugguuagaacaacauguaaaugaacauguuaaauuaauaauuguuauuaggugguauggaaaccuuaguuccaugugaagguggcauguuacuguuuuuuuuuucuuuuuagauaaaugacauuucuuuuuuuucuuuucuuucuuuuuuuuuuuuuugagauggagucucacucuguugcccagacuggagugcaguggcaugaucucggcucacugcaacuuccaccugccugguucaagcgauucuccugccucagugucccccgguaguugggauuacagguauauaccaccaugccuggcuaauuuuuguauuuuuaguagagacgggguuucgccauauuggccaggcuggucucgaacuccugaccucaggugauccaccugccucacacucccaaagugcugggauuacaggcgugagccaccgcccccaaccuagauaaaugacauuucuguuuaaauucugugcaaaauucuauagcaaaauauaugcguuaucucaucauuuuauuccuaucagacauagaauauuuagggaagauuagaggauuuugaggauugauuguuuuaaacaugaaaacuuguuugcuguugaguucagaauuuuuacuaggaaaaaucuuucgugacuauuagcaaauuaaaaauggcugaaauaagucgggacgguggcucacaccuguaaucccagcacuuugggaggccgaggcaggcggaucacgaggucaggagauugagaccauccuggcuaacacagugaaacccugucucuacuaauaauacaaaaaaauuagcugggcaugguggugggcaccuguaaucucagcuacucgggaggcugaggcaggagaauggcaugaccccgggagguggagcuugcagugagccgagaucgcgccacugcacuccagccuaggugacagagcgagacuccaucucaaaaaaaaaaaaaaaaagcugaaauaagcugagugugguugcuggcaguuauaaucccagugauucugguggccaacauggaggaucacuugagcuuagcaguucaaaguuacaaugaacuaugaucgugccacugcacacuagccugggcagcagagcgagaccucaucucuaaaaaacaaaaaacaacaaaagaaauuggccagaauuuaucaacuuuuguugauuugaaguauauuuugcuaaaacuauauauguaaauauauauauauauauauauuucuauuuuuaguguuuuuuuuugagauggggucuugcucuguugcccaggcuggaguacaguggcaugcucauaagcucacuguagccuugaucuccugggcucaagugauccaauccuccugccucagcuuccccaauagcugggacuacaggaugcaccacuaugccuggcuaauuuuauuuuuauuuuuaguagagacaagaucuuacuauguugcccaggcuggucuugaccuccugcgcucaagugaucccaccucagccucucagagugcugggauuacaagugugagccaccaagcccagccuacggcuauguuuuaaaaucaguguuucuuuuggcauuacauaauggcgugaaguuuacauuagguacuguuuaccuguuauaaguuucaacauauucuuuuagguaaagccugcuuuucuacaaugauauauauauauauuuuacaaauuauuauugucccaaacauuaaguucaggggauacuuuuuuucuuuaacuugcuugcauuugauauuguuuaccaguucuauuuuguaccucuuuccucuuuuccucaacuaauuaugcugauuggguuuguuucauaucccuguuuuaauuauuauuuaauuauucccucuguuuuuuuuuuuucccccagcuucaauucuucugucacucccucaagugaacauuggcuguuguuuaguucugggucaucucucuuuuucccucccugugcucauuuacuguggcuucaacuguuaccuuuaaaauacauaguuaauguaguucauuuucuugaauuugaaucuugaauuucuaaccgucuacuguaaauuuccaguagcacaucuuacuagcuccaacuuaacauauguaaaccaaaccuuucuaaaucuuccaacuugcucugacuuacuucuguccaagauucuauccacauuuagcuuccaggccuuaaaacuuugaucauuaguggcuucuuuuuugucuacguacccaauuagaugcuaacuuuaaugggacuuuggaagauguguuuggaaaaaaauucuagguuaaaugaagaaagguuagucuuuucaaaaaauggugcuggaauacucuauucauaugcaaaaaaguugagccuugacacuuacagauuugcaaaaauuaacuuugaauggaucacagacuuaaauguaagagaaaaaacuaaaaacuucuaaaaggaaacauaaaagaaaauauuugugaucuuggguuaggcaaagauuuuuuuuagcugggcgugguggcucacaccugugaucucagcacuuugggaggccaaggcagguggaucacaaggucaggagauugagaccaucuugagaccauccuggcuaacacggugaaaucccgucucuacaaaaaauacaaaaaauuagccaggugugguggcgggcgccuguagucccagcugcucaggaggcugaggcaggagaauuguuugaacccaagaggcggaggcugcagugagauugcgcuacugcacuccagccugggcgacagagcaagacucugucucaaaaaaaaaaaagauuuuuuuuagauaggacacaaaaaguacaaacaaauuuaaaaauugauaaauuggacuugauaaaaauuauaaacuuucacuguuaaaaauauaucaagaaaacuuacaaaccacagauuggcagaaaauauuuuuacaaagcaaguuuuguaaaauauugcuuuguaaaaauaaagcaaguuuaauaaaugacuuuuaucaaguguauauaaagaaaucuuacaauucaaugguaauaaaacaaccugcugggcuugguggcucaugccuguaguuggaacacuuugggaggccgaggcaggaggaucacuugaguccaggaauugaagggguaacauugagcuaugaucauaccacuccagccugggcaacguagugagauccugugucugcaauaaacaaacaaaugaaaaaacuagcuggggaugguggugcuugccuauaguccuagcuguucaggaggcugaggugggaggauugcuugagcccaggaguucaaggcugaagguguacuaugauggcaacacuguacucucuagccugugaaacaacgagagagccugucucaaaaaaaaaaaaaaaaaaaaagaaagaaagaaaagcuaauuuuaacaaaagggcagauuugaguagauacuuucccaaugauuauauguaugguaaaaaaauagaugaaaagaugcucaacaucauaguuaucagagaaaugcagauuaaaacacucagagagauaaccacuaaauaaauacacaauagaaugacuaagauaaaaaugacugaaaauaucacgcccuggcaaggauguguagaaauugcaauugucauuacaacccacauacauucuuauacauuggaauguaaauaugguacuuuguacuuugaggaacaguuuagcaguucaggaauuagacaacaucuugaccauauaauaaaaaauaacaucacuaacaaggggcagguaaauaucacgugccuucucuuugugacaccuuaaaauuucaccuaauauuucuggugagaaugcauaaucuaaauuuagucauuaagaaacaucaggcacacccuagaugagggauguucuauugaaaaggauguucuguuacacaggauucuuuuaccuguguaaauugguaaaagacaaagaaagaugguagagauagauauuccaaauuaaagaaggcaaaagagauauagcagugaaaugcaaucaguaccuaacuuagaugggaucccgaauuagaaagagaaaaauaggcuguaaaggcugcuauugagucaguugacaaaaguggaauauggacaauagauuaaaaaaucaguguuacaaaaguugauaauuauguugagguuauauaagaaaauaacccaauucuuaagacacacacacugaagagcuuaggggcaaagggcuaugauauauauacuuuauucucugaauaauuuuagaaaaaauuguguuuguguguauggagagaaugaccuugugugcacaagcaaaggaugaagcaaguggagccaaaucuuaauagggaauuaauaaagacucuuuguguguucuugguauuauuacuguaacuucucuguaggucagaaauuaucucccaauauuuaaaaaaaacuuuuuuuuugaagugcuuuggcuuaaggauuuaaagagcuuuuuguuugcuugccuucguuuuuugccggagagggaguguauauggaggguggugguaguuuuucauuuucuuuuuauuucagauauuuuaaaguauauuguaggcuuuuuggggaagcugggagaggcaguaggcaggcauauuuaugaucaaucuuaaguuugaauuucucaauuugauaagugagauugaaaacuaaauguggacuaagccuacauguugauaauuaggcuaaaaauacugugauauagauacgcucacugaaauuuuuuuuuaaagaaucugcaaaauggcugauaauuuggaugaauuuauugaagagcaaaaagccagauuggccgaagacaaagcagaguuggaaagugauccaccuuacauggaaaugaagguaaauuuaauaauuuucuuugaacauguuuuauuauaauugucuauggagauuacuccuguguaaauacaaaacauccucuucuaugagugagaaucuucuguuuuguaguaugcugucauucuaggagccugacuccagacaagauugcaguaauuuugaaugcaguuuuucuuuuguggugguuuauaucucacaguguuucucuuaucucuuguugaagaauuauuugguuauaaaaugauuaugagaccaguucuauuacaaagaacuuccacaacauaaacagaauaguuguaaaagcaaguuuauagucuaugugaaaaaauucaauuuaauuaguuuaaaaaguuuuuuugaaaucugaaaaagugaauuuauuaauuuauuuuguacuauuuguguuucuuaauauaaauuucuuaaaauaauugcuuuuuuuuuuuugagauagaaucucgcucuguuggccaggcaggacugcaauggugugaucucagcucgccacaaccuccgccucccaggcucaagugauucuucugccucagccucaugaguagcugggacuacaggugcccgccacuaugccuggcuaauuuuuguauuuuuaguagaguugagauuucacuauguuggccaggcuggucuugaacuccugaccuugagauccacccaccucggccucccaaaaugcugagauuacaggcaugagccagugugcccggccuaaaauaauuguuucuuaaagcaaugucuuaaaggcuuucuuaaagcuuuccuuguuuaggugaaacugauuuauccauuuagcaaauacuuacugagauuguguuagguauuaugcuaagcucugagaaugcagcacugauuagaguguuguggcaccuucucagggcucaguguauguaauaagauacagcauguaguuuaaucugugccauaugguucaucauaaugacaguaaccauauauauugguuuguucaagaugauccugguuuaccuguuguccaguguuuuuuucugguuuagcauuuguccuggacaaagguaccuuggcugagaugauaaauaauauagauacccugauuacaauuuuacucacauggcuaacauuuauugaguacuagcuauggacaaggcauauucuuaagagguuauauuucacaguaaucuaugagguaagugcuguuauuguaauuuuccagaugaguaaacugaggcaaguuaaguaaugagacuaaggcaguagaguugguggaacuaggcuuugaccccuggcagccuggcuucagugcuuguccucggaaccaacauaauagguugccuuucuuccagauaaccugucauguaccaggaaugccaaggacuuuauauguaucauuuuauuuaaucauaauaucccuguuaagcaggugaauuuuuuuuguuuuauggauuaagaaagugaagcucacaggaguuaaguaauuuguccagguccacacagugguggauucaggaguggaaccuuuaugcagcuccagagucuaucucuuaaccacucuccaguaguuaggaccagcuuacggcuuuggaguuacaugauuuggaguacauagcuuuaaagacaguuuuguuauaauuucuaacauuaauuuguacauaaauaauuuuaagucuuaguucaaguaucaccugcucagugaggccuuauagucccccagcauuucugggccuccuuacuuuaaucugcuuuuuuuuuuuuccauaaccacuuccugccacuaucuacauaucacauaaucuaaucauguguugaguucauuauguguccccccaauaguuuauaagcuucaugauggcagaaauucuucuauuuuuuaaaacucuuauacuuucaaugcuugacaaaauguuuggcacuuaaugggaacucaguaaauauuuguugguaagugaaugaguuaaauauuagaauaucuauuauaaaauuaaaauaccuuuggcuaauuccucaaaccuuacacuuaauuucuucuaugauguacuguguaauuucaucaagcuguuuaauuaaaauuugagaugaguuguauauuucaugguuuuuuuuuuccucuugcuuuuguaaacauuaugucucuuucagggaaaguugucagcgaagcuuucugaaaacaguaagauacugaucucuauggcuaaggaaaacauaccaccaaauagucaacagaccagggguuccuuagguaugucauuagaugugcuaaacuuauuuuaagauauccuuagugggcucuucugaaagagguuugucuugucagaaaaaaagauuuauuuggaauccuaguaguuuuucuuucuggaaucuuacguaagucaauauggucuacauaugaaauagaacucauacugaaaacuuuguacuuguuuuaugugauacugcauugguuaugauuuauggaacuuauagaagaagguguguauaacauaacuuaaaaauugaaaacuuugaaaggaauuugugugugugagagagagagagaagagaaacuuuuauuuguugauugaaaauggugaacuugcuuauuuaaaaauuaaagaaauaugcuuaaaggguacaaaaugcuguuuggugaaagacuauuuuaauuauugaugaucauguuggaauuguaaagaaguuaauacuguagccauacuaaugcuuugauuaugguaugguaugaaaauauuuggaaacuuuuuaccacauuuuggcuuguugguagguauacauuuuaaaaaaagaaaauguaugaauauguaaaaauuuuuguuuauuuauuaaagacagggucucucucucucucucucugucacucaggcuggagugcaguggcaugaucauaguucaguguuaucuugaacuccuggguucaagcaauccuccugccuuggccucccaaaguacuacaauuacaggccugagccaccaugcccagucuguaugaauauauauaauuuuuuuuuuuuuucuucaaggcugagucugacccugucgcccaggcuggagugcaguggcacgaucucggcucacugccgccuccaccucccagguucaggcgauucuccugucucagucucucaaguagcugggauuacaggcgcaugccaccacacucagcuaauuguuuauauuuuugguagagacaggguuucgcaguguuggccaggcuggucucgaacuccugaccucaggugaucugccugcccgccucggccucccaaagcugggguuacaggcgugagccacugugcccgaccuguaugaauauuuucaaugugcauuuugugauuuauugaugaugacaaacuuuuucacaaaaagaaaaucaacuaugauaaguucauuugauuaaagcauuguucucaaauggacagcuuuucauggauguagguauacuccuaaauuguuuuugugugccaguggauacaaggggaugccggccaagaaacuggauagucaguaagcuuugucucugcauuagacaaauagcucaaagugagugcccuacuuuuaauaucagauagauaacucuuuccauuuugaaucucuuauaaauuauuaauauacagcauuagugaacuaaaguauuauauauugguaaaauuuuuuaaucucuaaggcucucaauuuuuuuucugugaaauaaguuugauuaucuuccagcccuacguuuuuaugaaucuaaauuuuaauuauuccaagagauaauuuuuaaaaaguuuaauaguagguuaucucaagcacuaaggucgcuaagguuagacagaaucccuuuuaaauucuaggguuacagcuugcuuuggauugggcugugaugccuuuaugaccugucaggagcuacacuuuguuuccuuaucuuaugacaucuaucucaaaaagucguuaugggcgaaaguuaaauacgugaaaagauggcuggcacguaauugguacacaauaaauauuaauuucuuuuucuccuuaacaucuuuuuuuuuugagacaggaucuuacuuugucgcccaggcuggagugcaguggcauaaucuuggcucacugcaaccuccacuguccaggcuuaagugauucauccucccuccucagccuccaaguagcugagaccacaggugagcaccaccaugcuggcuaacuuuuuuuuauauacauauauuuucuguagaggugguguuucgcuauguugcccaggcuggucuggucucgaacucgcuagcucaagccauccgccugccucggccucccaaaguucugggauuacaggugugagccacuugugccuggccuuccaucuuuuuaaaaguaguuuuucgggcugggcgugguggcucacaccuguaaucccaacacuuugggaggcugaggccagcagaucacuugagaucaggaguucaagaccagccuggccaacaugguaaaaccccaucucuacuaaaaauacaaaaaaauuagcccagcaugguggcgcaggccuauaauccuagcuacuugggaggcugaggugggaggaucacuugaaccuaggaggcggagguugcagugaccgagaucaugccccugcacuccagccugggugacagagagagacuccaucucaauaaaaaaaaagaguaguuguuugaauugucuuaggaauuauucuuugaucauuacauucacauauuauggagaguuaacaguauaacugaaagauggugaccucugccuuuucauuaauugguguuacuucggccucugaccuaggcugacuucucaucuuauacauuccccgaguguccauaucugcucacagggcuuuauuuacuguuaguguguucaugacuucugaaucuguauccccagucccagguucuauugcgaacuugacccauaugucugauuuuccauuggacaucuguacuuguauggucauguauggcaugggcucaaaaucaaaauuugcaaaauuaacuuauacucuugucaaacuuucuagugcuccccaucucacugagcuggcugccuagucauccuugauuccugucuucuccugucuccuauaucaagcaguuacacaagucuaguugauucuaaugcauaaaucucaaguaaggucacucugcuguaaucccacugacuuucuuuuaugaggccucuguugucugucagauuuuuguaaaagcuuccuaguguuuuuggugguuguuuuguuuuacagucuagccccguguaucaaaucucuauguuuucuauauauuugcauaaaacaaaucugaucauauuagucucugcuucaaacccuuugauggcuucuuuuuuucuuauaugauaaauuugccaucuuaauacuucugcuagauuggguuggucaauccugucaugugcuucuagaggauuuguucuccucuugaagaguaguuuugaacuuauucagcuucucuuuuguaccacaaugacaugccaacuugcaucccguuguauuuccacugccuagcacagugcgcagcacuuacugcuuggaaaaguuguuuuaaaccaacggguuaauguccccauugcaaaaauaaaaccaauucucuuggguguguugacuuuaauuuucauggaaugcuucuuccauugccaucugaaaccauuugaugcacauggaauuuuauuaaagaacaauauauaauugacuaauuuuauacugcauaagcauuuaguuacugaccuccugccugauuaauuguggcuuuaaaauucagucaaauacauaguuucucacacugggaaaaauguaaaauuauuuggcaacuaaggguuuuccuuaaguggucucauuuaggaauuauaaaaaacaggucuaauauaggucagauuuggaaaugagguauugacuuaaagcacuguaacaucguaguuugaauaaguaauuaagcauaguguaguaaucagugauauauaaacuggacauacucauuuuauccaaugaaaacaaucuauugauagcucauaguacaacuaucauacaacacuaugauuuuauaaauucuuuucuguuagauacugaugauauucaugguuaauuccauguggcucuuucuaccaccauuuauaccuuucauaaaaggauuugagguagcguuacagugacuucugacaccagcuaccuggaguuggaccaaacuucacagguuaagggcauaggccuccacaagacugccuucacuucagacuccagcugcaaguucaagggucaccaggacaccuucaggucugaccaucuggcuauaaauuuggggguuuccccuauccccucaaguucaauaauucauaagaaugacucacagaacucaagaaagugcuguacuuauggucacaguuuuauagcauaaguauacaaauuagaaauagccaaagguugagacacauaggguaaggucugggacgguccaaacauuaauuaucuguuagucucagggagacauuacccuccuagcacaucaguaugugacaggauacagaauauugccaaucagccucaccuaagccugaguguccagaguuuuuacuggauuuuccuuauguaggaaugauugguugaauuguugcuccuuggcuugaucuccagcccugcuguauucauuccccuuaggccuggcugaugucacauggcgcaaaggcccaacccucaaaucacaugguugguuuuucuggcaugaccagcucccguuuuugucuucucuguagcauaaacucucuagggguucacaaugauucacuucguuaguauaaacuguuagguaugguccaagguacccacugugaauaauaaagacauucccaucaucugguaaauuuuaaggucaaacccacuaggggcucacaaugauuuacguuguucguguaaacuauuaggugugguccaagguguccacugugaauaauaaagacauucccauugucuggaaaauuuuaaggauuuagagguuaccucccagaaacuggagacaaaggauucaauuuuuuuuuucuuuuuucuuuuccaagccaauuuuuuaauuacacauaggauguacaugauuuaguucauauaagcuaaugaaaaaaugucuuuaauaaggaguuugucagaauacuaguaauauuaaauuaagagaaagucaccugaaagugaucuauaaaagaucuuuuaucucccuaaacuguuucuaggcauaauguuuguguuuauuucauuaaaagaaauucuuacuaacuuauuauuguuuaacaaccauuacugguauuauuaacaauaaucaauauuguugaaauacuuauauuaaucauuuaaaugcucccauuaaucuuuuaaaaauguuuugauacaaaugugucaaggucuuaaaacauguaguuucuccccaccacccaguuuuuuuaagggagaggaucuugcucugucauccaggcucgugugcaguggcaccauaauagcuuacugcagcuuaaaacuccugggcucuggggaucuuccugccucaaccucucgacuagcuaggacuacaggcucaggccaccaugccuaauuuuuaaauuuuuuguagagauagagucuugguauguugccccggcugguuuugaacucuuggguucaaacgauccucccuucucuggcuccuaaguaguugagacuauagguuugugccacugcaucugucuaguuguaguuuuaauuauuuguuuugagauagagucucgcucuguugcccaggcuggagugcaguggcgcgaucucggcucacugcaaccucugccuccuggguucaagcuauucuccugccucagccuccugaguagcugagauuacaggugccugccaccacacccagcuacuuuuuuugugcuuuucauagagacaggguuucaccaucuuggucaggcuggucucgagcuccuuaccucaaguaauccacccaccuuggccucccaaagugcugggauuacaggcgugacccacagcacccagccuuguaguuuuaauuaucauuccucuuugucuuagguuuauccuauuguaaacuaaaucacagauacucuucuacaguuuuuauucauuuuguaugagugaaauggguccuuguagugauaccuuuauagcugaaauuuaagaguacagugucuccucaauuagucacaucuccuuguaagucacccauuguguaaaggccuauuauuauuuccuauaauuugucuuuugauuauuuuuacauaaugcuuuuucaugguaguauaauaaugaaaagaaaguaaauguucuaugguaauuuguuucauagaguaauuaugaugaaugcucuguuagaagguaaauuaauuaugaagaaguuauauacuuuagucuuaaguauuuuauguaagccacaacuguuauagaaaccaaauacuucuaauuacuauaguucugaagcauaauguuaacuaucuuagggucauugauguuauacuugaugaagugacaucacuucaaaugacccuaaaaugacacaaaugcuuuacuugcugcuagauccaucagaagacaacaggcacaauaaguaagccucaccguguuccuuagcucauuaagucaauugagaugcuauuguuaaugcaugguuuaaaagaauaggauauuuacauuguucuauacaguuccuaauuuuaugucugugacuuaccucuaaugccauaaaauguugguacaagaugacaaaauaagaauuaaaaaguuaguguuuucuguugacuaaacauuaaauuaauaaaguuauaaauaacucagaaggcauuauauauuguuacuugucaagacaauuuuacaauacuauuugaauuaauagugaaaaacaaauacucuuaguaaauaaaaauuuaacuuaauaugaauaauaggccgggcgcaguggcugaggccuguaaucccagcacuuugggaggccaaggugggcggaucaugaggucaggaguuugagaccagccuggccaauauggugaaaccccgccuccacuaaaaauacaaaaauuagccaggugugguggcaggugccuguaaucccagcuacuugagaggcugaggcaggagaaucacuugaaccugggagguggagguugcagugagccaagauugcgccacugcacuccagccugggcaacagagugagacuuugucucaaaaaaaaaaaaaaaaaauauauauauauauauauauauauauguauauaugaauaauaauguaaaugaaaaugaauuauguuuuucuuuccauucuuccacauaaacccccaaguagaauugaaaaacagcaguaaaagccaccuuaaacuuacacuuuuuguaaauuuguaaauugcuuguuccuggaugggcagguaguguguuggcaucauccuggcagcauuguugucuuuuacuccuuggcacaauagaacauccauugugacccugugugacuagugauauguaacuuugguaacuaccucucucuaugcagucagaccgcuaacaggagaaauggaauauuaaguauaguauauuguucccccucaccuuuucucauuucuuccucugucucaggcacucauucauauauucauuugcagauuuauucaaugaacauuuucuuggguuaaaguuaugugccagcauuauaaaauugaauagcgcaugggccuugccuucauagauuuuauaguuuaguuuuauauaugauguuccauucugaacaugagaaucaaaacuuucucuccuuaggcuuaaauucuguaucuuuaaaaaaagguuuagauuccuucaaaaggaaacaguuccuuucuaggaugauuuaaaauuccaagcauauggaaugcuuuaguuucuuuuggaagagaguuagaagcauguguaagaggugucccuaaggaauccucuguuauacccucuaucaucaaggaguuaaauaggccagaaauguuuaucaagagaauuccaguguugauagcgguaaguggauuuuaguauucuguaagaauccauaaacauccacuuauguuuauauuacacuggccuuuucccugccugaaauguuucagugauguaguaagcagugauaugacacauucuugaaaaguucccaucauucagcuacauugugagaaauaaggcacaaaauggugauuuuuauaucaguuuauaaacuacagucaaauuuuauuucaucuauagugcucauagcugaaucuuuaaggaaaguuuuggccaggcgugguggugcaugccuguaguccuagcuacucgggaggcugagaugggaggauugcuugaggccaggagguugaggcugcaaugugccaugaucacgccacugcacucaagccuagguaacagagcgagacccugucuaaagagagagaaaaaaaaaaaagccaaguuuuauuuuguuuagaaaugauaauuuuuuaauacuauaguauuauguguauaguaggacuaaaaaagggaugaagcuucagaucugaauacucaucuaaugucuaugcuucuugacauaguauuuuauuauugaagguuugaaaaguauauaauuugauuuuugauagcuuuguugagauauaauuuacacaccauaacauuuaccuauuuaaaguguacaauucaaugguuuuuaguauauuuacaaguuguacagucaucauugucaucaucccuaaauguaauuugauuuuuaaauuuuguguaaggaaauacuacucaaauucgaaguuuuucuucaaaaauuaacauccauuuacagaguuucuguuugggaugaugaaaaaauucuggaaauggauagugaugaugguuguacaacauuguaaauguacuuaaugccacugaauugaaugcuuaaaaugauuaaaaugguagguuuuauauuauauacauuuuaccacaauaaaaauuaauauccauuuuuaugaaaucagaagugguuuaacuuuagaaguuuuuaggaauuucauccuaucugaaugcucuuugauacaaaaagaaaauuaaaaaaaaaaaaagaaaugugauucuaagcaacacauggcccuaauaauuuuuucucagaaacauguuauauuaaagauauucuuguaugcuaaaaaaaaucauguuauuaguuuuccuagacugaaaaugaugcauuaaaauuguuguugguauuuauuuuuauagaaauuaguguauaauuaagugaagauguaaagauaauuaguuuuucuuuaauuuugcuguucuugagaaagcaagaugccaaacaaugcuggacuacuugucuuaacuggaggaaaaagugaauauaaugcacacaugcauauaaauauguauaugauaauauaaaaguaucuguuuauaggugcauuaaaaaauuaucugcauggagacaagaaauaacaauguuuguuguucuggacaggagaacaggguggcuagggcucauggaugagaaugauauuuuugauaauauuuuugauuaucugaauguauuaucuauugagacauuuuaaguaaaaaacuuacccuaauccuacucuuggaauaagcauaauucuguuccuucuuacugugcuuuguuacaggaaguagaacuuugagauugguuugaaaaugaauuauacuaagaaguuguuuuuuuucuaggaauugauuauggauuaaguuuaccacuuggagaagacuaugaacggaagaaacauaaauuaaaagaagaauugcggcaagauuacagacguuaucuuacucagguaaugaguucuauuaaugaguuggguuuaauguuucagaauucagcuccuaaauuuguuuucauaagguauuagucauauguguuaauuuuuagguuuucagugguacuagcaaaguaguaguauagucaaaguuaaguggcauauaugacauugguagagaaaaaaauauugcugagaaccggugccauagaaugauacagacuuuugaccuuuugacuaaggcaguggauucuaauuuuaagugagaucguuaauuaugguuuuucauguuuucuguaaaguugucaugguuugaaguaguccaaucaugguuucccacucuucuacaccccccaacuauguauuaaaaugacauauggaguucuaguugcuaauuauuuuccuaugagccaagcuuauaaaauuacauuuaauuauuuagccacuaaagcuuuuguuuuaugaucucauguuuuacuuagcagaacucuugaguauuuuuguuaaauuauauaauggccaaaguaagguuuauuguaaguuuuaaauuuagguuauaaaauuauuuuaaacaauuaugauauuuguugucaucucaaaauauucuuuaguuuuuuacugcuuuauguuuguuccaaguguacaaaugucucuuauucugauuuacacauggagagaaugaacuuugacuuaauacacuuugucaaugguuuguuucccuugacuuuagggcauuacacaagggaaaagaaagguaggguugucugcaauacguccuccuucaguuuuuucuuucuuuuuuuuuuuuuuuacgaucuagaagguugcaaucauuugcauuuaugagauucaaaccaauuaggaaaacggguucauuugugauuuugagauguuugaauggcaccauuuuguauucuugcuuuuagcagaugacagcauacacauuauaauuuuccguuaauauagucauuacuuuugauuccugcuuugcauuuguguuuauugcuuucuuaugcauucuuuuugaauauucugcaguuaagucuguuuucagcaugcaauuuuuuauuucucaaauuacacuaaucacaguaagauuaauagaguaguagaauauccaagauauuugaacuacauguugugagaauuuggauuacucuguuuuuccaccaaaaucuauagauugcauuguccauuuauauuggaaaacaaagagaaacaguuuaugguuuuacaaaacugguuuuaaaaggaaucucacagauucaccauucaacuaacauauuuuaaacacuuauuaugaagauauaucagguaugcauccugucuucaagaggcuuagaauuuaguuguagagauagcauucauacgauucagaaagugguaacuacaagaaggauauaaugaucaagauaguccucauagugggaauuucuauuuugugaggcaaucuagauuugggugaucuggagagagaaucgaagcgagaaagcuuuucagauggaaagcauagaguaaaggaggaccuagaggguagacuuuagcuuuguaugaaugaggcauauuagguuuaccagccugacugggucagaguaucauucuuuuugagaguaguaagaaauaaugauguauauaggauaggaucaaauuagaaggcaguggauuuuuaacuuguuauauguaauagucagugaugagcaucauacuuucuuaaauagcuugugaagagcaugguaacuguguuuuaggacaguuaguucugcauguagagacucucauuguguuaaauugcugcccaacuucuuaacugauuuccucgcgcuaauuuucacuucacccuccaagcuauuuuccagaaugauucagucccuaacuuauuuaaauaugucaguauccucuaacugccuccaggauaaaaauucaaauuccuuagcauggcacaugucuuucguguuccagccugacucccugggcuuauaccucauuaucuuccccuucccuacuuuuucuuauuggguggaguuuuccucugguaucagauaucuaccauuuucucuuguagguuuugcauuacucccuagguaagauuuuuaaaaaggauaguggugggggacaugagaagaaauugccgucaugaaaguacaaaucuuuaaauucaaagggaugugaaggaguuuuuuaagauuuuuuuguuuguuuuuugguuuuuuuuugagacagagucuugcucugucgcccaggcuggagugcagugguacgaucuuggcugacuguaaucucagccuccuggguucaagcgauucuuuugccucagcucccggaguagcuggaacuacaggcguccaccaccaugccuggcuaauuuuuuuguacuuuuaguagagacgggguuucaccauauuggccaggcuggucucaaacuccugaccuugugaucugcccacuucggccuccuaaagugcugggauuacaggcaugagccaccgcacccggccaguuuuugagauuauuaagaauauagucggccgggggcacggcugacgccuguaaucccaguacuuugggaggcagaggcgggcagaucacaaggucaggaaaucgagaccauccuggcuaacacguugaaaccccgucucuacuaaaaauacaaaaaaauuagccuggcgugguggcaggcgccuguagucccagcuacucgggaggcugaggcaggagaauggcgugaacccuggaggcggagcuugcagugagccgagaucgcgccacugcacuccagccugggcgacagagugagaauccgucucaaaaaaaaaaaaaaagaauauagucuuguagaggagcacuauuuccuuaaaauuagagagacagucuuuuguucacauuugagaaggugggacuggaagggaaagcaagagaaaaagaaaacuacacagacuauagggagcuggcugcagcuuccuggacccccugaaauauguaugguuuccaagucccacucauaucucuuguggcuuccagacuuggauugcauggauauuugaguuuuuaaaaaaaaucaaaucuuuuaauuuugucaagaagaguuauuaaaacaaacaacuaccaucuuuuuucguguuuuaauuaauuuuuuuuuccugugcccuuccugcccagagaugguuuccuguuuuuagaauaaaagaugcuugaccaucuaaacacagaaaagacauguucucaggggaacaguuuuuaaauugagucaguuaauuaauauccccagcccagaccuccauccugaacuucagaguuuucuagcuggcugcauaauucacauuuucacuuugaaaucuaccugauaucuuauguagaccauguccaaaagagaauucuugauuucuguucuucccacccucauggcugauaaaccugcacuauccguagccuguccuuuuaauuuccuuuuugucacaguaauuauuaccuucuagcaugcuguauaauuacuccucauuauguuuauuauuucuuuuucauuuuccccagcuugaauguaugcuuuuggaggacaggaaucuuuaucuguuuuuuucagucccaaauguaucagaaaguuugggcacaugguaggcacucaguauuuauugaaugaaugaaugaaugaaugauuaaaauuuagcuuuuugaaaaaacucacuauguuguucuuuuuuuaagaauuaaaguuuuuuugguagagacaggguaauaaaaaaaaguuuuuuuuuuguuuuuuuuuuuaaauacucaagcuggucuugaacucuugggcucaagugucccuccugccuuggccucccaaagugcugggauuacagacaugagccaccacucccugccuauguuguuguuauuguuuauucuuuucauuuuauugaaaauuucaaacaucauucuugacccauguuuggaaugggaaauugcccagugaaggagugaggauguuaaaucuaucuuccugguuggaacuaugaauggguuuuucaugcauuuauaacucuacaaaauaauuagguuuauaguguacuucaguauauaggagguaaaaucacucagggaucuggucaugugucuuauuuuuuccuugucagguaaguuuagaguuccauacagccaacuuucaaauuagcuuuuguagcacaacucauuuguaaauucagauuuaaugacacuuuauuuauuuauuuuugagacagauucucacucugucacccaggcuagagugcgguggugcugaucuuggcuugcugcaaccuccgcuuuuuggguucaggugauucuccugccucagccucccaaguagcugggacuacaggugcgcggccccaagcccggcuaauuuuuuguguuuuuaguagaggggguuucgccuuguugcccaggcugguccgaacuccugagcucaagugaucugccugccucaaccucccaaccugcuaggauuacagguaugagccacccugccuggccagauuuaaugaaacuuuauuaaucacuuaguuuugcuaauuacuaucuuuccauaauguuuugaauacaacgcuauuguaguuaauacguuguuuugcgguuauuugcuuacaugucuguuucugcuacugaauuguaaaucccuugaauauagggaaaauauauuuguaucccuaccaucugaaaauaguaccugcauaguauuagaugguugcuaauugcuuguuuaaugaauaaauaaaaggcauggaauuaggcagguugacaauuauugauugauuuuauccuuauaaccuagugauguguagauggcauuauuucuguuuuauagacaaggaaacugaaaugaagugaaguaaauuauuccaaaguauuugacugcuaaguaacaguaccagaaaguuggagaucauauguauuuuuuuaccaauuggggaucauguguauuuuuuuuuuccaguucuuuguauuugcuuuacagcuuucaaagcgauuuuauauuuuuuguccuccuucauccuuauaccagcuuugguagguaggcagagcagguacuauucucauuuugcagaagaagaaagugucugucagaaaaguuaagugacuuccccauuguuacacaacugauaagugcuugggcuaguuguagauccuaggucuuuugacugcuagucuaaugcugccucuacuacacugcauuacuuaaaugcuuaaugaacaagauuggaggaacacauaaacaacauucauaguuuauaucuauuggcauuucaguagauauucacucacauaauuauaggaaaaauagaaaaaaaacuuguggcaugcauuaagauauuugugaggaaguuuaaauuugccuugagaacaaaaagacaguagagcacugauaaugaagaguacaugcuuagaagacgaaauugggaaauuuuuuuucaugcuucuaaucaucuugaaucaauagacguauauauugcacaugaaaauuaaggccugauuuucccuuucagggaguuguugauuggaagaaaauucucuuuuuuccaaaugcuuuugguauggucuauauagauuuguaguuucugucuucauuccauuucauucauuugcucugcauaauauaauacuaguuuagaauauagaaugcaaagacacauuuaugcaacauauuuuauaaaggcaauuagguaauauauuuuuuuaauguguauauauacagaaaaauuuucuaucuacgagugaaacagauccaucuacuuugggaguuucucuuccuauuggugagagguuaucugcuaagguagguggauaggaguaguuauuguggguaccaguuuuccgaggcaucaaaaucauuaaagaacauacugcugauuuaaaugcaaauggaagaucacaucauuuccccacacuugaauauauuucuauuucaaaaauccguggagucauauuuaugcuguuuaaaaaaauuuucuugaacacaacauuuguaaccauauaauuuuauauuucuuuaauauguugauucuuuugcuguauucaguuauacuuaacugaauauucagaauucauuuuuuucagcauugauuucugacuauaaaguuuaugcuauguaacacaguuauuggaauaaguggaugugaaauuauagugagcuuuuauauagggugaggguaaggguucuuugaaugugugauucugacacuccauuaauacacguccauauuccuuagagaugaaaguaauaaagcacuguacaccucuuguagugacucaggucucaccagaguauaucagagaucaugaaauaguauauaagacaaaauggacaguuaauaaauuucaaaagacagaccuaguuucuuuuuuuuugagacgaaguaucaccccguugcccaggcuggagggcaguggcggggucuuggcucacugcaaccuccaccuccccaguucaagcgauucuccugcaucagccuccugaguagcuggaggcaggauuacaggccccugccaccaagccccgcuaauuuuuuguguuuuuaguagagaugguguuucacaauguaggccaggcuggucucgagcuccugaccucgugauccacccgccucagccucccaaaguacuggcauuacaggcgugagccaccgcucccagcugaccuaguuucuuuaguacuuuuuuagauuguguuguuuuagcgacacgggaguauuaaaauuuaagaacauuuuuuaaucauauauuuauguuuuaacagaacauuucauuauaauauuuuauaaucugugauaauuuuucuuuuuaaguuuaaaauauaaaggaucauuuuuuaaccuuggaaagcaaaugguuagcagcaggugcuucaggggaguggguugggcauuaggagagggaggugucccugagaaggaaagaaggaagguaaccccaucauaucucuuuggaaacaugcuaaugacagaucuccuggcaaacacaaucaucauauuuacuagugggagagauuuaucucugaaugcuuuuggcagaauacaccugguuugucuaggauugcuguugggaaucaaaccuggaaucuauggauuuauguggcauggcucuuuggaaaaugucaucuaagcucuguuaacuauuggaguguaaaauggagauguuucaugaacgaagcaacucccuucuguuagagaccucauguauuaauggaccaaagcauguagucaugcauauucucaugugacaagaaagaccuggggagcuguauguguguccucaaaccucuuccgacuucucccaugccuuucagugacaucuguccuugaaauuauuaguaaagcuugauucuggguaagaguucugauauguaugauucagauuugacauucugauaggacauugagggauuuuuuuuuccugaaguugaauuuuaacauugccuuuugauuuuuauuuuaaggaaagguugaaacuugaacguaacaaagaauacaaucaguuucucagggguaaggaagaauccagugaaaaguucaggcagguggaaaagaguacugagguagguuuugcuuuugaauuaaaucuguacuacuacuaccacagguugaauauuuuguacuugaaaagcuuuuucuauuuuagacauuuuacuuuuuuuuguaaauacuugcaaaauuaagccaaauuaaaccaaacacaggacauuuaaauauuuaguuuuggaaguuauuuuaucucauauugaagaacuuuuaacauuuaauuggggagauuuaauuuuagagaucaguuuuguuaagugauuuucauuuauuuuuaaaaauuuaaaugaguuuuuaugaugacaauuccuagcuauguuuguuuuuuucaaaauuuaaggaucaauuagccggacaugguggcaggugccuguaaucccaacuacuugggaggcugaggcaggagaaucgcuugaaccugggaggcagagguugcagugagccaagauugccucacugcacuccagccugggugacagagcgagaccuggucugaaaaaaaaaaaaaaaaaaaaaaaaaaggaugauugauguaucuggggccaaaacauuuaccacuuucuauauccuuuguguugagaauuuaauuugaaauauuuugaaguaauaucuccugggauaggaauuugcauuuaguuuauccucucuuuuuuuuuuuuuuuuuuuugagacggagucuugcucugucacccaggcuggaaugcaguggcacaaugucagcucacugcaaccuccacuuccuggcuucaggcgauucuccugccucagccucuggaguagcugggauuacaggugccugccaccacgccuggcuaauuuuuguauuuuuaguagaguugggguuucagcauguuggucaggcuggucuugaacuccugaccuugugauccgccugccucggccucccaaagugcugggauuacaggcgugagccaccaggcccugccacagaaagguaaaauuuucuugaaauuuuuuuuucuaaaaaaauauaugggugauuaauguugccuaggcuggucuugaacucccaggcucaagcaauccacuggccuccaccuagaauuuuuauguaauaagcuuuucauaaacugcacaauuugauggguuuuagaauauguaaaccacaaucaagauaacgagcguauccuguaucccccaaagugguucugggacccuuuggaaucuguguguccucacuguccuccacucauucccauacugucuccagaucuuccugaccugacuucuaucacccuagacuaguuuacauuugaucauuuacuauaaauggaucauacaggauauacuaguuuuggagauauggcuucuuucacucgguaugauuauuuugagguucauuuguguuguugaauguauggaugauucauuccguuuuguugcauaguaauguuccauugcauggcuguaucagcuuguuuauccauuccccuguugauggacauuugaguuauuucugguuuuugcuauuacaaguaaagcucaugugaacauuaauguaaaaacguauauauauauaaauauaugggugauuaaauaaacaucagaguugaaaugauagacuaaguauaaauugaggguuuaauuaccuuauaagagauaguuucuugucaaguuuuguuucuuuuuucuuuuuuaauugaacagcccaagagucagagaaauaaaaaaccuauuggucaaguuaagccugaucuaacuucacaaauacagacaucuugugaaaauucagaggguccuagaaaagaugucuuaacuccuucagaggcauaugaagaacuucugaaccaaagacgacuagaggaggacagauaccgacaacuagaugaugaaaucgaauuaaggaauagaagaauuauuaaaaaagcaaaugaagaagugggcauuuccaaccuaaaacaucaaagguuugcaagcaaggcuggcauuccagauagaagauuucacagauuuaaugaggaucguguuuuugauagacgguaucauagaccagaccaagauccugaaguaagugaagaaauggaugagagguuuagauaugaaagugauuuugauagaagacuuucgagaguguauacaaaugacagguauuuacaacuucauuuuuauuuuauuugcuuaauauagcaaauuaauuguuaauauuugcuguuguuacuuuuuaucauuauacuagggagaagcaguuuugauuuaucauaauuaauucuaagaugcugucaguuuuaagaugcaucauuauuuuaugucccacugaggggaaaaagaaaacacucaaggugggggcccuguuguaaaguuggaaaacugaaaggcuacacccuuuauguaaaaguaugugaauuggaaguagucauucccacagaaagggacagagaggaaauguccacaucccaaccuuggcagugaguagagaguaaagauacaaacaaccuuccuugagaauuugaaguguaaauuaguaaugauucaaguucacaguccgaauucauacugccaguagcguccaaagaaaccuugaggcaagaauucagaguuuucucaauucauagugcucuuggaugaggggaaaaauaacucugcaauaacuugacauaaaaccaggucauuggcuguucugacuuccaauauuaaaauguggccaggcaugguggcucaugccuguaaucccagcacuuugggaggccgaggcgggcggaucgcgagguaaggagguugagaccagccugaccaacagggugaaacccugucucuacuaaaaauacaaaaauuagccaggcauggaggugcgcaucuguaaucccagcuacucagaaggcuggggcaggagaaucacuugaacccgggaggcagagguugcagugagcagagaucacgccacugcgcuccagccugggcgguaaggugagacucugucuccaaaaaaaaaaaaaguguggcuggggguugugccucacgcuuguaaucccugcaguuugggaggccaaggcaggcagaucacuugaggucaggaguuugagaccaaacugaccaacauggugaaaccccaucucuacuaaaaauacaaaaauuagccaggcguggugggacgugccuguaaucccagcuacucgggaggcugaggcaggagaaucgcuugaaccugggaggcagagguugcagugagccgagauugugccacugaacuccagccugggcgacagagcgagacucugucucaacaacaacaauaaaaauaaaugaauaaaauaaaacgugugaaaaaaggauaccuuaaaauagaugaaauacaauuuauuccuguagucauaaguuuuuucagucagauuuucagaugguuuucaguuccuuugaauguuuuugugacacuauuuauaauuucuuaacugcuacaaugagguuuuauuguuguauuuaucauacauugauacuugccauaguuuaaccuaacuuguuuuggagauaggaauaccucagggucucauauuugucauugacuuguuuacuugacaaguguuaauacauuuugaguagcuuuugggaccugcuuuauuugcuaguccaaauagauuaguuuuuaaguauuuuagaaaauguuuucgggguagugcuguacauucaauauucuaacuauuaauuacaauacaaagcuuuuacaguucuuugucuucuacauucuguagcuguuauguccucacacaauauuuuuaauauuuaccuugauuuagguaauuugaaugaaggauuagaauuuggaaauggcaauuauaguuucucugaucugaaucuaauuguuuauacuucagaaaauucuccaaauccuauaauguuauauuugaaaaugcuuauauguaagguaauuaaaggcugacuaaacuaaaauaauucaguuggggaacugcaaguaaucuuugacucuuggugauaaugucuccuuuguacaugagaacuucuuuucccuuuaugguguuuguuuacguuuagggugaauguaaugcauacccuuuuaaguuuggaauuuuaagaaacauaaugguugcuucuuuguuuuuuuuuaaucuauuacuuuuauaauuauauccugugauaauuuuauacaugaacuaacaaaugaauaucauucuauuugagaacucucauaucuucuuauguaucccaaaauaaaaugaacuccuucaauauaaacuuuuccaaauacuauuuaagaauagauuaaacaugagguugagugagaauaauucuuguuaaauacuuuaaaguguuucuucaauauauaaaucauauuuuuauuucguuuuuauauaaacucugacaucuccaaguguuuuuucuuaugugucucuuuaacaauuuaauuuaaaaugggauuucuuuauuucagauuuauagauuccuuauuuccagcaaaaaaaaaaaaaagaccagucauucaguaguuuauaaauagacugguuuaggagaaaugacuguauuugugaaaauuuugagacuaaagaaauguggaacugaguuucaucucuugcuccaagcauuuauucuuaacauacuaugcaaucuugaucagaaguucuugacaaaaaauaauuauaauguauuaugagaagugcacaguuaauuuuccuucauucuucuaaguuuucuuuggucuuuuuuuuuuuuuuccuuuccuaaaagucagcaucugguaaauucuaguuuugguuuauaauaauuuuuuauuuuugguuucaauuuuucucuacccuauaaacguuuacuuuuuuuucauauaccauaauuauuaaugaaauauuuccccauacuuaaauaugggaaagcuaaaacuuuucucagaaaaugauguugccuuccuaaacucauaucaugaaaucacugacagcauucuuaauuaacaaggugguuaacacuguaauugauaguugcauucuguguguguauguguguuguuuauuuaugcauauuuaccaauucaaguaaaauuuaucauguuuuaggagcuuucuaaaguagaauguaauagcaugucuuaagauacuuugaaauuuauaagcucuauuuaaauauaguaauccuagucuuauuuauuaacuugaacuguagaaguuaauauuuuacuuuauuaucuuuuacuuuaaccaauguuaaugaauaaaagaaguuuuacuucuuaauacccaaagaaaccagguacagaguagaugggguugauaauagaaaacacugcuaccaaaguaaauauaaaaauugggaaagaauggaaaacaaagagaaaaaugauuguccacaguuaacaucucagaguguuucauuagcuucuuuuuuuuuuuuuaaagauuaacauguguucauuuuuaggauaaacuuggccuguacccuauaccugguuucuuuggguauuacgauuuuuaccugaucaacuagaguuguugacucuugucuucaaggaaauagggagaaaaauauuuuuuucauuuaaaauaccuuuuuuuuuuaguuaguaggauggugaaaccauuuugcaguuauuuuauucccucaaucauaucugauuugcauuucaaaguuaugaguucugucccuuugugacaaaacccaacauguuaaggugugguaagugaacuuauauauuaaaagccauagaauauuuagauagauuuucuauggcuauaccacccuggaaugugccugaucuuguuugauguuggaaacuaaguaggcuuggaccugguuaguaauuuggugggagaguauuuagauagauuacuuuugggucacaaggauagucuuaaucugguacucucacagugaaacauaaagggguuccagggacaaacugaaccuaaacagaacuccugaacuuugauuagaaucaaaugguucuuagacauuuagugagugcauuacuuuuggauauuaucaucugucuguuuuccuuuaauguugagaugauugaauagagauguagccgugguaaaaccacugcugauucuuacuaguugcuuucuucagagaggacuuuuuuuguucagaaaagguuacaacaauaaauuguaagaccauaaaagcuguuuuaagugaacuaacagagcuaguucugggugauuaaaugcuaaauuuauuagaaauauaaaggccaauuuaguaaaugaaggaaaugccauaaaaauuguagggauauuuuaauagagaauaagguggcuaacuuaccaaacuauaguuugucuuuucagcuuaauuucccuucaagguuucuuuuuuuuaggucuuacauugguaauuuaaaaaaaauuauaaaaucuguauuuguaaacaguaauucuuccuugacuuaaaaaagauaaacaaaucauaugucauuucauaaaauugaauaguaucccuaagauuuuauuaucuuuuuagugaaaugcuuauuucugcucuuuuuuagccucuuaaacauuuuucggucuugaucuuauaauuauuggugacagaguggacuuuuauaaucuuguuaaugauuuuuuucuucaaugaaagguauaccuuagaacaucuuucauaugugcugcucacuaggaaaucuuuugauuuugcuguagauuuuagcaaagagaccuuaaccuuauacauaaauaaaaucauuucuuaaauuaauuuaggaugaacuuugaaaaugaccucuuguguuuaugguguuugcuuuacuaucuauauacacugaagagacuguaaaagauuuuuuaguguggauaccuugggugcaguggugguauaaagauaagcuagaauuauuaaucuaaauauuaucuucagaaaacuuaacuaauaauuaaggaagccacaagcccuauguuaauuuuagaaaaagcuuuuguauauuuaacuggccuuuaauucugggaccccaaguuaugcuuuuaagaauuuguaacuuuaaauuucuauuuaauuuuuuucuuuuuuuuuugagacagggucuuacucuguugcucaggcuggagugcagugguacagucuuggcucacugcaaccucugccuuccaggcucaaacaguccucccacuuuagccucccaaguagcugggacuauaggcaugagccgccgugcccggccucuguuaaaaaaauuuguaauaaagauuucuuuauuauuaaagaauauauauauauauauaaauaaagauuauuuuuauauguaauuuuuuuuuggccuagauaccucuuuacuacaccagugaauuuacuuuuuguguugugucauggguucucaagaaaaccucuagguugggugauuugcuaggaggauccauaaggacuuuggguauaguuguagucacaguuauaauuuauuacagcaaaaugauacaaugcaaaaucagcaaagguaaaaggcacauggaacaaaguuugaaggaaaccaggcacaagcuuccaaggggucucucccaguggugucacacaggagaugcuuaauuccuccagcauugaauuguaacaauauaaggaaaugucugccaggaaagcgauuagacacuuggugcccaagguuuuuauugugggaugguuacguaggcacccuguaccuggcauguaccaaaauuccagacuuccugaagaaaagcaaauguuuagcauaaacuauaguuuguguaaacaguuuaagcacagugagcugcucuuaucaguucugccagugguuguaacucucccaaaaucuauauucccaggugccagccaagggucaacuguacagucaggauuuucugaggauaggcagucucaggccugcucuguuaacgcuuuucugcauuauauauaaauauccaguauaauuaaaucugguugccuggcaguguuaauuacaaauuugaauuugaguuuguauuuaccuguuuguuaagugguagaaguagggaaugacacuaaacugaugugucauucacacaucagaauguguguaugugaucugugaucgauuaaaaaauggaagccauucaugcguuaugccaugucauaguuacuaagauuaaaauuccaaauaguguuuucuccacagaugauauugacaguggcuuguaugauggaaacaagggaagaaagaauuuuauaugcugguucuguggagagugagaaguuucuuuuuuuuuccggaaaauugccauuuuucuuaauccaauaaugaaauucaccuaaaauacugaauacugcuuuaacaaccauauuucuuuguaauaguccucuugagaaagacaauauaguuggguaacucaacagccauguaaagaaacuuugaaaugcuuaugaaaugcugauuuucacggaugccaauaaguguugguguaaaaagucauguugguuuuaugguaugagaaauuaagcuaaaaauaaaaucaguguuugccaaauggaaaaaagauugauugaaaaacauuuuuucauuauuauuuuccaaaaagguuuuuaaagaagaaaacagaaaacaugcuaaucuuucuuuuuguuguuuaugaccucguaaguaaaguuagcuaaucauuuucucuguuuauauuuuccauucaccuaucaguaacauuuauucuuuccugugauuuacaguguuagcaaaugucaugguuuguuauauuuuauuuaauuuauugauaagacugcugcuguauuuuuaaguuaaaaagguuaugacaggucgcgguggcucaugcuuguaaucccagcacuuugggaggccaaggcgggagaucacaagguuaggagaucgagacuauccuggccaacauggugaaacccugucucuacuaaaauacaaaaaauuagccagguaugguggugcgcgccuauagucccagcuacuugggaggcugaggcaggggaaucacuugaacccaggagguggagguugcagugagccgagauugugccacugcacuccagccuggcgacacagcaagacuccgucucaaaaaaaaagaagguuauacguacaaugaaauaauucacagacucuaugaauuuugauuuaaaaaauguucucauuuugaauuuugacuauaaucuuugugagugcagggacuguguccgaauacccaguagguguucaguuauucacuuuuaaauugaaugauaaaaaaguguuaguauauuuguaguuuuaaaaauaaaaauuuauagcaaguacauuaaaauaacauaaucuuuuuagaaaagauuauuacguuuaaacucuuagugucucauuaaccagcagaucauacaaauucuauuuaauuuuauaaugcauuuauaguaaaacuucauuauaacacuuuguuccuuuuaauguugccaacaucaaauguaaaaacaccaaacuguuauaagaagguccacuguauguggcacaugcuuuauaagcuaauguguuuuuaaggaugcacaggaacaaacgagggaauaugccuccuauggaacaugauggggauguuauagaacagucaaacauaagaauuucaucugcugaaaauaaaagguacaguauguaauauaaauucucugcuuuagucauuacauugugaaacagaaugugccuaaaacuggcuaacugaaaaaguagaaagauacaguaaauuaacagccuuccuucuuagugagaagugaauuaaaggaaaagaaagguggggagguaguacuaaaugaaaaucgauaguacuuuacagcauucuuuuaaagaacaaguuuugguuauaaagugugccaagguguucugaagaagucccuaucauuacaaaguauguaaauuuguuugaaauaauaaaagaaauaaguauaauuuaauggacuaaaaaucaacuuaaaauaucuuagagucauggugaugcaacuugacuggaaauaaauugaaaauguggccgggccugguggcucaugccuguaaucccagcauuuugggaagccgaugcaggcggaucacuugaggucaggaguucaagaccagccuggucuggccaacauggugaaacccagucucuacugaaaauacaaaaaaaaaaaagaaaaagaaaagaaaaaauuagccaggcguggcaaucccuguaaucccugguaaucccuguaaucccagcuacucgggaggcugaggcaggagaauggcgugaacccaggaggcggagcuugcagugagccgagaucgcaccacugcacuccagucugggcaacagagcaagacucccucucaaaaaaaaaaaaaaaaaaaaaaaauuggaaauguuccuguggugugaauuuuucuuucaaaaguuuauuuuugauuuucaguuuaucaaguagauagcuuuuaugccuacuuuguaaaauuagugcucauauauuucugucauguugaaaggaaauuguauguauuuuauauuuauguucucuuucuacuuacaguuuuuuaucauuuugguggcauuccugugucguacauaaggauaaaugauuuugaaucuauaguauacagugaagauaaugucauaugucaagaaagaugucuauuuuuuucuaagaaaaguaauauauaaacacugcuugcaauaagauaauuugcuguuuuguucuaauugauuaaguuuccuuugaggauuuuuuuccccuuguuucugucuuccaagaaagguuuuuuuuuuuuuuucuuuuuugagacagagucucgcuuuguuguccaugcuggagugcagugacauauuauagcucacugaaaccuugacuuuacaggcucaagugacccucccaccacagccucuggaguaguugggacuacaggcaugugccacuaugccuggcuaguuuuuuaaaaaauuuuuuuguagagucaggaucucuguuguccaggcuggucuugaacucccaaacucauggugggauuacaggcaugagccauugcgcauggccaggaaggaguguuuuuagggaugaucuuuucuaaguaugugcauagaucacucuuucuuuuccuuuuuuuuuauuuuuuauuuacgugcacuuuuuuucuuuuucuuuuucuucuuuuuugagacagagucucacucugucacccagacuggagugcagcggcacgaucucagcucacugcaaucucugccuccuggguucaagugauucuccugccucggccucccgaguagcugggauuagaggcgugugucaccacgccuggcuaauuuuuuuguauuuuuaguagugaugggauuucaccauguuagccaggcuggucucgaacuccugaccucagguaauucgcccgccuuggccucccaaaaugcugggauuacaggcaugagccacugcucccggucuuacaugcacauauauauauauauauauuuuuuuuuuuuuuuuuuuuuuuuuuacugggguagcuguuuuuuuaugaaaaaggauuuuuuuuuuuuuuuuuuucgagacagagucuuguucugucacccgggcuggaguacaguggcaggaucuuggcucacuguacccucugccuuccagguucaagugauucuccuaccucugccucccaaguagcugggauuauaggcgugugccaccauguccagcuaauuucuguauuuuuaguagagaugagguuuuacugugauagccaggcuggucucaagcuccagaccucaagcgaucugccugccuuggccucccagggugcuguaauacagguguuagccaccacgcccagccugaaaaagauuuuauuugagaaccuauacagccagugaagcaagcugaauguuuuuguuuuuguuuuuguuuuugauaugugucucacucuuguugcccaggcuggagcacaaugaugcuaucuuggcucauugcaaccucugcuuccugguuucaagugauucuccugugucagccuccugaguagcugggauuacaggccuccaccacugcacucagcuaauuuuuuuguauuuuuuauuagagacgggguuucaccauauuggccaggcugguuuccaacuccugaccucaggcaauccacccacguaggccucccaaagugcuggaauuacaggugugagccaccaugccuggccaaauuauuauuaauuuuuuaagccugaauacauuggaguugcacuguauaaagagauagaaugccaugauuuuaccuuaaccuuaaaaauuuguaaauauuuuaauguccauaguacuuugaaaggcuaauaauucauagcuacauuuuacucugaaauuuugcuuccugaaaauuaucuggauuuuaauuuacucuuuuucucugucuuuuuuucuuuagugcuccagacaaugaaacauccaaaucugcuaaucaagauaccuguaguccuuuugcagggaugcucuuugguaggcacaaaacuuccaacuaguugcgcuuguauagagugucuuauaauccuuuuuuaagugagaacucaguguuguaauuaauacuauuuuuacuaauaguagaaaauauuuguaagugcuuacuuuacacuagguacuauucuaaucauuuaacauauauagcucuguauaauuuuauuuuguauuuuuaaaauuuuauguaucuucuuauuuuuacucaugauguucaugaacacaucuauguauaauuuuaaagcuaaauuauuuagugaugugcuuuccguaggugauaaugaaauuauuaguuucaguaaucuuuuuuuuuugcaaaauggauugaucauuaccaaucaguaaugagcuuuuaauuccauauuuuauuagcacucuguugcaguguggcuguuucuuuucugcuuuuaaaaaguauuuuguuuuauuuaugauaguuuuuuccuuaauucuucuuucuaguuucuuuagcuaguacaaaacugcuguguauuuuaguuucuuuucuccaaauuaaaccuuucuuuccuuuguucuuuucauguaguuucugagaagguguuuuguucaaaucgugaugauggucuaaauuuucuauuuauuggaagucaaggucauugcugaauauaagcuuguuuugcuauauuacacuuggcaaaauuuaauaccagaaacugugaggagagacuuguuucugguuuauaccuuuaaauauguaauagaaaagaggucuuuuugugaaaacuguuagaaaaaaaugaacugaaauuugguuuuaguaaaguauaugaagaaauuaacacucuagauucauucaacguaaaaacagucaguaaauuaaauacugguuuagagacauauuauugcauuauauugucagguuuuuguucccuugugaauggcuauugugagaaaaauggcaugccaccuagaauucuaguguaauaucuguaggugaaaauugaccaguuuaaucaguaccauguaaaggcuauauucuuuuuguuuuguuuuuauuuauuuauuuuauuuuaaauggcuauauucuuauguuuuguuuuuuuuuuuuaauuuugaaauugaguuucgcucuaucacugaggcuggagugcaggggcacgaucuuggcucacugcaaccuccaccuccuggguucaagcgauucuugugccucagucuccugaguaguuggaauuacaggcaugugccaccaugccuggcuaauuuuuguauuuuuaguugagacgggguuucaccauguuggccaggcuggucucaaacuccugaccucaagugaugugccugccuuggccucccaaagugcugggauuauaggcgugagccacuguucccggccgauguaguuuauaaaacaugguaaaauaagagaaaugucuuucugagcugagagccuacugauaaauaauuuuaucaauaaaaggauuauuguacccugaccuuuuaaagaugaauggcaugaguuuaucacuaaugcaauccaggauuuauagaugaauauuugguaagacaauggacucuaacauuugaaacuguuaaagucauuuaauucaaugacuuaccuccugguugaucuuuuccccccaaaacuauguuuguacauaccuauaggaaacuuacgauuuccagagacaggacauuccaucuucagauggcugugauuguuaugauacucuuauuucaauugaacugaaauuuaucuuccuauaauuuugccccaaggaugucacuugggaccuuuugcuuuauuuaaaaagugagaucauugauuuaguuuagagcuaaauaggaaauguauugugggguuuauaagagaaccauagguaauuuagaaguauguuuuaaaauuuccaagcauuuggggauuuuccuucuaucuuuuuuguuauugacugcucguuuaagccucuuaugauccaagaauauaauuagauuaauuucaguuauuucaaguuuguuaauuucuuugacaaaguuuuuuuuuuuuuuuuuuguuuggguggcucagaauauagucugucuuggugaguguuuaguauguacuugaaagaaugugcauggugcaguuguugaguauaguaguugauaaaugucauuuaagguugggugugguggcucacaccuguaaucccagcaucuuaggaggcugaagcaggaggaucacuugauugagcccaagaguuugagagcaaccugggcaacauagggagaccaugucucuacaaaaaguaaaaaauaaaaaaauuaacugggugugguggcaugcaccuguaguccuagccacuuaggaggcagaaguaggaggauugcuuaagccugggagguugaggcugcagugagccgugauugugccacuguacuccaacuugggugacagaguaagacccugugucaaaaaaaaaaaaaaagaguuaagucaaguugguucaucguauguucaugucuuguauauccuuaaugaauuuuaucugcuucuauugauugcuuagagagaaguguugaauucucuaucuuguccuucgugugaggccuggagugccagagagauuuuucuuaguguuccugcacuuuccccaguuuucagcaagaccuucauguccuugacagugagggcaucucucccuccacacuuuccccuucuccgcaguauauugcuguugauuguuacuugaugcuggacugguccugugcaucugggccucagggaugggucuuucucaacauuacuguccuugcccaggaugauagcuaaacucuucuuugugucugaggaggguuuugcaucagauuuuucaccagauuuuuuugcccuuccccuaacaguaacaagccuuugcuauauaagagugugggauacuggguccaagcugauuuucugucccuucaccaauagcuugcagcuuuugcuuuguauagucugcuuugaaagucuggaaugugggccauguuuugugccugaaugucacaaaaguaucucuuucaggucuucuguauuguuugaucccaguuuuucuagugaacauuugaaaauugcauucaggcagcaacuccagugggucaagucugggcaugguuuacugaacagauccuuuguuaauggucucaaaaggcuauaaucaagguauccgccaggcugccuuuuaaccggaggcuugaguggggcagaaucuuccucuaagcuaauucagguuguuggcagaauucauuucuuuguggcuguaugacugagggcccuggcuucuuacuggauacccacuggaggcugcccacaguuccuaguggccaucugcuguucuugucaugugggcuuccucaccaugguuacucacuuuaugccagcaagaagaaucucuaaauucagggagggcccaguccuucuucuaagggcuuucaccugauuauaucagguccaccuaagauaaucucucuuuuaauuacuucaaaauuaguugauuugguaccuuaguuacaucugcaaauauuuuuccauccuuccauauucuauuguauacaaguaaguuacagguccuacccauucucaaggggagggaauuauacagggauucagcugggagcagggaacauaguagccaucuuuaaaaaauuuugccuaccauugucgcauuucucuguuacuaauguugcaaucucacacaugcuccuuaauguagcaguuucucauuguccgaacuaguaccccagguucuuugucccauauccgagaaaauuaagaaacauagacacaaaggugggguuggagugaaaguuuaauaagugaaagaaaaaaagcucucugcaggaaagaggggaguccaaguggauggcgggguuacagcugaauuaaaaagcuuuuguaagaaacucuucaucucuguaggaguuugaguaacuuauuuuaucaguaaagcugucugugcuacucccguuaucuuauacagcuguggguacgucuuuaggcaagcagaaaucggcuugucuuguuuguauaacuguggguuuguuuuagauaagccacccccgccccauccccaugcaaguucccaccaugaauaugccuaaacugggguggaaacuuuuuccugggaguucacuaauuagacaaagaacaaagagcucugugcuagauccuguuugcuuaucuguccaggugcagucugagguuuuuuuuuuuuccccagguuguuuuauuuuugccuguugcugugacuuuucaagcaggcugcuucugcagucugaauuuuuucccaaaugauuuuuccuuuccuucucccucacuaaagaccaacuugaucuaaguucaguuuuaagcuuagcuaaggaccucuagaguagcuuuccuuucagagaauaguuuagucuuacuacuacagagugaccuuucugacauguucccugagagaccaccaagaacauagcuggcuggagcuugaauuuugcuccuuuguuucaggucugagaauuguucaguuuauauccuucuuaguuuguugccaggccaaauggaauuucacucugugaaugcacaaacuagcacacugcaaagucugaagggaccuccuguggauuucuggagcucuuuuuaugcuuccuauuggaucuuugcuccauaacuucuagccauuuuagccuuccugaauuuugcucuuuaucuacucaauuuagcucaguuuccuggcccucuuuggguucucuuuaccucuuuaccuguaucuguggucuggaaauuucauuugggcagaaauugggugauuauagggcucaccucaauuacaauucugcacuaccuauuguccaguaucuggaaaacaauuauuuuguguauuuugcgcaguuuucuaauguuucuguuguuguuguuguuguuguuguuuauuuguuuuuuaaacugugagguuaagucuugugcuugguuauucuaucauggucagaagugaaaugggaauauuuacuuuuauuauaaaacacaguuauuaaccuuaauguaauuuauguuaccucuacgggagcuucacuuuugcugacaucuaugcuuaauggacaaacugagaugcugugugcccacugaugguuggagaccaauaaugaaggcaguacagaaauugcuguuucaauugcauucuugauacccugugauuuuuguaguguuccagaucuugcauauuuagauuaagagguuauuuuguggcauuaacauaugcaauaauaauaaucuucucugcauucaaaauuuuugauuaacuggauuuuuguauaaggaauaccaaggugagagguuuguauuuuuuccuguagaauugaguuuuuugagcagagugccaguuugauuaguguauuuuaugacaguuaauauuacauaguguacuggaucuauuggagcagggagaagggaguugggaagacugguaauuaguuaggaaguuauugcugcaauccagguuagauguagagaggacuuauccaagguuaauggcucugagaauagaaaggagggggccucauaugaagugaauagaagaggacaagcaguccaaguuauagugagauuuugaggcuccaguauugggccauuaguagaaaaugaagaggggcaguugguuuugagaugcucguuugcgauugaaauguuaaauuuguaagacuuauggaagauauuaauggaaauauuauuuagauuguuagaaaaaugggguugggauaagaacauucuguuauuuaggaaaauuuuugacuaaugguagaggcaugggcaugauuacuguaucuuguguuugacgcauaguagguacccauuaauuacaaaagaaauugaagaaggacugauucaugugauuuuuuuccuucuguauuucuugcauauuaguaauuauaugauacaauuaagauggaguuuuuaaggacuuaacuuucuaauugcauacgaugcuuaagaguuaagauuguauuuuucucauaccacuaucuaggaggugaagaucgagaacuuauucagagaaggaaagagaaauacagacuagaacuguuggaacaaauggcugagcaacagaggaacaagagacgguaaugaaagguuugcauuuaaaagagauauuuugaguuuaaagugcauuuguguaaaaugacaugguuaaauaagggguugucguucuaauaugauguuugauuuguaaaucacuuauauuuucaucucuacaugcuaaaucaacaaggaaaauaaauacuaagagaguuuuuuuuuuuuuuuuuuggucauaaguagcaagugagaguauuuauauauucuguaauagcccuuuuacuucccucauugauuucuucaguuuuugauuuaagguagcauuuaauguuauagauaugcccauuggauuaucccauauauaguaacaaauauaaaaguauuuuuugccauaugaaaugguaugcacacacacauacaugcaaaaaaaauuguauccuauaaauuuaacauuuccaucccaaaugagcaucucaaaaccaacugucccucuucauuuucuauuaauagcccaauaauggagccucaaaaucucacuaugacuuggauuccuuguccucucguauucacuucauacgaggcccccuccuucuuucuauucucagagccauuaauguuggauaaguccucucuacgucugaccuggauugcagcaauagcuuucuaacuaauaacuagucuucccaacucccuucucccugcuccaguagauccagcacacuguguaauauuaacugucaaaaaauacacuaaucaaacuggcacccugcucaaaaaucuucaguggcuuccucaauucuacaggaaugguaaaucacaaguauuuauguuguacauagguaucauuguuuguagucuuucuuguugaaauaccuaugagauauuauaguuuaaaauuaggaauagaguuuaaaauuagaaauuuuaaauauagcuuaaaauuagaaauuacaguggaucacgccuguaaucccagcacuuucggaggccgagguggguggaucacaaggucaggagaucgagaccauccuggcuaacacggugaaaccccgucucuacuaaaaauacaaaaaauuagccgggcgugguggcacaugcuuguggucccagcuauucgggaggcugaggcaggagaauugcuugaaccugggaggcggaguuugcagugagcugagauaacgccagugcauuccagccugggcgacagggugagacucuugacuaaacaacaacaaaaacaacaacaacaaaauuaggaauagagaucucguuuugagagaauuugagaccuguuaucucuuaguuuuugccuuuuuucccucuaucucagaggaagccaauaucuacuguuugauguuagcuaucuuuaacaucauuuuuaaaaaaacccuauuauuaggaaguaugguagauauauuuaaauuuuuacccuucuuuuugcuaacugaaaauauauguguacccuaaaagagguuuuuuuguuuuacaagguaaauauuuuauuuuuguguuuuauuuugugugaauuagucuuugaaauacucuaggcauuggcuuagagauacauaguccaaguuaguuacaugugaauucuaguuuacuuuguaucaaguaaaaaaauuuggcuuucaguauuauuuaaggcuguaaugucaguuaaaggaauuauuuguuuuuguagauguagugcauagacuuuguguauaagcuucuuucagugaugauuuauaauuuugauaguuuacuauaucuuuuuaauauguaaaacuuuaauuuuguuuagagaaaaagauuuagaacucaggguugcagcgucuggagcacaagacccugagaaaucgguaaggguuucuggcaucuuuuaauguuuaaucuuucaucaaaugauccucaaaugugguggcagguggggauagagaauauugggagaaaaagagaguagaccaauuugaacaguaauaaaauuaacuaaauucaguucucauaaaguguaaauucucuuaacuguuauuuccuugagguaauuuuuccuuuuucauuugugugucauuuuuuuaaaguuuaaauuaguucucucugcuuuauucacauguacuauuccaugggaaaguuaucuggguuaaauuuacaauugauguuaauauuuuucuugaauacaucuugaucacuuacuuuucuuacauuggagugauuucugagaaaacugacgacuuuauuuuuaaagcguuuuaguaauuguuacuuauuguaacauuagagagauaauaaucuuauuuuuacuuuaauuuugcaauucucaucauuaaguggaaugaauuacucacaucauugcaguuaaguaaggaggagguaauuuauuguuuuuaccacaauuuauuuuuucuguaguugguuauguaauauuuauuucuaauacaagucuuguuucaucuuugaaugaugauuaagaccuuuaauuucauuaaaaagcucauucuuaaaaaggaugcagcaacuuaaaauuauuuaccuguaggcaacuuuugauuugcuuuuacuuaugcugagaauauauccuguggguuaucuauuuggaaaaguuucauauugcaccagcaucacucgcaguaugcuucuggguuaaccugauaaaucauuccugauaagauaaccaugguaggaaaaaaagaagauaaauuucaaagcuaaauauauuuuccuuuaugaaucaaaaguuuccuuuuaagaggugagcuuuuuaauguaauauguuggcauguuaaauuuuguauuuaugguuacacuagugugugacagaccuuauuuaucuuugaauugaagcuccuauacagugucaaguugauuuaugagaauaaauaaguaauuggaggcaacaguuacgccuuuacuuuuggguuuacuuuugaugugcaaaucuuagaaaagggcacauaagugauguucuaaaguagagauuagcaaaguguggccugugaccaaauuuguuugcuaccuguuuucauaaaaaaaaguuuuauugcagcacagccuuguucauuccuugacauacuguuuguggcugcuuuagcaccauagcugagucugcucauuaugaagagacuauguagucuugcaaaucuuaaucuauuuacugucuagcccuuuacagaaagcauuugcugacccuguuuuacagaauacuauaacagaaauggcaauuagagaaguagcacgguguccuaguacauaaaaagaauacuacagguauauuuaaaauuaauaucugacucuagucuuugcuuaauuauuuacuaauagugagaccuuaggugauauauuacuucucagagagccucaauuacccauuuauaaaauaagcauuagauauucagagucuggcugggcacagaagcucacaccuguaauuccagcacucugggaggccgagguggucggaucacuugaggccaggaguucaagaccagccuugccaacguggcgaaacccccuucucuacaaaaauuagcugugcgugguggcaggugccuguaaccccagcuacucugaggcugaggcaggagaauugcuugaauucgggaaguggaaguuguugugaccugagaucaugccacugcauuccagccugggcgacacagugagacucugccucaaaaauaaauaaauaaauaaauaagauagauagauagauauucagagucuuuuauagcuguaaaauucuguuauucaguaaauaaauaaauaaaaauagauauucagagucuuuuauagcuguaaaauucuguuauucugugacugucuuaagugccugcugggauaggaggucuuuugaggucccuuccaccuuuaaacuuaugauuauauguaacaaacagauuuuuuuucuuuauuuuagccugauagacuaaagcaguuuaguguggcaccaagacacuuugaagagaugauaccaccugaaagacccagaauagcuuuccagacaccucucccuccuuuaucugccccaucugucccacccaucccaucaguucauccuguuccuucucaaaaugaagauuugcgcaguggacucagcagcgcccuuggugaaauggugucucccaggugcuuguuuaaauguuuuguguuugggaauuagguaagguauugcuauauuuuauguuuagaaggauauacugaagcggaugacguuauucuucagagauuuuguacaguuaacaguuuugugaaauaaauucucuugaaauuuguuuuuuucucugcuauuauaaaaaaagggaaauucuuaaaacauuuuauuguuuaaagaugauuuuguaucuuuagaaugaauuacuaaguacauuuuaguauuuauuuaguuuuggguuguauuuugggauguuuuugauaucuuuuaacauauaaaaguuguacauuuuuuucaauuuuguucuuuccacuuggcaaacauugaauucuucaauuugugcagaaaaaguuucuaauguggcucuuuuacacauauaauuuuauuuuagcuucuguuucuucagcucauucucugugauuacuuaugggcuguguaacucaaauaccugaaauaaaaaguguugagauuauaaaaccuguaauuuaaguauugggguaaagauuugauuucuguaggugaaaggcaucacacuauaauagaauauacauaaagaaaauccuguuguuaacacugauauuuucugggcuauacuuucuucuuuguagggccugggcuuauuuuuuguucacuguuaguguauuaauuauaaaauauauuuaaauuuagagguguuuuucuuaacuuuuuugaacauugauauuuucuggacuguauuauuucaguagaaguuggucuuuuaguuacuaaccaacuguggaaguguguuuacuauacuuaucaggggcuuuguguuuuuuaucugauggcuuccugacucaggaauaggaggcauuggaauuaacagagcauuuuaugguggucucagcauugaauuagggauugaaaugguuggcuuuccuaucuggauuuugggcaaaccacaccuuuguugaacuucaauuuucucauuuguaaaaguggaguaguauuauauuuuuuucauguuuacaauuacaggguugugaggauuagcuuguauaaaucucuaugaaauucgauuuaaugaugacagcucccuuucauaacaguuauuugacauuuuuguugauguauuuuuguugugaggaugguauaagguuuagacacauugaguggcuaguaaaugugaaagauauucccuacugaagagaacuuccguaccuucuuaguucuuuggaauuauuuugaaguauaugacaagggagaaccuguuaagauacauacaacagugagaacauucuagaaugccgccaucucuuucuauucauuuaaaggaauuugccuuugccauuuuuacuacugaaaaauauugcauugguagcaauacagagauauuuccuaaucaguaaugaagugcuaauguagagguuuuuagaaguuuuaaauuuaugaaauacuuaaagauugugucaauacuuuacuguugguauuuaaguugcuuuuauuuuacuauuaagaaauacacucguuuccucagucagacugaaccauuuguacucacacuguuuuguagcucuuugccuucucuuucuggauuguccuuccucuaacacacacaagcucacuccaguagcauggcuuaagcguugccucuucuggaaagccuuacaugugcuuucuuucucucccucaugugauuuaaaugucccuucuccuguaccuauagcaaucugcauuuuuugggcuauauugcuauuuaguuuaauuugcuuguacuauuauuaauuauuuaauuugcuuguacuugacuguaguuguuuauuuucauguuacuccugagggacagggaccauguuugucuuuauuugauacuggcacauagugccuauuggauauuaauugauugaauauuaacccagguuuuuaucuuacauaaauguaccugaaauugugaaauccuauguaauaguauuugcuuuuuaagucauaauuuuuggugaaugauuggagcaagauggugacauuuucuaaaguagugauaggauuuucaguacuguuuuugcaaaagaguaacaucuugauuuuuuaaaaaauugcaaugaaauaugagaggaauuuuucaucuuucuuuucauacaggauugcaccucugccuccaccuccccuacuaccaccuuuggcuacuaacuaucgaacuccuuaugaugaugcauacuauuuuuauggguccaggaauacuuucgaucccagucuugcuuauuguaaguuaucuauaggguaagcauuuucuccccgcuuggcucaauaaggaaaauuguuuuuuuguguaaacaaaaaauaucuaaaugagaaaagcacaacuuugcuuaauucagauguuauauauugauuuaauaaaugcccuauuuuaaagcccaguuauauuuuauaguuauuuccuuuucaucuugguuuaagaaauaacgauuguguuuucuuauguuguucuuugcuaacuucuagcccagaaggaaauauugaugguuuucucuauguaacauuuugauuaugcaccuuuuucuggaggaauaaguaaaauauuauuaaaugauuauucuaaauaaacuuuuuuuguuuuuuuguuuuuucuuuaagaugguucaggaaugaugggcguacagccugcagcuuauguuagugcuccugucacccaccaacuagcacaaccuguuguguaaguuauuaguuaaaagaauaauuuuuuccccacuuuuauuuuguuaagauacacauaaccuaaaagccaccauccuaacauuuuagaguauacuauuuagugguauuuaauauuuucauaaugugcaaccaucaccacaauccaucuucagaacucuuuucaucuuguaaacugaaacucuauacccauuaaauaauaaugguguaccuccucauuccccuaccuccguucucuggcaaccaccauucuaugucucugauuuugacuacuccauguaccucauaugaauagaaucauacaauguuuaucuuuuugugacuggcuuauuucacuuugcauaauguccucaagguucauccgucuuuuagcauauuucagaguuucuuuccuuuuuaaggcugaauuauaauccauuguaauuguauacaacauuuuacuuaucuaaaaucuauccauuuauccauuaguggacacuuuggauugcuuccacauuuuggcuauuugugaauaaugcugcugugaacaugaguuuacaaauaucucuuugaaaucuuguuuucaauuuuuuugggucuguacccagagcuggaauugcugggucauaugguaauucuauguuuaauuuuuugaagaacugccauacuguuguccacaacugcuauacuuuuuaauauucucaccaguagggcacaaggguuccaauuucuccacgucuuugccaauacuuauuuucuuuuucuuuuuuuuauaguaaccauucuaaugaguguaagaugguauuucauuguagguuuaauuugcauuucccuaauuauuagugagguugagcaucuuuuccuaugcuucuuggccauuuguauaucaucuuuggagaauugucuuuccaaguacuuucccauuuuugaauuagguuguuuguuuuuuguuguugaguuuucagaguccuccauauauccugguuauuaauucuguaucagguauuugauuugaaaauauuugcucccauucugucuugauauugccuuuugaugcacaaaauucuuaaauuuucauaaaguccaauuugucuuuuuauuauuguugccugugccuuuggugucaugucugagaaaucauugccaaauccaacauccugaagcuuuugcccuauauuuucuugugagaguuuuauaauuuuaggucuuauguugagcuguuugagucauuuugaguuaauuuuuuuaugguauugcauaaggguuugucuuaguuauuuuguauguggauauucaguuuucuuagcaccauuuguuggaaagacuauccuuucugcauugagagauauuggcauucuuguugaaaaucauuugaccaaauauacgaggguuuauuuuugggcuauuuauccuuuucccuugguguguaugucuuccuuuaucccaguaccuuaguguuuugauuacuguugcuuugaauguuuugaaaucagaaaaugugagugcuacagcuuuguucuuuuucaaaauuguuuuggcuauuuuggaucccuggagauuccauaugaauuaugggaugaguuuuucuauuucugcaaaaaagucauugugauuuugguagugaguagugaguguauugaaucuuuggguaguuuugacauuuuaacagugucaugucuucugauccaugaacauaagauauauguccauuuauuuaugucuuuuaaaauuucuuucagcaauauuucauaguuuucauuguauagguauaggucuuucacuucuuuaguuaauucuuaaguauuuuauucuuuuggaugcuuucauaaauggaauuccuuucauaauuuucuuuucaaauuguucauuguuaguguauagaaaugcagcugauuuuuggguguugauuuguauccuguuacuuuacugaauucauuuauuuuaauaauuuuguuguagaaucuaggauuuucugcaaauaagaugauaacaucugugaacagagauaauuuuacuuuuucuuucugauaugaauacuuuuuauuuauuuuucuuucuuucuuuuuuuuuuugagacagagucucacccugucacccaggcuggaguacaauguugugaacuuggcucacugcaaccuccgccuccugaguucaagugauucuucuggcucagccuccugagaaacugggauuaaaggcgugcaccacuaugcccggcuaaguuuuuguaucuuuaguagagacaggguuucaccauguuggccaggcuggucucgaacuccugaccuugugaucugccugccucagccucccaaaguccugggauuacaggugugagccacugcgccuggccccuuauuuuucuuucuuaauuacuuucuuaauuacccugacuagagcuuccaguacuauguuuaauagaaauggcuaaagcgggcaucccugccuuguuccugaucuuagaggaaaagcuuucagucuuucacuguuguguaugauguuugcuguagguuuuucauauauauagcuuuuauuauguugagguaauuucauucuauuccuaguuuguugaguuuuaacgaugcaaguguuaaauuuugucaaaugcuuuuucuguauugugaugaucauguuuuuuuccccuuuauucuuuuaaugugguauauugauugauuuuuuuauguuuaaccauaaccauccuuguuuuccaggaauaaauuccacuuagucaugguguauaaucauuuuaauaugcugcuggauuugguuugcuaguauuuuguuaaggaguuuugcaucaguguucauaugugaucuuguuguaguuuccuuauacugucuagcuuugguauaagcauaauguugggcuuauagaaggaauuaggaaguguucccuccucuugaacuuuuugaaaaaguuugaggauuuauauuaguucuucuuuaaauguuugauagaauucaccagugaaaccauaagguacagggcuuuucuuuguugggugauuauugauuagagauucagucucuuuaguaacuaguuauauaggucuauucagauuuucuuuuucuucaugauuuagucuugauagguuuuuauuucuaggaauuuguccaucucaucuagguuauccgauuuguuggcauauaauuguugauaauauucccuuacaguccuuucuuauuuuuaaaagauuaauagugaugccccuuugugaauuucugauuauauuuuauuauuuauuuauuuauuuauuuuucugaccucauucuucccaucacagaauuccugauuuuaauagaagauucagagccuucuuguuggucaguguagcuaagcauuugucaaucuuguugaucuuuucaaauaacaaacuauugguuugguugauuuuuuuuuuuucugucguuauucuaguuuccauuucauugauuucugcuguaaucuuuuaaauuuccucccuucugcuuacuuuggguuccguuugcucucauuuuucugguuucuagagaugaaaaucuagauuauugauuugguaucuuucccuuuguuugguauguauacuuacaacuauaagcuuuccucuuaguacuguuuuagcuacaucccuuaaguuuugguauguugucuuuucacuuucauugcucucaaaauauuuuccaauuuuuaaaaauuucuucaucaaccuguugguuauuuugaaauguguuguuuacuuuccacauaauugugaauuucccaaauauccuucuguuacucaugucuaauauaauuacauugcaguaggagaacaaacuuuguaugauuucagucaguccuuuuuaauuuauugaggcuuauuuuaagaccuaacauggucuguccuagagaauguuccacaugcauuugagaagaauguguauuguccuguuggugaguguauuauucuauaagugucucuuagaucuaguuggcuuauaguguuauuucuuuuauuuccuugaucuucuguguaguuguucuauuauuagaagugaaguauuuaaucuccaacuguuacuuuguguguguguguucugauauacagucuugcucuguguguguguguguguguguuuguguguguguguguucugauauacagucuugcucugucacccaagcuggaauacaguugugagaccauaguuugcuguagccucaaccuccugggcucaagcaauccuccuaccccagccuccugagcagcuaggacuacagccgugugccacugcaccugacugauuuguuuauuuuuuguggaaacagggucucccuguguugcccagugugaucuugaacuccuggccucaagcgauccucuugccucagccucccaaaguacgaggaauauagccaugagccaccacacccggacuccaacuauuauucuugacuuguguauuauucucuucaauucugucaguuuuuguuucguuucuuaggucucucuuuauaugcauauguuuauaauugugucuuacugaagauuugacccuuuuauuagugucagagauucuucugugucucugcuaacaauuuuugucauaaagugcuuuuaguucuaauauaaauguugcuguucugguucucuuuuaguacuguuugcaugguguaugauuuuucguauuuacucucaauuuauuugucuuugaaucuaaaagaugucucuauguagacagaaugcaguuacuuccugguuuuuauguuugccauuuugcaauuuuuuucuauaugucuuaugucuuuuuauuccucuaauccuccuuuauuaccuucuuuuucuucuucguuuuuuuuuuuuuuuaagagauagggucucauucucuuucccaagcuggagugcaguggugugaucacagagcucacugcagccucaaacuccugggcucaagcaauccuuccacuccaaucucucaaggagcuggaacuacaggcacaugccaccacgccuggcuaaauauuuguauuuuuuguagagauaggguuuugccauguuucccaggcuggucucaaacuucuggcucaagugaucccagccccacaaagugcugggauuacgggcaugagccaccgcggccaggcucuuuuuuuuuuuuuuaagacgcagucucgcuguugcccaggcuggagugcaguggugcgaucucggcucauugcaagccccaccuucuggguucaugucauucuccugccucagccucccgaguagcugggacuacaggcgcccgccaccacgccuggcuaauuuuuuguauuuuuaguagagacgggguuucaccgcguuagccaggauggucucgaucuccugaccucaugauccacccgccuuggccucccaaagugcugggauuacaggcaugagccaccgcacccggccuauuaguuucuuuuauguuaaauauuuaauagcauucaauuuugauuuuuuuguugccuuuugcauaauuuugaguuuuuuugugguuucccuacagauuaaaauugauaucuuaauuuaaaauaaaugaguuuagauuaagggcaacuuaauuucaaugguacacaaaccuuuucucuaauauaaggucauuccuuuuccucuacuugaugcuauuauugucauacaaaucacacuauuauacauuuaagucucucaacacaguuuuauaauuauugccuuaugcaauugucuuuuauuuauuuauaaauuuauuuuuugagauagggucuuacucuguugcacagguuggagugcaguggcaugaucauggcucacugcaagcuugaacuccugggcucaaacagucuucccgccuuagccuccugaguagcugggacuacaggugcauaccaccaaugcucagcuaauuaaaaaaauuuuuuguuuuguuuuguuuuggagauaggaucucacucugucacccaggcuggagugcagugguaugaucauagcucacugcagugucaaacuccuggauuuaagggauccucccaccucaggcucccaaguagcuacuacucccacuacgccuagcuaauuuuuuauuuuuuuaauuuuuuguagagacaggcgucucucuguguaucccaggcugcucaugaacuccuggccucaaaccaccuuggucucccaaagugcugggauuauagaugugagccauugugcccauccauaguugucuuuuaagucaaauagagaagaauaaaguuacaaacgucuuuacauuuguaauaucuuuuauauuugcccauguaauuaucuuuacuggcguucuuuauuuguuugugcuuacuucaguugcugucaaguguucuuucauuucaagcugaaggacucccuucaguguuucuuacagaacaggucucuuagugaugacuucucugaauuguauuuaauaaugucuuaauuuagcuuucauuuuugaaggauaauuuugaugguauggaauaguauugguuggcauucuuuaucuuuuaacacaauaugguauccccuagccuuuaugguuucugauaagcuguuaaucuuacugaggaucccuuguaugugaugaaugguuauucucuugcuuucaggauuucucugucuuuaucuuucagcuguuuggcuguauaaguguggaucccuuugaguuuuucuuacuuggaguuugaugcgcuuauuggaucuguagauuaauauuuuucaucuaauuugggaaauuuuugcccauuauuuuuuccaauauucuuugugucccuuucucugugucuucucuuccugagacccccauugguacacauuaugguguuucacaggaucucugaagcuucguucauuuuucuucagucuuuuucuuucuguucuagacuggguaaucucaauugaccugucuucaaguucauugauuguuucuucugccugcucgaaugugcucuuggcucccuuuucuuuucaguuauauuuuucagcucuaucauuuuuauuugguucuuuuuaaaguaauuucuaucucuuuguuguuaauuuuauuugguaaacauuguuuucacaauuuaauucuuuuuuugagauggaguuucacucuuguugcccaggcuggagugcaguggccugaucucagcucacuacaaccucugccucccagguucaagcgauuguccugccucagccuccugaguagcugggauuacaggcaugcgccaccacgcuugguuaauuguguauuuuugcuagagacgggguuuugcuauguugcucaggcuggucuccaacuccugaccucaggugaucugcccgccucggccucucaaagugcugggauuacaggcgugagccacugugcccagccacuuuauuucuuuagauacauauuuuuuaguucuuucaacauauuucugauaacugaauaaaaaucuuuguugauuaaauacaaggcaugggauuccucugaaauuuucuguugacuucuuuuuuccccguauguauggcuuauaauucucuauuucuuugcaagugucauaauuucuuuuuugaaaacugaacauuuaggaaacauaauguggcuacuguggaaauuagauucuccuccuccuugugguuuguuguuguugcuguuuucuaaguacccuuuguaaagucuguauucuuugucauauguggccacugaagucucuguuaggauagcuuaauaguucaugauuagacugagauuucuuuaaaagcuuugacccaauaaaccucccagccuaugccaacugguucugugugugugugcuggggcaugcguucaguacccuggcaauuuacaucuuuguuuuagcuuucacaucccacuugcacagggucucaaugccagccagaaaugagagguguucucagagcuuccucgggcauccauauaauugcacauacauguggcuuucuaaauucucaggaauauguuggagcuuuucaagaccccaugggcauguuauuucccagauuuuucuuuuaauuuuauugucagucuuuugcuugcccuggcugguaucacuguuuuagauagcuaugauguuaaguaauuacugcugauuguuuucuacaaaaccccaggauagugaguucugagucugguaaaauauaggcucugugaauggggcuuuuccugggagcugccagacaggucaaaagugagauuuuucuagagauuggauuuuuggggaauuccagaccuauucuaccuguccaguggauacuagauuacugguuuucacagcaacugucuuugggcagcguuuggauuuuaaguuuaugauagagcuaaggagaaacugaaaggucaagggcaaguucaaaugccacaaaguuuacuucucuuacugaaaaucaaccuuaacaaaaaaacaaaaacucuccugggauuguuccaagccuuccaugaauuuccaaauuacuuagcucaagcugcuauaacaaaauauuauagacuggguggcuuaaacaacagacauuuuuucuugguuuuggagacauagaaguccaggauaaaggugucagcagauuugguuccuagugagggcccuuuuccuggcuuugucauuguauccucacaugguagagagagcaaggucucuggucuuucccccacuccauuucacgccuccccauuuuuucuuaaguacauuuaaucucaucacgaggacuguacccuccugaucucaucuaaaccuaauuaccucucauaguccccagcuccaaauaccaucagaauaguacgcagggcuuugauguaagaacacaauucaguacauggcaccagaauuauuaaaaaguugguuuugacaauuuugacucguguucucauugcuuuaacggaguagcagguuuucuuaaaguucuuauucugccauucuagaagugcuuucuauaaaucagcuuuagaacauuuucaucccuccaauaagauccuucaugcccauuuauaguuaauccuaauucccauccucaguauaguuguuuuuaaguucuucucuguuaaauuuuucugaaggccacauuaaaaaguguaaacuuguuauaaaaguuagauaacugagugaccagcugaauuaucuuacaaaccaaugacuuucaaauauuuguuuguuuccaagcauuuuagcaugagagguggaaggaaccugugacucuguuaacuauuuugauguacgcacaaucugucuucuuuccauugacuuuauuaauuuagcaugcuuuaaucuuuguaucauuugagaggaugguaaagauuuugauuagcuuuagucuuucauaaggauggguguguuauuauauuucuaggguaaccacuaaaaguauaguaacaaaagguaccacuuacuacaguaauagaggaaaaaauucaaaaaagaacaaccaaaauagaauugggaaauuguuuuauuaacugucugaucuuuuucagcuuuggugauggaauaaguuaagaauuuguuggccgggugcaguggcucacucuuguaaucccagcacuuugggaggccgaggcgggugaaucaccugaggucaggaguucaagaucagccuggucaacauggugaaaccccaucucuacuaaaaauacaaaaauuagcugggcgugguggcacaugccuguaguucuagcuacucgggaggcugagacaggagaaucacuugaaccugaaaggcagagguugcagugagccaagaucacgccacugaacuccagcuugggcgacuagagugagacuccaucucaaaaaaaaaaaaaaaagcuucuuggccggguucagucuuaaacaggcuaauacagaguguggaaugaaggaauacucuccgguuacuauuaugagacuuucauaaucuugauacuuaaaccuaauaagaccaguaugaaauggaaaauuacaagcuaguuacacucauuagcacagacacaaggauccuaaaacugaaccucaaaguauagagaaaggauuauugaucuggaauuagaauuacucucgaauauaggaugauuaaauuuaguagaguauaucaguuaagagcauggacuuuguagccugauugccuugguuugaauccugcuuuuaccauucauuagcuugagguguauuucuuacuucuauuccuuguccguuaauugggguaauaaugguaucaccucacaggguuuuucugaugauugaaugguuaaaauauguaaaguguuuaggauagugucugaauacuggagccuauugguguuagauauaaucaauaugauuauaaaauaaacuacuguaaucuaccauguuaacagaauaaagaagaaagcuauaugauaucccaauagacaaaggaaaagcauuaaaauaauugcauuagugauuaaaaauguaauaaaauagguuagaagggagccuauaaacaugaaaaacuuacaucauguauuuuauuuaaugaugauagauuuaaaauauuccuuuugagauucuaucauugcuuccuuucacagggcuuaauuucagcaaggccaaaaauaagagaaagaaaggaaggaagguacaaggauuagaaaggaagagagaaaacugauguuauuugcaaaauaauauaugguuaaaauauuggaauuaauaugaaaguuuucacagaauuacugauuacaaaaucaauauacaaaaagcaguugcaggaaauggcaguuccuuaaaaagaauaugauacugcaauuccauuccuaagcauguaaucaaaagaaauaaaaauaacauguagaugcaaagacuuggaugugaauguuuauagcugcauuauugauaauagucaaaaaguggaaacaauucaaguguccaucagugagugaauggauaaacaaaauguguuauauucaugcgaugaaguacuacucagcaauaaaaaguaaugaacuacugauaugauauaauauggaugaaccuuauaaauguuaugcuaaaugaaucuauacauacuauauuggucccauuuauauaaaauguccaggaaguacaaaucuauagagacagcaggcuacuuacuuaauaauuaccuggggcugaggguugaguagggauugauugcauauggcuaugaaggauauuuuuggguuauaaaaauguucuaaaacugguuauggugaugaucgcacaacucuauaaauuuacuaaagaucauuuaauuguauacaguugacacucgauaacacagguuuaaacuguaugaguccaccuacauguggauuuuuuucagccaacuucaauagaaaguacaauauuugugggaugugaaacccauguauguggagggccuacuuuucuuaugugggaguuccauggggcucacuuugggacuugaguauacucugauuuugguauaggcagagaguccuggaaacaaucccucagauauaccacgggaugacuauacuuaauaccccaauuauuuccucccuuucauccugaucugacuacauaaauccuuaaacccccuuuuugggggagucagggaggaguugauagguaaagguuaagaauuugggucugugaguaugugggcaauauagacgggagggaucaugagugaaauagauauugagagaaccuguccaccauaugauuuauaaacaguguauuuugagagaaugaguuuauucacauagacccucucaaccuucuuuauucauuuacacaaagagcccccuugcucugaaaaaauacagucaguuaggaacuauuugaucuaguuuaccucaucuucccuuuuagccacucauaauccaaugugacaguauacacaaacauacuuguuuauccuaauaaaagauuguaaauaaguuagaaaagguaaauacacaauggaacucauuuuuuaaagcagugauauuuuuggagaagagaaagcuuuuuuaaaauuauaaaaucaggcugggcgcaguggcucaugcuuauaaucccagcacuuugggaggccgagguggguggaucacuugaggccaggaguuagagaccagccuggccaacauggugaaacccugucucuacuaaaaauacgaaaauuagccgggcgugguggcgggugcuuguaguaccaguuacucgggaggcugaggcaggagaaucgcuuaaacccgggaggcggauguugcagugagcggagauggcaccaucgcacuucagccugggcgacaagagugaaacuccgucucaaaacaaaagaaaacaaaaaauuauaaaaucaguauuugaauuuaucuuuuauaauuuagauuucuaaaauguuuuacugucuucaaagucaguauauuccuguacuuaaacauguguuauguuggcugggugcagugacucacgccuguaaucccagcacuuugggaggcuaaggcaggaagaucacuugagcuuagaaguucaagaccagccugggcaacguagaaagacuucgucucuaaaaaaagugagccaugcauggugaugugcaccuauacccccagcuauuugaaaggcugagguggaaggaucgcuugauuccaggagaucaaggcugcagucagcuaugauggcgccacugcacuccagccugggugacgaaguaggacccugucccaaaaaaaaccaaaaaaacagcacuuuauugcuugugauuuauguaacaacaauauguuuaacauuuuuucuuuuauguuuccuugugaauuuuucaaaaauauuaauuuuauuugagacagucagacuuuuuccuguaauuacauuguuuuauucuugaaauagcuaagaaguaauuuuauuaguaaaucauuuaaaaauaaaucauuaguuauuguguuacuugagggacuuuggcuguguuauuauuucuguuuguucaggaagccgccuaagucauauguguacuguucaaugaauuaccacaaacuuuuuucacuccuguguaacuaucaccuagcuuaagaaauagauacagugaauuugaaaguugcaaggauugucaaagcaaaggcaggaaggagcuaaggaaggggucacuuaaggauuccucuuuggccuauagagaaauauccuucuguauuuuuaaauguauuuauaugccaugcuauuucaaaaaacuguuguauuuucuucuugcuuugucgucaauggauuuaaauuauuuauuguguauuugauguaggaauacgguuggacagaaugaacugaagauuacaagugaucaagugauaaauucaggauugauuuuugaagauaaaccgaaaccuuccaaacagucacuucagucuuaccaagaggcuuugcagcagcagguauugauucauuuacucauuuacuguugaaccucuuaaguguaagcaugguggucccuuagagcucagaguguggccggggaggggaaaaaaaacaguuaauuauaauucaaaaugcugaguuuugaaguggauacaguaaaacgcuguuggaagcauaagauagggaaaauaauugccuggggcaguugggagagcuucacacaguaguugauauuuaagcugcauguugugcaaugacuacguuacaaguugcugguguauacagagaauggaauugggguggaagaaggggcuggagaguuaguuagguuguucuagcagauugugaaggacuagcuaauaagggguuuucaguuucaucugguuaugggcagcugaaggaaggaaauuuuaggccaagaaaaguaugaaaggauuguuugcuuuaagcagauuuauauuuuaugaagauaauugguugugauuuggacaauugggaagagauuggcagagaaauuauuuaguagauaguccaguaaggaggugaugaggcccugaaccagauggggacguuggggaagacaucuaagagacaauucucagguuucauugacaggacucagauauagggaaugagaacagaggguuugaagaugauuccuaggagaauaaugaggcuauaaaccaaaauggggaauacagguaguaguucauguuuacagaggaggauaauggguucuuucguaguuuguaauauuugcagagaauuuaagaguaacuaucaaauguaugggguucuuugugggaauucccuuaccaucugagaggacccugggacucuaacuuacuuacuuuucuauagaauuacacuuggauuucuuuuaaaaguacuuuuguucaacuuuuacaugggcaacuuucuugaaagauagauuuuuaaaauuacagaauuaccaaccuuuuuuguauguuaggauucuacaaauaaaagacugaauuuuaaauucagaaucuguuuuugcaugagcauauuaaaaacaccacugacaaaacuagauuuuucaacucuagaggucuauuugaugugugugaugacuucuuuggcuaugcuggagcaaaagguugcuuaaauuuacugugcauaugguuaugaguuuaaaagugacuuuccaaaauguagacacuuguuuauugccuaucuguaugucucuacagaacaacccugcgcuuauacuuagugaugauaagaaugcauuuguuuuuugugcuuaauacagcuuuacagaaguauugcagguuuaguuccagaccacagcaauaaagcaaauaucacaaugaaaugauucacaugaauuuuuugguuucccagugcaugcagaguuaucuuuacacuauacuguggucuauuaaggugcaacaugucuuaaacaagcuacguaaacuuaauuuaaaaauacuguauugcuaaaaaaauuuagcaaaucauaauccuuuugcugguggaaagucuugccucaauguugauggcugcugacugaucaggguggcaguugcugaagauuggguggcuguggcaauuucuuaaaaugagacaacagugaaauuugcugcaucaauugacuccuccauucaugagagauuucucuguaggauacgaugcuguuugauaccauuuuauccacaguagaccuucuuucaaaguuuggaguccucucaaaacccugcugaugcuuuaucaacuuaguuuauauaauguucuaaaucuuuguugucaucucaacaguguucacaacaucuuuaccaagaguagacuccaucucaagagaccacuuucuuugcucauucauaagaagcaacuccucauccauuaaaauuuuaucaugagauugcagcaguucucucaagucuuccaugccucacuucuaauuccaguucucuugcuauuucuuccacaucugcaguuucuucuaccacugaagucuugaaucccucgaagucauccaugaaucauccauuagggucaacuucuuucaaacuucugauacuguugauauuuugacuuccuuccaugacucacaaauguucuugauggcaucuggaaugguaaacucucuccagagggcuuucaguuuagauuucccagauccaucagaggaauuacucucuguggcaacuauagcuuuaugaaacguauuuccugaacaguaagaauucagugucaaaauuacuccaugaguuaaugggcuaaagaauggauauuguauuagcaagcaugacaacaacauuaaccuucuuguauaucuagcucuugguugaccaggugcguugucaaugagcaguaauauuuugaaaggaaucucuuuuuuuuaguaguaggucucaacaguggacuuaaaauacucaguaaaccauucuugaaacaguugugcagcaauacaggcuuuguuguuuccuuucuagagcacagguagaguagauuuagcaucaucuuuuuuuuuuuuuuuuuuuuuuuuuaaagacggagucucacacugucacccaugcuggagugcaguggugcgaucuuagcucacugcaagcuccgccuccuggguucaugccauucuccugccucagcuucccgaauagcugggacuauaggcgccugccaccaugcccggcuaauuuuuauuuuguauuuucaguagagacgggguuucaccauguuagccaggauggucucgaucuccugaccucgugauccaccugccucggccucccagagugcugggauuacaguugugagccaccgugcccggcugauuuagcaucauucuuaagggcccuaagguuuucagaaugguauauuagcauuggcuucaacuuaaagucaccagcugcauuagcuucuaaugagagagucagccuguccuuugaagcuugaaaccagacauugacuucucuuuacuagcuaugaaagucuucuuuuaauacaaggcuguuuugucuccauugaauaucuguuguuuaguggaaccaccuucaucaguuaucugaucuagacuuucugggugacuuguugcagcuucuucaucagcauuugcugccucauguuguacuuuuuuauuuuuauuuuuauuuugagacaaagucgcacucuguugcccagccuaggcuggaguacaguggcacgaucucggcucacugcaaccuccaccucagccucccgaguagcugagacuacaggugcccacuaccacgcccagcuaauuuuuauuuuuuauuuuuuuuuguauuuuuaguagaggugggguuucaccauguuggucaggguggucuugaacuccugaucucaagugauccgcccaccuuggccucccaaaguuuugggauuacaggugugagcccagcccauguuguacuuuuauguuauagagauggcagcuuucccucaacuucaugaaccaaccucugcuaacuugcaaguuuucuucugcagcuuccucacuucucucagccuucauagaauugaagaaaguuagggccuugcucugguuuaggcuuuggcuuaagggaaugcugggcugguuugaucuucuauuuagaccacuaaaacuuucucuauaacagcaauaaggcuguuucacuuucuuaucauucauauguuuacuggaguggcacuuuuaauuuucuucaagaauuuuuccugugcauuuacaacugggcaaaguguuuauuuaacauaagaggccuagcuuucagccugucuaugcauuugacaagccuuucccacuaagcauagucauuucuagcuuuugauuuaaagugagagaugugacucuuucauucacucaaacacuuacaugccauuguaggguuauuauuuggccuaauuucaguauucuaucagggaaaagagagacccaaagagagggaaagagacaggggaacggcugauugguagaauagucagaauacauaugacauuuauccauuaaauuugccaucuuaugugugugugauucauggcgccccaaaacaauuauaauaguaacacuaaagaucagcaaucacagaucaccauaacagauauaauaauaauuuaaaaaguuugaaauauugugagaauuaccaaaaugugacacagagacaugaaauuagcccaugccauuggaaaaaugguacugauagacuuccucaaugcagaguugccacaaaccuucgauuuguaaaaaaugcaauaucuguggccaggcgugguggcucacgccuguaaucccagcacuuugggaggccaagguggguggaucagaggucaggagauugagaccauccuggcuaaugcggugaaaccccgucucuacuaaaaauacaaaaaauaacugggcgugguggcaggcuccuguagucccagcuacucuggaggcuggggcaggagaauggcgugaacccgggaggcggagcuugcagugagcugagaucacgccacugcacuccagcuugggugacagagcgagacuccgucucaaaaaaaaaaaaaaaaaaaaaaaaaaaugcaauguccgcaaagcacaauaaaauucagcacaauaaaaugagguaugccuguauuuaaaguugccaagcauuccccagagagaguugauccuccgaccucugaauucugggaauagaguuugccuagggaaaguaggucugguaagguugaggguagacuuuguggcugggcauuccccuugaaaggauagaugaaaaaggaacguagggagaucugauggucccauggaacuggcaggguuagagagggaauggcucagguagacacuaggggagggaaggaggaguugguugagucugaaguaccuuaguggcuagaaagucauuugguguauauagaggaacaggggcuauguauucuagccauugaauuauuuuuauuuuuaauguuauuauuuaaagacagugucuugcauaauguugcccaagcugaaguacaguggcaugaucuuggcugacuacaaacuccaccuccuggguucaagugauucuugugccucagacacccaaguagcugggauuacacaugugcgcaaccacacccagcuaauuuuuguauuuuuaguagagaugggguuuugcauguuggccaggcuggucuugaacucuugaccuuaagugaucugcccaccuuggccuccauaggcaugagccacgacaccugaccuaaaguauuuuuacauugaguauuacauauauuugugauuuuaaccuuuguagggggguacacuggggaaaaaaaaaaaagcaaauuuuuuugcuuguuuucuaauacaaaaaauaacaucugguauuacuaacuucuuguaucagaauacuugucagcguuuauuuuaaauauaucuuauguugucaagauucgggaaagagaagaaagaaggaagaaagaacgugaagaaaaagaagaauaugaagcuaaauuagaagcugaaaugagaacauauaaucccuggggaaaagguggagguggugcuccucucagggaugcaaaaggaaaucugauaaguacguuauuucuacugacuuguuuuuaaaauaagcuaaauuauuuuuaacuuuuuaaaagauuggggaguagaaaaaaguaggaaucauagccucuauagcaacgcauguauguaacuuaaugcauaugagguauuuuaagaguaaauauaauaacagaggcuagaaagcauuucuucuucagaauacuauccauuuguuuuuauuauaaauauuucauccuccgauguugauaacccaguugcagagaaaagcucauguuaguugauaaguuuuuacugaaacugguacuuagaauauuuuguucccucauaaaaaugauaaaacccauauuacaauuuaaaaaaaauaaacuaguaagaugucuuagaaauaaaggauguaaaacaguuuugggaggggauuuuguguuuaauuuaucuaugcaauauaccugcuaauugcaagaauuccuuugggaaaaagaagacaugaucauagaaacuuucuagcaaguuucauaauuuguugauuuaucuuucaauuauguacucucaaaaauguuugaucuaguaaucacacaacaaauacuucgaaagaguggcuuuauacaacuuguuauauacaguugucuguugguaaccaugggacauugguuccaugaucuccugugaauacccaaauccauggaugcucaaguuccugauauaaaauugguaaaguguucgcauauaaccuacacacaucuuccuguauacuuuaagucaucucuagauuacuuguaauaccuaauacagugaaaaugcuauguaaauaguuguaaucuuguauuaauuagggaacaaugacaagaaaaaaagacuuuucacauguucagugcagaugcaagcauccauuuuuuuuuguuuuuuaauguuuuugaauugugguugauugaauccacagauguggaacccgcaguuacaaagggcuguuguauauauuaggauggucuuuguuuagcguuuaguuaagcagaauaaaaguagaucaaagauacacacuucauguucuuuagguguuauguauuguaggaauagaugagugauagaaucggaagauuggauguugaguuagaauucucguguguugcaaaaauuuucucccauucuguagguugccuguucacucugaugguaguuucuuuugccaugcagaagcucuuuaguuuaauuagaucccauuugucaauuuuggcuuuuguugccauugcuuuugguguuuuagacaugaaguccuugcccaugccuauguccugaaugguauugccuagguuuucuucuaggguuuuuaugguuuuagaucuaacauuuaagucuuuaauccaucuugaauuaauuuuuguuuaagguguaaggaagguauccaguuucagcuuucugcauauggcuagccaguuuucccagcaccauuuauuaaauagggaauccuuuccccauuucuuauuuuugucagguuugucaaagaucagauaguuguagaugugcggcauuaccagaaucuacaaugaacucaaacaaauuuagaagaaaaaaacaaccccaucaaaaaguaggcaaaggauaugaacagacacuucucaaacgaagacauuuaugcaaccaacagacacaugaaaaaaugcucaucaucacuggccaucagagaaaugcaaaucaaaaccacaaugagauaccaucucacaccaguuagaauggcgaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggauuauaaaacaugcugcuauaaagacacaugcacauguauguuuauugcagcacuguucacaauagcaaagacuuggaaccaagccaaauguccaacaaugauagacuggauuaagaaaauguggcacauauacaccauggaauacuaugcagccauaaaaaaggcugaguucauguccuuugcagggacauggaugaagcuggaaaccaucauucucagcaaacuauugcaaggacaaaaaaccaaacaccgcauguucucacucauaggugggaauugaacaaugagaacacauggacacaggaaggggaacaucacacaccggggccuguuguggggugaggggagcggggagggauagcacuaggagaaauaccuaauguuaaaugaugaguuaaugggugcagcacaccaacauggcacauguauacauaugcaacaaaccugcacguugugcacacguacccuaaaauuuaaaguauaguaauaaaagaauucuuauguauuaugccuuugcuuguuaaauauugguuuuuuugaagauauauuugaggcccacuuuaauuuauuuuaauuuaauuaauuaauuuuuucgagacagaguuucacucugucacccaggcuggagugcaauggcaccaucuuggcucacugcaaccucugccuccagguucaagcaauucuccugccucagccucccaaguaacugggauuuauaggcaugcaccaccacacccggcuaauuuuuguauuuuuauuagagacgggguuucaccauguuggucaggcuggucucaaacuccugaccucaggugucccacccaccucagccucccaaagugcugggauuacaggugugagccacugugcccagccuacuuuaauuuuaauagcucuuuuuuucuucccaaaagauuuguuccuuuccuaucuucaccucaugaauaauuuucucacaguuuugaaagagugaaacucuuauuacuuucuuuaucaaugaaaugauuuuagaugaugccuagcuaacauuucuuauuuuaauagguaaguguuuacuugaaaauauauuagaaaaacacuaguuuuccauuuaugaauagugcuauaauauuuucuuuuaaacuacagguauuaaagugaaggcauuaguccaggcauuuaauggaaagugcuguaauaauaaacaaacccaaauucuuagaagcuuaaggccucucuuguuaggcauccacuuuugucccacucugaugcugcuguuugggugguucuccuccaagaagugacucagggauccauuguuucauuccuucauuuuagaguccuuuucuucuuguccagggacaaauugaggauuuuguuggggccuggccuggauguggaggaagaucauuuuugccuucauuccauuguucagaccuaguuauagguucuaaccuaacugcuugggaggcugggaaguuuaacuuucuuuaugcucagaagaaggacaugggauuaauagccauaugggcaaucuuugcuacaguaaauuuaaauuauaaauugauagaaguuaacuaguuaccaugaaaaaugugcuuaacugagugaaacauuggaaaacauugggauagagcaguuuucuaaaaucuuaccucuaagauuauuucuaguucaaacaauacaauuauuguguucuguaugccuuuaauugguggaagugaguaggauaaauuuggguuauugaguuauaaaacauuauuuuagaauugcuugaccuaaugagcauggagaaaauguuuccacauuauuuuagaauugcgugaccuaaugagcauggagaaaaugcuucuuagauuucaauuuuuaauaguaauguuuaguuggcuuauuuaaugccgucuucaugccaugaaauagaaaaggcauacuauuuuaucaaauacaguauaacucuuuuaaugauauuuucaagcaaguaaacucaugacuuaaagaguaucaguuuauuuuguauguggaugcuacauuuuaucuuuauuuuuauuuuuugagauggaguuucgcucuuuugcccaggccggagugcaaugaugcaaucucaguucacugcaaccucugccucccggguucaagcaguucuccugccucagccuucugaguagcugggauuacaggcaugugccaccacgccccccuaauuuuguguauuuaguaaagaugggguuucaccauguugguggucuugaacuccugaccugaggugauccauccaccucggccucccaaagugcuaggauuacagacaugagcgacugcacccaguguagcuacuacauuuuagagaaggcgggaacauuacauuugaaauauguaguauagagcagugugaugacuaagaccacauaacgucuguucauuaucuuggcuaacuuuaauucugcugcugacuuuucuaauuacuccuguucuuuuuuugaucuuuuauuccaaagaaauuaauaaaauugaaucuuaacacugcacccuuaucuuaccuaagaagaucucauuauaaggcauaguaguuacuaaugaaauauaaaaauguguuauucaugcaacuuuaaaguaucaccccuuuuaaaguaaauauuucucauuuuaauuauuuguacaguauuuuauucuguugucuuucucaguucuuuauuuauuaaaguucuuuauucagguuuuuauuugaaacuuuacaugaaacuguccaugucaaauguuaaaacguauacaccaaaagaaaaaugucaauaaaaauaaauuaaaagauaaaauuaaaaaccacuuugaaaaaugguaucucauaguuccaauugauuaacaggaugauuaguuagucaguucucuuacuuacucguccacccaugccaaucugugaucucguuucuggcaugaaaauauugccuuuuuucugacauuuguguuuuagcauaguguuucugagauucauccauguuguuacauaugucaguagcuuauuuuuuuuauuacugaauaguauuacauuuucugaagguaucacaguuguuuauccauuuaccaguugauagauauuugggcuguuuacaguucaaggcuauuauaaauaaagcuguuagaaacauucacuuacagaucuuugugugaacauaaauuuuuauuucuuuuggguaagugccuaggaauagaauugcuggguugaauaguaaguguuuaacuuuguaagaaacugccagaacauucuccaauuuuguuuugucauuuugcauuccuaucagaaaaguaugagguuucuaguugcucugaauuuucaucagcacuugaaauuaugcaucuuuaaacuuuuaguuauuuuauugaaagugcagugauaccucauuuaaaaaaagcuuuuucuauugugaaauuaagaccuaaaagaguugcaaagaugguguagagaguauccuucaccuuguuuccccugacguuaacgucuuagauaaucauggcacaaugaucaaaauuagaaauuaaccuagauacagugccgauaauuaaguuacauaccuuguucgaauuuuaccaguuuuuuuuuucuuuuccuaauguccuuauuguauuuuaggcucugguccaggauccuauaaugcauuuaguucaugucucuuuagucuccuccaaucugugaaauuccucuuucucagucuuucugucucucucuguuccauugcucuauauuucuauccuuuugcccguaucagagucucuugauuacuauagcuuuguaguaaguuuugaaauugaaaaguuugaguccuccagcuuuguucuuuuuuuucaagaucuuuugacaacucaacuucuucgcauauuuuacuaucacuauaguaauguaguaauauuauuauuuaguaauaaguuauaguaaguaaauaauguuauaguaaguaauuauuacuauuacuauuacuuugucaugucaagcaugguggcauuuucauugggauuccauuaacuuuauagauaauauugaaacagccagcaucuuaauaauauugagccucuugauccaugagugggcaguguauauccauuuauugcuucuaguuaauuucucucagcaauauuuuguaguuuuugguggcagaucuuguguauauuuuguuaauuguuucccuaaauauuucaugugguuugaagcuauuuuaaaauguuacauuaaaaaauuuuuaauucauuuguucauugauggucuauagaaauacagguaaauuuuuuauauugucuguagucugugugcuugcuacugucuguagucugugugguugcuaaacucacuuguuaguuuuaguaguuuuuuuguagauucuuugauuuuuaauguaggcaaucauagcaucugucaguagaguuaguuuuacuuauuucuuuccaaucugaugccuucuauuuauuuuaauugccuuuuacacuguuuaagaacuccaguacaguguuaagaauucaugagcgcagacauccuugucuugucucugauuucagauggaaagcaaucuuucaccauuaaguuagcuguaggcuuuuaguugauuuuucuuuuaucccauugaggauguucuauuccuuguuugcuuagagguuucauugugaguguauguugaauuuugucaggugcuuuucugcaucuauugagaugauaaugugguuucuuuacccuucugaccuaugguaaauuacauugauugauuuuugaauauucagccaaucuugcauuccugggaaaaaccaagcuguauuauugucuuuuauacguguuguagaauuugauuugcuaguauuuuguuagagauuuuugcaucuaggcucauaagauauucugguuuuuuauuucuuuauaauguugucugguuuuggugucaggguaauucuggccugauaacaugaauugggaaauguuuuuucuuuuguuuuuugagacagagucuugcucugucgcagaagcuggaguacagugacauaaucacggcucacuguagccucgaccuccuaggccgaagcaauucugccaccucaacuuucugaguagcugggacuacagucauguaccaccauaccuggcuaauuuuuuuuauuuuuuguagaaacagggucucacuauguuuauguugccuaggcuggucucgaacuccugagcucaagugauccucccaccuuggccucccaaagugcugggaauacauaggugugagccacaucgccuagcugggaaauguuuuuucuguguuuagaauucaccagugaaggcuggguguggcggcucacgccuguaaucccagcacauugggaggcugaggcagguggaucacaaggucaagagaucgagaccauuuuagccaacauggugaaacccuaucucuacuaaaaaaaaaaaaaaaaaauuagcugugugugguggugugcuccuguggucccagcuacucaggaagcugagacaggagaaucauuugaacccaggagguggagguugcagugagccaagauugcgucacugccagagcgggacuccaucucaaaaaaaaaaaaaaaaagcauucaccagugaagccaucuggguggggaaucuucuuuuugggaaaguuuuaaacuaugacuucacuuuauuuaauagauaaagagacauucaguuuauuucuuaugugagcuuugguuauuugaaucauucaaggaaauuauucauuuuauuuauuuauuuauuggcauaauguuguucauaauauuucuuuuuuauucuaauguuuguaggaucuguggugauggcuucucauucauuccugauauuuguaauuuguauauuuucuuaaucugucuggcuggauguuuaucaacuuuauggaucuuuucauagaaucagcuuuaguuuucauugauuuuuuuucucugcuuuucuucuuguuucagugauuuugcucuuaucuuuacuauuugcuuccuuuaguuugcuuugugcuuacuuuucucccuuuucuaauuucuuucuuuuuuuuuuguuuuuguuuugagacagagucucucugugucgcccagguuggagugcaguggcacaaucucggcucacugcaaccuccgccucccggguucaagugauucuccugccucagccuuccaaguaucugggacugacuacaggcacacaccaccacaccuggcuaauuuuuguauuuuuaguagagacgggguuucaccauacuggccaggcuggucucgaacuccugaggugaucugcccaccucagccuccgaaagugcugggauuacaggcaugagccaccgugcccagcccccuuuucuaauuuuuuaaugucgaugcuuagacuaugauuugagaccuuacuuauuuucugugcauuuaagugugcuacacauuucccucugaguacuguuuuagcuguacaucacaaauuuuuauguguuguuuuaauuuucauucaguuuucugauuuucauugugacuuuucuuugacccccauuaguuauuuggaaguggacuuaaaaauuuuccaaguaucaggggauuuuccugagagcuuucuuuuauucaauucuaguuuguauucuguuuuguaagagaauauacuuuucuuuuuuuuuuuuuuuuuugagacaaggucucacucugucacccaggcuguaaugcaauggcacggucaugccucacugcagucucaaccucccuggcuaaagugaucuucccgccucagcucccccaaguagcaaggacuacagacacaugcuaccaugcccagcuaauuacaaaauuuuuuuuagagacagggucucacuuuuuugcccagcuggucucaaacuccuggccucaaaugauccucccaccucagccucccgaaguguugagauuacaggcaugagccacugcgcccagcuggagagaauauacuuuuaaugacuucaguguuuuuaaguuugugagauuuguuuuaugagccaucaguuagaauuuuacucuauaaguaaguguauauauuuuaaauuagguuaauuuugauauauguauuguuaguagugcuaggguugggaauuuugcuuagcucucugaauuaggucauuauaaaagaguuucugugucagccaugaauugcugaauaauccuggguuuauaguaacauuuaacauaucucagcccuucacaaaauauauuuugauauguauuuuccaccaaaguauaaagaguagcagcuaacuugugaaguuaauuaaaauuaauuuuuuuauaaugagcuaauucacucagugaggagcacguaagugcuccuaauuuuauauugaauguuaugaugauuuacauuuaaaauaaaguccuaucuuugcaguugacaaauuacacucuugaccaaagugccuuuuuuaauuuucguuuuuuagcugauuucaaaucauuuauuuuaccaucucacagaaagacagaaaaggaguggccaguugccaaaucauuuuucccaauaaaaagcaauauggauuugguuugcuugcuaaaucugauagucuuaaaucuuaauaauuauguacucugaugaaauuaauuuucucuuaauauaaauauguugaauauuauuccaguugagaaguccauauauaaucaacaauaaauuauaauguguuaucgaaguuugcuuacauauaggguaucuccuaauguaugguuugugcaggugacuaucaaacuaagauugcauucccuaagcacucacuaguuuggcaacacagcuguagauuauuucaagaauaucuaucugccuugccaguccuuggcacuugggaauuuucuugcagucaccuuuuucugugguuucacccagucccuucucuuugcauuuuuucuauuuauuucuucuuucuaccucugaacaugcuuaggucacuuguauuaaaacacagacaaaugcuuccuuuaccauauaaaacacauucaaaaaguaguccaugcuuguugcugucacuucuuaccacccucuuauuggcuauuuuuccauaguauaacaucuagcuuguacccccgcgccccaccaccccaugccacauugucaacaaaaagccugaugaccuaauuucaauuuaaugauuuuuacucaucuuuuaucuucuuugaacuggcuugacaguuccuuuuuuucucuaaguccuuuguauccuccgagaugcuguccagacuucagcuaauauuuuuuggaugugcauuaugaacuagaguuagacucugcuagguuugugagcaugaucuuucuucuaaggacugucaucugaccuuguguguuucucaucccuucauccauucucuuccaugucaucucuuuuacuccuguguuacucuuuaggucuucccuacagauugaucuuuaaaucuuuuucuuugcccucaaccauuuuuauuuuuauuuuuuuugagacagucucacucugucacccagccugaagugcagugguguaauuuugacucacugcaaccugcacccccccggcuuaagugauccucccaccucagccccccaaguagcugggacuacagguacaugccaucaugcccagcuaauuuuuguauuuucaguagaaaugggauuucaccauguugcccaggauggucuuaaacuccugagcucaaguaauccacccucuuuggccucccaaagugcugggauuauaggugugagccaccacgcccggccagacuaauauauuaaucccacuucuguaacaaccacaacugccuccauuaccuucuacagaacaaaauugagagccauugacauguguuuuaggauauugaagaauagguauccauucuaugguuuccagucuuauuugccauugcucuauuacaugugcuuuaugcucuagucuagcuggacuacuuuaauguugccagaacacucaucaugcuuuacccacuuggagugcuuucucacauuguucuauuucucuauuaugcuuuccuacuuaucuucaucugugaagcuccuauacauuuuccaaguccaagcugcccuaaauauuguaacagaaugugaaccuuccugauucugaacucccauucucuuuuguagcauuuauguauuacuugccauguucuaucuggaauucuaauugugauucauguucaaaauacauucuugaacauaacaggcuuccugauaaauacuucuuauauccagguuuaaguucacuuucagugcugccauacuguugcaguuuuuugguuuguuuguuuuauggaaaacagguacuuuuuauuuuauuaaagcuuuaaguucuguaaucauucaguucuguuuuugagauugguuguuugacccaauucuaggugcucagauuuuugcuguguguauuagauaucuauucuauguaaugaauuaacccaaaacuugguguuuuagcaugauaaacaguuauuaucuugcgguucugaggguuagaaauuugugagugguuuaguugggugguucugucucaggcucccucauaauguuggaguccaagauguugaccauggcaguagucaucugaggcuugauggggacuguaagauucauuuucaauauggcucccucacauggcucaggaggccuuaguuccuugucauaugggccucuccauagggcucccuuaguguccuuaugguauggcaguuggcuuucuucagagugaaugauccauagauaagcaagguggaaauaauuucuuuuaugagguagccucagaagucauauaccauuauuucugcaauaugcuagucauaagaagugaguuauuaacucuggacaccacugaaggggaauggaauuuagcuuuacccuuugagggaggauugccaaguaauuugugaauauauuuuaaaacuccacuccacauaauuauguguuauuaggagaccgaugacagguaaauuacacuaugaguuguuuuaaauuguugcuauauuuuuucuauauuaaagaaauucuaaguucugaaguaacauagauacuguuaauaugguuuuuauguuuuguuaaagauuuauguguccuuaauuuaucuacuaauugagauuauuuuuaaggauuauuuuuugaaaaucuuaaaaguuuugauaauuuuguuucucuuuucagggcaccaacauaucauugaauuauucccaacuuuguccuauuguuuuucuuucugacuuccuauuuuaagaaaauauauuuugcaugccaauuacagaaauguguuuauugaaauaaauggcuuauuuuuuccucucagcugauuugaauaggaugcacagacaaaauauagaugccuaccauaacccagaugcaagaacauaugaagauaaaagggcuguuguaucucuagacccaaauuuagccacuucaaaugcugagaaccuagaagaugcugcaaauaaaagcucagguuuuuaaucacuuuuuuuuuuuuuuuuuuuuuuuuacauuucugaaauuguucaguaacauuucuguucugugacuaaguucuuauugggaucuugagaauuuggcuauccugauacaggaaacauaacacacuauucauaaagugccuuuucuucauaguuacuuugaaaaaaggugaauagggaaagguuacuucuuccuacuguguuucuucucagcuuuguaacuugcuguguauccuuuagcugcugcuaacauuuuuauuuugcuagugggggacauuucuuaauaucaaacacucuuuuuacacacauacacaauuugcaucuuauauccauagcuguuugaauuagugaaacaguaucauugugauaugauaaauuguacagggaaauucauuuuuuacuuguuuuaguaaucauuuacccucccuuguaaaacaacaguguacaaagaaaugaagcaauguuguuuuuuuuuuugugagauggagucucacuuuguuaucccaggcuggagugcaguggcauaaucucagcucacugcaaccuccaccuccuggguucaagcaguucucuaccucagccucccaaguagcuggaaucacagguacccaccaccacaccuggcuaauuuuuguauuuuuaguagguaugggguuucaccauuuagccaggcuggucucgaacuucugaccuugugauccauccgccuccaccucccaaagugccgggauuacaggcgugagccaucgccugguuacaugccucuuaacuacuuaucuuugauuuacuauuaauauccuuuaaucaauucugaaagaugaaaauuauucaauuaucuuuuuuugacauaccaggaaaaguugucagguauguuaaauuguguuauauauuuaaaaauaaaauuuaauacagcaccucacacuauauuuugaugccuauaaaacuggccauuuauucauuacaaaauucuacuuugugcuuucacagaaguuuugauuuuagauuagaaaagaacuuuucauuaggaaguucuaaaauauuugugacugaucauguagucuuuuuuguuuuuaacccuuauuuuuggcuaaacagauaagugaaguggggagcugugauuagagucauagcccugcaucuuucaaggcuuugaugguagcacacuuaucuguagccuuuuugaacaguuuaagagauggauuauuuaccguuuucaugggcagcuuguaccaguguuuucuaauuaugagaaaaugcuuucuuuguucuacaauauauuuuaucggauccaguuuugauuuuuagagcacuaaaauuggaaccuuugauuuugacaauauuauugauuuggcucuuuuaauuuguaauagugugugguaagaacaucacaacaccuuuucauauuauugcugcuaagagaauuuugacuuauuucugauauuuuucucauuugcugcugcuucuaguagucuguauugagaucucauugccauacagagucuuucucuacccuuuucuuccauaccugguauuguuuguaguucuggcucagccuagaacuuucgcuaucuuaguaauaacacuuuuuagccaucuagcuuugcacaccaagcaaaaacaccagaaaaucaacaguucccaugaucccuucccaaaagcauaagccugaugauuaaacaugcacagcaaaauuuguugccuauagccuuucuguaccacugccagguuuuuaugcugauauuguugccaagauguucuguuuuaagaauugaguaaaaaaaaaaccauaaaauguuuaaaacuuccuuuuuuuugugaauugaaauucccaaauuagacuuuucuucccuaagaaugaauuaauuggcugggugcaguggcucacgccuguaaucccagcacuuugggaggcugaggcaggcggaucaugaggccaggagaucgagaccauccuggccuacauggugaaaccccgucucuacuaaaaauacaaaaauuagcugggcgugguggcaugugccuguagucccagcuacuugggaggcugaggcaggagaauugcuugaacccgggaauaggagguugcagugagcugagaucacgccacugcacuccagccuggugacagagugagacuccaucucaaaaaaaaaaaaaaaaaaaagaauuaauuaaucuaaaauaaacuuucucaauacaagaaaugauucaaagccaccuaauuuugugcuaugccauauauauguguaugagugcauguauguguauguauguacacacagacacacauaucuuugcauauauguagcauuugauauuuuaaaagccugaaggaacuugaauauagcugaaaauugaauguuacaacauguguuuaaguuuccuuauccucuaauauuuuaucuucauuagguuuguuucugaugcccuuuauaauguucauuauuuuuucuuuuauuuuaugguuuuuagaugagcuauggcuuaugaagucuaauacgaauuuggcuuaaauuuauuuuuuuggcuuauuaucaugccaagauacauuucugcuuucuuuguauauagcaaguguuucccuaugauuuuccuuuuauaguuuauucauuucuaaaaggacuucucuugucugucucuaauaauauuucuucucuaauugccccaaagguuuagaauaggagugagcaucacggugaaacaugcuacucaaguuuguuuugcuaaucagcuuuuccaccacagcauaaaauuuaaaagagccuucaagguguauauuuaguuuguuuucagugggaaaauuuucuagagggaaaaaguauucauaauguuuaaguauugauuuggcuuucugccagucuguucaaauaagcauuaauaaauuuaaauacaaaagcaaaauagaccugagugguagcugaacugcaaagcaauuugccuauacaaaacuacaugcgagaaauacaugcuuuaggcugggcacgcuggcucacgccuguaaucccagcacuuuuggaggccgaggcgggcggaucaucugaggucaggaguuagagaccagccuggccaaugugacgaaaucccgucucaacuaaaaauacaaaaaaaaauuagccaggcaugguggcacacgccuguagucccagcuacuugggaggcugaagcaggagaauagcuugaaccugggaggcagagguugcagugagccgagaucaugccacugcacuccagccugggugacagagcaagacucugucucaaaaaacaaaaaaagaaauacaugcuuuaguuuaaugguauaaagaaugagucagaaacucaaaaauaauauaaaaaguuaugugaggcuuaaauuuaaaugucauuuuuucccaucugcauucaaagagacucuaaggguauaauuguuuuucgaauugcuuuuaugaaauaauuuuuuccauuccaagaauauaugauacuauuuauagguaauauauacuaaaaaauuuuuguucauguuuauaucucauuaaguugagaguuuuaaaaauaaaaacgauuacaauaauuaagaugcauucuaauuuguuaaauauguuuuucaaagcugacuuucuauucugucauuuaaacuauugggaagcauuuugaaauuacugauuuuuaaaaacgguuuuagaaaauuuuaaauauauguuacauaauacauuuuaauauguuauuaagcaauauucuuaaguaaaggauauucacauacugaagaauguaaauauguccuuuuuuucuuuauaaauucuauuuuaaagccuuuguugcaaugaggguuguuuaagcuguuagcuuuuauguuuccuuuguaucuuucagauauuauuugauuuuuuuaacuguuaauuuuauuuuaguauuaccauuuuucuuucucuuacuacuguucaucugaucuucagauucuaaucucaaccuuccccuucugauuuuaaucuuuggacuuuuuuuuuuuuuaaaaaugaauuuauuagcaaacuguucauucuuuaacuguuaaauuuucuaagcauuggcuaauaguauguuuuugcaaaauauuucuuucaaggucauaugcaaacacagagcucuccuuuugcucggggaaauguauuuggugagccuccaacugaacuucagauuaaacagcaagaauuauacaagaauuuucuucguuuccaggugaaaugcuauuugaucaguuucaaaguuucaugagauuuuaauaaacaaaacuugcaaagauuuucuccaggauaaauacuaaauucuaaaaugccauacuguuaucuaaaauaucuaauuuauaucagaucagauaucaguaguacaaaaguuauuucauuucaaggaaauaaacagauguauuaaguauaguaguugacuuaaucuuuuauuuuauuaaauaauuaauuuuuuuuauuuuuuugagacggagucuugcucugucuacccaggcuaggguguaguggugagaucuucgcucacugcaaccuccgccuccuggcuuuaagugauucuccugccucagccuccugaguagcugggacuacaggugccugccaccacgcccggcuaauuuuuuguauuuuuaguggagacaggguuucaccguauuagccaggauggucuugaucuccugaccucgugaucugccuaccuuggccucucaaagugcugggauuacaggcgugagccgccacaccugaccaauuuuuguauuuuuaauagagacgggaugucaccaucuuggccaggcuggucucgaacuacugaccucaagugaucugccugcuuuggucccccgaagugcugggauuacagguguaagccaccacgcccagccuaagucauuaauuuuaaaucaaagaaugcugagauuuuaaaaacugauuuacuaauauauucaucuauuaggcagagaaugcaucuuucuagauauuuguaaguuauuagaaaaucaauagauuuuuuccaaaugauuugauauuauuacagauuguaaauaaauaaaaauuagauuuaagauaaucacaguuuacaauuauuugccccauuuauguacauaaguaaauggcauuuaacauaguagaacugcccagacuauucgcaaaggaagacacuugaacauccaguguuuaugaagcaaacagacuuacucccauacuggggguacccugggcugaguccuagggauggagccugagaugaaugugagauacuugcucaugagggacucacaguuucuucuuucccuaccucccuccccuucacacucacacuuagauaccagugucagauuaaucuuauggccugguuaauccuccuuugauaugacuuuucaccugcuauucuucuuuacucaaaaucuggugguagcuuuucuuugccuacagaaauuaucucaacucuugaaccuaacauuuaagguuuuauaaucuaauuccaaacucuuaaauagaugcccucaaacauaucuucuuuuuaauccuaauuauucuugacucuuaaauaaggcagugacguaauggauauagccuuuaaggaugauugauauuaggcugggugugguggcucacaccucuaaugccagcacuuugggaggccaaggugggcagaucucuugagcacaggaguuugagacuagccugggcaacaugaugaaaccccauuucuacaaaaaauuagccaggcauuguagugugugccugucaccccagcuacucgggaggcugaggugggaggauugcuugagcccaggaggcaaagguugcagugagccaagauaugccacuuuauucuugccugggugacagagugaaaaaaggaugauugaugugacaucacuguuuaagauacaauaauagaggauuaaaaagaguggaagcagggauauuuuacuagugugggugacaguggaaauggguggaaagugcuuuuuaagguucagcagaaacaauauagauauuaaaugugagaaacugguaucagaggucccaauauugugcacucaagucagguagcagcaaguugaggguucagagucccuguugaacguaaaggaccgugugguauauugaccaugacagcaggucauaauuuaaguaccuccucuaaugcuuagcaguucuuaucauggucuaagguagaauucagccaaaaaacaaucuuacaauuguauagacuuuuauuguuuuugagauacuuuuacauauagugucucaucaaaccucagauuucucugagagagguuuuauuaucucuguuuaauaacauacaacuaauacacagacuaacaggcuugcccagggugucacagcuagcaaauugugaggccauugcuugaacccaagucuccagacuucaaguguaauaucuauggauaucagacuucuauuuauaggauucacuaggaagucuuuaccucuagaaaaaguaugguaaugggggaagcuuuaacuauuuuaguuucaaccuucaguucuuccacccugucaacccucaauuuaucugugaauggauugcuuucagaugaugauuuuuuaauuuuucuuucagcagccucuucaaaaucucuucucccaccucaaacaaaaccuaauauguaauucuaagaaaauguaaaauagaucaaugguauuuauuauuacugucaacaauauaaugucagauaaaaaguauccaaaacuuuuguuaaaaaaaauauuaugaaauguucaaaucugugcacaaagaugguaagaaauuagccugaggucuguacaaguaaguuccacaguuagcucaaguuaaugcaucagaagucuucaugcuguuaaaauuuggugaauauuaauaacacuugugaauguuugacauuuuuaaccacagcuuuaaaaauaguuaacaaauaaaauauuuuuaagaacucugaagcauuuuuguguuauguaauuggaaaaccaugacaggaagauagcuuucccugcuuuccagaccagaaaccuguugaacaacugucuagcauuccuguuggcacugagcuuuggauccauuagguguaugauccauuaauagcuuaaaaauugguauucuuugauuuugauggaaaagugaccccugugaaugugauuuuuuuuuccauggaguaggaagaagggggaauugaguauugaauaugaaauuuugaugaauuauaaaugauguuuucuuuaggcauauuggacuugaagaagugauugcaugcaaauugcuaacuaaaaguacuaaauauuaggcuuaugcauauuuaauaauguugugagaaagaaguguuggaaaaagcccuaguauauaaaaucauaggauguguuagaagauuaaaguucuuuuuuuuuuuuaaagacagagucucauucugucgcccaggcuggagugcaguggugcaaucucggcucacugcaaccucugccuccuggguucaagugauucuccugucucagccuccugaguagcugggauuacaggcacacaccaccacgccuggcuaauuuuuguauuuuuaguagagacgggguuacaccauguuggccaggcugguuucgaacuccugaccucaggugagccaccgcgccuggccagauuaaaguucuuguagcucaaaaauuaauagcacuagauagagcaaccuugaagcuagaggaaguacagacaagaaaaacaaaaauaugcugaguaguaugauccauaccuaaggauaacuaaaaucuguugauaacuuuaaaccagagacaugaauaccugguucccaugcugcuguucuucccugccucauucaucgggcguguggacuaucuaucucuuagggccuucuuuccuucaaaucuuaggcucuagaguacucaacgcugcagacuccagguagcauucaagaugaaacuuaauugugaguccuugugaccuaaauccuccuccaccuaauaguuuuaguucuuucuccauuaaccucuauaguuaggaaauaacaaagggcauuugggagaaauggcucuugcauuaaaaaaugauugaauacuaaaauacuaauuucacuguuauuuuagaauaaucaauuccaagaauuuugacacauaauagcagcaaucacuauagaauaauauaaucaugaauuaguugcuuagaaccuucuauauaggaggacuuuuauguuccuuacauuguuucacuuuaauucuuuaagcacuccuuugagauguaggcguuaauaacuguguuuaccagaaaaaagagaaaacugaggacaagcaaguuucuuaaggucacacggucuguuugguggaacuggaauuuaacucaaagcuuuuaacaguacaguaaaucauguagccucccugaaaauacaggagacugaaaaauuuaggaacaugcaaaaagaggguacaaguguugaguuuauauacuaucaggaaaaaaauaagugauauucuaacuuuucaauaguuuuacaagauaaauaacuaaguuuaauucuuuagauugaggaaaagaaacaaagagaggaagcagagcgagagagacugagaauugcagaagaaaaagaagaaagacggcuugcagaacagagggcacgaauucagcaggaguaugaagaggaacaggaaaagaaaagagagaaagaggaggagguacaucuuuuuucccuauuguauuuuacuacuuagucugaaggugaaaucuuugacuugaaaagguauuucuuacuuauaaaggagaacaguguuggaguacauuuagaaaauaucagaucaauauacauucuuuggauauuauuuuauuaaggugaaaggguaauuuaagaaaggagauaagugaugacuuuaaaaauauagauguaggcugacugaagacuuuauaaaagaugccuaauauuuuauuuuuaagcagacaacuuauguuaaagaacaccauaucaugucaucuauaucuuuaucucauuuuaucagauaaauaaggcagcacauuuuugaauguacuauagaaggaauauauggaaugcauauuucucuuuuuauuuuaaagcaaaggcuaaaaaaugaagagcauauucgguuagcugaagaaagacaaaaagaagcagaaagaaagaagaaagaagaagaagaaaaauauaaccugcaacuucagcacuacugugaaagagacaauuugauuggggaagaaacaaagguaaguuucagacaaaaaugucaaucaaacccauaguuuaacucacuuucacugugagaguuguacaguuguuagaaaaggggagaaagaggaggaggugcuuuuguuccuguucugucuuacuguuuagucugggcacaauguacugaacuuucuguaggagguacugucacugugcuuuguugguauuuucuguccauugaagguaauggauuuacuuacuugagccauucuuagucucauucccaugguguaugcggugccacccaagaauauggucugcagacaguacaacaugaacuguuuguuaugguucaugacaagacuaauacagaaagugagagugguuuauauauauauauauauguauucuuuuuuuuuuuuuuuuuuuuuuuuuuuuugagacauaaucucgcucuguugcccaggcucuggagugcaguggcacaauuuuggcucacugcaccuccacuuccuggguucaagcaguucuccugccucagccucucaaguagcugggacuacaggcacacgccaucaugcccagcuaauuuuuguauuuuuagcagagacgggguuucaccauguuggccagacuggucucaaacuccugaccucagaugauccacccaccucugccucccagagugcugagauuacaggagugagccaccacgcccggccuucucucucuuucuuucuuucuuucuuucuuuuucuuucuuucuuucuuucuuucuuucuuucuuucuuucuuucuuucuuucuuucuuucuuucuuucuuuccuuuccuuccuuccuuccuuccuuccuuccuucuuucuuuucuuuucuuuucuuuucuuuucuuuucuuuucuuuucuuuucuuuucuuuucuuuucuuuucuuuucuuuuucuuuuucuuuuucuuucuuuuuguuuuaagagaccaggucuugcuauguugcccaggcugaucucaaauuuuugggcucaaguuauccuccugccucagccucccaaaguggugggauugcaggugugagccaccacacccugccucacagauaauuuuuuauuguaaaauucaucauuuaagaauuuaaggucgaggcaggcggaucacuugaggccaggagaucgagaccagccugggcaacauggugaaaccccgucucuauaacaaauacaaaaauuagcugggcgugguggcaggcaccuguagucccagcuacucaggaggcugaggcaagagaaucgccugaacuugggaggcggagguugcagugagccgugacugcacuguggcacuccagccugggugacagagcgagacuccaucucaaaaaaaaaaaaaaaagaauuaaacagaauuguuaguuucccauaauuauauuucuuguaauuucuuauguuuuuuaaaaaugcuauuuuuuaaggaauauauacuuuuaugauauuauaauuuaauuguaaaguaccauaaaguuuuaaaucagcuuuaucccauuuaaugcauuugccuuucugaaauuaacauugcuaucauuuucuuucauuuauguaugucugauauauauauauauuuuugucuauuccuucaguuuuaccuuugugucaccauauuuuuuauuuaguuagcuucuaucuuuaguuuguugaauuuuuaaaauccuaaucugaguuauaaucuuuuuauuuuuauuuauuuauuuauuuauuuagaaauagagacucgcuuuguugcccaggcuggagugcaguggugcaaucucggcucacugcaacuuccgccucccagguucaagugauucuccugcccuagccuccccaguagcuggaauuacaggugcaaacuaccacaccuggcuaauuuuuauuagagacgggguuucaccauguuggccaggcuggucuugaacuccuguccucaggugaccugccugcuuggccucccaaagugcugggauuauagacaugagccacugcaccuggccuaaucuuuuaaaauagggauaucuaaauccauuuauguuuaucaaaacuaaugucuuugcauuaauugcauuucugacuuuuuuguguuuuucuuccuugauagcuuuuuggucuuuuguuauguguacuauggcuuguuugcuccauccucuacagggauuuagaaugucuauguuguauuuacaaugaaguuuuuggacuauaagguuuaauacacuauaaacugaaauauagaaccccaucgugaucuugaaaagucccucauccaugaugcuguuagugauuagaucuagauuuucgagguugauuuguauugcuuuccagaaggauuuuguuauuuaauuuuuuuguauugucaugguaccuuuuuauuauuaaagaugauucuuuaguuuuguuauauuuuuucuuuuuuguugcuuuacuuguguuuguugauuuuuuaaauccuaaucugacagucauacuguuuuaauaaagaugucuaaauccauuuauguuuaucauaaccaacauguuugaucuuauguaauugaauuucugacuuuuguagaaagcauuuuauuaaauaaaagcaauaacaaucuaaacuucuuagaugacuuucuuaacuauaagggguguguguguguguauauaugugugugagugugaugaagcaaauaugcucuuaaauuuuuuaaauuuuucagcacaugagacagccuucuccuauaguuccugcucuucagaacaaaauugcaagcaaacuccaaagaccuccuucaguugacagcaucauacguuccuuuauucauguauguacuuuuguuuuuauuuguucauccuagcucaguuauuuuggauugggggaucgaaugaaauuuucuuuuucauuauauuuggauagguuaaauuuuuucagaucugaaauauaggugauaucuacaguaauuugccugcugcuucgauuguaacugauagugcuuggugcccuaaaguuucuuuugacaaaccauaauuuagccccucaagcuagguagcuguagauaugcucauugagucuguuauacuuuagauugaacuacaaggaaaagagaacauggaaaauguucuaagauugauccucaaggugaugcuugaagaauaugcaggaauuugccuugaagaggagggugagggauuaucagcuuguggaaagucguggagagcaauguaagcucauggcacauguggagaaucuuccaugguguggucuggccugaugaugcuugugcauuaaggcagcagaggagguggaggucagaacauguguggcaugcuguacggagugcuaagagcuuugauuuuguuccauaggcugguagauuccagacaggcuaauuagcagaagguaaagaaaugugucagaagaacauguuucugaauuccacccuuugagauucugauuuaguaggucugugguagauaaugcauaggaauucauuguaauauuuaaguaggggaaugacauggccacuuuuguauaauguuuuuuuaggcaaugguguggagauaaguuuuggagguggggcaagacuaaacauggagauaagaugcuuuugcacaaguccagaugugagacugaggacccaaacaaaggcagugacaccaagaacugugaaggugugacagcuuuaugauacauuuaagagacauaguaguacuauuuguugagugugugguggguaggagucuaugauaacuuucaaguuuuuggugaggguuacauagaguaggcaguugaaaauaugaauuguggcagcagaaugaguucuggacucgauuuguaguucuggacgccaucaacauauuggugcuuguuaaauuagugccauugucuacgaugagugucuacaagagaaguaaaggaggcugagaauagaauacugggaaauuaccaacauuugagaagcagugaaaggaauggacagagggugagagaggauggcagugacggcaguugcgacuggccaaguaaaaugcccacugaaugugucacuugggggucacuugaugacuuuggugaaggcaguauuguuggagugaugggugugaaagcaaaggccauagcuguguguugagaagugaaugagaguaggcaguagacccaaaaguacugcauuuacuguucuuuaaggaagcucagcugugaagggaaggacagaauggacaggagacagugagcaaugaaggaugagguaaaauuuuuuuuuaagaaagggagagguuuuuacacauaggcugagaggaaggugcuuggagagaggaaguuggaaaaaagaauaaucggaggagaaugggagucaauuaucagauacagaguacaggugaagggauucuguuuggguagaggcaaggacacuuccaucgugaugagaaggaagaauagauuuacaugguagauacacucuagaauagauauaaaagguggauauacucuaccuuggguagaguauagcuggguaaguuuuggagguaggauaguguggaguuugguuuccuuuacauauaaauacuucaaaaaauuacucccuucaagcuucuguguagggaagacauacugaacaugucuuugucauuauuguugaacaggaaaguuccauguccagggcacagucacccccgguaccugccaggaaaaaucagcuccgugcagaagguagaguuaacuacuaaaccuguuaccuagaguauuucucuuuuuaacuuuucauuuugaaauaauuauaaacucauagaaaauugcagaaacaguauagagcgguuaggugcuguguacccauucuccaacuuuccccugggguaacaucuuagauaguauagucucauagccaggaaguggacauugaugugguccacagaccaucagauuuuaccaguuuuuacaugcauuuauguauguguauuucugugcauuuuuaucaugcacaguuugugcgacuaccacugcaaucaagauacagaacuguuccaucaccguaaaggaacuuccuugggccucuccuuuauaguugcacucccccaagaauaucgcuucugaaauuccuauauuauaaaaaauguacuuguggguccuaaugacguucacaauuaugauccauguauguguguauauauaaaauguuaaaauaucuuucauaaaauugucucucugagcaguuucacuuuauuauuagucagguuguguuuuaauguuuagucuuuuguucuuauuccugucuuguguuuuacuuaucaaugggaauuugcagaggagaaaaaaaauguaauuauggaauuaucagaaaugagaaaacagcuucguagugaagagaggcgucuacaagagcgauugcuacacauggacagugaugaugaaauuccuaucaggcaaguuuagaauugcaguuuuuguguucgcuugaguucuuuuaucuuacuucaccuauccaguaauuuuguaguuugggaacaggacuaauucaucuuacuuaaaaucuccuuacuuuccuuuucuuugucuuuuacaaaaucagcuguagaaauuuaguucucaaggggauucauguaggaauggaaauuuccggguuggaauaauuacagacaguaguugcauuuuagaacuguuuuuuauauuuuccauuaauaacguagcuuucugaaauacuuuuuuucaacaaaaucacguacgggcuaccgaacauuucugaucauuuuugccaggagucauaaauuucaugaagcaguguucuucaaacuucaguuugcacuguuuuaguagguuguaaaaucaacauaguggguaacuaccacauuuucuuucuuucucuuuuuaaaaauaaacuuucuauuuugggguaauuuugauuauaaaaaaguugcaggcugggugcaguugcucacgccuguaaucccagcacuuuugggaggccaaggugggcggaucacgaggucaggagaucgagaccauccugucuaacacagugaaaccccgucucuacuaaaaauacaaaaaauuaacugggugugguggcacgccccuguggucccagcuacucaggaggcugaggcaggagaauggcgugaacccaggaggcggagguugcagugagccgagaucacaccacugcacuccagccuaggugacagagugagacucugucucacgaagaaaaguugcaaacaauacagagaguuucuguacacccuucauccaguuuucccuauuguuaacaucuuauauuaccaugguauguuugucacaacucagaggcugacauuagaacauuacuaugaacuaaauuugagacucuuuggauuucuccaguuuucuacuaauguucuccuucuguucaugggccccauacaagauguaccacauugcauuuaguugucaugucucccagucuccucgggucugggacaguuuaccagucuucuguuguuuuucuugugaaagucuagaugggcacuggccagguauccuguagaaugccuccuccuccagucuggauuugacugauguuuucugaugauuagacugggauuaaggguuucuggaaagaagagcacaggcauuguucugacaucacaucaucacauuguaucagggguacaugauauccacaugauaccucuggaaauguuaaccuugguuaaaguaguguuugccaggauucuccacuagaaaguuaacuauucuuuggucacaaaugacuaaaucuagcgcaccugcaagagugagaaggggguggaauuaagcuucaucucuuggagcagggguuaccuauauacaguuuuuagaauucuuccauaagaaagacuugugucuucuuccauuuauuuauuuauucaaucguuuauuuauuacugucaucucauguauauuuaucauauacuuuggguuauaagccagugcuacauuauuuuauuucacaaauuguuccaacuuuggccauugggagcucuuucagguuggcucccgugucucuuugacauguccccauccuuuuguuuuuugaagacuucuuuccagaugccucaggaucaucuuguauuuccccugccccaucccuagaaucagcuauuucuccaaggagcccugguuccuuuuggagaauguauuuagaaaccagauaagcugggucugcuuauugcugggugucacugcuucuaggcccucuggauaauauauguauguuauacuaagucauaaauauaaacauaucuauaauuguuccuaugucuauuuguauacauauuaaguuuaugcugaugucugacuguaauccaguaugugguaggauuuuaacauagcacguuaauuugacuacuuaugguuuguuuagauuuuuguuuguauucuccaggaauauugaaacaagguaaacaaggugaggaaauuucaagguacagauuggcuugauaaugaaauguuaauccaaggugguaauuuucagugauucaauaauucucccauaguaggucaauacguuccaagcaauugagagguaguguuuuuuuucuauauuuacuuuuacaguguuauaaaugccuuaacugugcagcuuuccaacuucuaaacaugcauauuuaauucaguuuaacgguuuuuuuuuuuuuuuaauugaucauucuuggguguuucucgcagagggggauuuuguagggucauaggacaauaguggagggaaggucagcagauaaacaagugaacacaggucucugguuuuccuaggcagaggacccugcggccuuccgcaguguuugugucccuggguacuugagauuagggaguggugaugacucuuaaccagcaugcugccuucaagcaucuguuuaacaaagcacaucuugcaccgcccuuaauccauuuaacccugaguggacacagcacauguuucagagagcaccggguuggggguaaggucauagaucaacagcaucccaaggcagaagaauuuuucuuaguacagaacaaaauggagucuccuaugucuacuucuuucuacacagacacagcaacaaucugauuucuguaucuuuuccccacauuucccccuuuucuauuugacaaaaccgcaaucaucaucauggcccguucucaaugagcuguuggguacaccucccagacgggguggcggcugggcagaggggcuccucacuucccagaaggggcggccgggcagaggcacccccaccucccggauggggcggcggcugggcggaggcugccccccaccucccacccggacggggcagcuggccgggcgggggcugccccccaccucccuccuggacggggcggcuggccgggcgggggcugccccccaccucccggauggggcggcugcugggcggaggggcuccucacuucccagacggggcagcugccgggcggaggggcuccucacuucucagacggggcggcugcugggcggaggggcuccucacuucucagacggggcagcugccgggcggaggggcuccucacuucucagacagggcggccgggcagagacgcuccucaccucccagacaggguugcggccgggcagaggcgcuccucacaucccagaugggguggcggggcagaggcgcuccccacaucucagacgaugggcagccgggcagagacgcuccucacuuccuaaacgggauggcggcugggaagaggugcuccucacuucccagacugggcagccgggcagaggggcuccucacaucccagacgauggguggccaggcagagaugcuccucacuucccagacgggguggcggccgggcagaggcugcaaucuuggcacuuugggaggccaaggcaggcggcugggagguggagguuguagccagccgagaucacgccacugcauuccagccugggcaacauugagcacugagugaacgagacuccgucugcaaucccggcaccucgggaggccgaggcuggcagaucacucgugguuaggagcuggagaccagccuggccaacacagcgaaaccccguuuccaccaaaaaaguacgaaaacuagucaggcgugguggcgcgcgccuauaaucgcaggcacuuggcaggcugaggcaggagaaucaggcagggagguugcagugagccgagauggcagcaguacaguccagcuucggcucggcaucagagggagaccguggaaagagagggagagggaggccgugggggagacgggagagggggagggggagggggagagggagagggagaccuaacgguuuuuugacauuaauuuuucuuuucauuaauaaauucuuuuggcaagccaauaugauuuaagaaagaguacucgagcagcgccucaauuuucucgcuugaaaauuauacaugauaauuucuacccuuugagaaucuagugaagaauaaauaaauguauguauuugaaauaaauaaauaaauauauguauuugugacucuuaaguucuaacuuaaguuauaaaacauguuacauuuaucaucauuuagcaagaauugguuaaauacauuuacuuuggaauaauuuuaauacauauucugauuaaagacaucucagaguugguucuuuauugcaauuucaugaauauauguacaaaaggaaucuuguauucacuaaauaauuugccauauucaacuccuauuaugugcuaggcucaaaacaaaugugauguggcucacaugugaagauuuaguaaccuacuuccuaacuuaucaguguauaacuauuagcauuaauggaaacuagacagcaguccaauuuaauggucucuuggaugucuuuuuaguauuuugcauuauaguaaaucuccauagaguuccuuucaccuuaaguauuagaggucucugucagccuugaccagagucauuuuguggccccagugaaugcuccccugcaaaagggaaacuccauuagagcaggggcauugucuguggggaucccagcuaucuugucuuggugcuuagggaagauuuaaugauaaagaaaugaugggaggagucugacuaagccucauaaugaccauagcuuagagcuccauuuucaaaaauagaggagaccuagugcugacugaagcagcaguagguauuuuauuuuauuuuauuuuauuuucaggacuagaaacaccaucccucuuuuaucaucacucccucaaagcccuggcagaaaacacccuuacuaccugcuaucuauuaauuucuuagguaccacaggaaucaguuaacuaguuagguuaucaaguuccuuguaaaguccauuguaaaguuaauguuggguccucugaauaaugcccauauugaacuacguauuaguaccauauuucuguuuuuauuuuuauuuuuuugagacggagucucgcucugucacccaggcuggaggcaugaucuucggcucacugcaaccucugccucccggguucaaguguuucuccugccucagccuccugaguagcugggauuacaagugcccacccccacgcacggcuaauuuuuguauuuuuaguagagacaggguuucaccauguuggucaggcuggucucaaauucuugaccucaggugauccacccgccucggccucccaaagugcugggauuacaggugugagccaccgugcccggccaguaccauauuucuuuuuauauuuuuggagacagagucucuuucugucaccuaggcuggagugcaguggcaugaucuuggcucacagcaaccuccgccuccugauucaagugauucuagugccucagccucccaaguaggugggacuacaggugcaggcuaccacaccugcuaauuuuugcauuuuuuaguagagacgugguuuuuccauauugcccaggcuggucucgaacuccugaguucaagcaauacgucggcuucucaaagugcugggauuauaggcgugagccacagggcccugccuauuaccauauuucuaugugugauuugugucuuaggcugaggggaagguaauuuauugauuaucuaaugcaugucagguacuauacuagguacuuaacaguauagcauuuaucucaauucugaccggauaugguggcucaccccuguaaucccagcacuuugggagacugaggcggauggaucaccugaggucaggaguucgagaccagccugaccaacguggcaaaauccugucucuacuaaaaauacaaaaaaaaaaaaaaaaauuagccgagugugguggugcgugccuguagucccagcuacuugggaggcugaggcaggagaauugcuugaacugggaaguggagguugcagugagcugagauugugccacugcauuccagccugggcaacagagcaggacucuuucaaaaaaaaauuuuuuuaucuuaauucuguuguucaccguaagacuauaagggguagacaucugcauuuuacagaugauggaaucgaggucaaacugcuaauaaauaacagagcuggucuuugaaucucaguuucucugaccucaaagacugugaucuucauacuccaugaacauuuuauuuuauuuuuuccaugaacauuuuaaaguaaggcugaaucauucuauuguaauaagguaucuugcaucugaggauuuugaaaaauuucaauaacguuauaaauaugcuauauuuuaagguaaaggauggaacuaauagagcuguucgaauaauuuauuuauuuauuuauuuuugagacggcuucuugcucugucacccaggcuggagugcaguugcacuaucucggcucacugcaagcuccaccuccuugguucacgccguucuccugccucagccuccugaguagcugggacuacaggcaugcgccaccccacccggcuaauuuuuuguauuuuuaguagagaugggguuucaccguguuagccaggauggucuugaucuccugaccucgugauccgcccgccucggccucccaaagugcugggauuacaggcaugagcuacugugcccggccaauuuuuuuuuuuuuuuuaagagacggggggccgggugcaguggcucaugcacgccuguaaucccagcacuuugggaggccgaggugagcagaucacgaggucaagagauagagaccguccuggccaacauggugaaaccccaucuuuacuaaaaauacagaaaaaucagcugggccuaguggugcacgccuguagucccagcuacucaggaggcugaggcaggagaauugcuuaaacccgggaggaggaggcugcagugagcugagaucacgccacugcacuccagccuggcaagagagcgagacuccaccucaaaaaaagagacagggucucccucuguuguccaggcuggagugcaguggcaugaucacagcuuauuguagccuuggccuccugggcucaaucaauccucucaucucagcaguagccaggacuacaggcacacacuaucaugcuugacuaauuuuguuguuguuguugagauggaaucuugcucugucacccaagcuggagugcaguggcgugaucuuggcucaccacagccuccuccuccuggguucaagcaauucucaugccucagccucccgaguaggugguacuacaggcacacaccaccacgcccaacuaauauuuguauuuuuaguagagacaggguuucaccauuuuggccaggcuggucucaaacuccugaccucaggugauuugccugccuuggccucccaaagugcugggauuacaggugugagccaccaugccuggccaacuuuuuuuucuuuuuugagauggagucuugcucugucacccaggccggagugcaguggugugaucucagcucacugcaaccuccaccucuuggguucaagugauucugcugccucagccucccgaguagcugggacuacaggugugcgccaucacacccagcuaauuuuuguauuuuuaguagacaugggguuucuccacguuggcccagucuggucucgaacuccugaccucaggugauccaccugucuuggccucccaaagugcugggauuauaggcaugagacaccaugccuggccucauaauuuuuuuuuuuuuuuuuuuuuuguagcgagggggucuugcuuuauaggccaggcugguauugaacuccugauuucaagcaguccuccugucugccucccaaagugcugggauuacaagugugagccacagcaccuguccuagaguaauuuuuuaauaauaugauguggugaaaaagaccaaauuucuuuuacagugaauuagaugugaacucaccuauuuuuccugugaagcacauauuaugauuugucauuuaucuauaggaaaaaggaaaggaaucccauggauauauuugauauggcuagacaucgguugcaagcuccugucagaagacaguccccuaagggcuuagacgcugccacuuuucagaauguucaugauuuuaaugagcugaaagauagaggugaguagauugcugcucuuuuaaagauguagcagaaguguucuacccauauuuaaauaucuauaaagaucuuuguacccuuuuucuaaaguggaauuuuaucuaugguauguauuuuaguuaaaaugaaaugaaacuuauguauucucuaggucuucaguuaaccagucugguagaugaagcuuuaguuugacuaacugcuuucuuuuggagagcauacaguguuaaagucuggaauggaugagaucgcauagacuaguacgaagaauggaacuuggcauuuaauggaggauggacagacaaagaugagcucaugaaaaauacugaggagaagccagagagacuggaggagaagcaggagaauguaggauccugaaaccugaggggaaggaguaucaaggagacaggaucauguaaggugaauaccggaaaaugucaguuggaugaggucauuggugaccucagcuagagcuuuuuaaguggaaugauugccgauuaacuuuggaaugaggauugacuaggaggcaagauguuggagacaauaggcauaagacuuuuagaagacccuuggcugggaaagggaagggaaggagagggaucaggagcuggaagaguccuuagaaugugaacgugaggagcuaugcaggagaaagagguucaggcucuaggagagggagagugauuguugaagugaaaucuaggggauuugagggaagaguuaggagaagcuuugauguagccacuuagggcuaauggaagagaaaguuuaguaaggaaacgagauuuccaggguacaugaggccugggagauggagaauguguggaggaaccaaauguguguuguguaauuuuccuuuaggcauauucagcagagcagguguuggagcagaaggggcagauuaugggauguguggucguaugacguaggccagaaaacuggaauuuaggcuuuuuauccuuuugaaaauacuaucuguuuauuauagcaaauuuucaaaauacagaaagauaguaagaaggaaaaaucacuuuagucaaacuaccuauauguaaguaccauuaucauuuuggauguuuucuagucuuucugagcauaauuaaaagaaaaaaaaagauaaauuguguuauuuauuuaauuuucucuauuguuuuucaccuagauuuacacguauuaucaauuacguauacuguuauuuuuuaugcuaucaaauauugauuacuuacuaucugccaggcauuguguuaacccagugggucucaugaggaguuuggucugaagucaaaacuguuuguauuauaaacuaagacauuauuugucuuuuucauucucauucucucauguguauauagauuggccagagacuacaugacauguaaugauuucaucucuuugaagcuagcaaaauguguccuuguguauucuuguguuuuaggaaucucuuaguuuuaauuucuaauauggcgugugugugugugacauacauaaguaaagcucuuugggguccucaauuuuuaagaguguaaaaaagaucuugagaccaaaaagguuuaagccauagaauugggcuguucauuucccuguguuacuacaucuugcccucauucacccaugacuuggugguugguauuguuuuuuuaaugaguuuggaagcagugaagccagggaccaauccaaguuuauguguccagaaacuucuguuaacuucugaaaauggcuguuaaccauuuucacuauuuuguucuuuugauaauuucugaucauaaagcuuuauacauauuuaggaccauaaaacuacauauauauuuaggaucauuucuuuauauuccagcaguguaauuagugagucaaagggaauaauauuuucaaggcuuuuuauauguaugaacuguauguuucuucucaagauuaaaaaauuuuuauucuuggccaggcacaguggcuaaugccuguaaucccagcacuuugagaggccgaggcguguggaucacgaggucaggaguucaagaccagccuggccaacauagugaaaccucgucucuacuaaaaacuacaagaaaaauuagccgggcauaguggugggugcuuguagucccagcuacuugggagacugaggcaggagaauggcaugaacccaggaggcagagcuggcagugagccaagaccgugccacugcacuccagccugggcgacagagcaagacuccgucucaagaaaaaaaaaaaaaaagaaauggcauucccccucaaguuccagccagucuacauuuaucuugcuuucugcaugauauuuguaaggacuaaaauauuaauuggccaguaacauuauuuuuucacguuuccaguauauuuuagagaucagccgugauuacagugucucauggcugccuuagucauagccaugugaccaucugcuuggauauaccugcacguagucuguguucuggguggcauccuggcagggcuaggacagguagagauggacaaugcaacauccacugcuuguucugggguauuccuuauguugguaaguuugugaaaagacacuuauuaaagaauauuaauuucauauucuuuaguuuuguggcuauuuuacuguccuuugacuuuagugauguuucacuauuucuaucauuuccuugauuuugaaauuagguuacucauguuacuuacagugaaguuuuacaaaaucccauuugaaaacaacauuuaacuuaguuauauaacauauuuuuuauaccagauucagaaacacgaguugaucugaaauuuauguaccuggauccuccaagagaucaucacaccuuagagauucagcagcaagcccugcuaagagagcagcagaagaggcugaacagaauaaaaaugcaggaaggugccaaagguaagaaauaaucauugcugugucaaauaguaucagcacgcuguuuuuccguaggcuuucugcaucucuucuauugauuucauucccaggcauccuccuuucacuggcagccccaugcucacaggguccguuuggucuguaguaccagaaaagaacaaguaugagagagagcucugaguggcuccacuagggugguguauucaugcaugagaggggcccagucauucacuguagccaggaggacugaauacuuugaccaggccaggugacgucugcaucaggaacuaggaaccaaaggaaggagugucaggcagacauaucagugcccugucaugaugugucgggcauuugccuacugugccaugucaggcauuugucuacuguggugugaguguguuuaaguuuugauguggcguaaaaucuguaaagcaucagacuggacuaugaauauguuuucguauaaucaacuaacugaaagauacuuagugguuacuaggagugcagguacuggccuauauccaggggauauggugaugagugacauaugcugcugcucuugaggagguuauauuuuguuggagaagugugaugcuaaagaaguacaacugugaugaauaucgcacagaagaaaucuaggaugcuguuggguuggggugggugggcaccuagaagcagaguggggcuaguugucucagagagcacugaugggcccugacgauagccagguguacugcauggccuucccaucuguauuucaccagccuucaggccaucgagguuaaccauggaaaaugaguaaugaaaacccaacaaucagauaacaagaguggaagggaugcuccugcuaguuauuuuuaagaaaaguuaagacccuaucuugggaggcuggucuggcuugcagaaucugaggaagauuuuuugacuucaugagauagcaucacaggaguaagugaugcagcaguuuaggcccagaucauaggucaagacuucaauaaacauuuguauagggauugucgucccuucaucugguacagaauuuuuaauaacagccucauagcccugugacagaauaagccuaauucuaggauaagcaguagguauaucaucuggagagaggagagaagcaagugcauucuucaaccuuuguacccagucugguggcauuuuucuuuagucucaaaaugaagaucugaucuugugggauuuuggcagcuuagacugauuagcccacaaguaguccccauguggauacagguacauuuuagcacugaagguaucuaucucccacagcagccacuccccaacuuccaguagacacuaugaagaccuaauucauaggaauaugaccucacuggccaggcgugguggcucacaccuguaaucccagcgcuuugggaggcugaagugggcggaucaugaggucaggaguucaagaccagucuggccaacauagugaaacccccgucucuacuaaaaauacagaaauuagcugggcauggaggcgugugccuguagucccagcuacuccggagccugagucaggagaauugcuugaacccaggagguggagguugcagagagccaagaucgugccacugcacuccagcuugggcaacagagugagacuuagucucaaaaaaaaaaaaaaaaaaaaaaagaauauggccucacuauaaacaaucacaaacaugucuauuaaaauaucugagaaggaauacaggcuaucauucgcagcuuguuuauuuucaaaggcaguaucuaaaaagggcaaaauguacuauucacaggaacacauaggaaggcuggucauauuggagaggcuuugggauaccugauccaagaucuuugccucuggaacuaagugccuggaauugagcuuauuucaguuccaugugagggagccccuguuuaacuccaugcaacaacuuucuacagauuguagaaaucugacaagauggugaaggauccugcauugaucauuuucuuuuucuguuggcauuaguuuuacauuugcaaugauuuuacuuguuauguucauucaugugaaugggagaauuuuaugcagcuagaauggaugcagggcuauguuuuuuaauaagugauaucuuuaaaauacucugaagugugauaguugaaaaguaauuuccaguagagagcuagucaaaaaagauauucuaaaauuuaauuuauauaguaagcauuuucugaccuuuuaauuugcuuuuguucuccauugacuacaguugacuuagaugccaucccaagugcuaaaguacgagagcaaagaaugguaagcaaccaguuacaauuuuucaaguuaguuuuugggggauuaaaaaucuuuaggcauaugaugaucaaguaauucaaauuuugaauuauucaggaauauugaauuaagaacguaagucuuaucaguaaaguggauagcuugagaaguguuaguguaauauauauagaaaacauauuguaauggcuaagaacaagauucuagcacuaggcuguuccagugagucuauuuuuagcugcgugacuuagggcaaguuauuuaaucucuuuaugccucagcuuccuaaucuguaaaaugaggauaauaguacauaaauuaauauuugcaagguacuuagagacaggccuggcauauaaguuuuauguaaguguuuauuaaauaaauaaaaauagcucaagugcuguugugagaacugagauaauauauuaaaagcccuuacagcaguccuggcccauuaugagugcagugugaguguuugcugucauuaccaugagcaguagugggaguaggagucuguuauggaaguaguguugaggucuacaaagaaaauaagcaaaggaagggaacagagaaugauaacacccaccuguauccugagggggguacuuuuugugcaagacugaauaaagggacaggaugagcucuuuucaaucaacaaauauuuauuauuuccuauggacaagaaacuguucuaggugccgggguauaggaguaaacaaaagggacaaaaaucccuguccugugacagguuacauuccagaaggagggagagacaguaaucaaauaaaucaauaguuuuuugaaucauggugcuguggagaagacaacagcagagaaggcagcuggaggauccugggugggaggguuuauaguuggaaauacagugggcaugggggcucacuggguaggcaacauuugaguaaggacaucagggaggugucuaugggaaaugugggggaacuucuggaggaagaacauuccaggaagaggccccaguggaaguuggccuagugcauguaaggagcagugggagagccaugagcaagggccaguugggcacauggggcagggggugacgaggggaggcagcagggccuugggggccauucugggacuuugccuuugacacuugugcaugugaugggaagcugccaaggucuuuaaguggaggagugacaugaucugcuugagguuuuuacuugauccacugacugcugugcauuuugacugagugggacaggaggcuauuguaguaauuuaggcaagagacaagcucacuuucugauuaaagaaugcagugcaucauuguaauucauugccuuaaaaauuaauggacagcucuuugcuggaguguccuacugaagcccagauuaucugguaagaaggugcagggagguggaguuggaugacuuuagguuccuucugacauguugguuauuauucuguacugcaaaauucucuauauguaaauuuaaguuuucucuaauuugggagcucauuauaauaagcccaaucuuagcauuuuuuuucguuacuauacuauaugcuccacuauaucugugcugcaucauuguggcaauugcugucacauagggcugucauaaucugagaguauaccccucucucucccaugacacugugaucuacuccagagcagaaacucuuaauucaucuuuguauccccaguuccuagcaugaaagaaauaguaagugggcuauacagguuuauggaaauucggaugaaugaaucuuggcaguggcuuaaagacuuaauguuuaauuggggucuuugcuucauacuguauuauauuuuccaucagucauaaugugauccuuuuauuugacuucaaccauaaaggggcaggaaggaguggagcuagggaguaaauguguuagcuuguagaaucuguagccuggagagagacugucuucuguugcuaucaccgucuucguaggaauuguguguguuaaggcuuuccaguauuuucugagcauuggaauguagucaguccuaccucuacccauccucugcuuuuagggagaacaguguggaaacuugugccucuucuuaguauaaauuuguuguuuuuguacacaaaacuaauaaaaauagucauugaaacauguuucuuuuagcccagagaugacacuagugauuucuugaaaaacucauuauuggaaucugauagugcuuuuauuggugaguauauuuauuuuauuaaggcuauauuguuuaaauauuaaaccuuucuccacacuuaaaaaccaguacuguauuccuuguuguacaagguaguaaaaaaaaaaaaaggaauauucuuuuuucuguuuuaaucagauaugccuuggaaaguuuucaaaaucagaauuacugaaaugaacuuuaaaagucuuaggaauaguugacaaaccuguacaugaauguucguaacagccucauuucuaaugccaaaugcuggaaucagcccagauguccuucaguagaugaaugguuaaaaaaacucugguacauccaugccauggaauaccacuuagcaauaaaaaggaacaaaguuuugaaacuuggaugacucuucagggaaauagucugagcaaaaaagacaaucccaauaaguuacauacuacuguaugauucaauuuacauaacauuuuugaaauuacaaaauuaagaaauugagaacagauuagugguugccagggguugagggauagggagagguguauaugguuauaaaagggcaagaagagggauccuugugguuugggaacuguuuuaacaacuuguuugcagggguagauacauacauguaaaugggaaauaaaauaauaauaauagaucuuaauacacacauaaaaacacacaaaugaguauugguaagaugguaaauuugaauaagaucuguggauuguaucaguaucgauauccugguugugagauuauacuugaguuuugcaaaauguuaccauugggggaaacuggacaaaguguauaaggaaucucuacuauuucuuauaccuguguaccuuaauuauuuuaaucuauuuauaguucucuuaauauuucagucaaaaaagucauaagacuuuuauuuagucuucagaagauaaguaaagguaccaugggaucuucuuuuuuuuuuaaaguaguauacacuuacgauuauguacucugaucaugaguguuucugcuauccuagggccaucagggaaugaucuagucuacauauuaguuguauuucaggccaauuacuuuagauuuucaugugauaaaauuccaaauuaacuuauauuuuucucuuaaugguuuuuuuuuuguuguugcuguuuuugagagagggucuugcucugucgcccaggcuggagugcagcagcacaaucauugcucacuacagccucaaauuccuggacucaagugcuccucccaucucagccuccccaguagcugggacuacagcaugcaccacgauaccugguuaucuuuuuuauuuuuuuguagagaugaggucucccuauguugcccaggcuggucucaaacaccuggacucaagggauccuccugccucagccucccaaauugcugggauuacaggcaugagccacuguaccuggccauuuuuuuuuuuuuuuuuuuuuuuaaugaauuuuuccuuuccaaggaagaugcacugcggagagaaggaaagauaaaaccagcaggagacagggaugggaagauugcuugucagggaaaugagaccuuccuuccuaacagugaagauggucugggccacucaagaugguguguuggaguauugcaugacacuagagcaaagauacagcaguauuuaugguuaacagucacugcaaaugcugcauaaguaagucauggcuguguuaaccacugcucuaaggaauguaaagcugaugguuucagugcauuauuuuaaaaaauaggguuuuuaaaauuguaaaauacacauaaacauaacauuuaccauuuuaaccauuuuaaaguguacauugacuggcauuaaguauuucuauugugcaaccaccacuaucauccaucuccagaauucaucuugaaaauagaaacucuucauaugaaacaguaauuccccauugcccucucccuccagccccuggcagccaacauuguacuuuccaucuccauaaauuugacuacucuaggaccucauguaaguggaaucauacaguaucuauccuuugaugacuggcuuauuucacuucacauaacaucuuugagguuuauccauguuauagcaugugucagauuuucuuuuuuuaccccuuagagacagggucacccuugccacccaggcuggagugcaguggugugaucauggcucacugcagccuugaccucccugugcucagaugauucuccuaccucagccucccaaguagcugagacuacaggcacacacuaccaugccugaauaauuuuuguauuuuuuguagagacaggguuucaccaugcugcccagguuggucgcgaacucuugagcuuaagugauccuccugcggccucccaaagugccaaagugcugagauuacaggugugagcuaccacacccagccagauuuccccuuuuuuuuuuuaugcugugaauaauauuccauuguauguguguaccacguuuuguuuauccaaucaucugucaguagacacuugaguugcuuccaccuuuuggcuguugugaauaaugcuccuaugaauagguguacaauuaucuguuggagucacugcuuucaguucuuuuggguauacacuaagagauagcauuugcuagaucauauaguaauucuauuuuuaauuauuugaagacucaccacauuguuuuccacagcagcuguaccauuuuacauuccuaccagcagugcacaaaaguuccgauuucucuacauccuuaacacuuguuacuuuguuuuuugaauaguagcaauccuuacgggugugacguggcaucucauugugguuuugacuuacauuucuguaauaauuagugauguuggacaucuuuacaugugcuuauugacuaauuguacaucauuuuugaagaaauaccuauuuaagaccuuugcuaauuuuuaaaaucagaguuuuuuuguuauugaguugugggaguucuuuauuaucuauucuggauauuaccccuuaucagauacaugauuugcaaauguuuucugcauaguggguugccuuuucacuguguugauuguguccuuugauacauaggagcuuuuaauuuugauacaguccaauuuaucuuuucuuuuguugccugugcuuuuggugucacaucuaagacaucguugccaaauccaauaccaugaagcuuuccucauaugcuugcuucuaagaguuuuaucuauagguuuagcucuuaauguuuagaugccuaaccacagagugucaaaauacaugucagaaagcaaaagaauggcaaggagaaauagaugaauccacuguuacaguuggagauuuuuaacaccucucuaucagaaauggacagagacagaaaaucaguaaggacguaguugaguucagcaacaccaucaaccaacuggauauaauggaugucgaaagacaacuucauuaacaacagcagaacccauauucuucucagggucacauggaacauucaccaggacagauuacaaucugggcaagaaaacaaaccuuaacagauguaaaagaagauaaaucacacaauaucuguccccagaccacaauggaaauaaacuagaaaucaauaacagaaagauagcuggaaaaaucuccaaauacuuuggagauuaaaugccacauuucuaaauaacgcauaggucagagaaaaaauaugaaaauacauuuuaaaauacuuugaucuaaaugaaaaugaaaauacaacuucucaauuuguaggagguagcagaaauaaugcuugucuuucuuucuacuuuccuaauguaugcauucaguuaaauguaaaaugccaaacucuaaaacucacagaagauaccaacagaaaaucuagacgaccuuggauauggugaugacuuuuagauaaaaaaccaaagccacaauuuaugaaagaaauaauugauaagccagacuauguaaaaaauugggaauuuuuuuuuuuuuuuuuuuuuuuuuuuuagacaaagucuugcuguuguccccaggcuggagcgugauggcgugaucuuggcucacugcaaccuccgccucccggguucaagcgauucuccugacucagucucccaaguaguugggauuacaggcgccugccaccacgccuggcuaauuuuuguauuuuuaguagagacgggguuucaccguguuggccaggcuggucucgaacuccugaccucaggugaucccccggccuuggccucccaaagugcugggauuauaggcgugagccacugcgcccggccaaaaauugguaaauuuuuaaggugcuuaaauuuauaggauugacugugcauacaugaagaaaguagaaagaucuaaaaucaguauucuaagcuuccacauaagaaaauuagaaaauaauuaaauccaaaguaagcagaagaagagaaauaaaaauuggagcagaaaucaaugaaauugaaaacaggaaauaaauagagaaaaucaaugaaaccaagaguuauuucugagaagaucaguaagccucuagccaagcuaauaaaagagaagacacaaauuacuaauaccagaaacagggcauaucuagcugggcaugguggcucacaccuguaaucccaguacuuugggaggcugaggugggcggaucaccugaagucaggaguucaagaccagccuggucaacaucucuacuaaaaauauaaagauuagcugggcaugguggugugugccuguagucccagcuaucugggaggcugaggcaggagaaucacuugaaccaggagguggagguuacagugagcugaaaucgugccacugcacuccagccugcaugacagagugagauucugucuaaaaaaauaauaauaaaaaaauauaauaauaauaauaauaauaauaaagguuggggggcauaucacuacaggucccaugaacguuaaaaacagucggccgggcacgguggcucaagccuguaaucccagcacuuugggaggccgaggagggcggaucacaaggucaggagauugagaccauccuggcuaacacggugaaaucaugucucuacuaaaaauacaaaaaaaaaaaaaaaaaaaaaaagguggugggcaccuauaagucccagcugcucgggaggcugaggcaggagaauggcgugaacccgggaggcggagcuugcagugagcugagaucgcaccacugcacuccagccugggcgacagagcaagacuccgucucaaaaaaaaaaaaacaaaaacaaacaaacaaacaaacaaaaaacacaacauaguccaagagccuggugugauuccguucugcauggcuguucucuugagaagugguuguuuaucuccguccaccuucuuucccaccuaagugcaugccaccagccaauggaagauuugaugagcccugaggccccagaacuaucuuuucgguugugaacuaaaggccgacaaagauuaucacuuuaagauggauaaugaugaaaaugagcaccaguuaucuuaaagaacguucaguuuaggggcuggugcuggugcaaaggaugaauugcacauuauugaagcagaggcaaugaauuacaaaggcaguccaauuaaaguaacacuggcaacuuugaaaauguacagccaaugguuucccuugggggcuuugaaauaacaucaccaguggucugucgguugaugugugcuucagggccagugcauauuaguugacagcaauuaguagcuguggaggaagaugcagagucagaagaugaagaggaggaugugaaacucuugaaguauaucuggaaagcagucuaccccuggaggugguagcaagguuccaaagaaaaaaguaaaacuugcugcugcugaagaugaugaagaugaugaugaugaguuugaugaugaggaagcugaagaaaaagcaccagugaagaaaucuauacaagauacuccagccagaaaugcauaaaagucaaaucagaauggaaaagacucaaaagcaucaucaacaccaagaucaaaaggacaagaauccuucaaaaaaacaggaaaaaacuccuaaaacaccaaaaggaccuaguucuguagguccuuugcacuuaaagcaaaaaugcaagcaaguauaggaaaaggugguucucuucccaaaguagaagccaaguucauuaauuaugugaagaauugcuucuggaugauugaucaggaggcuauucaagaucucuggcaguggaggaagucucuuuaggaaaauaguuuaaacaauuuguuaaaaauuuuccaucauuucauuucuguaacaguugauaucuggcuguccuuuuuauaaugcagagugagaacuuucccuacuguguuugauaaauguuguccagguuccauugccaagaauguguuguccaaaauaccuguuuaguuuuuaaagaugcaacuccacccuuugcuugguuuuaaauauguauggaauguuaugauaggccauaguaguagugguggucagacauggaaaugguggggagacaaaaauauacaugugaaauaaaccucacuguuuuaaauuaaaaaaaaaaaaaaaaaguccaagaauaccaugaacaacucuaugcccacaaaucugauaaccuaaagucuaccacccauuuaugguaacucagcaaacuuggaauagagggggaacuucugcaacuugauaaagaacaucuacaaaaguccuacagcuaacaucauaaugaugagaaacuagaagcuuuccugcuaagaucaggauguccuuucucaccacugauuaacaucauacuggaaguccuagcuuaauauuagcaguaaggcagaaaaggaaauaaaaggugugauuggaaagggagaaauagaauuguuuuucuucacagaugacaugauugucuauagaaaaucugaaggaaucaacuaaaaaaugccuggaacuaguaagcaguuauaaucaaguugugggauacaagaugaauauauaaaagucagucacuuuacaauaugccagcaauguacaagugaaauuugaaauuaaaaauuaaaaacacaauaccacuuacauuagcauucccccaaggaauacugagguauaaaucuaucuaucaucuaucuaucuaucuaucuaucuaucuaucuaucuaucuaucuaaucuaucuaucuagaacugccugaggaaaacuacaaaacugaugaaauugaaggacuacuaaauaaauggagauauauuucaugaccaugcacaggaugacucaguauugucaagaugucaggucuucucaacuugaucuauagauucaguacaaucccaauaaaaaucccagcaaguuauuauguggauaacaacaaacugauucuaaaguucauuuggaaaggcaaaagauccagaauagccagcacaauguuuaaagagaagaguuggaggacucucacagcugacuucaagaguuaugauaaaguuauaauaaacaagacaguguggcauuggugaaagaacagacaaauagaccaguugaauggaauauggagcccagaaauagacucaugcagccugggcacaguggcucacaccuguaguucuggaacuuugggaggcuacuugaggccaggaguuugagaccagccugggcaacaaaacaacaccuugucucuacaaaaaaaauauuuuaaauuagccgaugugguggcacacaccugaaguccuagcuauuugggaggcugaggugggaggauuacuugagccuggaaguucaaggcugccgugagcuaugaucacgccacuaaacuccagccugggcaacaaagaaagaccuugucucaaaaaaagaaagaaauagacucacgcaaauacagucagcugaucucugacagaggaccaaaggcaguacugacaaaggaccaaaggcaguauuaugauggagaaaagauagucuucucuacaaauaaugcugggacaacaggacaucugcaugugaaaaaauaaacauagaucuuacgcccuucacaaaaauuaacucaaagucgaucuuacaucuaaauguaaaaugcuaaauuguaaaacucauagaugauaacaacagaaaaucuagaugaccuuggguauggugaugacuuuuagauacaaaaccaaaggcacaauucauaaaagaaauaauugauaagccggacuuuguaaaaauuuaaaaccugcucugcucuauaaaagacacuguuaauuaagagaaugagaagacaggacagagacuguaagaaauuauuugcaaaagacaugucagauaaaggacuguuauccaaaauacacaaagaaaucuuaaaacucaacaauaagaaaacaaaauaccugauuaaaagauucagcaagacuugcaccacacaucaccauacagauaacaagacaaaggaugcuacugagagacaggacuagcuggauuucaaaucuaggccgacuaagaauuccuaagccuagcugggaaggugacugcacccaccuuuaaacacagggcuuguaacucagcucacacccaaccaaucagguaguaaagagggcucacuaaaauacaaauuaggcuaaagcaggagguaaagaaauagugaaaucauauaucgccugagagcacagggggagggacaaugaucgggauauaaaccccaggcauuugagcugggaguggcaacccguuuuggguccccucccauuguaugggaacucuauuuucauucuauuaaaucuuggaacugcaugcucuucugguccauguuuguuacggcucgagcugagcuuucgcuugcuguccaccagugcuguuugccgccguugcagaccugccacugacuuccaccccuccggaucuggcaggauguccucuacacuucugauccagcgggguggcacccacugcugcucccaaucaggcuaaaggcuugccauuguuccugcacggcuaagugcccggguuuguccuaaucgagcugaacacuagucacuggguuccacgguucucuucugugacccacggcuucuaauagagcuuuaacauucaccgcauggcccaagauuccauuccuuggaaucugugaggccaagaaccccaggucagagaacaagaggcuugccgccaucuuggaagcggcccuccaccaucuugggaguucuaagaacaaggacccgccugguaacacauuaaagaauguaaauuaaaaugagauaccaccacauaccugcuagaauggccagcauucaaaacacugacaccaaaugcuggcaagguuauggagcaauaggaacucucauucauugcuggugggcaugcaaaauuguagucaauuuuggaagacaguauggcagcuucuuacaaaaauaagcauauucuuaccauacaguucagcguauacacuccuugguauuugccuaagggagcugaaaacuuguccauaaagaaacuggcacacagauacuuauagcaccuuuauucauaauugcuaaaacuuggaagcagccaagaugucuuucaguaggugaauggauaaagugugguacauccagacaaugcaauauuuuucagcacuaaaacaaaaugagcuacuaaaccaugaaaaggcauggaaggacccaaaacuuauuuuagaauuauagaaagccccauaucuuauucaauaaaaguuauuccuauuuuuaaaaacccauacaguauacauuuggaaaaucugaauaucaauuauauguuaaacaaugauaguguuguauaaauguuaaauuuucugaauguuauaauuagauuuuugcaguguaggagccaguccuuguucuuaugaggauaaacacugaaauauugagagacaaaaugccaugaugucaccaacuuauugguguagcaaagaggcuuggcaauaacaucauccccccaaauauauauagaaauuggcaaaguaacuaauggugauucuaaguauuuguauuauucuaacuuuucuuuagguauaauuuuuuucaaaggaguugcggagguuaccguagauguuguaggcuauuuguccaugucaaauuagcuaccgauccacuagaaugauuauaagcaaaaagaccgacaauaccaaguguuggugaggauguggggaaauuggaacccucuuacaauguaaaauguaaacagguugguaguuccucaaaaugcagaguagaguuaaccauaauacccagcaauuucauuucugguucuauaacccaaagaaaugagaagauauguccacacacaaaaacuugaaugugaauguucauagcaguguuauucauaauugcuagcagcuagcaaauguccaucuacugguaaaugcauagacaaaauaugacguauccauaugauggaguauuauucagcaguaaaauguaauaaacaacuuaaacauggcacagcauagaugaaucucaaacaccuuauugcuaagugaaaagacaaaagauuaaguuguagaauuccauuuauguuugguguuagguaagguaaaucuguugaaacagagccguguuugcccggggccagcagguggggagugauugccagugugcacaaaggagcuguuuaaggugaugaaaauguucuacuuuaaagugaugauuguacaacucuguaaauuuacuaaaaaaaucaccgaacuguguauguacauacauugaguguguuucaugguauuguaagcaaaaucuuaguaauuaaaaggcucuugguuuagcucuggguaagauuugaagcaguauuaagacuccuucugcuuuucgggguccucuuaggggcuuacggugagacauauccugccauugaagaugacguccucccuccaccaucacaguugcccucugcacgggagcgcaggaggaacaaauggaaaggacuagacauuguauguaugagacuuuucucccccuuuucaacuuagaagaaugagaggucuggguucugaccugugcuaaaucuguguggcccaauaaagagcacuugcuugaaauucagacaugggucugaaucuaggcucugccuugacuggaugaccuuggguagcuauugaauucugcugcuuuggcuucuuccagauaauaauaguauuuucuugucuccugggguggcuguaaguagcuccucaucccaaccuuccuucuucuccugcagaauauauggauuucagagaggcacaagaaggaacugaugucauuuauugaaaagcuucauaauaaccuaauucugugauauaggcaucaccuucauuucggucaaaugacuugccaaggucacaugggcaagaaggcugagauucaaacccauguucuccucacucugcuccccagcuuuacaauauagccaguaaaaaguagaggcuuuggaguuuaugucccagcaaugucaccuccuuguugaguaggcagcuugggcaauuucuuaaacucuguguguguuuccuuauauaugacgugaagaugcaguuauaugugaagcauuuagcacugagccaaguaugcagagaccucaccaaguaacagauguugcuauuagcguuauuauauguacagcauuaccaggugaaaauagcuuugcuuuuugccuuaggcaaccaccagucuacuuugguuucuauagaugugccuuuucuggacauuucguauaaaugagaucauacacuguaugauuauuugugacuggauuugucuuucuuuugaaggucauucauguuguagcaugugccaguacugaagccucuuuaguguugaauaauuuuccacuguauuaguaucccacauuuuguuuauccauuuaacaauagauauuuggguuguuuucacuuuuuagcuaguauggauacuauuaauguucauguagaaguuucugauguuuuuauuacucucgaauauauauaccuagaaggaaauuguuggguuauauggacacuuuguauuuagcauuuugaggaaguaccagacuuuuccaaaguggcuguaccauuuuaccuucccaucauccacugaggguuguaauuucuguauauccuggccaucacuuagugucuuuugauuuuagccaucuauugaguguaaaguggugucauggugguuuugaguugcauuucuguaaugauauugaacaucuuuucaugguuuauuagccaguuguauauuuucuuaggagauaugucuauucaaauccuuugcugauuuguuuuuuuuuuuguuuuuuuuuuuugauacagaguccugcucugucaccuaggcuggauugcaguggcgugaucucagugcacugcacccucugccccagugggguucaagggauucuccugccucagccucccaaguagcugggauuacaggugcaugccaacacgccuggcuaaguuuuguauuuuuaguagaguugggguuucgccauguuggccaggcuggucuugaacuccuaaccucgggugauccaccugccucggccucccagagugcuaggauuacaggcaugagccaccgcgcccagcccuuuguccauuuucaaauugaauugucuuuuuauugaguuguaagaguucuuuuacauucucacuacaagucuaguuaucaaugugugauuuucagaucuuuuuucccauucuguaucuuuuuaacuuucuugaugguguucuuugaagcacagaaguuuuuaauuuugaugagguccaacucaucacucuuucuugggcuuuuggugucuuaauuaagaaaccauugccaaccacaagaucaugaagauuuacuuguuuucuuucaguuuguucuuaauuguagguccaugauacacuuuaauuuuugcacagggugugaggugcagggguccaaguccauucuuuugcauguggccauccaguuguucuagcagcauuuguuuaaagacuguucucccacugcauuuuguuaacuccguccauaaacguaaggauuuauuucuauauucuucuuaaucuuccauugaucuacaugucuuuucuuaugucaguaccacacugucuugauuauagcuggacuaagccccugcugcuucaguuuuuuccuuuuguguccuauaauucucaagcuuuauccugacuggcagcauuucugucaucacaaauguuacuccuuauccuugagagucaucugagcuugcauggauaagcauaggagccauaauauacgugcucuauauuuucauguuuuauuuuguucaucacaguguacauuugagggcaagaggauguuuugauuugcugguuuuuuucuuuuuuuuugagauagagucucugucucccaggcuggaguccaguggcacaaucucagcucacugcagccuccaccuccugccucagccacccaaguagccggggacuacaggcgccugccaccaugcccagcuaauuuguauuuuuaguagagaugggguuucaccauguuugccaggcuggucuugaacuccugacuucaggugaucugcccaccucggcuucccaaagugcugggaucacaggugauaggcaccaugccuggcccugauucacugauuugugaacauauuuuguguuaaugacuuucugaaguucuguuuucuaacuacaggauagcagucguccuaauguagcaccagauggucucucucuaaaaucuauauccaguguaaauguugaugagcuuagagugagaaaugaggaacgaaugcgaagacugaaugaauuucacaauaaaccuauuaauacagguaaaugaccaaguguaauggccuauaguagaauccuguaugaacuuuuaaacuuucuuacucaaggcuuucacuaacgucugagggauagauggaaugaguuugaagaccuuugaguuguauggcccaagacauaguaacuauugagcaaaaccagaccucaggaugcaguuugcaucagauuuucucuaucagagagggugcccauuuuagaguggagucuaaacagguaaaauaguuuuugcuuauuaaacauauccaggcuuugcuuucagcaaagaaaaugcuauaugauaauaguaaucacuuuacuaaaguaaaacauuauuagaaauuagccuaaagacuuugaguucuuuaacacuuaugcuguauauuugcaguacuacaaagaaaauuuuuaccuucuucuuuggcuuuccacaccauggacaaagucucagaagucaaauaaagcuagucgucuccucauuaugagugcauuuuugugacuugcagguuaaagcuagucauagagcacaaggcaggaugguuccuuagacaccuaacaagcuacccugccagcccuacaccacccuuuucuauaccagugcuauuagucaccgggauaaugggacacuuucauauugguaauaauaauaguuuuagcaaauuacuggaguggucuauuugggaaauacucuuuagucuguuaaucuacauuacaauaaucuguuaagauuuuuuuagauccuaccuuuaauacuguguuaauuuaaaacuguacucauauacuaucuaucuagcagucaaggugugguguguucuaauggugguaauuccacaccaaacacaaagcagacaugguuaauugaugggacaguaggaaaggaugucuuuccagcuauaaggcauuuucuuuuagacccaacaaacugaauuaauauuuaacaggaauauauuugagggaagauagcauuuuaagaaucuuuuucagaagguuuuuaaugucuacacuguuuuuuaacauuguccuuucaaacaggagcuuuuuguuauuauguggauugacugcacauaccaauccuucacagaccaggagaauuaaaaaaaaaaaaaagaauaugauaucacaggguaggaagacagauuuuccuauuauuauaccuaauaauaaauaaaaguaaaauacagauagaaguugcguacaaucaaucagauucaauuaaagaaugaagcaagagcuaccucuucauugacuggacacggccuuguuagauuagguguuuuaagaauggaaguaaucucaugccaacuaguguuuucccaaaauaacuuaauaauuuccuuauagcaguguuguagguugaagaguauuccccaaaccuugcuuuaaaaaaaauaaaaagaaaaaagaaagaaauuuuauguguagccauuaggcuucuccugagguaacaguuacaaaauaagacuaccuacauuccuccuguugacuuuguuuuauggagaggugccuuugauaugcuuagaaucccucugguugcuagugccauggagucagcuuacucaguugaucauuuuuuguuuuacaaaauuggccuuugugggcccacucuccucccucuaaaauagggugggguggggugagucuaaccaaaacaaacaaacaguagaguucaggauaugagacuguggggaaaugcugaguuguaaugaguuggacuacaagagaccugcgcuuaugucuccugccugccaccuguguuaccugagccacgugucccuugccuccuguagaugaugagaguucacugguugacccugaugacaucaugaaacacauaggggaugacggaucaaacucuguagcaacugagcccuggcuccgcccuggcacuucagaaacgcugaaacguuucauggcagagcagcugaaccaggagcagcagcagauuccuggaaaaccaggcacuuucacuuggcagggccugucgacugcacaugguuaaaauaaaccuguacuggacccaguagugccuuuuaaggugaaaggaaugguaaaucuguaccuuuaauauguccuacuuuuggccccuaccugaaaguuacuuuuuuuccaucaucuguauauaaaauuauuuuuaucaugauguauauuauguacauaaauaaaaggccaugauuauugauuuauauaauagaauuguauagauuauuuuugcacaguuuugucauaaauuagggugguaaugaacuggauugaacuacuauaugugcauuauauugaauucugcuugucauuaagauaaggugaauaagugucuuaaacguccuguaaaaccggacuccccuuuguuacaugcacauuuuccauuguuaccucgaugcaaaagaauucauuuaguagguacaucuauuguagcugugauuauuccaguuucugugugaugcaaucaaauguccuauuaauuaauuauuauuucaugucauuuguagcuacugauacagcagaaaugaagggaacuguaauuacuuguauuuuuguaagccauacguuaaauguuuguuacaucaucuuucugcuucuauuuuuaugccaaugaaggcauuugucuuguuacuaauuacaugauguaacuacuucuugauauaaauaaauuuuuauuuuaauuacuaaaaucuuuuuaacuacuauggagcuuucuagacuaguuuucuagagguugaauagagguggggacacccgggagucaaggacagagagacuggagucuucuucuuccaccauggaaccuuggauaagugaguccaugugaguuuucuaaucacucaguaagugauacuucuaaaaaaggaaagagucauucaaauaauugugacauucugacucagauuagaaucucagaaccaugacagcugagaacauccccaggcacugcuucucucucuaauaauacuuccucugauguaauuaacgguugguagacaauaucagacaaauuugccacaauuaaauuacugauauuuuga

SEQ ID NO: 191091 - RNA, 19540 nt, Homo sapiens
aauucccuacccucgaccugucgaugccccgcggccccgcccgcccucuuaagccuggcucagcccucagggcccgcccgaagucuaccgagcccgaguggccuaccgagcccgaguggccccgcagcguccaggaggcgcccgcuccgcgguggcgcucuuggagguggugucggagguaggcacgggacaggacgcgccuggggcccggggcgguggucuuccagggccguuggggagggcggcagcacucgcuggcgcaguucguuuuggauggucguucugcccucucgggggcuuugaaucccaaguugcagaucccugaggucggaggaggcuaggagaagggcgccuuuggaggaucgggaggagacgggccgcugccugugucguggcugaccucuucuccugaccccguguucuuuaauuucugagucaugacccugcuugguuuucuuauugggcucauugaucucaagacccgccggcccugaaggggcuucauucuucagccucggugaacuugcugccugucuauuaaaacgccauccuuucccggcggugcgggggcgggaggacuggcagucgccgaggcucuucgcucccaccuggccagggcucguccacgcggcucccgaggggcuaccccaggccccaauaguccugguagaaugauuggaguuuccgaggaacccggggaauguggcggacgcugcccgcgagggaaaagagguucaggcggcgcauccuagggcagccaaaaguggcgcgccccuccccugcgggcagucaggaccgccaggacccgcggggucacaccgcugggccagagcaggucgcggggucccuggaccugcccgggggcucugggagcgcgucuccaucugcgcggugcgacccaggguccucggcucuucccucccagccgagggcccaggagcgccuggagcugucgcuugcuccauugcccuccgaccgccugcgcucggcucccggcccagccccgagguuggcagggccccgcggcucccacagacccuaccaacgaguuuuguaggacugagaagaaggaaggaaagggaacuucaauggguuuugcaggaaccggguugggggccgaaagcggagagcgggugugggaaggcggccgggcuuagggaaggggugcuuggagagggaaggggaaggcaacacuaacccggaauuuagaguagggcaggaucccggcagauuuccguuuggggcuuuuuuguguuugcuucuauugcuguuuuuucguuuugucuuaauugugggagcgggcuggcgggaucggacugggggcguuuauccuguucccuuggaucuggggcuggcugggguggaggaggcugguggggaggcgcgggucggaccccgggaagcucccgcgcgguguccucagcggcgcccgcuuuucugcagagccgccgagcgugcggucccgggauggcucuaccccggccaagugaggccgugccucaggacaaggugugcuacccgccggagagcagcccgcagaaccuggccgcguacuacacgccuuucccguccuauggacacuacagaaacagccuggccaccguggaggaagacuuccaaccuuuccggcagcuggaggccgcagcgucugcugcccccgccaugccccccuuccccuuccggauggcgccucccuugcugagcccgggucugggccuacagagggagccucucuacgaucugcccugguacagcaagcugccaccgugguacccaauuccccacguccccagggaagugccgcccuuccugagcagcagccacgaguacgcgggugccagcagugaagaucugggccaccaaaucauugguggcgacaacgagaguggcccguguuguggaccugacacuuuaauuccaccgcccccugcggaugcuucucuguuaccugaggggcugaggaccucccaguuauuaccuugcucacccagcaagcagucagaggauggucccaaacccuccaaccaagaagggaaguccccugcucgguuccaguucacggaggaggaccugcacuucguucuguacggggucacucccagccuggagcacccagccagccugcaccaugcgauuucaggccuccugguccccccagacagcucugguaaagggaguucacaccauuugggagucgaauuggacgggaaugcaggcgggaacgggaguguccgggaagaggcgcuuccagguggagcugaggcugcagagugcgggaagggggaaguaccuccaugagagccagggcuguucuaggcucacuucugaggcccugcuugcuuaacugcaugacuaagguugguuuuagugagagcugaggaccaagagagaaaugguuccugcagcgaacucccagguagguucagauucuaugcuaacaugcaaugacagccuucagcaguucacaccuaacagucccagcucagcuagcuacgcugaccuuagucaggcauuaccucugauccucaaauuccuugaauuugccuaaugggguuaauuacauaaacuuccaugaggcuguucugagucucaaaugagaaauuguauauggaauuguuuacagugaaaucguguaugaacagaccauguaaaaugagcagggaaaaauagaaacaacaaauaaauaucaaacugggaugaugguuaccuuuagggaauuaaggagggaaacaccucauaaaagcacuuuauaaugcauuuuuaaugaaaaauuguuuuaaccugccuuuugcuaggaucugauucucuuccucaaacucuggauaaagacucccuucaacuuccagaagguaggcaggacuccuugcauggauuucuuucccugaacuaaugcagagucaacucuccucauucucuuuuccugccucggcuuuccccuaggucuaugccucaugcagacgguguuuggugaagucccacauuuugguguguucugcaguaguuuuaucgccaaaggagucagguuugggcccuuucaagguaaaguggucaaugccagugaagugaagaccuacggagacaauucugugaugugggagguaaaucuguuucuggugggucugcugcugaaaauggggcgggagacuaguccggggaaaucuuggccuuugcccuuuugggagaguccuggucagagagagaggacauccagggcagauaucugugguuuguguugccuguaaaaggaaggaacggccaguguuugcuccaugaggauagcaccucugcaugaauucuguguuuugugggugccuuaagucauuuuagucuggaagauuagcaauggaauauacauuuaaagaaucaauauguuguauuauauuuauagacaaaacuaaaugcuuuagauauuauagagugcugaaacuaugcuaaagagaauaaaaacaaguuuuaaaauucaauauuauucaccuauaaaauuagucaaggauuaaaaaaaaaauaaccagauacucuucaagaucuagugaugauauauuagggauaugcuagugggacugcaguuuauuaccugcaggagaaaauuugucagaauguaucagauaccuuaaaauguucaaagucccuugacccugaauuucuacuucuaggaauauaguacaggaaaauaaucugaaauugaggcuauguggaauauguuaauccuaggguuguuuauaauaacaaaauguuggagacagcgaaauugccagcagcagagaaagaaguaaucuuucuuuguuuuuuuuuuuuuguuuuuuuuuucuugagacggaguuuuugucuguuacccagguuggagugcaguggcgugaucucagcucacugugaccuccaccuccuggguucaagcaauucucuugccucagucuuccgaguagcuaggauuacaggcaugugccaccaugcccggcuaauuuuuguauuuuuaguagagagggguuucaccauguuggccaggcuggucucgaacuccugaccucaugauccgccugcuuuggccucccaaagugcggggauuacaggugugagccaccaggcccggccuugaaagaaauaaucuauagcuccauuaauaugcaugaaaccuaacugggaguaaaauauaaaacuauucaguuguguuuaagugguggaauuaaauaaaaccuuuuuguuucacuuaccucugcuuaugaaauuaacaugugcucacuauaggaauuugggaagcaagaaagugauaaaaguaagaaucuuuuagaauaugucacauuaggcaggcucaguggcuuacaccuguaauucuagcacuuuaggaggccaaggugggaggaucacuugaacccaggaguuugaggccagccuaggaaagagugaggcccugucucuacaaaaaauuuuuuuaaaaaaauuugccaggcgugauggugcaugccuuuaguuccagcuacucagggggcuaaggugggaggaucauuugagcccaggaauucgaggcuacugugaccugugauugagccacugcacuccagucugggcaacagagugagacucugucucugaaaaaaacaaacaaacccaauaugugacauuaccuagagagguguccuuaaacuaacaaaucuauguuggcauaaguaaauuuauaaacuacuuguaaugacauaaaaaucagaaugauagaaguguauuugguggacucaagugugauauuuagguuacaaguauuaaaaaauuuauuuuauagauuagaccaaaaaagaaguacaauacaaacuucaugucuuauuucauuuagaucuuugaagauggucauuugagccacuuuauagauggaaaaggagguacggggaacuggauguccuaugucaacugugcccgcuuccccaaggagcagaaccuaguugcugugcagugucaagggcauauauuuuaugagagcugcaaagagauccaucagaaccaagagcuccuugugugguauggagacugcuaugagaaauuucuggauauuccugugagccuucaggucacagagccggggaagcagccaucugggcccucugaaggugagugcacacccucgccuugcccaaugagggcaucccaguagaaggacugggcucuuuuccacaaacccuccaugcacagcuccucccuccuaaaggcuaaugcagaggacuaaccgagagugucucuaaccaggggggaauuacccaggugaaggaaagcauccucaauuucccaaagcugcggaagcuacuccuauuuauaaagauauauacuccuauuuauaaagacuuguucuucuucccuaccuuccaccccaagaguaaaagaaaacguacuaaauggauguaacuucuaccauaggugagccaguuucugauucaucucugcccaggcuaauguagcugaagucuaaucacuagagcaguguuuuucaaaugguggguugcagaguugcaugucuuaguggggugggaaaucaauuuaguggucaagacccacauuaaaaaaaaaaaaaaguauagaguagaauagaaaauauugaugggaaucccuuaagaguaaggauuguuuugugaaauuucuauuucacauggguauauguggguauggugggugucaagcauaaaauacauugccuacuaugggucucaggcaaguuugagaaauacugagcuggacucucacucucaaacuuuaaugugggaaugaauacccagggaucuucaugaugcugguucucauucaggguaggggcccaggauuugguauuuuuaucaacuugcagggagugcugcugguccuggucccugguccacauuccaguagcaaggggcgagggaaccaccagcccacucuaggggugagacuuuggaauuugcauguuaaauaagcucuccaagugauuucuauauacacugaaguuuaggaacuacuaaucuaguaggugggacaagauaaauguaaauuccuguaaauaagagagaaggcaggccggauacuguggcucacaccuguaaucucagcacuuuuggaggcggagaugggcggaucacuugaggucaggacuucaagacuagccuggccaacaugguaaaaccucaucucaggucgggcacaguggcucacgccucuaaucccagcacuuugggaugccgaaaugggcagaucaccaggucaggagaucaagaccauccuggcuaacguggugaaaacccgucucuacuaaaaauacaaaaaauuagcggggcguaguggcacacaccuguaguuccagcuacucaggaggcugaggcaggagaaucauuugaacccaggagacagagguugcaauaugccaagaccgcaccacugcacuccagccugggcaacagaguaagacuccgucuccaaaaaaaaaaaaagagagagagagaaggcaaauuauuaugauguaauaaauguguaaggagcagguuuaaaaaaaaaauggcccaggcgugguggcccacgccuguaaucccagcacuuugggaggugaggcgggcggaucacgaggucaggagaucauagccauccuggcuaacacggugaaaccucuucucuacuaaaaauacaaaaaaauuagccgggcgugguggcgggccccuguagucccagcuacuugggaggcugaggcaggagaauggcgugaacccagcagggggagcuugcagugagcugagauugcgccacugcacaccagccugggcgacagagcgagauuccguuucaaaaaaaaaaaaaaaaaaaguaaauugcaucugcaugccuguuuuccugcuaggcugagaugcuucagggcaggaaauaacccuaaacacuuuaguaucucgugcuucuggaucccagugcguacugacugagaggaagacauuagaacuaagcuagaaaaagcugcuuagggaugagaugaaauaaggcacguguaagagggagagagggaaggcaaucaggcucagggaacagugaagcagaaggcaaggaaauguccagaaauuaggggguaaauaauaagcagucauuauuuaucuaaugauaaauaaugagcagucagccgucauuauuuaucuaaugauaaauaauggucccaaugaugaggggcugucaggauuguuuuggugaacuaucuuccuacucccccagguaucuuauguccaugcuggguuccccccgccacugaaccaucauaagcccucauucuguugcuuguucugaucgccucugauaucugcauacagguugaguauccuuuuucugaaaugccugggaccagaaguguuuugguggguggugugggugugggaauguaggugaagauaggaauggaggcaaaaaugguugggauucucuaugaucuguggagcucuaaguugucuccuacuuagcaccaaaccaagaccuguuggucacuuccugaaauguaccaacuccuuucgaaauaaaagucaacaggcugggcgugguggcucacaccuguaaccccaacacuuugggaggccaaggugguugggucaccugaggucaggaguucacgaccagccuggccaacauggugaaacuccgucucuacuaaaauacaaaaaauuagcugggugugguggugcaugccuguaaucccagcuacucaggaggcugagacaggagaaucgcuugaacccaggagcagagguugcagugagcugagauggcgccacugcacuccagccugggugacagagugagacuccaucucaaaaagaaaaaugaaagaaagaaaagugaacaauggauuugagaaaaguaucugcuuaguaacuggcaagaugguuauuauccuuuugagaaaucauuauuauuuuuugagauagggucucacucugucacccagacuggaguacaguaguguaaucuaggcucacugcaaccucugccuccaggguucaggcauuucuccugccucagccucccgaguagcugggauuacaggcaugcaccaccacacccagcuaauuuuuguauuuuuaguagagaugggguuucgccauuuuggccaggcuggucuugaacuccuggacucaagugauccacccaccuuggccucccuaaauucugggauaacaggcaugagacaccauggccggccauuuuugagaaauuuuuucaccguauguaucaaauuauuacaauguuuguaacuuugaugucucaguaauacucuucuggaaaucuauuaucgagaaauaguccaaaaggaaaaagcuaugcuuaugaaaauuuuuaacuguggcaccacucuugugagugaaaaaucacaaacaaccuaaauguucaguaguauaauaauuaaguaaaugaugauacaggcucagcagcuccaaucaagaaaucccaaauccaaaaugcucuaaaaucugaaacugagcacugacauauugccaaaagugggaauuuccacacaccaguacuugacacaaacuuuguuucaugcacaaaauuauuuaaaauauuguguaaaauuaccuucaggugggccaggcacgguggcucaugccuguaaucccagcgcuuugggaggccgaggcaggcagaucaccugagaucaggaguuugagaacagcaugacaaacaugguggaaccccgucucuacuaaaaauacaaacaaauuagcugggcaugguggcagaugccuguaaucucagcuacucaggaggcuggagccggauaaucgcuugaaaccgggggcggagguugcagaccgagcaagauuccgucucaaaaaaaaaaaaauuaccuucaggcuauguguauaaaguauguauaaaacaaaacauaaauggacuuuauauuuagacuuugguuccauccccaagauaccucauuauguauaugaaauauuccaaaguucgaaaaaaaccugaaauccaaaacacuucuggucccaagcauuucagaaaaaggauacucaaccuauuuguuauuaacauggaauaguaugccgauaucagaggcaaucagagcaagcaacagaaugagggcuuaugaugguuaagugcaggggauacccagcaugcagauaagauacuuguguuccaguucugaaccaagugauaccugaugcuuacagcauuauuaugaggacauauauuuuggacaauggagggaaacuuguaaacaacuuaauuuguugggaauaauuauaaaugaauguuaauuuguuaaucuguuaauaugaaugguuuggaugugauaaaaaggaaagaaaaauuaaaauuccauugcauucucaaaugaguuuuuuuccccaaaggcuuuuugguggggauuggugguaggugggagccuuccucuuuaaggucuugaguggugagggaagggucuagacucuaugugggcggguuauuugaauaugcaagcauuccccucuugugagggagagagggaauuuggguguguguuuugggguguggaggugugaagagcuagggggagggaggauagggaacaagauaaaauuaggaaggauagggaacaagaugaaauuagguuucauuucuaccuaagugguuguucuuaagcgaacucaguauugaaacuuuauucugaauuuuggugugcuuuagugcuuagguuuguaaaauugcugacccucucuucccuucccaccccaggaagcaggaaggccagguauuucugaccaauaaaaauucuaccucugugccaaaaaagugucccagcacggggauucugagaguauuagcaccucaaugaaagugauagacagagcagggcgauggaucagcuuggggcuggcaguugccuuccugguuauuuacuuaaugaauaguuuauuuccuuagccaccuguuaaacgugccugggauguaguugucaacuaacaaagccccugauggacagcuucccugcuguccugaugcugagaagauuucuaucugcagacucuugcauagacucacucuuggcugcucuuccucccuggggucaaacaaugagaucucuguggugcauucauagucaaagccacuuuauccucugggauccagaguguccucugcagggaugcuuuuguagguggccccuguucucucgccuucccccaacacauagacaccccuggacgugggaccugcuuugcuagagucuagcugcacccucucuaacuucucuccuccucccuccuccauugauaaaaacagauuuaccucucagucuugucugccauucagugauaguaucacucacauugguaagacucgguaaguguuagaauuaaauuagucaucacgguaacccugugcauuagggaagucaagaugcuuucaaccuuacucuauacauaaagauucuagcucuggaaucugccacaaguuuugaguaaugaaguauaaacuaagaaggucccuugaauuguguagaauagaacagcacugugagcugcggguguccuggugacugcucugagcuuguaacucaggcugaucuuaaaggcacaaagagaaauaggucggccucagugccucaguguauuaaccuuguaacaagugccaggcaggaauguguucaagagcugcaggguugcacugcccuuaaauggggcugguggaauggucucuucaacaguacauaucaaggaacaaaagggaaagagagccuauagguuaagauauuuaagagacauagcaaccauauacaacauguagacuuuguuugaagccuaauuugaauggacugaccagaaaguaauuaaacaaauauauauguguguauauaaaugugcauauauaaguacauauauguuucuauaaaagaauaagaguuaaucguuuagguaugacaaugugacaaugacauuaugguuauguuuuuuuuuuuuuuucgagacaaaguguugcucuguugcccaggcuggagugcaguggcucaaucacugcucauugcagccucaacuaacuuccccaggcucaggugauccucccaucucggccucugggacuaaaggcgugugcuaucaugcccagauaauuuuuauuauuuuuuuguagagauggggucuuacuauguugcccaggcuggucucaaacuccugggcucaagcgaucuguccacuucagcuucccagaguguugggauuauaggcgugagccacugcaccuggcacaauuaugcuuuuuuuuuuuuuuuugagauggaguuuugcuguuguugcccaggcuggagugcaguggugcaaucuuggcucacugcaaccugcgccucccagguucaagugauucuccugccucagccucccaaguagcugggauuacaggcaggcaccaccacgccuggcuaauuuuguauuuuuaguacagacgggauuucaccauguuggccaggcugguuuugaaccccugaccucaggugauccaccugccucagcuucccaaagugcugggauuauaggcgugagccacuuugccuggucacaauuaugcuuuuuaaaaauaugucaucuucuaaagauuacgguuagauguuuuugagucaaaggaugaauuaguauuaaaauaaucuacuauggcgagcggugauauaaaugaaaacaaaauuaguuacgaguuggucaaagcuugguguuuggcacaugaggguuuauuacacuauuauuuucacuuugguauguuuacauuuuucuguaauaaaaagguuuuuaaaaauucucuuggcggccgggcaugguggcucaugccuguaaucccagcacuuugggaggccgaggcagguggaucacaagaucaagagaucaagacuguccuggccaagauggugaaaccccaccucuacuaaaaauacaaaaauuagcugggcgugguggugugugccuguagucccagcuacuugggaggcugaggcaggagaaucacuugaacccgggagguggagguugcagugagccgagaucacaccccugcacuccagccugggugacagagcaagacuccaucucaaaaaaaaaaaaagaaaagaaaagaaaauucucuugaccaggcacaguggcucacgcauguaauccuagcacuuugggaggccaagaggggcugaucaccugaggucaggaguucuagaccagccuggccaacaugaugaaacccuguuucuacuaaaaauacaaaaauuagccaggcgugguagugggcaccuguaaucccagcuacuugggaggcugaggcaggagaaucgcuugaaccugggaggcagagguugcagugagccaagaucgugccacugcacuacagacugggcaauacagcaagauucugucucaaaaaaagaaaauuccucuugaaguagccaaagaauucuuggcuaaaaauaaauaaauaaauaaauauccucuugaaggaacuagggagggaaguaacugaagagacauuguguuugcuguguuugacagagucugcagaaggcuacagaugugaaagaugugggaagguauuuaccuacaaauauuacagagauaagcaccucaaguacacccccuguguggacaagggcgauaggaaauuucccuguucucucugcaaacgauccuuugagaagcgggaccggcuucggauccacauucuucauguucaugagaagcaccggccucacaaggugaguauuaggaggacacaugacccaccaucacguucucucucccuucccaagcuccugaacacggggaguugccuuguaggugcuagcugcagggcugugaugccugacggacacccucucugaaggaggagaggauaguauuacggaacaggcaggcgugaauaggcacagcgaugcacauguguuaggaugcagguacccacagagggaggaacauggaggaaggaguguccacggccaccuggacacguggauuaugaaagaugcacagagguggccuugagccaaguauagaaggacaaauggggugucugauuuauacugguggcaggguuaguugggcaggaaagagucgagcuguuccagacaggagagagccuggcaugugcuccuggggaacugcgccuuguuccaaaucugugcagguguguugacagguauagguaagaaggaagugaaggcacgguccuuccaaggagcggaaggccucuacagugggccgaggauuuuguaagacagaaaaucaguaaugacauuacggagccauuccaaauaccuggaugcucugcuaggcuugcugcaaaaaaguacaauauucccuugggcuuaauuaaaaggaggacgaggcuugggcacagauguauucuugcuugacuguuggccuugucggaacuaccucaggcagcuacgaccuugagcccauuuuccuguuuugaaaacugagaauaaaaucaucauaaaauuguccuaauuucucccuuccuuccuaagcuucuggaaaagucauguuuaaucacuauauuauauacuccuauaaaauuugaauacauuuacaguuaucaugcauuuguguaauucuaaaaggauuuaaaaauaucaggacggugaagguauuucucgcuuauuagacuggcaaaagugaaaacuauccaguauucugauagugaaaaguuugagacugcauguucaucaacacaaaauugauuauauaaauuauggcuuacuggccaggcgcaguggcucacgccuguaaucucagcaccuugggaggcugaggugggcagaucaccugaggccaggaguucgagaccagccuggccaacauggcgaaaccccaucucuacuaaaaauauaaaaacauuagccgggugugguggcaggcaccuguagccccaguuacucuagagguugaggcaggagaauugcuucaaccccagaggcggagguugcagugagccgagacugugucauugcacugcagccuggguggcaggagugagacuccaucccaaaaaaaaaaaaaaaauauugucuuaucaagcaaaaaccaaauuacagaagauguauagaaugcuugcucucuuugaaauuggaggccgggagugguggcucacgccuaaucccaguacuuugggaggccgagacagguggaucacgaggucaggagaucaagaccaucguggcuaacauggugaaaccccaucucuacuaaaaauacaaaaaauuagccaggcgugguggugggcaccuguagucccaccuacucgggaggcugaggcaggagaauggcgugaaccugggaggcggagcuugcagugagccgagaucgcgccaccgcacuccagccugggugacagagcgagacuccgucucaaaaaaaaaaaaaaagaaaagaaacuggagggcugucaaccaggaggucaguagaugacaggacugaugaggaagcuggugauagugagaugauggcuuacccuucaacagacgaggugcucuuacaguacaguggaggaacaaucuuuuuuuuuuuuuuuuuuuuugagacagucucacucuguugcccaggcuagaguacaauggcaugaucucagcucacugcaaccuccaccuccuacgcucaaacaaucacccaaccucagccucccaaguagcugagcugaggcuauaagugcaugccaccaugcucagcuaauuuuuuguauuuuuuguagagaugggcauguggugcgcaccuguggucccagccacucgggaggcugagacaccagaauugcuuaaacccaggaggcagagguugcggugggccgagaucaugcuacugcacuccagccugggcaacagagcgaggcucugccucaaaaauaaauaaaaauaaauaaauaaacaaauacaaagauuugcucucuccucugccccauaagcaugccuggaaagagguugugaaagcacagaaaccuuucucagagaaaaauuguuuuuucucuuuaguuaguguaauuuccuuaaaagugaugucaaaaccaaaggccuucugcuuuaucccuggcaaacucucggugcuugcaccucucugguaguuuacuucaccugguguagaauuccugagacaguuucgagaggaguugccagggucaagaaacaauauuaauuauucacagcgugugaacaaaauauuaaccucuucaugcaaguucaacacgucucagauaaucugcuacugugcauuaccauguuggcuuacauguucaucgucaccccuccuugauuucuagcuccugguuucuagcaguguggagcacacaguagguacucuguaagucguagauaauuguugaguuaauugcacaguacuuguaguuuacucauagcucugugaggaaggcagagcagguauuuugcccaugagcaagaucgggaaacuaagauuccagauuuaaccaauguucuguagucacacagcuaccuguugagagagcaggacuaauucaggccucugccauauaccacaaaccuguucaguucccacauuccacaucugaagcaagaguucucucaggucgggugccguggcucaaggcuauaauccuagcacuuugggaggccaaggcaggaggaucuguuggaguucaagacaaggcugggcaacauagugagaccucaucucuacaaaaaaaaauuuuuuaaguuagcuggcuuaguggcacgcaccuguagucccaguuacucaggaggcugaggugggaggaucgcuugagccugggaguuccaggcugcagugaaccgugauugugccacugcaguccagucuggguaacaaauugagaucccgucucaaaaaaaaaaaaaagaaaaaaauuggaaaagaguucuucucuaaccccagguaaacgcaagguugaaauggacuuguuagaggaaggugugauuucaacuauauuuuucuuuuucaccuuaguguucuacaugugggaaauguuucucucaaucuuccagccuaaacaaacacaugcgaguccacucuggagacagaccauaccaguguguguauuguacuaagguaaauggaaccucuuacuaagggauguguccugagcucugcuugagugucuauggauaagaacuugaaacaaagccuggcuuaaugaguucuugguaaauguuagucaaauaucagcccaguccucauuuccaccccuaaauaugcucaaguuugcuaaagauggucaaauauaaccaaccuccuauugccaagcuggcauuuagaguacauguaauaaaauacauuccaaauuuauggggaccugaugaccuauuacauaguauuuaaaagcacuagcugagugugguggcucacaccuauaaucaaauuuuccaugcaucgguggcuuaugccuguagucccagcuacuugggaggcugaggcuggagaauugcuugaguccaggaaguggagguugcagugagccaagauugcaccacugcacacuccagccugggugacagagugagacacugucucaaaaaaaaaaggaggggguggggaggcgugguggcucaagcccguaaucccagcacuuugggaggcugaggugggcaggugccuggagauagggaguucgagaccauccuggccagcauggugaaaccccaucucuacuaaaaauacaaaaauuagcugggcaugguggcacguuccuguaaucccagcuacuugggaggcugaggcaggagaaucacuugaacccagaggcagagguugcagugagucaagauugugccacugcacuccagccugaguggcaaagugaaacuccgucuccaaaaaaaaaaaaaaaaaaaaaucacuauuucauaguauuuaagaacacaaacauggccaaguuucaaauccugccucuggugcuuaccuagcugugccacccugagcaaguccaugaacuccuguuaguuuccacauugauaaacuggggagaauagucuuuaccaaguuguuggauaacaucaguaaaguauauaaaacucuuguaacagugccuggcauaacauaaaaguacuacuggaauguuaacugcuauuauuacuacuuuaaucugugaaggaugcuacugauguaauuuucuauaggagcauugcagaagcggcaucuagucuauguuacacagaauacagaguuguaaaaacagagaugaaucaugugguuagagguugcuauaauagaaacaauagguugaccacgcuuuagacauauuacaccaaaauagcucuaugcuacccaaugugcaguucgcgguuaaucauauguggcuauuucaauuaguaaagacgaaguaaaguugaaaaauuccguucccuagguugcauuagccacauuuuaagugcucaauggcuccauguggccauugauuuccaagauggacagcguggguaaugaauauucccauuauugcagcaaguccuguuggaaagcacugguauagauuauguuuucagucacugagucauuuacgcuuuuuacaguaaagccguaaaaggaguagaggcuguccuacagcuacuucuaagccucucaaaaggaauaaaacauugagucuaccagauuagagcaacuaauaccuccaaagugugugucaauagaaugaaaauaaugggcauagaaaaacaccacugagcugggcgugguggcucacaccuguaaucccagcacuuugagaggccaagguggguggaucaaccugaggucaggaguuugaaaccagccuggccgacauggagaaacaccaucucuacuaaaaauagaaaaauuagcugggcaucauagugcaccuguaauuccagcuacuugggaggcugaggcacuagaaucgcuugaaccugggagguggagguugcagugagccaagauugugccacugcacuccaaccugggugauggagugagauucugucucaaaacaaacaaacaaacaaacaaauaaaacaaaccuacaaaccaucucaaaaaguuuaaauuaaaaagaagaagaagaagaagaaaaccaguaaggcacugacuuaugcaaagacacuggccgauauuagcuucuggucgauauuagcuucucuuucuguaaugagguuugucuugaaguaugauccuaggacccacaugcaucagaauugcuuguuuaaaugcaggcuccugggucucaugucagauuuauugggucacacucucuugggugggguugguaaucugcuuuuuuuuuuuuuuuuuuuuuuaaagagagggucuugcucuguuacccaggcuggagugcaguggugccaucauaacucacugcagccuugaccuucuggcucaaguuauccucccaccucagcuuuccaaauagcugggaccacagguacaugcuaccaugccuagguaauuuuuuuacuuuuuguagaggugagguauugcuauguugcccaggcuggcagucugcuuuuuuuuuuuuuuuuuuuuuuuuuuuggagacagagucucacucugucacccaggcuggaguacaguggugcaauaacggcuuacugcaaccuccgccuccuggguucaagaaauucucccaucucagccuccugagaagcugggauuaaaggugcacgauagcaugccugacuaauuuuuguauuuuuaguagagaugggguuucaccauguuggccaggcuggucucgaacuccugaccucaggugauccaccugccuuggccucccaaagugcugggauuacaggugugaaccacugcgcccagccugcaaucugcuuuuuuacaaacuggaccuccagauaaucuagccauugaagaaccacuguucuaacauccagugcuucucaaaacuagccagaaggacacaucaguggaguccuuucggauuaaggcuacugaugaugaccaggagugcucuauggccuuaaaacccaagguucguccauaaggaugagcaacagugaaauuuaccccuuaguuuaauugguuguccagcucguggaaguugacuuuuucuuguguucuguauuucuguucucugcagagguucacagccuccagcauacuccgcacacacaucaggcagcacuccggggagaagcccuucaaaugcaaguacugugguaaaucuuuugcaucccaugcugcccaugacagccauguccggcguucacacaaggaggaugauggcugcucaugcagcaucugugggaaaaucuucucagaucaagaaacauucuacucccacaugaaguuucaugaagacuacuagcccugccaggcacaaugacucacgccuguaaucccagcacuuugggaggcagagguggguggaucacucaaguccaggaguucgagaccagccugggcaacauggugaaauccugucucuaccaaaaaaauacaaaaaucagcugggggugguggcacaugccugugguuccagccacucaggaggucgagguggcaggaugguuugagcacaggagacggagguugcugugagcugagaucgccccacugcuuuucaaccugggugacagaaccagacccugucucaa
